United States Patent 9,518,277 (GENETICALLY ENGINEERED MICROBIAL STRAINS INCLUDING CHLORELLA PROTOTHECOIDES LIPID PATHWAY GENES) - sequence listing, part 12

SEQ ID NO: 41202 - DNA, 19482 bp, Chlorella protothecoides
  modified_base (1076)..(1085): a, c, t, g, unknown or other
  modified_base (2567)..(2576): a, c, t, g, unknown or other
  modified_base (2811)..(2820): a, c, t, g, unknown or other
  modified_base (3075)..(3084): a, c, t, g, unknown or other
  modified_base (4217)..(4226): a, c, t, g, unknown or other
  modified_base (5939)..(5948): a, c, t, g, unknown or other
  modified_base (6046)..(6123): a, c, t, g, unknown or other
  modified_base (6378)..(6387): a, c, t, g, unknown or other
  modified_base (6647)..(6656): a, c, t, g, unknown or other
  modified_base (7513)..(7522): a, c, t, g, unknown or other
  modified_base (7897)..(7906): a, c, t, g, unknown or other
  modified_base (8334)..(8343): a, c, t, g, unknown or other
  modified_base (8640)..(8649): a, c, t, g, unknown or other
  modified_base (9047)..(9056): a, c, t, g, unknown or other
  modified_base (10191)..(10200): a, c, t, g, unknown or other
  modified_base (11238)..(11247): a, c, t, g, unknown or other
  modified_base (11304)..(11513): a, c, t, g, unknown or other
  modified_base (12250)..(12259): a, c, t, g, unknown or other
  modified_base (13193)..(13202): a, c, t, g, unknown or other
  modified_base (13510)..(13519): a, c, t, g, unknown or other
  modified_base (14146)..(14155): a, c, t, g, unknown or other
  modified_base (15036)..(15045): a, c, t, g, unknown or other
  modified_base (15694)..(15814): a, c, t, g, unknown or other
  modified_base (15947)..(15956): a, c, t, g, unknown or other
  modified_base (16461)..(16470): a, c, t, g, unknown or other
  modified_base (18864)..(18873): a, c, t, g, unknown or other
cccccccccgccagcctgggagccggcgctggtgaatctggggcatgcgctgcgcaaggcgcggcgctgggacgaggcggcggaggcgtttgagcgcgcgctgggggcgcggcgcggtgtccctggcacccacaccgcgctggccttcacgtaccagctgcagggccgcaccggcgaggccgtggagcagtaccacattgtgaggaagaaggaggaagaaggggggaggggtgggggggaggtactttggtgcagaaagaatgtaggaggggactactgagtgagatggcaggtgctcagacattaggagggggaaaaggccgtcccaacctcctgtgtgaccatgggcactttctgcacagccagtcagtctcacacccactgcccattcctccccacaaaggcgctggggcttgcgcctgatgacacgtttgcggcagagatgctggccctggcggtcgaggaggatgtgggagccttcatggacagtctggaggcgtgacgcggggttgaggggaaaaggggggctgcgggtctctgaaggagggaagcctcttgtccagcagtggctggattccaccccgtggcagcatgtcagtcagcagcatgcagccgtcattggtgcacaatgaccttgatgtacaggatcagaccactggtcgccccttcaagactctgcatttgccaagaccgggtgggtatctggtggttgggttcgatctccccaggtggggcaggcgtggtcttttcccgcgccctgcaggcgcgccctcaaatacgattcagctgcggagttctgttgcagggcctgccctccggacggaaccatatggatatcaatccaatcgacacaatctcacgaatccgtgacgtcgctgtcaaaccccccgtaatgctgattttggtcgcacgaggtaccggggcgggtacacgcggttctaggcgccgatgacgtagggggcggcaccacgcgtccatggcccacgagttgcctcatcgaggtatggaggagtacgactccgtggaatcggacgcggcgccctctgccccggcgtggctcccccatcctgggccgnnnnnnnnnntctcatcgagttatggaggagtgcgactccgtggaatcggacgcggcgccctcagccccggcgtggctcccccatcctgggccgctgcagcaagcggtgctgcatgagcactcgagcccccaccggcaggccggggcccaagtgcccacgacaggtcgcggggatgcagtggtggacgtggagattggcagtgccgccaagaagcccgatctcacaccggggcaggggatcaaggatcagccgtgccggtaggatgagttgcccgattgtgaacatcatcaggttgggaagggcaggcatgctctgcaccctcatcggggtcgatccccttgtcagcattggctggcacatgacagctgcctgagcacccggctcgcaccattcccccatcccagcactctaggcctgaggcgccggcacgcccaccagctgcggcgccaggaccgggatcagaacggcgtgccggtgccctccacctcccggccctatagcctgtgtgccggcccctcggccatcgcccagggctgcctggggctgggcatgtacttttacaccatcaagtggctctgcgcgctggccctcctcctgtccatcgtgtacatgtaccccctggtggacaacctgggcacccagggctgggctgcaaggtacaccctccagctcggcagcggggtgaggaggcatctgagatgcatcgaagaagggggtggttatggagggtatgggggctgccttggtacactgtaaccccctcaaatagtgtcaatggatggcctgcagacagtcacaaccctcccctcccccccggtgccctcctccaggcgatgtcctactcatgcctgaagccctggcgcaccaccagcttcgtcacccgatccaccgtcggcgcatactgctccgacccgcgcttcgccagcgcctttgactgcgcggcttcctgcagtgcggacgacgcctcggccggctgccccgcggacagccctccgcagctccaggccccgccgccccccggcgcccctagccccgaggacccggcggacgcggcatgcactgcgcaccagccctgcggcgacggcggcggcgccgccgccggctgcggctgttgcacactggccgtggacgcgggcacgctgcgggcggcccacgccgtacccaccgcgcagctggccaccttcctggtcggccaggcgctgacgggggtgtggatagccgcactgctggcggccctggccagattcaagcgctccgcggcgcgccccgtcctctccgcctcccgcttctcggtcctgctgcgcggcaagcggctggaggacgggccgctggccgactgggcgcggcagtatggcccggtggcggcctgcgcggtcatccccgcggtgggaggggtcctgcgctggggccgggaggcgcaggtcctgaggtccaggtgggccgagattgtgggcctctggggggtggggcttgggggagggggggctgtgnnnnnnnnnngcgggaggcgcagggcctgaggtacaggtgggccgagattgtgggcctttggggggtggggcttgggggatggggggctgtggggagcgtcggtacgcgaaatggggtaggcaagggagcggggcacagtgtgtggagaacgtgttctgtgagatgatggcttgatgaggttcccgggagtacgactcggtgctggagagaagggtggccagtgccttgcggctgtggatgccannnnnnnnnnattctgtgagatgatggcctgatggggttcccgggagtatgactcggtgctggtgagaagagtggccagtgccttgcggctgtggatgccattgtgacacatctgttcccttgtcgaattcaggtttcccgcggcaccttcaccttgacagtggtgcctgcgcattggatatctgatcactcatcctcaactctccactcttgccctccgccgcccccaaaccccgtgtagcctagcggaatcggccgcgcagcnnnnnnnnnnaccttgtcgaattcaggttgcccgcggcaccttcaactcgacagtggtgcctgcgcattggatatctgatcactcatcctcaaccctccactcctgccctccgccgcccccaaaactcgtgtagcctagcggaatcggccgcgcagcagatcccgcccccgctcggcgccttgaaacgctggctgttccgctgcgctgcgctgggctgcgcctcccacgcgcgcctggccgcccgcctggcacgagccgagcgtcgggtggcgctgtacagccagccgcgccacgccggccggcccaccggctcggcgctcgtgactttcgagtacgcggcacacgccgacgcggccatcgcccacggcggcgccggcggggcggtgggctgggtgctcgatgccgcgcacggggtggtagggtgctgctgccgctgctgtggggccggcctcgcatccggacctgcaggcatccgcctggcggggtcacgcgtgcgcgtctcgcgcgcacccgaaccctccgacatcatctggcggcacgcggccagcgcgccacgccccggcgccctggccgcccgccgcgcactcagcctggccgccacagcactgatcgcggcggcgggcgccgccgcgcagtacggcctgtgcgtggcggccgaggcggcgcgccggcgccgcgtcgcgcgcttctacctggacccctccctggcccagggcatctccttcgacagctgggcggcctttgctgcctcggcgggggacacggtgcgcctgtccctggtgtccgccaccgcggggctggccgtcgtggtcgtcaacctgggcgtgacggccgccgtgcgccaggtgggaaggctgaggggagagggcggtggggaatggtgtctggggaatgcgccgaggttgaaatgatgatggaagggactcgcaggtagcgatgaacgactgtccgcccattcattggaagaggaggaagtgccttgaaggatcgatgccagatacgtatgtttatctttgcgtgtcagcaatctacccatcttgccccttcgactgtcttaacaatcccccaaacccacgaccacccaaaaccaaatcaccaaaacagctaacgctgcacgagcggtggccgacacactccgccannnnnnnnnngttaagtgatgatggatgggactcgcaggtggcgatgaacgactgtccgcccatttattggaagaggagacagtgcctgaaggatcaatgccagatacgtgtggttatctttgcgtgtcggcaatctacccatcttgccccttcgactgtcttaacaacccccccaaccccacgaccaccaaaaaccaaatcaccaaaacagctgacgatgcacgagcggtggccgacacactccgccacccaccgctggctggtggtgcgcctggctgccgcctactgcttcaacgcctttgcggtgccggtgctggcggcctacgcgtcgggcaaccgcgccagctggttctcgcgtggcggcctggtggagagcgccttctggacacagctggccaatgcgatcgtcctgcccctggccagcctgttcgaccccgggccgctgacgcgcgcgcacgcgctggcgcgctgggcgcgcacgcaggcggtgctggacgcgctgctggcgccgccgccttttccgctcgccgagcaggccgccaacgcggtcatggtgctggcgctggcgctgtggtgggggccggtgctgcccctgtcccccatgctgggcacgctgggcctggccacgctctactgggcagacaagtgggtggcgctgcgccgctgcgccgcgccggccaactcgcagggcgccgtggatgaggccacgggggtcatgctgcgcgcgctgcccctggtccagctggtgctcatgcgctacctctacttccaggtgagtgtttgttctttggggagtttgggggggggagtggaggtaggaggagggaggatgctgcatccatgctcaagcaggggacgtttgtcatcttgcagatggagtcaggtcagcaccacgcagaagcaatgggtggccactgcgtctcccacaggtcacccagccagggtctcccagagaaagtcttgctcacctgcctgcacctccctgtcctcgtttactcaacctgcaccaccgtttccccttcccacctccgccgcgcaggaccaccctgccatcgacgtggtgttttgggtggggctggcactgtggctggcgctgtccttggtcccgctacacaccctggtcccacgctggctggagggaaagcggtgcgcagagggggcatcggacggcgtgggccccggcggcggcgccaacagccccactgcggtcggcatgcgatacagcgccgtgctcggtgggggccagcgagggggggtggaggacacctacatccctgccatccccgcggcctgcccgccggacttcacccgcaccctgcaggccctattccggccagaggggtatggggcggcagaccaaggcctcgtccccgccccgttggcgccctcccctgggcgcccagccgggcctgtacccaacaggagtggaagggggccactgccgacgtcaggctccttcaggtcgccagggagacaggaaccgaggggtggtgccgccctgccctacactcatccggccctgcatacccacgctgaggaagccgaaggagaggaggatatgcagggcgttgggatgccttcagaggagaccaggcctccgggcagcagctccccgaatctcttgaccccccgtggctcggtgctgctgcagtcgcagagctggttgtgggagccctccaccacggcctccaccatcttcaggatgggtggggcgggacgggnnnnnnnnnngaccgaggggtggtgccgcccagccctacactcatccggccctgcgtacccacgctgaggaagccggaggagaggaggatatgcagggcgttgggatnnnnnnnnnnnnnnnnnnnnnnnnnnnnnnnnnnnnnnnnnnnnnnnnnnnnnnnnnnnnnnnnnnnnnnnnnnnnnncggctcggttctgctgcagtcacagagctggttatgggagccctccaccacggcgtccgccatcttcaggatgggtggggcgggacgggtgcactccacgccggtgacaggggtgcagccacccttcccccaccccagtcctgcaaggggccccttgggcatggctgcgtcacgcactcgacttttctctgaggacgacctgccctgatataggtaccttttcacgcaagcctcttgataaccttgtgcgcccgnnnnnnnnnntcttttcgctgagaccgacctgccctgataaaggtacccctttctcgcaagcctcttgataaccttgtgcgcccgccactcatgatccttgctactcatacaatgtttggacgcggtgtccatccatgcacatcctcttgagatgtgagattccctacttcccctgcccacgaggtacttctcctgtctcttgccatgcacacagtcactgctttccggccaaagccacacgcagagcgctcaaaagagggggaatgtgnnnnnnnnnngactcatattgtgtttggacgcggtgtcaagccatgcacctccccttgagatgtgagattccctacttcccctgcccacgagttagttctcctgtctctcgccatgtgcacagtcactgcttcccggccaaagccaaacgcagagcgctcaaaagagggggaatgtggcggggaaggaggtctccaggcgggctttggctccagcctcccagtgactccagcccagctgcttcagcagcttcacacgcgtctccagcatgcccttgtgcttggatgcaagcttgtcgtccgccagagccttgtccagcgccctgtatgccagtgctagctgtcccttgcgggcgaggcgctgggcgttcaggttggcgtgagtcccctcggcggaggtgtccacccacttctggagctcgacaaaggccgcctcaaactcatcggtctcggtctccgcgggctgaatgaggcaagtgcatggaagaggaggaatggagatcagcatgtggactccactatgtgcagacactgaagatgatgtattaggcagagcccatgacaggctgtgatcagagcagagcgatgcagggcaaggcagtgctgcagctccatgccacacggaaacagaaggccgaaagctgcagggtcacacccttgatcaccatactcaccacctcaggatacttggtgaggagagcggatgccttggatgccaaggcttgaatgatggcatccctctgcagctcaaagtctgtgcggtggtgccaaagcacacgggaagttggggcagcacggtgtctacaatgaacacactgcaacggacatccttcaaaactgcctggcaatgcaaagtatgacacatccannnnnnnnnnatgtctacaacgaacacactgcaacggatatcattcaaaattgcctggcaatgcaaagtatgacacatccaaagcatgtgctgtttgatgcgaccctctcgagaggcacaagggtgagctcgcgcttacctttcttgcggctgtctttgtctggacctgtctcaggcgacttctgtgcgagatacactgccaatttggtggtgtcaattgctgcaatcactgcatcagcagcggcaacccgatcctatcatagggatattgggagtgaagtcttgggcactaataaaagaagcacttggccctgacatgtaagggcctggcctggggcgggcagtcccacactcaccatgtgcccaaccacgctccgtaagcatnnnnnnnnnngtcgtaggaatattgggagtgaagccttgggcactgataaaagaagcacttggtcctaacatgtaagggcctggcctggggcaggcagtcccacacttaccatgtgcccaaccatgctccgtaagcatgcaccctctcctcacctcgaccaggctgtccttgtcagacctggcatccaatcgcgtgagacgctcggtgaggaggggcaggtgtcccttgttggcttcaaagactcggtcccacagacgttggtaggttgatcgctcctcctcgctcccatccttgaggtcctgtgttgttgtgagaagctaaggttgctattgggagggggagctatcaatgaagtggaatggcctgcatgttgtcacacatactccacagtcatcgtgttgaacatcccgcccaacccagcctcctttgccaaacannnnnnnnnngtgtgagaagccaaggttgctaattgggagggggagctatcaatgaattggaatggcttgcatgttgtgtcacacatactccacggtcatcatgttgaacaacccgcccaacccagcctcctttgccaaacaacaccaacagccagttgcatgccttgaggaaggccacctgggccgccagcaccgccttttccaggtcggcatccacatcagcagcgtcttttttcccattgccgttctccggcgcggtgcccttgcccttgtcaacgtcgctctttgggggcggcacgacaaagnnnnnnnnnnacatccacatcagcagcgtctttcttcccgttgccgttctccggcgcgtcgcccttgcccttgtcgacgtcgctctttgggggcggcacgacaaaggacagggccagcgtgtctgggctctccttgcccggggacgaagccagtgtacccagggacaccgagcccgacagaatgcgcccggccgtggcatccttgggcagcttgtcctcggcggggttgcccaggaagagggccacactggaccctgcatggtcgttgtgagcgggaagaggctgaaatgtgcgaggattgccgtgctgctcctgtgcatccctgaaggaaattcaggcccccgaataggcgagccaggttgcatcggacgctgcaagacagagcatgcaccaggagggtctgaaagnnnnnnnnnncatggtcgttgtgagcaggaagaggctgaaatgtgcgaggattgccttgttgctccagtgcatccctgaaggaaattcaggccaccgaacaagcgagccaggttgcatcggacgctgcacgacagagcatgcaccaggagggtctgaaagattgcatgtgaaggtagatccagatcctgcaatggaaagaggcaccttccagagagttggtaacaccacccaccatgcacgaggctgagctccttggcagctgcgccaccggtcacgcacgcggcctggctggtgtagaccggcacgcagatgctgggatccagcttcctctcagccaccaagggcaggtcctgtgactcgggtcgccatgcatggtgggagctccgggtgggggtctcaagcacggtcatacactgggcttgtgacgggagccagcccacatgcatgcagtgcatcctgttgcaggtcaactccaactacagccgccggaaaccctggaacccaccttgaatttctgcagcaggtcagcatcagtgtgccgcagcgccacgcgaatggcgaatgtccccgccccgagcttgattccctgcggcgggttgattgggcaggatgactactttcagcggcagcgttgtgaggataatccgaggagctgcccgacagccgtccgctctacccagggagcacccctcctccactccacagccctcgctgggagagtagggccgcagacagactccccctcccctgtcacagaccccttcccgccgagccccggtgcccctgcccaggcccacctcggggtagatgtcaccccagcccaggaccttcttgttggcgtcggtgaccacgtgcatctgcccgtccaggatgccatcgtacaccagcctgttcaggcgtggaaagcgcggcgtcacagtcccgccctctgccagggtcaggctgtaggttagcgtgagctggtgcgtcaggcgggagcgaggcagcgcgtcgcgcggagcggagagcggcgccagctctgcagccgtcgggcacaggggaatgcacagcgtggtcaggcttgcctgtgatgtgtgtgtggggcgatcggagaagggtatcagatgagatgactcctggaaacagggtggggaggctgcagagnnnnnnnnnntgatcggggaaggttatcaatgagatgattcctggaaacagggtggggaggctgcagagcgccatcgccacagaggtgacacacattccgtggcaggtggacttcgtttgcctgcatgcccatccctctgcagcccgacacccagcacggccagggcacccggccacacacagaaccctgccggcatgcacaacacaccttgggctggatgcgttcgggccccagaggtgcacggaccgtcagccttgcaattccggccgcgccgttcaggagcaggcccttggccggtgtggtggctgtcacgccgtggaaggttaatgacagccgcagcacacagctccccagactgagtggtgggagggtgcagtgtcaggcgcgtggggagcattgcacagggggtctttattatccaccgtgcccaccttaggccccctccctaccatcccaccctatcacccccccacacacaaacacctgttccacatttgggcaacggtgagctccagcggggttcccgcgctgacggcaaaggctgcctccaccttgccgccgtcggccagctggaccgacttggcccactcagtgtccgagaaccgcgtgtgaggggcaagctgggtggccctgagcatcagcgtctgggcgggaggggggattaaagagtggggttgaaactgcctgcatgtggcttgccgccaaatggatcctcatcaagctttcacccaggtaagctctgcgctctgcacagcaaacgcgcctgcacgcccgacaggcacagggccacgcagaacagtgaggttttcattgtcggcagcaccagcatcaccacccaccttgggcgtctccatggaagcggtgaggcgcagctccgcccaggtggccccctctgggacgtccaggaagcgcctggcctcgatccccgcggcaaacataagcgtctctgttggggagggggcagacatgagcacctaagcaccactcaaggcgaacgcaggctgtggaattcagggcgcggggcactagccacctcgggcagtgcannnnnnnnnntgccaaacggatcctcatcaagctcccacccaggtaagctctgcgctctgcacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgtctctgtcggggaggggccgacatgagcagctgagcaccactcaaggcgaacacaggctgtggaatacaggacgcggggcactagccacctcgggcagtgcagcagctgcgacttttgggtttgccgcgatggccgtacagggatatgggagggtacttcccagcccacctctcctcagatctcacacagctcctactccatcacaaacgccaggccagccaaacccaaaacaccaccatccccttcccaccgtcaaaggtgtggggccgctgcagctcagcgtggccctcgccctcgatctccacgtccgcccccggctggctaccgccggccgtcacgggcgtgggaaccgccacggtgatggggatggtgaacagagtccccgcgccggggtcgctggtgtcggtccccctgatctcggtgtggtgcagccccggctccaggctccgcgggtccacctggatctcgaagctgcgccccgtggcgtacaggagcaggtgcttggggtggctgacgaaggacgagcgctccgaagaaagctcggcgcggacctccatgtccagcctcgctgccacctcctcgggcttgaaccagggcttgaccgtcaccctgcatggttgggggttggggtgggattgaggggaccggggagcgggggcctggctgctgggtcgtggtgtggttccaccgtgcgcctgaatctcccctcgcaacccctcccgctcccgctnnnnnnnnnnggggtgggattgatgggaccgggaagcgggggctgggtgcggggtcgtggtgtgattccaccgtgcgcctgagtctcccctcgcaacccctcccgctcccgcttactggtgggtggaggtcaccgccgtctcctgccccgtccgcaggaagacgccacgctttccaccccccgccgccgcgcccgcgtcggtgcgctgcagcgtgacctcccagggctgcgaggccgccgggctgcagggtgcgaggaggaaagcgtgggcgtcggccacctggatgaggcccgcgccctggctcagcacgctgtcggcgtcccagctcgtccgcaggcaggtggcctccagcccgcggcgcaggcgggctgggctgggccgcacgccctgcgccttgaggccagacaggaccagcgcgatggcgcccgccgcgcagggcgaggccatgctggtcccgttcatgagctggcggcgctggcgcgtccagcgcgggacaggggccacggcgccgccgggggcgcacagcgcgacgcccacgtcgccgtcgggcgcggggccgcggctggaccagttgtactgctggccgtcccgcagcggctcgcgcagcgcgtgccccgcggcggccatctctggcgcgacccaggcgcccacgcccaggatcgcggagctcgtgccccccggggcgcccaccgtgcacagggcggggccgctgttgccagcgctggagacaaagaccacgccgtgttcgtgcaccacctcctccgccagctcgatgaagcggccttgggagggaggggggtgcggagggtggggtaagatattgatcatgacccgctggcgcgggagctccgagcttgagtggtgaacgcaggacacggcaggcgctggcccgcactgctccgctcaggcggaatgcggctggggcggacatgatacccagaannnnnnnnnncaagatattgatcgtgacccgctggcacgggagctccgagcttgagcggtgaacgcaggacacagcaggcgctggcccgcactggtccactcaggcgggatgcggctggggcggacatgatacccagaagacaagactcgtggttgcccccggcaggcactgcactcacgggcttcatgatgagtgcgggctaccctgcacctctgggtcactgctgaaccgtcggatatctacaatccagccctactttccccttcagaacctcaactccaccccctccaaaagccccaccgctgttgggcgtggcnnnnnnnnnncacaatccagccctactttcccctccagaacctcgactccaccccatccaaaagccccaccgctgttgggcgtggccgtgctctccccatagctcatgttgatgatgtcggccttgtgctgaatgacggcggccagggccctgtacagccccggcgccgtctccatggaccccagccgcgtgtcgccgatcttgcaggagatgagttgcgcgccgggggccacgccggagaggtggggcgctgccgcatcgtaggcggcggtgatgccggccacgtgtgtgccgtggctcccggcatccaccacgatggacaggatgttgccgccgtcgtagatgttgacggcaaagttgcatgcgtcggacggcgagaatgccgtgtactgcgcaggccggagcagcagaggcgaatgtcaatggaagaggggttggcgtacgatcggtgagggagagccttgctgcaaacaaattcacagttggggtgccatacagaagggagggggtgcaggtttctgcactccatttaccagatctgcacaaacgcccctccttcgagcctgcaccctgagcaggcctggcaggcaggaccccctcccccctgctctcctcagctgcagcagacctggcgccnnnnnnnnnntaaatctacagtcggggtgcaatacagaagggagggagtgcaggtttctgcactccattcaccagatctgcacaattgcccctccttcaagcctgcaccctgagcaggccaggcaggcaggcccacctccccccagctctcctcagctgcagcagacctggcgcctggctttaaagtcggtcatgggcttgaagtcggccagagcgccgcgggcggggccacgcagctccgtcagatccagcgcagcccaccagaccgagctggcatcctgccagaccacggcatccagcaccgggccctggtcctcgaccttttcggcaaactcggagagcagcgccacgcgtgcctccagctcctccctttcctctttggtgaccttgggagtcccctgagtcgacagctgcagcatgggcggacgtaggagggcttgaggggtaagaagggcagtacaggagcgttgagcacagtgcgtggcatggaagtgcattgtggtctgacagagagcattggcctggtgtgggtcaggtcctctagcacagggcacaggacaaggaatcagtgtgcaggatggactcaggagtgatcatcaccgagcaggagccttggtgagcaacgacatgtcttggaaatagacagactctcatacgacaccacaacggggacaaccctctcctttagtcaaacatcaaacattcctcgcaggacacaggcaaaagcccaacacaccttggcaacctccgcggtggccttggcgagcagatccctctgctcctgcatccacacccgccgcctgtcggcccggatggagtctgcaaggcccttggggacaagatcaaagaggcgcttgctgcccacgtgccacttcccgctggggttgtccnnnnnnnnnncggcatggaagtgcattgtggtctgacagcaagtattggcctggtttgggtcaggtgatctagtaacgggcacaggacaaggaatcggtgtgcaggatggacccaggagcaagcaccactgagcaggaaccttggtgaccaacgacatgtcttggaaatggacagactcgcatacgacaccacaacagggacaaccctctccttcagtcaaacatcaaacattccttgcaggacacaggcaacaccccagcacaccttggcaacctccgcggtggctttggccagcagatccctctgctcctgcatccacacccgccgcctgtcggcccggatggagtctgccaggcccttagggaccagatcaaagaggcgcttgctacccacgtgccacttcccgctggggttgtcccaggcggggttgaggcgcagcgcgctgcctcgcaccccctggatggtgtagtctgctgccactgtgaccacggtggaggtgtccacgtccccactcccagtgcagtccaggacgtcgatgatcttgggcctgccgttgggcgtggtctgcagcgcagcagcgccggggtcgatcccagtgtccagaatcgcgacgacgatgccgcggccatcgaactcagggtgctcctgcgtgagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccatgggttggcactgcatgcagagagcctcactccacgacctcacatccctcaaagacaaaatcctaagcttcaaaccttgaggaaggcatctgcttagatgtccttcttcggcatggccccggcgaannnnnnnnnncaccatgggctggcactgcatgcagagagcctcacgccacgacctcacatccctcaaagacgaaacccctgagcttcaaaccttgaggaaggcatctgcttggatgtccttcttcggcatggccccggcgaagggatcgggggggccttccctctcctcctccaataactgatctcccagggtgatctcattcatatcagacacgacgacagcagcttgacgcccagtatctgaatccatgttactggttctttgtccttgaactgacgaggctgcccgtgcagggagctgcgagcaggccctgccacccaccgtgcgaccgacgctgggccgggagggcacacacctatgagcctgttgaacagcgaaccttgatgtcatacgaaccaggaatgtgtttgtgagggtcctcacgccttctgattccaagttcctcgtcccgtcccgtcgaggtggtacacctcatgttcatgggccgggtgaaatgcatgcgacgctccgggcnnnnnnnnnntaagttcctcgccccgtcccgtcgaggtggtgcacctcatgttcatgagccgggtgaaatgcatgcgacgctccgggcgcgctccgacaccgatgcaactcactgcgaaccccgacctagccgcggatcgacggaaccccagcttacagtatgctcaaaaacaggttgccaattacgagcacaccccctcatcgacctcagtacgcttctgggtgctgacggtctgagatggaggaggcctccggccccgcggccccggcagtccccgagccaatcaggttcagccccaagaaggatggcctgcccaagaccttcacctacaccttggagaaacgtgtgtccgggatcgtggtggatgggcgcgatgaggctgccatgcccagcccccgttgcgggagcatgccgcccctggtggacccagaggactttggggctccggtgcgcggggtagagggggaccatgcgcgctgatgggttggtcagaggttgcatttcgatcaagctcagctgaaggaattgcacacatcggcagggactgtcctttagggtcttcatgaaagtccctggcagctgcgggaggagcaccctcatggctcgcaccctctcaccccatcacacagcccggccagctgattcccatcaaccgcagcaccccacccagccccgcggatgtgtaccgatgcgcggggtgtgtcaaggcagagtgccaggggccgacggggtgcaccgacttccagtggcgggaccagtcgggcgggtacctgcgtgagatcctgaccagccgggtgtacagcgtggcccgcgagacgcccttggagcgcgcccccggcatcagcgatgccatcggctgcaacctgtacctcaaacgggaggacatgcagccggtgcactccttcaagatcaggggcgccttcaatcggatggcgcgcctcacccccgaacagctgaagcggggcgtcatctgctcctcggccggcaaccacgcccagggcgtcgccatgtctgcagcccacctcgtgcgttgagctggatggggggttgggtggtgtattgtggtgggttggcatggaggcaaacacggcatgcgtctttagggtttcagagtgtgggcccggcatgactacaaacagaggatggtgcagggcgtggggcacctgggttcagcacactgaaagctgccatcgctctggctggaaggagggcctcttcaagtattttggcaccggagcctcggtagatgccagtgcgcatcatgcagttcactttgaccccacccccttcctcccattcccagggctgctctgccgtgatctgcatgcccaccaactctccggagatcaagtaccaggccgtggagaggctgggtggcaccgtggagctcgtgggtgagtccttttacgagacggcggcgcacgccgtggcccgtggcatcgccgagggccgcaccttcatcaacgcctacgacgacccctactgcatcgccggccagggcaccgcgggtgcggagatccttaggcagggtgacattgacaagatggactacatcttcgtcgcggtggggggtgggggcctcattgccggcatcgccgcggtggtcaaggcgctgaagcccagcattaagatcatcggcgtggagccgacaggtgccagtggtcagagggagagtagggtttattgtgcatcattgtcttagaggggtctggggtggactctagggacaagccaacaggcagagagcctctgagccaccagacattgctccaagctctcgctccgacggcgttcccacggtcaccttgaaccccatacccctgcgtgccaggggccaacagcatgacccagtccctcgtgcggggggagcgggtgacgctgagcaaggtggacgcgtttgccgacggtgagagcgtagatgtgaccgtcgggcgtttggaatgtgggtgtgctggaggcctgcagcatgtcgccgccagtcgagcgtcgccgggggcacatcagtctggggcaacaggggctggaggtcgcagcagggcctcctgcctgctgacgctctcaccgacatccccattccacccttttctccccaggtgtggccatcaagctggtgggcgccgaggccttccgcctgtgccgcgagctgctggacggcatgctgctggtggacaacgcggccatctccgcggccataaaggcatgtgctgcgtcgggtgctggacctctggcttgcagcaagccttgctcgctgttcgtaccggccctgctgccccttcccacgtcgcacccaccatgcatgcgagccatacaggctcagactgcacggggcaaacctagaccaaaccgcccctctcccacctcccctccacccccgcaggaggtgttcaacgagacgcggtccannnnnnnnnntgttgcacccaccatgcatgcgaggcatacaggctcagactgcgcggggcaaacccagaccaaaccgcccctcccctccaccctcgcaggaggtgttcaacgagacgcggtccatcctggaaccggcgggcgcggtggcggtggcgggcgcgctggccttcgcctcgaggtatcgcctgcgcggcaagaccctagtggcggtgacctccggggccaacatgaactttgaccgccttcggatcgtgtccgagctggccaatgtgggcagcgccgagacgatgctggccaccgcgctgcccgacgagcccggcagcctgctgcgcctgatggacatcctgtccggcaactcgggcccgctgaacatcaccgagttcaagtaccgctacaacatgcactccgacggcctggcacgcatgctgttcagcgtgggggaggccccggggtcgaaggagagcagggcgctgatggcgcgcgcgcaggcagcgggcatccgcgtgcaggacgtttcggacgtggagctggcacagacccacctgcgccacatgatcgcggggttgggcgggaacgtacccaccgaggagattttccaggcatgtgggaggggggggg

SEQ ID NO: 41203 - DNA, 94 bp, Chlorella protothecoides
ccatccaccaagatcttccatcggtagcttgaacctagcaatttttgagcagtgcgcgagtcgatgaggagcgtcagcgatctacggcagttgc

SEQ ID NO: 41204 - DNA, 15579 bp, Chlorella protothecoides
  modified_base (6578)..(6674): a, c, t, g, unknown or other
  modified_base (6818)..(6827): a, c, t, g, unknown or other
  modified_base (6943)..(6952): a, c, t, g, unknown or other
  modified_base (7068)..(7175): a, c, t, g, unknown or other
  modified_base (8244)..(8253): a, c, t, g, unknown or other
  modified_base (8718)..(8727): a, c, t, g, unknown or other
  modified_base (9725)..(9734): a, c, t, g, unknown or other
  modified_base (11244)..(11253): a, c, t, g, unknown or other
  modified_base (12371)..(12380): a, c, t, g, unknown or other
  modified_base (15079)..(15088): a, c, t, g, unknown or other
ccggctcgcaagcgcggcggctggggggggcggagctgcgcggcctgcacgacgccgcgcgcgcccctctcctctgcctcctcctggcgctgctgggggcgctgcggcccgagctacaggccgagggtctggccccgcgcatgctgcgcatgctgaccgccgggctgtggcgcgtgcccgggtcctcgccagaccgcccccgcctgcaggccgaggtctgcgccgggctcttgaccctggcgcgcgagctggtggccggcggcggcgaggacgccggggtccaggcctggctggcggaggcccgttcccggcagggcttggggcactgggtcctcggctgcctgacggatgcggcggcggcgcaggagggcggcggcggtgcgggggggtcaccctcgctggaagcgatcctgggcggcgagctgcgggcgcggtgcgaggcggacgtgccgcacggtgtccgtgcggcagaggagatattgattgcagggtcgggcctgacggcgctgcgccccggcatgtcggccgatgcggtggcggcgctgagccctgtggccgcggcagcgtgcctgggcgccccgggccttgcctccgctctggagcgtgccgtggatgggggcgcaggtgtcgaccgggccgagctcctgctggccttgctgggggccatcggagcggatgcgagaggcgcgctgcccgaagccgaacctgccaccctgcaggccaggctgctggagcacctggcgccagccaacagcccgctggtgacgctcctccttgacacgctgggcctgctgggcggtgggggtcgtgcgaccacgctggccagctccgccccgccgctcttgcccaggtatggatggaggggtgtgtctctgtggggggggtgggggggggaaggcctcgagtgggggcacagcagcgaggcccctgccgcgctcatgccccctcacatcgcccaccatcccacactccctcacccttccctgccagcctgctgcgggcgctgcgctcgcgtcccccgccctcggccgtcggcctggccctgctctgcctgcagcgcggcgaggggcagggcgcggggctgctggacgcgctgcaggccgacctcgtggacgcccggggtcaaacggggcgcggccaggtgctggccgccctgctctgcctgtcccgcaccggcgcgccgcgccagcgcgccttcgccgaggcgctgctgtccgggctggaaagggcggcgggcgagggccggggcgcggacgtgctgacgggccgcgtcgggcccatgctggaagcgctgctgcccctgctgccgctggtttaccaggaccgcgcgccagaggctgcgaggaacctgcgcgcccgcgctctgcgcgcctgctgcaccctggcccccgcgctagccgccgtcccggggtcaaatgcgcgggggctgggccggcgcacgatggcggtcgcgcaggcgctgctcatgggcggctgggcgccctggctgcgaggcgacggtgaggccctgatgtcgggaggaggtctggtagttccctggttgtgtgcccatgcagactgatacaggcgtctccaagttccatcctctgatctgggaccagtgtgccgcatttgcaccgaagacctcgatcccgccaatcacctcacccacctgtccaaattgcccccggcagccgagaggaagctgcgggacgtccagccatacgaaggcagccgggccctggcggcagacctgcaggccaggaacatgcccaagcgcctgagggcctgcctcctggccatgctgcccatgcccccgcccagcgcaggcctcatggagctgccgggttcagaaaacggggcccctctgcttgtcgacccctggacactgatcgattccgggtggaaagcagggccacggacagcagcgctggaaccctggagcgcggcggaggcgccgccgccagccccgaacccgcctgcctggctggaagggtgcatccgcagggagcgcggcgtaagagagttgcaatgagagcccccacccaggccatgtacccagccattgccagagaggaaaggttctgtgcgccacgcacgcacagaaagaatctttgagttccctgcagcggtgtctaaaccctcccgtgcccccctgaaatacaaacactctcttacccaacccacttcctcatttgactgcattcgattttcagcgaccagtagtagcctcctgcaccctgccagacctgaacccctatatatgtttgaagaaaacatgattacatgtcaaggggcgcaccgacagctcagagacaagggcgcgggcatgggtacaggcctgcgcatcgccttcagcggaagtatggggagacgtggatgtttagggccgccgcacggcgccgaaactccctgtcttctgacgccgtgggcaggcggcggggccgagggggcaggccaacatgccggccccggggcggggccagcagggggctgaactcaaaggcggaagtgcatgccgaggcgggggtgggcggctggagggtccccgccgcctgtgcgggtgtgacgggtgatgcctgcgtgcgtcggacgccgaccgcctgcaccccctcctcatcgctgctgctggaggagtggtcgggtgggagggcctgcactcggggcctgagagctgccttcgcacctgggctcgcctcggggcccgcgcctctgcccatgccggcgcggatgccttggctcgaggcctcgcccgcgtgaaagtcctcgcccgcaccggcgccggcatccagcgccgtgccgggcgtggccggcctccagctcgcgctgctgcgcgcgctgtgctctggtgtggagcccggctggaaactgacgccgcgccacgcaccccgcgccccgctggggtttgtggtggggggaggaggggcgtgctgtgtcgggtcgctgggtgcggcaactggatcggaggctgccgtggacgcggccggggacggcgggtgctgtcgctggacctctcgcacaggctggctgacatttgtatcgctcgcgtccggcgcgaaagagggcgccggcagtggggaggggaccgggcggggcggacgctggacggacgcttggctgccggcggtggaaggcgtgaagtccatggcagacaggccctgcaggcgcatcgagagtgtgtggtgaggggtgaacaagggatcctgcagcatcaaggtgctgtcccggccgcacacgggtgccgtagtgttgcatgcgagaagtgaccccatgaggtcacacatccctcgccagacaccccattccacacacctggtccacggtggccagcttcgactgagctgccttgaggtcggccttgagccgggcgagacggccccgcaccgcatcctgcacatctgcggcggctgcggggcgagagagagtggagctgattgggtttgggtgtgggtgtcatgctgtaggttgcagccagcggcttgcctagctagtgtgcgcatgcccttgtgatccgcaggccaggccagtttatcacagccaacccatgacagggcagggaccctcgtccatcccagggccgagcatgcgctgccaatgagccccatgaacactcacgctttgccgcgagcgagctgacgctgaacgccgacgcaggcgtggcgatgcgcccgcgcggcgccgtgcccggggtgtacaaagacacaggggcgggagtggccacgacgtctggtgagccagaagcataggcgccatcgatgattccacagacaagctggagcgcggggggtccaagctgcgtaggatccatgtcaacaggccctgccgccagcccctctactgcctcctcgtcgctggaggtgacagaggccatgctccccgccccagagccgcccatggtggtcgactggctatgaatgaccgccgcgccgtcgccaacgaaaggaccactgtcagccatcgcaccgtcggatggcacggagcgatgcgggagctggtcggcggaccagctgcccgcttcggaccccgcaccgcccggcgcctcgaccgcgactggcctcacaggcgacacgtccaggctggctggtggcggcgtggccgcgccgcgcgcccaggctaaggatgccgaggaggcaatggacgctggggacgcgtccagcacccccgagggggtcaacagcgccgccgtcgggcccgggagttcggtggcgtgggtctggaccgtgggaagcggcgtcgaggtcgtcaccgctccaagggtgatggattcggcgggttggtcacctggccggagggcagcgctcccctgctcgtcagtaacaggccccatgccgcccggcctggcgaggaagttgaggggcgtggggcggtggggtgaggcgccgggactgtgcgcatccgccgcagaaaagcccggaggtgtggccagctcctgtggcccgtcccagccgagcgtgccgtcggtcgcagctcccgcttgctccaccccatcaaagtcgtgctggggagtggcgccaatggcagcctccgaaaggacgccgtccagccccttcaggtctgcatccggccgtgcctcccatgctcctccctccaagggctgcacgccctctgcgtctgcctgagatgcggcaaaaggcggcacattctcggaagacggggtgtcgggcctgccatgggcctcccctgccagggcgtgcctgacacctgctgcgccttcttcctcccgccctgccagggcctcgtagtagcggaccatctcccggacctgagagggtgtggactgagtgttgagtgctgggaggacacattgtgacccagggttttgtaaatctccccaaacatgctgtcaatcctcgggacacaacactgcattccaccagcagcagcagggcagggttttctcagtccgaaacccacccctgagactcgtgaggccgggacgtttgtgacgacaaaggccccgtggaagaccgtgcactggtcctcgtcgacggaggcggcggcctcggtctgcgagtccgcatccagagtgctggcagcagtaggtgccgctgccacggctccctccttttccgccgactgggctaaagctgcacctgggctcaactcgccagagggtccaagggaggactgcgggctgccagggctcgggctgcgccgacagacggcgtcgacatcctctgccaccgccagcaactctgggttgtcgcttgtcgcgccctctacagtgccctggattgagaagggcgtgcgcccctcctccatggcctgcagcctggaggtcacctgcaggggcgtggtaccatgaggtttcagagctcaaggggccgggccgcagcacatgcaaggcgagtgtcctcttcccccttcccccccatcgcccccactcctcagctcatcgcacctcgggcgacgcgccggccaagtggccacacagcgtgctgtagtccacggtgatggtcgtggcggtggagggcgtgccggcaaacggtgtgtagaacacctccttcagtgctgtctccggctcccgagccgcaatatgagtatgaggcgtgacctgctggtccgggccctcgccctcctctctgtccccaagggacagctgacgcgccagtgcggcactctgtgctccgtcaatgtactgcgtgggtccgaaacgggtgccccttgcgcgaacgacgctcccgcctccccccgccggggtctggtgcgccctgccctccgccaggctggcgcgggcctcctgcagcgtgcgggccagccttgcctgccgggccacggccgggctggcaggcactccccgcagcatggcgcggacccccgccagctcggcggccgagctttccagcagctgcgggagggttgcgggtggggagtcagggtgcatggacgtgtgtcgagcacggatgggtacgaagattgccaaagtaggcaggctgctgccccgcgcgacacgctttcctgttcataccccccgcccctcatcccagctcgcctgcttgatcctgggggttgcggggatggcccccgcagcgtgcccagcgtgcagcccctccagcctggcgtgcagctcgtgcagggtggcatgcaggtcctctggcgcctcggcgccgggggcccctggcccctgaccctggtgccgggaggcaacggtggccgtcgccgcgaccttggccgccgccacggccgccgcctcggcgcccgccagcgcggccctgtggttggggaattggaggggaaccgggacgaccttggacgagacagagtgatgctggcacggcactgcaccacctccaaccgcgcagtttcaagcacgtcccttgcagctgcgccctggtcgcccaagcccatcgaggccccccctcccccgcccctctcaagctcgcacctggtggtgtccagctcagcgtgcagcgccgccagccgggcctggtcatgctccgcacgctgcgcctggagctgggccaggagctgggcccgctccgcctcgcagctcacgaacagctcctggatgcgggccgccaggaccaccatgtgctgcgcggctgcctgcgcggccgccagctcctcctccgcagcactgcgcgcggttgcaggggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgggtcggcgcgcctcaactcatgtcaagtcaaccagtgccaggggtgtccacctccctcctacacccccggccttcatcccttggctccatctccctgtcgaagaccctctcttcacccccaaacagactcaaaagtacnnnnnnnnnntaggagtgatgggctttcggacggtcgtagatgtgggatcgccaccgacatgcgagggagtgcacggcagtgtcatgcacggattgtatgcctggatgtattcggtggatgccagnnnnnnnnnngaggagtgatgggctttcggacgattgtagatgtgggatcgccgccgacatgcgagggagtgcacagcagtgtcctgcacggatcgtatgcctggatgtattcggtggatgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccttcatccctgggctccatctccctgttgaagaccccctcttcacccccaaacagactcaaaagtaccggacccccagggaaatcctcctcacatgcgctccgcgcgctccgcctcgctctccaggcccagcgcgcccagcgcggcgcgcacgccctccaactcggcgctcagctgcgcattgcgcgcctccacctcctgcacctgccccgcggcggcccacagccgccgcagctccccgcgcgcgggcgtgcccagcgcgtcccccagcccacgccgcgccaaccaccggctcacgctgccttgacccaggacgggggtggtggggacgaggtgtgccccctcctgcgccggggtggcctggacggcctctgccgccgcctgggccccgcgtgccgtggaatccccgtgccccgccgccgccgccctcgcctcgccgcccacggagatgaggggcatgggggtgaggtggggcggggagcgggggctgcccagcgcaccggcctccagcggcccctgcccggggacgctgcccgcggcgccctcgccgtacgccggggactcgtaggccgggccgcgcaggtgcgccagcatggcgcggaaggggtttgtccccggggtggggcccacgcaggacagcgcgggcccggtcacgctgccggacggcgcgaggagggacccggcgctgccggcgggcacggcttgcgtggcctgggcgaagcggggggcgggggtgggcaagacggccgcgccgtcgccggcggcgaccatcgccccgccaaaggagaaggtcggcggggagacggcgccgtggcctgaggggcgcgaggggggtgggcggattcagaggagggtgcaggcacggggaggcagtcccctccgtactccagctgctcacaaccaacccatgcatcagagggagatttgctggcccatcgatcggtggatcgatgcgcagcagcgccacccgccagcaccccaagcatgacgtgcctgctcggggtgaggcaccatgttccttgtcggcctgcgcagcgccctctgatgccagggaccggaaggtgagnnnnnnnnnntatgggccgaggcaccatgttccttgtcggtctgcgcaatgccctctgatgccagggaccggaaggtgagtggcagctgggtctcggcgcctggcccactccccatcgcctcggcaaccccctcaggcagcgctagctgcgtcagtcctggcaggcgctgcttgaggagcagcgaggtgctcccaacggaggaatgctctgcgtttgcgacctctttggcttcctcgtccaggggtgactctcccatcgcacccgttggagccctgaactggtcggattccccgctggaggtcggcacgcgcaggggaaagggcttgtcccccgacggccccgaggaggcctcttgatccttgtctggcacctcgccaacatgacttctagccagcagcgtgccatcctccgcccagaactcctcttgtctagccttgggggccccaggcctgccggagttgggacgctcctgcnnnnnnnnnnttcctccgcccagaactccgctcgtctagccttggggggtccaggcctgccggagttgggacgctcctgcgccacgctcggggccaggatcgcgccgtccctccccgcacccggctcaggcgagagcatctggggacccgtgcgcaggtaagtgttcaccagtcgccccatgcctgcacagcagtgcggtgtggggaattcgatattgagtcgaggattccagccggcgtgtgagtggcttcacacagatcctcctgtgcatgcgctcacaggcgtgcctgtcctcccccagcacagacctaccctctgcggcttgaccgccacggtgaatgtggcctaggatgctgcgggcctcaggcgtcggcaggagaccagagccccccgcgcgaccctggcgcggggctaggggcgtctcgcactccggcgctgctgcgtccacccgggacgccgtcctctgggcgagggggctgacggaggacagccactcgctgacgtggctcgagccaggagcatcctccgcgaggaagcccggggtcaaaccctcgctgtgctctgctcgcagatcgtagtgcggcgagtcgaagctggggttgtcgtacagagcgaagctgggggcaggtgtgtgctggggctgggaggccgtggggtggggcttggaggggccagcggccacactgtaggcggtgcctggagccctgggctgggactggggcgggggagtgggcttgggaatgcgggtctgcgcgacggccgaacctgcccccccgccgggctgggacccccgggaggccggcttgctccgccgtgttccatggcccgcaggagcagctgcgaagttggagtggatgaccccgaggggggtgcgggcttcgcgctgagggtccgccatgcttcctgaggttcgggttggagatttgagaggtcatcatcgagccttgtatgtatccgggagcattcttcgaggatatatgctgccgggatcctcgtgcgacgcaccnnnnnnnnnncttcgggttggaaatttgagaggttatcaacgagccttatctgtatctgggagcattcttctaggatttatgctgccgggatcctcgtgcgacgcaccgtgtggaggagcaacgctaccctcaagagtcctttcccatcgctcgcggactgggtcgagcgtaggagcgcgtctgggaataaattgcaaccgttccgctaatggtttgtcgctcggtattttgccccggaagcatgcgagctggcaccgcctcaccggttgttttgaaaccggtctgttgtttgcaatccaaacatcgaccgcgcgcgcgcccaggcccctggtccttcctcgagaccctcgccttgggctctaaccccaaacgcttcgcatcatcggacaatgattagacgatttgaaaaacgtattctatatatacgaatccaggatgcagaccgtcgccgtgtctctgctgtgtcggaggtctgtggtcgcagcaacgcagtccctctccctgggaccagcgcccagtctggcgcacttcctccatagatacagcacagagacgaatgtgccatctacctccagcagcgacgtgtacgtttacacatcgccgtacggccccacggttcggaatgtgaaggtatgcatggctgagttgttgagcaggtcttggggccggggacctcgggcattcgaggtggaggactacacgcgggaccctggcacccagggtcccatcttgaggtgatggaccaccttcctggttgacattccttcctcaccacacccccatcacccctcaccctgactccccatgtcgctccgcagaggctgagccttttcagctgcgcctgcgccctgggggccggtcccatcatcctcggcctggacagcggcatgaccctggcagccaagggaagcatcgccgccacgctgggcagctttggcgccttcaccaccggcctcttgcactggttcgtgtccccctacgtccagcggctggaggttgaccgtcgtaccggcggcgtgcgcgccgagacgctgacgctgtggggtacggaccggtgccatgccttccacctcagcgacgtgagcgccgtgtcgggggggcacccgctcacctccttccaggccctgggcaagacgttctacgtcgacccgtcccactttggcgacaaggagctgctggcgcgcctcgcgccggaggccgccgccgtggccaccggggcggcggccaaggaggagatcgagcacgtcaatgggatgcgatgaggcggcctatcccaacgacttgggacgatggagctgctgtggaggttgccttcttgaggtctcatcgatgccaagctggtgcatggaagatgactgacccatctgttcgtcatgcccggcctgcactgtgcactcgttggtctttcctcctgcaacacagaactccacggtcaacccatcttccttgcattcccgtcctcttcctgtgcaaggacccccccacacacacatttcctctccaccatctgtcatgctgnnnnnnnnnnagtcaacccatcttccttacactcccgtcttcttcctgtgcaaggacacccccccccccacatttcctctccaccatctgtcatgctggcagagtgtacagaacggcgagccagattgtcagctcagcgtcagcagggggtcgtcagcgagtgggcgctcccgaatgagccaagcttgaataggattcctcagcacaggtgtaagtcaaggtcagggaaacaacatgctgcgccagggatggaagggagttggggcggccgggcggtggtcgtgcccacaagtgcctgatgtcgcgcgccttaggaattgttatccctttggcccccgtgccgcgccgcatccgtgcagccttgattggcattcgcggagaggcagacccaggacgaccctgctctgtcgccagtccgccccaccccccttcaccctctcctcctcacgctcccaactcctcctcacgccttggcgcgccccgccttcctctgcttagcgtcctggcgctgcagcgtctccagcaactccttggccacttgcgcggcggccaggtcggccgacccgccgcgcagggccgccaggtctcgccggaagcggcagtcgctgggcaggggggccgcctctggcgcccactcccctcgctcctcctctgccagcacccaggcccgctccccatcccagtccaggtgggacagccagttgccgcggcaggcggacagcggcacggcgcccctggggtacccccaggcctccagcgcgtccccgcccttgctgctgccgctgagggacagcgagcgcaacgccttgcccgtcagtcccgacccggcgtcggccttggggcgcggcagggcggccgtgtccaggggcggggcgcccgaccagccgtccggcgtgcggcaaacgatgccgcagagcgtgtcgctgcgctggagcgcggcctccccgcccgccgactcggcggtgaggggaccgaagcgcagggccagcaccagcccgttggccgcgtcctcgaaccgcgcggtgccagagatctcggcgcggggcacgcccgtgcccaggatgcctgttttggtgtgggtatgggattgtgggggtttgggagatgggagcgctgaagggcaagctnnnnnnnnnnggagatctcggcgcggggcacccccgtgcccaggatgcctggttcggtgtgggtatggggttgtggggggttgggagatgggagcgctgaagggcaagctcaggtgggagaacggcaagggtaacagtcagctccgcaccacgagcgcacggaaaggggtgggcttgcccccaggtggaagcgcatggcactggacacctggggtccgggcacgcgaagcaacgacgagccgttgccttccctcagacactgccctgcgcaggcccttgtgactcaaacacactggcacatcaagccctcacacagcctgcaccagagcattcaaccaaatgcgatgcccccgcaacccttttcctccacacccccccacacccttgaggtcgtagaccggatagtcgacggtgacagccccgccgtcagcgaagcgcatgacccgtgcgcccttgctgcaggtggacacggcggaggtgcgataggtgacggtcggctcgctgacgccgttgtacacataccgggccccgggtccgaacagctggtaggcggagatggggggatggtgtgaggtctgctccaggaagatgtgggagccgtccggcagcgaggcctgccacgtctcgcccaggatggggttgaagggcttgcgccaggtggcgaagacgaggtggaaccccgcgacaaagtaggtggccacccacttgaggcgctgcagggggtcgggcgcgtccgccgcagcgtccaggaagcgggggaacacccaggggtcggccagtttctccaggtaggaccgcggctcgaagatgcgcaccgggagcgacaccttgagcaggtccaggttgcccatcagcagattcttgcccagacccttcaccacctccatgatggcgctgcgcaagggggggaagggggtgcttgtggtgctgtgggtggggcagagtgatgccctgggtggatgagggatcctccctgcgattaggcccccgcctggtccctggtggcccttgccaggtcccatccccgggttcgtgccagttagggattcccgcctcgtgccagccgaaacccacccgcgttgctgcttcatgagttccgcattattgcaggcataccctccgtccgagtgggcgtcggggtgcaaatgcacctcctgcggggacagatcggggtggaatcggaccgggagggggtgcccgggaagcgcaaaatgcggatgcctgcacgcctgcccgctcaccccgttgaggggctcgaagaacacgtcctcatccgatgtggtgtcatgcggggcgctgggcctggaaatctcgggcgaagagtcggacatcgggggtttagggattcgggggaccaatttcgacatcgtcagcgtccttggtcctgaggggactgggactctcagcctccactctctactgttcccgcatccttggatgcagttccggggccagtaaatatatttgttcggtcggtacgctccgaacgatttgacacatctctgacagcccgttcatcatctcgtggggttcaggggcacctcgcgcgccgcacgggcagatcacagatccatgccgaaccaggcctggcccttcctaaggtccgtgctgctcctacggaaccggtgtccagcagcttcgatccatacacaagggagtggagaggaatgagccacacctgcacgcgcgtcgccacccttggagtctggaggaatctgtggtagtgtccgtcgctcccccacattcattccaccatgagggcggcactggccgtgttctcctccggcaatgccccgtgcactcccttgggtacatcaggttttcccatcgtggccagtctgaggagagccttcgcatctgtgaacacccgcgcacatggtacgtggacctcacacctctctcgatccgcatgaaggtcgcatgcatgcgagggatcagcgatccaaccccccaatcgggtgcacctcattattttgctcatgcaggtttgaatagggccgctgggcagcatgggggaggcagtggtgcccgccccaggccctgccagcccctcctcgctgctgctgtgcccttctcggccggtgccacggcagccaggcccctgcagccgccccgcatctgcatccttggtggagggtttggcggactgaacaccgcagtgaagctggacggtctcgtgtggcctgagggcaccaagccccaggtgaagcctggcacatgtggctggcatctggatgggatgcaggtgccagggcagcttgcagacccctttgcaccctggtgatgattgtcctggccattgtggcacctcaacatcccccttctccttcccctcagatcaccctggtcgacgccaatgagcgctttgtgttcaagcccctgctgtacgagctgctgtcaggggcggcgggggaggaggaggttgcccccacctttgagaagatcctgcgccccacctccgtctccttcgtgcgtggccaggtggagagcgtgaacgacggccctgccaccggtccagaggtatgttggtgctgggatgagtggtagtttggcatgggtgtgattgcacatataccaaattacattccaatcctgctggacaccagagcaagttgcctgaggtgttatatgctcgcctcagccgtcacccctgtgcttttatcacccccaccgactattgtacctcatgtctccctccccaaccgcccnnnnnnnnnnctgctgggatgagtggtagtatggcatggttgtgattgcacatatttccacattacattccaatcctgctggacaccagagcaagttgccttaggtgttatgtgctcgcctcggccgtcacccctgtgcttttatcccccccaccgactactgtacctcatgtctccctccccaaccgcccccaggcgtcgagtgggggcagcgtgacgctgaagggcggcgccctcctctcctacgactggctggtgctggcgctgggcagcgagccgcgcgacgccggcgtgcccggggtcaaagagctcacgcacggcttcacctcctacgaggacgtgctggcgctgcgcggcgcgctggccgccctggcgggcaaccccgcgccgcgcgccgtcgtcgtgggcggcggctatgccggcgtggagctggccgccgtgctggcggacgtgctcccgcccggcgcggcggtgtccctgctggcctcggggtcggacatc

SEQ ID NO: 41205 - DNA, 81 bp, Chlorella protothecoides
ccccccccccccccccccccccccctcacaatccgccaagccccctttctgcactcacatgatctcctccagcgagcagta

SEQ ID NO: 41206 - DNA, 79 bp, Chlorella protothecoides
cgttcatcgattggccagggaaagcagtaggaggtatttgtctcttgaaatttggtatcagtggcaatggggtctgccc

SEQ ID NO: 41207 - DNA, 61 bp, Chlorella protothecoides
ggcggcggctgtggccacggcggcgggccccgacgcgcgcgaggacaaggacctggggtcc

SEQ ID NO: 41208 - DNA, 161 bp, Chlorella protothecoides
agcagggggggggtgacgagccggggcaatttgggagagaggtgcttggggtggggcgcgccagggtaggtcatggctggcacccggggctcgccttgcccggcagatacccgctcgcggcgttcactcacccctgttccccgcgacgtgccctcaccatg

SEQ ID NO: 41209 - DNA, 61 bp, Chlorella protothecoides
agccggccaagtcatccgccaagcgccggaacactgtggatccatctcaagttgacggccc

SEQ ID NO: 41210 - DNA, 70 bp, Chlorella protothecoides
agggcgcgcacggtcgataatcgaactgttccggggtggagtggggggtgtgagcgggaggggcggagac

SEQ ID NO: 41211 - DNA, 61 bp, Chlorella protothecoides
cgccgtcggctgccggctgtacaccagcgactcccgcgaggaggccgactcctacctggac

SEQ ID NO: 41212 - DNA, 62 bp, Chlorella protothecoides
ggctctgcctccaggacccggtgggtgggctaggaatgggagtctctggtgtcccctgcgac

SEQ ID NO: 41213 - DNA, 75 bp, Chlorella protothecoides
gttgtgcgcccagtgcctctcggcgccctcagtcccacatcccaactcccaccctgcttgccacagctgggcggc

SEQ ID NO: 41214 - DNA, 141 bp, Chlorella protothecoides
gcggctggggccatgtttgcgggaggaggccgggcacatgtgtacatttgtccccccccggacatgcctccccaaggccccggctcggctgctcctcatggaacccgcctctacttcactctgtccaggtgcggggacggc

SEQ ID NO: 41215 - DNA, 80 bp, Chlorella protothecoides
caagagatgagcccaccagctgcctcagcgcctagcccctccataaaagcctcccccagcccttctcccgaggactcccc

SEQ ID NO: 41216 - DNA, 61 bp, Chlorella protothecoides
tctcctcgttcacgtctgaaggggggggggggggggcatgattctgtgtgagggggcttgc

SEQ ID NO: 41217 - DNA, 118 bp, Chlorella protothecoides
acggggacgacgtgagtcggagggggtgggcggctgagtgttgctgagctgccctgggggcagctctgaccaggagggggtcttcccgtgccgagggctcgggccgcacgccgtccgg

SEQ ID NO: 41218 - DNA, 102 bp, Chlorella protothecoides
gcgactctgacccattgcacaatgattatgaatcccagggcggtagaaaacccactcatggccagcaacagcaccagccagccacgcgttcaacagtcccca

SEQ ID NO: 41219 - DNA, 96 bp, Chlorella protothecoides
gggcggtggaggggcaggggtgtcagagccagggtgtcacggagggaccagcattgttcagggggcagtgcccggtgcgaatgtcaagcaggtgac

SEQ ID NO: 41220 - DNA, 12773 bp, Chlorella protothecoides
  modified_base (114)..(201): a, c, t, g, unknown or other
  modified_base (938)..(947): a, c, t, g, unknown or other
  modified_base (1558)..(1567): a, c, t, g, unknown or other
  modified_base (3183)..(3192): a, c, t, g, unknown or other
  modified_base (4173)..(4182): a, c, t, g, unknown or other
  modified_base (4248)..(4257): a, c, t, g, unknown or other
  modified_base (4404)..(4413): a, c, t, g, unknown or other
  modified_base (4492)..(4501): a, c, t, g, unknown or other
  modified_base (4580)..(4687): a, c, t, g, unknown or other
  modified_base (5518)..(5527): a, c, t, g, unknown or other
  modified_base (5692)..(5701): a, c, t, g, unknown or other
  modified_base (6566)..(6575): a, c, t, g, unknown or other
  modified_base (7750)..(7759): a, c, t, g, unknown or other
  modified_base (8277)..(8286): a, c, t, g, unknown or other
  modified_base (8663)..(8672): a, c, t, g, unknown or other
  modified_base (12022)..(12031): a, c, t, g, unknown or other
  modified_base (12224)..(12447): a, c, t, g, unknown or other
  modified_base (12554)..(12705): a, c, t, g, unknown or other
cggcggcggcgacgaccgccgggggcccggggtcgagccagctgtccctgcacgctgcgctgcagcagatggcgctgcagcaggcggcggcggccgcgcaggccgcggcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgctgcgtgcgctggcggccacgctggctgaggtgggcctgctggacccggccttcctccacgccctgggccatgccgacttcctgccggacgggcactaccaggccgacacgctgacgctggaggagtcgcagcgacgggcggacctcttcaacgccgcggtggaccactacatccagagtgggtggcagtgtgggggcttgtgtagggtgtggggggagtgtgggagggaacatgtgggtctgttgtggaggcgggaggaggtcgagacgggcaggtcggagggtgggaattgcacagtctggtgtcctgagcgccaagtaggcgcatcgcaccctgccctgccacccatggattccacgggaggctggcctcaccaccggcgcccccccccccctcacccctggcgcagcgagcatggacgggaggccgcagctggagattgaggccgccgccaagatcgggctggacggcgggccgctgtactaccgctgtgcctcgtgctccaccgccgtctccgaggcgcggcggcagatcgtctggtgccccggctgcaaggtgggggggtggaggggtaggaggagttcgacatggcgtgggcctgggggggggatcgagatgaggtcggctgggcggccctgacaggcgcaatgcatggcgcgtgagatggtgtgggaaccccctttccgacaccacgagggcttcagcctcctgcgggctgcaggagggcctggnnnnnnnnnnctgagatggcgtgggaaaccccctttccgacaccacgagggctccagcctcctgcgggctgcaggagggcctggagggcccagagcggtgcctttgtcacggctccttccaagatatcgcccgttgcccaagcacagttcccccgaaaaatctcccgtgccaggcgacgcccttctgcagcggggactgccaccgccggctctacccctcgcaccgcggcgtgtgcggcttctggccgcggcccctgcttcccagccaggtcgcgctgcgcatgggcgtggaggcgcacatggtgcgagggctgtcgggcggggcgctgcagggcgcggtgctgcggcagatgcaggcggtgcagcgcagctaccaggcggccgccgtcgcggccgccgcagccacgggcgtggtgggcgagtgaccccgagcgggcagcgcgtgtcgatgcgcggaggcacggcgtcgcgctggggcgcagggcagcatgccggcgaagaggcggcggccccgcccctgcggtcctgcactcacggcgactgccctgcgccggcctcgcgcacgccggcacccctgcctgcctccgcgccccccgccctgtcccactgcccaagcagacnnnnnnnnnngggccggcacccctgcctgcctctgcggcccccgccctgtcccactgcccaagcagacgtcttgcaatgtacaaacatcttcctggaagggcaaggtacatggcgcggcttggagggccacgaggcggcagcgccgccgccccctcccacaccaggagggggcggcggcctggtggtcagggggtgtgggcagtgcacagtgggcttatgcattgattggtggacggcagtctagcagtacagtcgtacacagttggcagggaagcagtaggggtcgcagtatgtgaacatggtctgattcgctctatcacggagaggaagaaagtgctttgagttcctgaaggagtgctggagcgacttgcggcgctcagaagcggtgtgcagggctatgtgcaaggaacaggggggcctgctggcatggtctgaggcggcgcgagatgattgctgggacaggaagatggttgtttggagccgggttggggggaggggaggtccgtcccctccccggtcgacggcttcgggtggcggagtgaccccttgatcctgggtgtccacgctcagggtgccgtggtgggtgcggctgccagggcggcggcggcagcgaccacccggtccaggcgcagcagcccagcccccaccctaccccggagctgggccgtgggctccgcgctttccaacagcaggcgcttgagggccggggcggggagcgcgccgggcccggccacgctgagggccagggcggcggcgccggagacaaagggggcggccatggatgtcccgctgagtacgcccgtggcgttccccggaagcgtgctgaggatggcctcgcccggcgccgccagcgccacggtgcccgcgccgcggttggagaaggaggagagcgccccggcacgccccacggcggccaccgccaggacgttggcgcggtccgcggcgtagctggcggggtactgcggctcggcgtccaggtcgcggtcatcgttccctgccgacaccacgatcagcgcgtcggcggcctccgcggcctccatggcggcctgcatggcggcgttgggcgcggcggcgccgccccaggaggcctggatcacgcgcgccccctgggccaggcagtagttgacgcagtccacggcggcggaggtgcggcccagcccgtcgccgtcgatgaagcggcaggccaggaggtcgacgttgccccagaccacgccggagacgaggagggcgttggaccctgccgcgcccacgatgcccgccacgtggctgccgtgccccagctcgtccatggggccggggctgccgggcagcatgctcacgcccaccgcggccgccatgttggccgccaggtcctcgtggctataggtgtggaagggggggggcggggggggtgtgaactgggggtgagtatgagagtgaatgacggtggatgaggaaacgccactagacatgggcagaggcgcagagtgtgcgggattctgcggcatgggaggcaggctgggtcgagcagcaggtgcagaggcaacgcccaaaggcctcgtccggaccttcgcctcgcctgcatgggtgagtgcatccattgccagggcgggaccccatcccataccccacccccctcacccatnnnnnnnnnnacaaaggcctcgttcggaccttcgcctcacctgcatgagtgagtgcatctattgccagggcgggaacccatcccataccccacccccctcacccatttcacacgacacatcactcactcgtagtcgatgcctgagtccacgatgcagacggtgacggccgccgcgcgggtgggggcgcccgtggcggtggcccaggcctcgggtgcatgcacggcctccagcccccactgctcggggaagtcggggtcgtcaggggtgacggagtccaccctgagggcgtgcacgtgcaggacctcgtccagcgcgacccactcggtggtggccagggcgctcaggttctgggccagggccttcaggctctcccccggcccggcggccgcgacggcatactccaccgcagtcgctgtgctggccaccgccaccatgccctcgctgggccggaccttgtaaagcacacgtgtggcttgagggatggatgtggggttgaaggaggggaggatggcggtgggcgggggcgagggcgccagggtggtgtggaccaggggccggacggcccggacctgcggtggggcaggggagaaggggcatgcgtgacaccaaccgcatttctcggcctggggcagagccaacggttgggagacaggcatttgcatgaagtaccccataaatggcgtaactgagtacatttgaagccgcggagcacaacccacgggggtgtgtccggcatccaaacacggggggacccattcgacggaacacccacctgcggcgcggacgacaagtttagcacgagaccgagaccccagaccagggccaaaggtgccaaaagcccacgcatggtgccagatatcattcgaaagtgtcagtctgtatgtgggttattgcccctcgcaggaagctcgctgtccagccaatcacttgtgactggaagagcccggacttgcaggcactagtaatcggatggacaggagtgagagagcnnnnnnnnnncttactccataaatggcgtaactgtgtacatttggagccgcggagcacaacccacgggggtgtgtnnnnnnnnnncacagaggacattgctcagtcagacgcttgaggccccttccgggactttctgcattcgaacttccgtgcgaacgtggcacggacaatccggagttggtcccctcggcgtcaactggtctgtgtgggtgatgaatggagcaacgagcnnnnnnnnnngagcgaaaccacgagacgttggcatccaggcgctctgaaatcctatacatgcacaatgcatgatcgaggaggcgccccnnnnnnnnnnaagcgaaaccacgagacgttggcattcgggcgctctgaaatcctatatatgcacaatgcatgatcgaggaggcgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggcacggacaatccggagttggttccctccgcgtcaactgatctgtgtgggtgatgaatggagcaacgagcgctgaagctatcgtttcgtgatattccctgaggacaatgaccacgagggccgtggcccagtctcgagggcaaggcgtccgtagctaggcacggccaagcctccggagcttccggaggtccgcgtgaaacaaccccagttccccgagccccgggctcccctcctgacagcacgaggcatcgccgtccttgtgcacttatatcaaaattgccaagctgcattccagcttgcgtcaggtatcacgtgggagcgtcactgaagttgggtttgcacaaggggtcgcaggatggccagctcgctggacctcagctggccagaggtgagacgcgccgtcttccggtctgacaggcgacccccctccaagtcagccacctcgccgtcgaggttgtcagtcgctggagaacctgccagaactcgctgcagcttcggctcggccagggcccgcagcgcctccgcaaaatccggcggcgcggcctctcgcagcgcgccctccagcacgctcatggtggcgctggggtcggcaagtagagcctcgtggacctctggtcccagcgcagccttggcgtcctcccacatggggagcgcagggtcccgctgcgcggccgtcagccatgcggccgcgatgcaccaggccggcatgtgtccattggggtgcacctgtcaggagacggaggcggggacaggctggtcaatggatgccggggatgtgtacttagggagctggtgcttacgccaccccgctctgcagacctcccagcgnnnnnnnnnngtggatgccggggatgtgtgctgagggagctggtgctcacgccaccccgctctgcagacctcccagcgggatccccctgccaaactcgctcgccactcgtagaccctgaagccccactcaacctcactcaccaagacggccgcgtaccgcctgcggcgcagccannnnnnnnnngcactcgcagaccctgaccccccactcaacctcactcaccacgacggccgcgtaccgcctgcggcgcagccagggcgtgttggcgtccaagaaagcgcggcgcgcctcccactctcgcgcgccgtgccgcgccgcaccccaggcccacaggggctccagctccagggtcacgctgtcgtgcgggttctcgggcagggtgaagccgtacttctccagcaggtcccggttccccagctcgccgtaggtgttgtgcacttcacgcccctctccgatggggctggcggtgaggatcctcagcgcggccccctcctcatcatccacgatgcagatctccagggccagggacagcccgttggcggagcgcaggccgtgcagctctggctcggcgtccgccaggaagctggggggcacgagctgggaggtcagcatcgtgccggcgccgggggaggcgcccggcgagccgctcccctccccgccggagccgctggcttcggagctgcccaggctctcggaagccgcctcgctcccactcgccgcgccctcttcgtcaccatcggcgtcctccgtgtcctccccctcctgcacctcctcctcgtctgcatcagagtcgctgtcgtcggagctgtcctccccctcctcgccctcgtacacagcatactggtccgacagggccaccactgacgccttgtggttgaacacgtctgccagcgggaccatggcgtcgcctgccaggtggggggtcggatgggccagagtaaagcagaggcgggtgcggtgaatggagccgcgcgggccaggctcgcaggccagggcacgcaaagtgcgggtccgtcggggggtcaggcattggacacggtttctaatnnnnnnnnnntgcgcgggccaggctcgcgggccggggcacgcaaatgcgggtccctcgggggtcaggcattggacacggtttctaatcacgcgctcgaggcgctcatgtgaaagatggtgatttggtgttgttgctcatcactcccccgggacatgggcgggcaaggtacatcgaggagagggaaagaccagggcgccaaacccacctacggcgtcgtccaccttaaacgccctggaggccaccaaggatgcagccgcctggaaggcagggaaggagtagttcatgccctccagcccatgcttggcaatcaggggctcgatctgatctgtgtagtctgaccggacacagtccagctcgtcgtggatggcatctcccagttcagtgccctgcaagagggccagttcctccgggccccagaacaccggcaggtactcgcgctcaggcaacgagcagaagtagccatgccttctgacgcaggggtggaggagggaagtcatcacgtcagcaaggtacaggcagacatgcgtgtagcctcagcagccagagcacgccctccaccttcatgcagaggtgctcacagctcaccaccgagacttgggccccaggaggcgctcgtgcatgaccgccatcaccaggcccagaccagagcacatattctcctccatgatgatgtcggagcagctggcattgcgcacactcaggcaggcgtccttggggatggtgcagaggtggtggccggccggaaggggccgccgcgagtggatggataaggagctgccgttcggagattttgactccttgatctgcatggcctcgtcgtcccaccacaccccctcccggtccagccaggctgtgaggcccggcagaagtgccgcgccgtcggccttcgcccttttggcctggggctccatctcacgtcccatcctgggttcctattggttccatattttttaaacaacaggaagtgtgcatgaccaacctgagggcttcgacctttagctatgcctgcgttggccacatcggagttccggggtaccgcgctggccgccgagcagcagtatcccatcctgtgcacgtgccgacagtcatgggtgacgagtcgtatgcgggccagggagtcatgtcgatcctgccggtccgagtaacccttttaaaacattttccaggccgcacatcgcacccannnnnnnnnncccatgtcgatcctgccggtccgaataaccctttttaaacattttccaggccgcacatcgcacccaagcaaccatggctgccacctctgccgccgcacgggcgccttgcgctgctttcgcccggtgtgcccccaccaccagcattgtcgcccctcgcctgggccccctgacccggcccgcctccctgaggtctacccgcggcaggcgctccctcaccgtgcagaacgctgtcaagtatgactacaacaccaaggtgttcgagaaggagttgctgaccttcgccgggagcgaggagtacatttacaggtacgatgctgtgccaactgcccatgcgcgtgatcgagggcattgcgaagttcgataaattcgctgagctggaatgcaaattgggacgtggttgctccagcatgcatgcaccgggtggccttgccatcctgctgatgtggcccctgcccctgccaagttccttccacacctacattcgaccccgctcgttccaggggcggccgcgacaagtnnnnnnnnnnatgcccctgccaatttcctttcacacctacattcgactccgctcgttccaggggcggccgcgacaagttctccaagctgcccgaggcctttgccggcatcaagcagattggcgtgatcgggtggggctcccaggcccccgcccaggcacagaacctgaaggagtccctggctgaggccggcatggacaccaaggtgtgcagtgttcttgtgtgttgggatgtgtatggcagttgcatgtttgttgtgcgaaactttggggggcctgagaacgccagaccccatgctattcccattatggcggttataggagggtcgcgcatgcctctgacctgccatctacatgcagtggcagggctttcccgccattcacagggcnnnnnnnnnncatgacagctgcatgtttgctgtgcgatactttggggggcctgagaccgccagaccccatgctgttcccattatggcggttatgggagggtcacgcatgcctctgacctgctatctacatgccgtggcagggctttcccgccattcacagggcccctgccccactccagcatccccctgcacaccgccacacactcacccaacccaacctccaacccccccctcgcctccctccccgccaggtggtcatcggcctgcgcaagggctccccctccgagtccgaggcccgcgccgtgggcttcaccgaggaggccggcacgctgggcgaggtcttcgacgtcatctcctcctccgactttgtcatcctgctcatctccgacgcggcccaggccaagctctacccgcgcatcctggcggccatgaagcccggcgcgacgctgggcctgagccacggattcctgctgggcgtcatgcagaacgacggcgccgacttccgcccggacatcgacgtggtgctgatggcgcccaagggcatgggcccctccgtgcgccgcctgtacgagcagggcaagacggtcaacggcgctggcatcaacgcctccttcgccgtgcatcaggacgcctcgggccgcgcggccgacgtggcggtgggctgggccatcgccacgggcgcgcccttcgccttctgcaccacgctggagtcggagtaccgcagcgacatctacggcgagcgctgcgtcatcctgggcggcgtgcacggcgtggtggagtccctgttccggcgctacgtggcgcagggcatgtccgatgaggacgcgtacctgaacagcgtggagtgcatcaccgggcccatcacccagatcatctcccgctccggcatgctgggagtgtacgaggcgctggacgcggagggcaaggcgaccttcgacgcggcctactcggcggccatcggccccgccaacgacgtgtgccgcgagatctacgacgacgtggcctgcggcaacgagatcaagtcggtggtgaacgcggtgtcgcgcttcgaccgctaccccatgggcaagatcgacgagacgcacatgtggcgcgtgggcgccgccgtgcgcgcgcgccgcgcgtcgctggaggtccccctcaaccccttcaccgcgggcgtgtacatcgccaccatgatggccacggtgcagacgctgcaggacgcggggcaccccttctccgagatctgcaacgagtccatcatcgaggcggtggactcgctcaacccttacatgcacgcccgcggcgtggccttcatggtggacaactgctcctacaccgcgcgcctgggctcgcgcaagtgggccccccgcttcgactacatcctcacccagcaggcatacgtggccgtggacaagggcacgcccgcggacgccgaggcgctggccgccttcaagcacgccgacgtgcacaaggcgcaggagacctgcgccgccctccggccctccgtcgacatctccgtcggcggcgacgacgactccacgggcgtcggcgcgggcgcggcgcgcaccgagttccgcagccaggccgtcctggcctgagcggcgggtggatggcggggggtggggatggtgatgatgggaagagggtgggtgcaagaaccgtgctcaggatggactggtgcctccttaacatatccaaaggggggtggccggtggggcctggagcacctccgccggccagggtacccgcggggagtgcagggtcctgttggatggttgttcccccttccctcatccctgctcccccccgattctgcatggatgtggacacacagcgcaaggaggtcgggcaaggggtggcgggcatctgggtgctgagggatgccgggctggggatgtccagggttgggggacgcatcaggacgggccagaagacttcacgggggcttcctgtgggcctttccagagaagtggcaaccgatgcaaaatcagcaagcgtatcggcggccgctgacgacgtagtgcgtcacgattcaggtcaatacacaggcgcacgcgcctggcccggccgcgcagggccccttcgcctgcagcctggccgccagggtccgccagggcgacaccctttcctcccgcgtcatggcggcggccccgctggtgctgggcatgacccacacctcgcagcgcgcgagggggaggggccagccggcgggcagcacccactggcggccgggccgaatggtggcagggcagcggggggtcaagcggatgcgacggggcgccgtggcgccgccgtccagcccgccattttccgggcagctgctggcctcttcatcgcactgattgggggggccgtctttgtgagcggcagcgcgcaaggcggggcaccgcgccttttcgggaaacagctccctgaagtggcgcacgccggagaaggccaccagccggggagcggcgcagctggcgcagccgcccgtgcaggcggcggcggcggccgagacgtgggcctccaggcgcaggaagaagggcaggcgccaggtcgccagtgtggcggaggagaatgcggccgaccgggtgcccgagatgccggagccgacgtccgcaaagcccacccccgccagggcaggcatcaggcggtcgtcctgtgcccccctgcagggagaggcaaggaggaattctttggttgtcactgaatgcaaattcacgttccttgagagtgagtacgagtccttgcagaggtaaaggcatgttgatcacaaccacgcagcacctgaccgtctcgggggcgatgccagtctcacgcaggatcctccacatccagttgttgggattcgagtagtagtgacctttgatcagggaaagatgacgggaaaactcaggccattgtacaggattgcaatctatgatgaggggtattagctgctgagcagatcacaggtgcccaccacctttgcggtcaccctgactcgcccgtccgccatgcatgggcgctggggttgtgcccaatgatgatcaggcgcagcgggtgagggggcaggagctcggggacacccagagccaggggtggatgcccgtcatcgccttcggatcgacctcgcttgccgctggagccctgattccgtgaggcctcatgggggcctggcgcttctgagcgggggccgttcttctctgaagaaggagctccaaatcggaattcctgcgaggtggggtgtcctgcatcatgtctacagacaaggcggacagggcccgacatgtcaaaccccgacatggaatcctacctcgaacatgcacgagatgtaggctcaaccatacacgtccgtgtcgcctataccaagatgcttggagctcatggcaacaagtgactagtactgcaagnnnnnnnnnngtgtaggctcaaccacacacgtccatgtcgcctataccaagatgcttggacctcatggcaacaagtgactagtactgcaagaataccatgctgctttggagaaaatgcaacgcctgcttgagggaatgcatggaccgacaggaaagattcacatgctttgcgaatcatgcacagcactcgctccctgggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggctgcaaattaagtgagccattccagcccacataccggtttttagagagcactcagtgcagagagtctcgtacgccacctcagcccatcccggtcttgttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgattcgtgcctaccatgccaacacccctatgggctgcatgcaacaggaacaagtatgacttgtgtc

SEQ ID NO: 41221 - DNA, 23970 bp, Chlorella protothecoides
  modified_base (117)..(204): a, c, t, g, unknown or other
  modified_base (268)..(277): a, c, t, g, unknown or other
  modified_base (961)..(970): a, c, t, g, unknown or other
  modified_base (1606)..(1615): a, c, t, g, unknown or other
  modified_base (1845)..(1854): a, c, t, g, unknown or other
  modified_base (2745)..(2754): a, c, t, g, unknown or other
  modified_base (3121)..(3130): a, c, t, g, unknown or other
  modified_base (3233)..(3468): a, c, t, g, unknown or other
  modified_base (3520)..(3529): a, c, t, g, unknown or other
  modified_base (3705)..(3714): a, c, t, g, unknown or other
  modified_base (4461)..(4543): a, c, t, g, unknown or other
  modified_base (4739)..(4748): a, c, t, g, unknown or other
  modified_base (4895)..(4904): a, c, t, g, unknown or other
  modified_base (6611)..(6620): a, c, t, g, unknown or other
  modified_base (7132)..(7204): a, c, t, g, unknown or other
  modified_base (7541)..(7550): a, c, t, g, unknown or other
  modified_base (7635)..(7645): a, c, t, g, unknown or other
  modified_base (8365)..(8374): a, c, t, g, unknown or other
  modified_base (9141)..(9150): a, c, t, g, unknown or other
  modified_base (9651)..(9660): a, c, t, g, unknown or other
  modified_base (12274)..(12283): a, c, t, g, unknown or other
  modified_base (12506)..(12515): a, c, t, g, unknown or other
  modified_base (12603)..(12612): a, c, t, g, unknown or other
  modified_base (14450)..(14459): a, c, t, g, unknown or other
  modified_base (15343)..(15352): a, c, t, g, unknown or other
  modified_base (15575)..(15584): a, c, t, g, unknown or other
  modified_base (16104)..(16113): a, c, t, g, unknown or other
  modified_base (16453)..(16462): a, c, t, g, unknown or other
  modified_base (17736)..(17745): a, c, t, g, unknown or other
  modified_base (17837)..(17846): a, c, t, g, unknown or other
  modified_base (18011)..(18020): a, c, t, g, unknown or other
  modified_base (18088)..(18135): a, c, t, g, unknown or other
  modified_base (18281)..(18290): a, c, t, g, unknown or other
  modified_base (19183)..(19192): a, c, t, g, unknown or other
  modified_base (19545)..(19554): a, c, t, g, unknown or other
  modified_base (19899)..(19908): a, c, t, g, unknown or other
  modified_base (21478)..(21487): a, c, t, g, unknown or other
  modified_base (22289)..(22298): a, c, t, g, unknown or other
  modified_base (22794)..(22803): a, c, t, g, unknown or other
  modified_base (23666)..(23675): a, c, t, g, unknown or other
ctccgcccccgcgcccgccaggcctgccgctgggcccgccgaccccagcgcctcggccgcctccagcgccaggcgcgcgaccaggggggtctcgcagcggaagcggcgggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggcggcgtcctcgtgcgcaccggcgcgcatgccgtccggggggtcccgtgacgcggggtcnnnnnnnnnngacggcggcgtcctcgtgcgcgccggagcgcatgccgtgcggggggtccagtgacgcggggtcgccggcgccgccaccgcagccgtgcgtgtgcaggccgggggccaggggcaggcccaccaggccgccggcgaagccctcgaccaccccgccccaccgcgcgccggccggggtgtcggtccggaggctggcggggatggggaggagggcggcgggcgtgtccgccatgcacagccccaggccgggggcctcgggcgtgaaccccgtgcccagcagctgcagggcggctgccgcgccgccgtcggtcaggccgtcgccgcctgcctcggcctcggccgcgccggggcccggcgggggctggggggtggagcactcgctgtcggggctgtgcgccgggccgggggaggcgccgacgtggccgccgacgaggggcgacgcccctggcaggggcggggtggctgcccccgcccgcacgctgcagggccgggggtgattgtgcgtgccctgggagggaatggtgcaggggagacatgcggtgagagcacgcagagcgggaggggaggattcagtgtgtgctgctcatgacttcgtcatcccgagaatggagctggtgctgaggggttgtgcaggtcattggcgtcccctttggggagggatgctatcaccggagccaactcatgccgnnnnnnnnnntgcagagcaggaggggaggattcagtgtatgctgctcacgacttcgccatcctgagaatggagctggtgctgagggattgtgcagatcattggcgtcccctttggggatggatgctatcaccggagccaactcatgccgagcagaggcacaggcacgttgtgctgtggccagcactcctgtccctgcactcccatcacccctccctcagcaatcaggcagagtccaattctccaggccagtccagaccctgcccgctcaccttgctgaggcagacggagacgaagccggtcttcaggttgcgctctatgatcttcttcacctggcaccctgggaagctgcacttgtagtaggagcgggggcaggagctgcccttcacgtgcttctccccatactttctccagttgtagccgtcctcattggcagtgctctctcgccgggggcggtcctgcgagatggggcgaggaatgggtgctcatgcccttgcaggcggcatctttgcgtgcaattcagctttcggcctgtgatgtactgctgcgtcgcttctgagctttctacgataatttagtatggtgacatggcttgaaagtcaccaccaaggccacttaaagccccagcaactgcagtaggacttcaannnnnnnnnncacaatgattcagtatggtgacatggcttcaaagtcaccaccaaggccactcaaagccccagcaactgcagtaggacttcaaggaacacagcgccccttcaccgcatgcgcaccttctctggaacaaccttgtgtgtgtttgcggccttggcagcagcctgcacagggggagagaatggaggcagacttccgtcacgttgctgcatgacagagggcacctgcgctccgannnnnnnnnnagatggaggcagaatttcgtcacgtcgctgcatgacagagggcacctgcgctccgagacatcagcggcaagggaaacgaccacctgctcttccattgcatggtgcaccactccacccacctgccggttccgggacggcgcattgaaggtgtagttgtaggggaatgcccaaggcatggtaccggccagctcaagtgggggggagtcccggtgggcctccatgctggcccgggaagggcccttggcccccggctggaacagcggcagcgggtgatacatcagcagggatgtcgagggcgagggctccacctgcgagtccagggtcttgccatgaggaggagcaaggtctatgctctagattgcgatagactattgcacaccggactcaccccgagcatgggaaggaggacggggctctcgaggattgtgtaggggtgccgggtgtgtgcagcattggggcatggtggggggcgccctccacccccatgtcgttgcgaagggtgtggaggcagcgaaaatgctgcacatgcggctgtgggcgacctctgtgcggtgggatggggagcacttgcctcgtgtgacccggtctccatcctgaccgtggtcagagcctttgaccccagcaggcgctgcttgccggcgtcatctccagatactagcggggcatgtcttgctccctgcctccctcatgctctgcaggcgttcgaccgcgaaaatgcaacatcctggtcttggtcaatcctgtgtgcaccgggccgggttccgggctaatgattggaaagaaggaactcgaggtacagctgtgcctggtgcagcctcgtcagtgagcacgccgtgtgcccaggccgcggacccgatgccgggcatgcacctctttggatacaatgttttnnnnnnnnnngtgcagcctcgtcagtgggcgcgccgtgtgcccaggccgtggacccgatgcagggcatgcacctctttggatacaatgttttcacatcacggcaccggtccggcctgacgcacgggtcaaggccaggagcagcgtcgcagcatgcaggcagccctgagcgtgggccggccagggacggtgcgcatcgcccccacccggcgagtttgtgagctgggcagtggccgctcccagcacggccagcgcctggaggtcggacaccatctcgcggaggctggcctcgtcggggctgtctgtgccgacgaccggccgcacacgcagcgtgcaccccgcgcccagcgggcacagcagcaccggcccggcctgtgcnnnnnnnnnnacggaggctggcctcgtcggggctgtctgggccgacgaccggccgcacctgcagcgtgcactccgcgcccaacgggcacagcagcaccggcccggcctgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccagccctccgcctcggcgcccgagacagggccggggcgggacaccaccnnnnnnnnnnctccctgcgcgccacccacgagccggcggccgcgacctcccttgcgctgctgccaagggtgccaagtgggagcggcagctgagaaggaggagggtgggtgatgggattcaagttctcggccaggcatcccccccactcccccccccatgccctcacctggcgccctggacctggannnnnnnnnnggggtgggtgatggcagtgacgttctcggccaggcatcccccccactccccttcacatgccctcacctggcgccctggacctggagctccacgacgcagcagctgccttgcgccccagactccatcagcgcagcctgccagccccccgcctcgacacccgagacagggccggggcgggacaccaccagccgccgccgtgcatccgggcccgcccaccagccgaggcgccggcaggcgcccaggacctcagcggcgagcgcggcgccggccgcggcttgcaccacgacggcctccgcgcagccgccgggcgaggcgcgcgtcagggcggccaggccaggtatcatgggcgcgacggcgacgtgcacgcagtgcagcgcgcttgtgaggccggccagggcgccggggtcctgaggccccggccctgcaccctccgtgggaacgttcgaagaagctacaaaggccaggaaggcggcctggcgggcgccgcaggggcccaggtcgaggacggcagactctggcaccaggtgcaccaggagggacggcaggcgggggggcctgccgtcgggagcacacttgtcgcccgcatgctgggccgaggaagggcggtcacttgacgattggccccccgttccttggctgtgctgcgcaccatcgttccccagcccggggtccggcacgccgcgcccgctgtacagctccgaccccgccgcgccgtagggcggcgcctgcgcgtcgacgcaggggggnnnnnnnnnnnnnnnnnnnnnnnnnnnnnnnnnnnnnnnnnnnnnnnnnnnnnnnnnnnnnnnnnnnnnnnnnnnnnnnnnnncggcgctggggaggagaggggtggagagcgcgtcggagggccccagtcgcggcagccgcgcggcgtcggcgaccatgcggtccacggtgtcggcgagcgcggctgcaaacgagcctccgccctcctcctcgcctgtcgcttcggatccccaccacgtctgcaccgagtctgggggacaccgcatctcgcccaggcnnnnnnnnnncgtggccggccccgtgagccagctctcctgcagcctctcaccgcgtcccgccaatccccccgcaagggcggcggccgcccacgcctccgtagcggcctgcagcagccgtgcgggggccgggccctggggacacaccaggaagagcannnnnnnnnngaacgagcctccgccctcctcctggcctgtcgctccgggtccccaccacgtctgcaccaagtctgggggacaccgcatctcgcccaggccgcacattccgtaccaggcgcccacatcctgtgcacgggcgggaccagggctcggatgatacttcttgacaaaaggtgcacagcaggccaagacatggtggccacaccagcgacgcagtggctcacatccacacacacacagccacggtatgcaccttgcaaaaggcgtgtgtggcctccttgcagccagtttggcacagggcgtaggcacgcagatgctttggctcccccatgggctccagggggctgatgtcccatgttgcaagcatggcagggctgacatccagccagtctccctgcatggtgggcaggagggtggagaagcatcaaacatgacctgggtttgtggcgaggaagacttctcccaagacagctccaataaaacctgcctaggagatactgaaacctaaccgcaccgaccgaggtggctcacctggtacccaactcgaagcgggggtgtggccagttcaaagtccagcaaactccctggctgtgagggtgcctccacgccgccctccgtcagctctactggactctgcagcgcgtgagagtgtccgggggctgccatcagaagcaggcccagcgctccctggttcatctcgagccacctctctgcgtcgagtccacatgaaggctccacagccggagctgcagggcactccttccttttgtgtcttcgtctccagcgaccgtaggtcacacaggggtcctcctgacttggtacacttgtaggagcgaagggacccggtgccccccaggcagcgagtcgactgcactccatgcatactagcttttcattcgcgaggcttgtgtaggctcagcaccgacaaacctcatcccgagggggttgctgtgatcggtgaaggtgccgcaccataatcttattgtaccagttcaggaggatgtttggtgaaacagctgtcagatcggcctacagcactggtttgtccatggactcggagagcatgttcacgggaaggcgcctgcgctcgatctgagcgcgaatttcaagtcacccgacagcttcctgttcgacacaacaggtgtacagccgaagatcgcagatttacatccattataaataaaaccttgcaatgaatacgggagacgttttcgacgagcacctgggtgtcatcgcagccctgcgggacaactatgcccggcatgacgacaccgacactatccgcgaactgctggggatacaggaggagttagagggcttgttgagctcccgagaagacacggtcaagcaagctatacaaggtgtattgtcctcgcgccgtgagcgttctgacacagggcaatatgcagggatggattacctctggaaacaagggcctgcatccctcctccattgctcccttacagccctcagctccagagtggaggaggcacgcatcaaggcggtgtatccagaggaagagggtgcacacgatgcccgactgcgtgagctggaggccagggtggctgcctcgaaacagcatgtggcccagctcaccacagagctggaggccctgggaaagcaacgccagcagctgggcagcagcatgaaggaggtcagcgtgaagaaggcgcaagtggaccacatgctgttggaggacgagcctcgcatcaggtnnnnnnnnnnggcctaaagaaggcgcaagtggaccacttgctgttggaggacgagcctcgcatcaggtgcgatgcccccggcagcgcccagtggcaatggaacttgtgggtcactggtagggcaggcccttttgagcaccgccctggcaagtgctctggactggtcctcccggctcgctgtgaaggagtcctttcaccagattacgttatcaccatttgcacaggcatcagctaagcctgtacgcccacgtatccaagatcagctggcggttcgacaatcccgaccgcattgcgggcacggtctcggatcctgaaaaggcggatgtgcggctcttcgacctggccccgcagatgccccgctttgaggccaccaaccagctctggaggctcatggaggccgcaagctgaggcagggtgctgcctgatgcaggctattgtacatgtacatggatataatacgagagacgccctcggcaaacctgctcagacacgcagactgctacaaggagtggtgggaggggnnnnnnnnnnnnnnnnnnnnnnnnnnnnnnnnnnnnnnnnnnnnnnnnnnnnnnnnnnnnnnnnnnnnnnnnngggaggatctgctgcctacgcctcatcttcctcgttggcaaggtcctttggcgtggcatgataccgatccagcccttgctttgcgcccagcactgcaaatgtgatgggccgaggattgtctcaacaggattctgtgctggtgcctgtggggcaccagcccagtgacactgccccagcatgcatagatccagcaggaagggcgcggtgcgcgtgcgcttacccagaagcaggtttgtgactgtgaggaaggactcggcgccgccgtgaaggtagtccacgttggacaggctttcgtggtacacgagctttgctgcggggggggggggggggggggggnnnnnnnnnnagctggtgccagtgcggcactaaaccagtgacactgccccaacatgcataggttcagcaggaagggcgcggtgcgcgtgcgcttnnnnnnnnnnngagcagagagcatacactcgagcgtggcatacgcatcagctcttgaacaccacgtcgtttgctggcatgcgtcggcatacgtcacccgaacgcctacagtacacattgaaacctgcgatgccggcgggaatggaagccacgacgaagacgaggaggaaataccagccgaagagcatgcggggcggcacgtcagggttcttggtcatgaagtagaggaagccggcatatggtattatgctccaggcaaacaggttttgcgcaagcgtctgtgtgtgtgtgaggtggaggagttgaaactgtatgcatccaggcgctgtgcttggtgatgctacactccatccgggagtatggcttcccatgcacatcccataatacctccatgtagcgtacctcggcattcacgccccatgcgaggtcaagcatggtggcatgacggggcgggcattttgggagtcgcgcaggggcccttgaccttgtgcattggagatgtgccctgccatggacctgcttgccccggtagccggctgcaggtccaagcaggccactgcatctactcagggaagcactgtctgtgagcaagaacatttgtagacagatcctgagcaatgaacatcaacttcttgtgcgtgctcttctcccgatcaagcgttgcacgagtccatgggaaccggattcccgttctttccgtgctttccacaggcacagcacagccaatgctgnnnnnnnnnntgagtccatggagaccggattcccgttgtttccgtactttccacaggcacagcacagccaatgctgttgaaggtatgacacaccctgagaccagtggcagtccgtcaagtgctggatcgtggcaatatctcccttgagaagcacttcggtcctgggaagagccgtacagccagggttcgaagtactcgtaggaggaggcacaatgttgcgcttcgctgcagcccagctggcccgccgaggacagaacctgcccgcagtgaccacaacggtaggaacgaggatgcgatgccctgtttgcgaatcatcattgagtcgcgcccccgcgcaggcattcatggcagcacccagccccaccccgcagggcctgcgctgcttttccgaggcctcggccgcggagctcagcatccctccccagttcagcatccccggacgttacgcctccgccctgtacatggctgctgttaaggcggacaagctggatgcggtgaccaatgagctgtctcaaatggccgggctcctcaagcagagcgacgacttccgggagtttgtcagcgaccccaccgtcggccagaaggtcaaagtggagggcatgagcagcgtcatggatggtctgggcgccagcagcaccaccaagaactttttcggtgtgtagggtgggtttgcaggagggatgtgtggggtgtggacactggagcgctccaagccagggtctgccgcgactgagtgctcccagcgtgggtccgctgctcctggggctgcctccaagnnnnnnnnnntagcgctccaagctggggtccgccgcgactgagtgcttccagcgagggtccgctgctcctggggctgcctccaagtgccatctgctgagctcctgcagacgcatccaggactcggatccccgcctacccactctcacccttcccccttcgtcccctgcgcagccctgctggctgacaacagccggttgaaccaggtgcccaagatcctggatgccttccagcagctcgtggccgagcagcggggcgaggtgcaggcggtggttactgccgcgcaggtacggcgaggcttgggatgcagggttggtagcttgttgttgcggccctccttcacttgtagagtggcatcccatctacttcccgtgcctgtgacggaggtgttagtgtcgacactcagttcccctcccccaccaccccctccatcatcacaacaccctctccaggagctaaccgcggccgatgtgtcggagattaccgagtctctgaaggacctgctgaagcccnnnnnnnnnnaccccctccatcatcacaacaacctctccaggagctaaccgcggccgacgtgtcggagatcaccgagtctctgaaggacctgctgaagcccggccagtccctgaccgtgagccagaaggtggaccccgccatcctgggcggcctgatggtggactttgaggacaagcacatcgacctgtccatccgctcccgcattcagtccatccagaaggccatcggcgaggccgtggtctgaggcgggtgcagcccctcactgacactgggccccccatgtaatgtacccctgcccccaccgagcgacacacggcacgatgtcacacacacccaggcagaggggggaaacagctggaaaaggggagtgcccaggcaccgccgcaatacacatgcaagcccttgctttcagaaaggggccgtcggcatcaggccaacaatcacttggcggccttgaagttctcctccgcctgctcccagttcacgacgctccaccaggcattgatgtactctgggcgcctgttctggtacttcaggtactgcatggtggcgccaggaagagggcgggggagggggcgcggtgatgacttcctgaaggcaggacccactgggtgtccggggggtgagaggtccggcatcccccgcccgacgagagtacggatgcatcatgggcgacctcgggccgcatggcccgagcacctagaaacagctccacccagcacccaggggattccccacgacccgcgccctgctcgcatgccccgtcctcaggcacgtcgcctgcccaaaaggcaaccccgctcacgtaggcgtgctcccagacgtccaggcccagcacaggggtccccgcctggtccaccagtcccgcctgcagggggttgtcctggttgggcgtgctggtcaccaccagcttgccctccggggtcacgaccagccaggcccagcctgagccgaagcgggtggtggccgcggcgttgaacttctccttcagcgcgtcaacggagccaaagctggcctcgatggcctgcttcagcttgccgccggggccggaggtgttggaggggttggtcatgatctggaggggcgcggggggtgcggcacgtgacagcatgagctggcagcgagccaagaaggggcagctggtgtttgaagttgtggagctccccacgagagattccccattcagcctcatgtctcccaatactacacacacgcacaccccctccgtccatgagcatcaggggaaacagcccagcacgcctcgcagccacaggtcggcctagtctccagcagagtcttcaccaggccaacaaccaacatgcccgtgccttccagaagaaggtgtggttccagtgcccgccgccgttgttacgcagcgcggtggagacatcggagggcacctcccccttgccaatcctcttgttgagctccaccaggtccaggccctggaggtcgctgtacttggcgacgacattgttgacgtttgtcacataggtctggcatggaggtgagtggggtcagggaggtttggagagggcaatgctgagttgtgaggaacccctgacttcgtggaatgcagcccggggcgcagctggccaggcgcatccgatgccgtcgcagcggggatccagaccggggtcgtgagatcacaggtgcccacctgatgatgcttggtgtggtggatggtcatagtctgggtgtccacaaagggctgcggaagagggaggagcgcgaaggcgagctcgtgcccgctggcatcctaccagcaaaaaccgaaacccaatggatgccggcaagtagtcctgtccgataccggataacatataaaccggcctcaggcccaagaatctgcctcacctccaaggcatcgtaggcgtatggcagatcgggcagggagaacgacatggcttgtgtgacgagtgtgaagcgggcacggatggggcgaggagtgcgtggtacgcggattgaatgtggggaagtttgatgtacggtgcttggcaccatgcttgtgaccttggtgagcttcatcttcaggagggttgatgtcatagagtagctgttcatgcgcagcacataggggacgcttgcccctctgtcaagtgatggtacagagtctcatgccgggttcgggaggaagctaagacttgatcttgttccttggcattctttcacattctgtcatgcctgctgaaatgtgtcgtgagcggcatcgactgtcgatagccacgacaaccccccttcctttcctctgctcagatctggcgaggaaccactcaggcgcctgctcccgaccactgcatgcatattcgaacatcagtctgaaatcttcatttaaatgttcaatcccatgaatatagaatactaggaggcactcattgatgtgcagtgaagcatacatttccttcgcatcccgcgcttagctgcacctccctcgattacagctctgtccaacgagggctccttttgctacaaaactcagcttgaatatggcaggtcccgagcagagagcggactccctgcggcaggtgagcgattttcccggcagatgaattgtctgcccggcgcgggcggcaccttgggatgggcaacaacgccctcgcccgtgctgccactcgccaccccnnnnnnnnnncccggcgcgggcagcaccttgggatgtgcaacaaagccctcgcccgtgctgccactcgccacccctgccaaccccctcccttcatctcagtccatggagaagatggtgacgcggctggacaaggataatctgcggcctgtgcagaaggagagttatttgtgcatggcccagtgctgtgacaacgcggctggtcctgcagagctccagcagtggtgaggatttnnnnnnnnnncacacaaagggttgctcaagagggtacaggcggcgattcggtgcatccttacctcccctactccccttgcgtagtgccaaccgctgcnnnnnnnnnntagacctctctttgggcatgcccttatgatgtcggactctgatacgtgtggaccttacacagagggctgctcaagagggtacaggcggcgaatcggtgcatccctgcctcctctactccccttgcgtagtgccaaccgctgcgagcagggcgtgcatgtcaagcactccatcatccagtcggccatggccgacttccagaacagggtgcagcgttgtgtgcagcgctgccaggatgcagcccaggagtccctccccataaagcccagcgagaaggacattgccagggcacaggtggggtggggtgaggtcattaggggggtggccgtgatgaaagggaggagcagagggtaggtcacagtgtcaatcagatcacctgtctggcagaaagcagaagcagggagttgagaatgatggatgtcgcacaccgcaggacaagctggccaactgcgcggcggactgcgcccaggagtacgaacgacagatcccaaagctggaaaagtcaatagtagagcagctggcacgggcgtgatctgtgtgtggagtctgctgctgaagcagcctgtttccaacgcgcaacctcccgcatccatcacagctggtcctcccgtgggcccttcctgagcacatcagcgagctgtgtacactgatgagccaatcacacatatcttggtcggatggacaagtcgccataccgcaggccttgtataaattcgtgaatgagagaatgaggtctgaacgctggatgagcaccaggggcgcgacttacgagtgctcagctctgcacacagctgagaggtgaactcaatggactatacgtaaacaacctgttgttcgcgacttaatctctcagatagtgtcgacgccttgcaagctccccagtggagtggcagggaccggttgcacactgcccgaagtcgtcgctttcaacgacatacgagaccggcaagcagcacggtcgaagcaggaaggaaagcgaaagacggctgctggatcgaggtatatggtgtgcaccaaatgcgagaagaagctcgcaaaggtaagggagcaggtgtgggtgcctgcacatgggttcgtgtgggtcagcctatgcatgctcactctctagcatgtactctctcccggaccccatacccctctcaatgaagcaggtggcctgtcccgataagtggaaggacggagcgaacaacacggtggagtctgggggcaggaaggtgaatgaaaacaagatgctaagcaagaaacggggctggcagccctacgccgccaagtgcacactgtgcaagaacaatctgcaggcggggtacacctactgccagggttgcgcctaccgggacgggctctgcgccatgtgcggcaagaagatcctggacacgtccagttaccggcagtctaacaagtgagaggacgtccaccttgaccctggctctatcgattgtggccatggatgctggcacaagtaccctgtagcgctgcacacgaagcaaaggtgtcgttcctgcatcggagtaagaggaaagtcatacttgctatggcctgtccacgccatgatgcaggagcagcatggtaccggggtggactgccacggatgtattgtggcttgcagccagggagggcagaggttatgggcatgaacagtctggcgcatttgctggacaataccatgctttgagtgacagcgccttgcttgagctcgatttcaccaccgcaggctcctgcctggagtggcttgcacactcagaggcatgaaaaagtacagagatgcccgaggggtcatccaggaagcgtgagcctgtgcggtgaagagagggctgcaaccgatttgccagtccagagatcnnnnnnnnnnagcatgaacagtctggcgcacttgctggacaagaccatgctttgagtgacagcgccttgattgagctcgatttcaccactgcaggctcctgcctggtttggcttgcacactcagaggcatgaaaaattacagagatgcccgaggggtcatccgggaagcgtgagcctgtgcggtgaagagaaggctgcaaccgatttgccagtccagagatccctgcatagagtatcttccgaagggtccaatcttttggatgtcctgtgcaggatgtatggaggatgaggtttatatcctggcacccctaccatcagaaatacaacgccgtttgaggattcatattcactggagtgcgtatgacgtgagtggcgagactcaagatccattcgccgtcccttcagactttgagtccaggacgcctgcatgagacgatgtgctgcttcaaagtaacctgccgatacaaacttaaagacagacgggcaaccaataccagccatgcatgctgccaaatgaaagaatacggccgagaagctccaagagatcattccaggtagtattgatataggcctggcaggtcctctgcccgtgcgtgctaccaccttgtcgtccaattcgagggacagcattgtctgcgcagcgacccagttcctgcttgaaactgctcactgtacacctgtgctcggagatctcatcacttccaatgggtacaaaggatcatgctcactcctgatactcctgaagtcaaaattgtggtgagtgctgcaaggaaggatgcaacactgtgcctgaagggcctgttacggatctggtaaaggggactatgtagaatccgtcagagaaccgttaggggagagacgggcatcggcactatttgcgttgcagaccacgtnnnnnnnnnnataagttgggttgaggtggcagggttgttgatactctgaaagtagatatcaaggtaattattgttgctgtaagcggaacaggtcacaaaggctgcttcaaagttggtcgagatcacgaaactgagataaaattcattcactgtcatagaaacagaccaggttccggacgaactattcaaatctggcagtggggagggagattggctgggcgagggagattggnnnnnnnnnngtaagttgggttgaggtggcagggtttttgatactctgaaagtaggtatcaaggtaattattgttgttgtaagagcggaacaggtcacaagggctgcttcaaagttggtcgagatcacgaaactgagataaaattcattcccagtcatagaaacagaccaggttccggacggactattcaaatctggcagtgggaggggagaggggctgggcgagggagattggctgggcgagggagattggctgggcgaaggggatgggccttgcaaaggtgacgcctcactggagtcagtggaacagccggcatctgcggcggtcttccctacttcagaaagttcagtctgttccgaggaagctgctgtgctggaggtgcagcctgcgactgcctgtgagagcacaatgtggaatttggcatgtgagtctgccctctcagggcgcacttggccctgcaaaggcggcatctcgcacccaaattgtagcttcttgaccccgctgctactgcagccactggctcatacctnnnnnnnnnntatctcgcacctagattgcagctttttaacacgctgctactgcagccactggctcatacctttgctccagtgctgtcggttgtggcagcaccatatgtagaggcctccacgggtcctgccgccgaactgacggccgtggcagacgcatcagtgcttgcagtctttccaggacctgtggtcaagccagagaagccactggtggcgttggcaggaagcgtaccgctgccaacagcctgtatgaagataatgttagagttgtactcttgaatagatacacaatggagtcttcgttggattagcgagagtactttcgcccatgggatcagttccaccctcggtnnnnnnnnnncgcagtcttcccaggacctgtgttcaagccagagaagccactggtggcgctggcaggaagcgtatcgctgccaacagcctgtggcaagattgtggtgaagatttgcccctgggtgaatacacaaggatattttcatcagatcaggtacagtcccttcgcccatgggatcagttccaccctcggttggctgttcataccgttgcagagccgagacctgtcactcccgagtcagcccgagagctccaggccttcagcctggcctccgccgttgctccctctccacaggctgacgcggatgccgttccggacgctccgatacccgaagacgtcgccgtacccacaccgcccgagacaacgccatccgacgttccctggagattcacggtaccttgtagcgtcctgcagtcacacgggtatgaccactcagcgtggcgtcgcactcccgcccatcctttcccctcctcctcctccggcgagggtgcctacagtgttgtaacccgaaacccttgcctaacaaacccgcccagataaaggcagcaatctcaccgctctacagagtgcatttgtagcacatgacgcccacctagagtcggcgggaactgaaaacgcgaggataagcatgagcgccgcgcatgaagggcgacggctcatgcacgccattgagaaggctcgtatacgaggtagcgcttacttgcacaacccttgcaatagtaaggtgcctactggatgaggttactcagcgcacgaaataggttcaataggcctcgtcatcaaggagtcgtccaaccttagcccacaaactcagagggagaggggggtgattgaactaggacgagacgatggctgacgttcgggcatgcggcagatcttgtgcagtccggtagcagcaccgagaacatgcaactcgccagactgcgatgtcgcctgtagactgactcggaatattgctaggtttcccacattacacaacacgcatgcagatgccaccgatccgcgcagaccgacgccacgattatgaccgcagcaggaaggcgcagttcagcacatgagattgcgtccgtccacaagatataacctgacatatctcaggtgagaactgcttgatggtgggcaaggataagttgcccgccctgaccggcagtagtactcgagaagtacgaagactcaaccgtgcgtgcccaacccatgccgtgcaaggcctcacacccatgcactttaaaagttcaggagcttgtagcaccatgcccagcttcgagaagagcacgagaaagctnnnnnnnnnnaccatgccgtgcaaggcctcacatccatgcactttaagagttcaggagcttgtagcaccaagcccagcttcgagaagagcacgagaaagctnnnnnnnnnnaagtatgtggaagtgtctttcaccgggtacatcaacaataggaaaggggtggaattccagcaggcctcacggccacttggggttaatgtcaggctggccacattctagtttccaaaatgagtagcctacactccctcaagtgtcaagtgtagggcttggcggggnnnnnnnnnngagtatgtggacgtgtctttcacctggtacatcaacgataggaaaggggtggaattccagcaggcctnnnnnnnnnnnnnnnnnnnnnnnnnnnnnnnnnnnnnnnnnnnnnnnnccaggtatccaagtactggacacattcttaccaggcttattctctggcaccttgatgaatctatgttggattagacatctccgtgtctcagggtgaacgggcattagatagaaagcataccgcataggtatgcatccaggaacttnnnnnnnnnntcaggtatccaagtactgaacacattcttaccaggcttattctgtggcaccttgatgaatctgtgttggattagataactccgtgtctcagggtgaacgggcattagacagaaaccataccgcataggtatgcatccaggaactttcagggaggcaaccttttcgacattcacggggtcagaatgatggagttagcccatcgcttcaccaagcaatgattttgccattcatcaagagcacctgctgctgcaccctgcatcgttcagttgagagatttctagcttctagggtgctcctcttctcccctcgctaaggtagattctaaacctgatggcgggaatgtcgagcgcgagtccccgctcaccacggtgagatcttacatctgccatgcacctacatatctagagcaaaatgcatattgattgagcagataaagaatcgtagcgtttgggtatgaataaattgtgaacgcgtgcccacgcttcgcttctctccatcccttccctggcgtccgttgcgggcaccttgaagaatggcgatcagcaacttcgttatcacaataggtcagacaaattcgaggcatgcattcctataatactcaatttgcttgtgaggaacccacctccctgtccatcctcattccactcttgcagtgggactcggggccgtggcctacctcatgaagtcagacatcaggggttcctcggccatgcttcgacgaaatctcaagcacatcaggggctggatggaggagcaaggagcggctgcagagtgcgttgttttggcaggagggaggtttggtgaacatcgcctcaaggggtggtggtcctcctttgctgcactcatacagggaggagggtaagtgctctttctggatcacgtcccttcttgtnnnnnnnnnntttcggtgaacatcccctcaaggggtggtggtcctcttttgctgcactcatacagggaggagggtatgtgctctttctggatcacgtcccttcttgtgaaacccccaaccaacttcaggcagaccatcagcaaggaagccaagcaggtcaccgaatccaagcccgcgcagcagccgcccgtacgagacccagccaagcccgaatagcgccctcatgtcccccttgtcatcaccacaacgtacaccttcagcgccggggccggcactgcgcccctcactttggcaacacatttccctggctgatcttccaaatgggttgaaaatttccgtattgcaatctgcctgtggaaagcnnnnnnnnnnccacatttccctgactgatctttcaaatgggttgaaagtttccgtattgcaatctgcctgtggaaagcccacatcaggctggcgcgggtgggaaaaccaatctgtgcagtgtgtgacacagtcgagtccagtcctaccaccgtgagtgtggccggctcacatgaggggttgatgaacgcagaagtaggctcagtcatgtccagcatttggcagctttccggcggcagccagagcctgcttctccgcctgagaatggacgcttttgggatactcgtcctggaaccgaaatccccaaagcaatgcctttaagatatgctgctcccaggttttgaaaaggcacaaccnnnnnnnnnngtttgggatactcgtcctggaactgaaatccccacagcaatgcctttaagataggctgctcccaggttttgaaaaggcacaaccaccagacagcctgcttctcaaccttcctacctcgcgaaacttggcgaggtagagcttgagcggctcgatgtagtcatcaaagcccagtgtgcacatcgcccaaagcaagtcgtctccggtgatggttttccgcttctcccgctgacacttgtcacttgctctgcatgggacacgagtgaggtgtatgtggtgcatcacaaactggtggtttcccgatgtgggaattccaggatccccaacgtagacgcctgagcacctgtgacaccaacaccatttcctacacagtgctgattccccagacagctacacccctctgtccttggtggccccaccccactgctcccaaatccttcaacgcgagctggggcaagaaacctcaactaccccgccaacaccaactcactcgctggtgatgaaggaaatgaactccgacacgcactcctgcacggactccttcgcatcctttgcaatcttcgcattcgccggaaggaattttttcatgtttcgactaatgttggcgatgggcaggaacctgtcctgctccctgcagcgtcaggaaggagggatgggtcacccgatccgaatagggcttggcttggtaccagctacccaaccactcctccagtcacttacttgctccccatgccctcgtctcccgagttgtcggccatttcgcagaccttgatccgcttggccgggttctcctgagtttccactgctcctggctttgatacaagtctctggaagtgctgcgagcctggctcgtacaggcaaggtcgcccaccgtcccgagacagccagacggcgagtcggcttcctcaagataatgcaccgtttcctgctaagaagtgtcacagccctgcagatggagctctagcgagcgacttaccatttggcatcccgatgtccccatggccagcacagcagcagctcaaagcatgctatggcccgggcaacttggtccatacggtgactcctgcgctggaccgtccatcctcgtgctctcagcggggtggaagtagctgctcgggacacgctgagcaagcattttcggaaggcagcagattggtgtttaagtcgctcaagctggcggtgacggtcgtgtagcgaaattgcacggctcgccgggacggcgcaagagaagaaagcctcgattgtccttgtgcccaggctggaacatccaataacagtagacctttttcgcgaccggtatgggagtgccggcattctaccgctggctgagcaccaggtgagtaccagggcggctctgacaacgatctttccgccaggcagtgtgtctggggatgcggtttaggttcgtaaacttgctttgcgatccttctggcggcccattacacaccccagtcgagctcttctttatgccgctgcctcctccaaccactgccctctcccgtctgtgttcccagataccccaaggtggtgaaggactgcatcgaggaggaggtgcagaccatcggagatgtgnnnnnnnnnncgtctggggatgcggtttaggttggtaaacttgctttgcggtccttctggcggccctttacacacccctgtcgagctcttcttcatgccgttgcctcctccaaccactgccctctcccttctgtgtccccagataccccaaggtggtgaaggattgcgttgaggaggaggtgcagaccatcggagatgtggaggtcccggtggacacgtcgcagcccaacccaaacggcatggagtttgacaacctgtacctcgacatgaatggcatcatccatccctgcttccaccccgaggacaagcctgcgcccaccacagagaacgaggtgagtggtcttggcctgaggtcgatccccgggtgtgcaagccctcaccatgaccttccttcgtgtgcacaagcctgcttgagctcgtgcatctgggctttggtgcgtctcaaccaggctcggtggttcgacaggcctggcggtgtgcccctttgcctgggccgcaacacggcatcgactcccaccccccaggtgttcctggcgatatttgactacatcgaccgcatctttgccatcatccgccctcgcaagctcctctacatggccattggtgcgataggagggatgccatccaagggaacccattggattgggtgctgggccctgtgccctgcaccctctacccggcgggggcaccccaactctcaagggattgggttcagcagcgtcccatcccggttcccggccctgtccgcataccccattccccactttcttttcgccctgcttccagacggcgtcgccccccgtgccaagatnnnnnnnnnncccctctacccggcaggggcaccccgactctcaagggattgggttcagcagcggcccatcccggttcccggccctgtccacaaaccccattccccactttcttttcgccctgcctccagacggcgtcgccccccgtgccaagatgaaccagcagcgctcgcggcgctttcgggccgcccaggacgcggaggagaaggcgcgggaggaggagaagctgcgtgaggagtttgccaagcaggtcagggggggggctctctcacaggtgcttgaagtgtgctgcggatggattgctcacagactcgtcgccgccacactggtcgcctgcgggcgtgcctggcctcctgctacgcagccctgggttcttaggattgtccagggcgcgtggaaaggcatcatgttatggcaattcccccctacttgcccagcccctgtgtatcctttccaccccccgccgccatctccaagccccaactctctccgctccgccctctcaggnnnnnnnnnngctcatccccgtcattctggtcgcctgcgggcgtgcttggcctcctgctacgcagctctgggttctaaggagtgtccagggcgcgtggaaaggcatcatgttatggcacacaccccccctgcttgcccagcccctgtgtaccctttccaccccccgccgccatctccaacccccaactctctccgctccgccctctcagggcatcaacatccccgcccgcgacgagtcgtcggtgttcgacagcaacaccatcacccccggcacccccttcatgcaccgcctgtcggtggcgctgcagtactatgtgcacctgcgcctgaactccgacccgggctggcgcggggtcaaagtgctgctgtcggacgccaacgcgccgggggagggcgagcacaaggtgatgacctacatccgggagcagcgtgccacgcccggccacgaccccaacacccgccactgcatgtacggcctggacgcggacctcatcatgctggcgctggccacccacgagccgcgcttcgtgctgctgcgggaggtggtcttcacccccgccccgcctgaccacggccgcagccgcgccttcccgggggggggccgtggcggcgggcggggcggcgcgcacgacggcgcgccgccccaggccccattggccccggtccccggtcaggaagagatcaagcgggaggaagcggcgcgcaagcccttccagttcctgctggtctccgcgctgcgggagtacctggcgctggacctgggcgtccccacgccctggccgctggaccgcgagcgcctgtacgacgacttcgtcttcatgtgcctcttcgtgggcaatgatttcctgccccacatgcccaccctggagatcnnnnnnnnnntctgtacgacgacttcgtcttcatgtgcttcttcgtgggcaacgacttcctgccccacatgcccaccctggagatccgggagggcgccatcgagctgctgctggccacctacaagcagacgctggcggccacggggcacctggtggacggcgcgcatgtcttcctggaccgggtggaggccttcatccaggaggtcggcaaggcggaggacgccatcttccagcgccgggcgcgcatgctgaatcggcagaaggtgcgtcggtcggggagtggggggatggagaggggggtgggg

SEQ ID NO: 41222 - DNA, 1246 bp, Chlorella protothecoides
  modified_base (109)..(321): a, c, t, g, unknown or other
  modified_base (490)..(561): a, c, t, g, unknown or other
cgggaggagcccggcgccgccgccgatggcggcccggcctcgctggcgcacctcttcgcgggcgagctggtgcgcgccgccgcccgcgctgacgtggcggaggcgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgcgggggaggctcacgccgccgccctgctgcccctcgcactggcgccgggcgcccccgcctcgctgcgcgccgccgcggcggcggccctgaatgacaagaccgcggccgccctgggcgacaccgggctggacgcggcggtgtcggcgctactggctggccccggnnnnnnnnnnnnnnnnnnnnnnnnnnnnnnnnnnnnnnnnnnnnnnnnnnnnnnnnnnnnnnnnnnnnnnnnagcgaggaggtgcgcgaggccgcggcggctgcgctgcgccgcctgtcgctgggacctgggctcctggccaggcggctgcgggccgcggccgggagcgccggcgagccggtcccgcagacgcccgtcaagcggcgcaaggctgctgcctccttgcaggacgacaacagcgagccactggcagggggggttggttgggtcggtgctgtggtggctgcttcctgcgcaggcgcctcgctctctgctccagcgggatcgcggtgatacgccctgaaccccgctcgagcactcccccctcctcacagaggcggcggtgggagcgtgcctgcccgtgctcgagctcatgcagtggtaccccgcggcccgctcgcccacgtcaggcgagcttgtgccggccctggaggcgctgctgggccgtctgattgccacagacacgaccgcgacctcggcaggggccccgaccccggcgtcgaccgactacgccgcccagctggtgctctcagcgctggaccgcctggcgctggccggcgccgacccggcgcctgcgctggacctggcaatgcgctgggcgcgggcggcccccggatccggctccctggcggcggcgctgcaactggccgccagcctgacggccgccgacgccgacgcgacgctggcgttcgcgctggagctggccgccggcagcgcc

SEQ ID NO: 41223 - DNA, 79 bp, Chlorella protothecoides
cttttagaatcggggcccccgccgtgtcgcagcggcgtccccagcctcaccatgttcaaagggagttcctacacggggc

SEQ ID NO: 41224 - DNA, 138 bp, Chlorella protothecoides
ttcaggacctctgggcttggcgccgaggggaacaggcctcaggaacccggggggcgccatgctgccccatgcctcctcccagcagcagcagcccgccccgccccagcaccaccagcagcagctgatgttcatggcggc

SEQ ID NO: 41225 - DNA, 144 bp, Chlorella protothecoides
ctaggggcaggggagccatgtctgagcaagtagcagaggagtgtcagagggaccgtggcgaaggatttgcaaaagggcgagggggcacagagcacggatcaaactgccagcccgggcccaatcatcatgatgataaacacacgc

SEQ ID NO: 41226 - DNA, 61 bp, Chlorella protothecoides
gcgggggtgagggccagcccgtgacggggcacaacgattctcgtacacaaggggctggttc

SEQ ID NO: 41227 - DNA, 61 bp, Chlorella protothecoides
accctccccgcctccccctcacctcgatacacctgcaggacgtttgtggaccaggtggcgc

SEQ ID NO: 41228 - DNA, 8830 bp, Chlorella protothecoides
  modified_base (252)..(261): a, c, t, g, unknown or other
  modified_base (804)..(813): a, c, t, g, unknown or other
  modified_base (1181)..(1190): a, c, t, g, unknown or other
  modified_base (1833)..(1842): a, c, t, g, unknown or other
  modified_base (2122)..(2131): a, c, t, g, unknown or other
  modified_base (2907)..(2916): a, c, t, g, unknown or other
  modified_base (4060)..(4069): a, c, t, g, unknown or other
  modified_base (4471)..(4480): a, c, t, g, unknown or other
  modified_base (4813)..(4822): a, c, t, g, unknown or other
  modified_base (5033)..(5042): a, c, t, g, unknown or other
  modified_base (5536)..(5545): a, c, t, g, unknown or other
  modified_base (6008)..(6017): a, c, t, g, unknown or other
  modified_base (6406)..(6415): a, c, t, g, unknown or other
  modified_base (7571)..(7580): a, c, t, g, unknown or other
gggcggcgccgcggtgcccgccggcaacggcgcggtgggcaccggggccggcgatgggggccgacgagacgacggcagccgagagcgacggcgcgaagagggtcgagagcggcggcgaagcgggagccgggaccgcaagcggagcgggagcggggagcggcggcgcgacgaggggcgagagcggcggagatcccgttcgccgcaccggcgcagcgggagccgggaccggaagcggcgcgacaggtgggtgannnnnnnnnnagatcccgctcgccgcaccggcgcagcgggagctgggaccggaagcggcgcgacaggtgggtgacaatgagggaggaaagggccactgtggccgagtcgatactggcccatccaggctgatctggacagggggattaccatgggctgtcaccgcgtccatgcccggcgttgccattgcagtctctgtctcccctgcctgcacccttgaacgccctggcttgcctcccaccaaccgaccgcgcaggagccgtgacaagggcaaggagaggcacaagtcctccaatcaccgccggtcgtcccgggagcgcagggccagggaggagaggaaggcctctccaaaggcagaggcaccgcctgtggttgcacctcctccatccagggacgagctggaggacctgtttgcggagcttgaggggtgacactcggtgcatggaacgctgcgggtggtcaaacagtgcagttttcgacccttacagttgtaactgggtgcccccgcgaggctgggtgcacacgagagaacaagggtgtatgcatcagggtcgnnnnnnnnnnaccttacagttgtaactgggtgccccgcgaggctgggtgcatatgagagaacaagggtgtatgcatcagggtcggccaggccagcccttggagttgccacgagggccgggcccgcgtggaccctggggcgcccggcgcgcaaagtaccatgaacaaagccgggccgttgtgcatccctggccctctttcaacgagtgtcgtcgacccttcaaagttgtttttggattcagggcagcagcagcaatggcgaacgacaaggcaatcaaggtgggcctgggcagccgcacactcgggcagggaaccccctggaagatgccatgccgcgtggacagctgagccaggcaatgcgcatgctgtggacacatgannnnnnnnnntgggcagggaaccccctggaagatgccatggcgcgtggacagctgaaccaggcaatgcgcatgctgtgggcacatgaaaccgatcgtctccccgatgtaggctgccatcaaggagggaggcaagaagggcgtggacctcgcgggcgtgtccgcgatgggcggtgtctgctttttcaacctggccgtggagacccctgagggcgacctggacctcctccaggctgtgatcgacggatccaacaccgaggtggatgagagcgctgaggagcgcaagggaggagccggggacatcggtgagcgggctcagctggttgggtccagggcatgcagaaagtccccgcccctggcgcacctccgtcctcacgcccggcactggccccctccccgcaggcaagatctttctctctgctggtgacaagcagctggccatcatcgcccatgtgcccaaggagctgcagaccaccaagaacgtcaccatcgatgagtgggtggcggctgtgaccaagcccctgggcgatgtcaccgtgagtgatgcacgtggctgtggtgccgggggatggcttttggggtctcgctgtcaggggatgggagggaggacaggtgggtcctggtggaaccaccgaggccgagaggctgcagggtnnnnnnnnnngtgcacgtggctgtggtgccgggggatcgctttttgagtctcgctggcaggggatgggaggggggacaggtgggtcctggaggaaccaccgaggccgagaggctgcagggtcgagaggacggctggagtccgtcaggatcgagaggacggctggagtccgtcaggatcaacgcagcgtgcctccctgcatgcatgcggagttccttgctcctccaccagcccaatgcgaaagctcttgttcctctcaacccctcattgacaggtggtgagcaagaccgannnnnnnnnnagagttccttgctcctccaccagcccaaggccaaagctcttgttcctctcaatccctcattgacaggtggtgagcaagaccgatgagctgatcaagatcaccgtcgccggcaacgccgagaagggtctgttccccctgaagatgcgtgacgaggccatctccgctggcttcgccttcctcaaggagaagggcctgatccccatcgccgactcctccgacgatgaggtcaactacgccgaggccgccggcgtcgagtggtgattgcaggggctgaaacgcggttcctggtcagatcatgtagcactgcagcttgctctggggggtggccgagggctacacacttctgtaatgtcaccccttcccatgcgtgagctgttgaagctctgcatcgggcagcaaagaggttggatggggctgtcatgatgacgccgggattgagagtttgaacggatacagagttcaggatgcctccaagattccggtacgtccgtggcctggtccatttctcttgcaactattgccagacaggggttggccttacacagtcgagacggctcagccatgcagttgggaaattcacagccatcccagtacagaggcagagcggagcggcatgtgcgtggcagcaggcgaggtccagacttgggctgtagcagggcccgaacccttgcacagcaaggcacacctcccgtgattgggcgaggttgtggtgctctgcgacgcgcaaatgcaaatctacgccgcagccgcctccgcgacagtctccacctcgctcnnnnnnnnnnactctgtgacgcgcaaatgtaattctacgccgcggccgcctccgcgacagtctccacctcgctcactgactccgcctccggggtcccggcgtccttggtcccaggcgccttccagtccaggggcaggcgatcatacctgaggcgaggaccaaaggacgggatcggatgcaggcggcgattcagcagcaaacgggcgagtacaccgctccacatcaacacctgcatggctcaccctccccagcccgactccaactgccctgggcttccgtctttgccctctcaacccacacacatctgggtgatggccaggaggtctgctgactcagcacgcagctcatcccagatgctactgccgcccacccgccacgcccagttccccgccgccttgcccggagtgttcatcctggcggagtcgtccagccgcatcacatcctggcaggaaagcggggatgtgtgaggggttggaaggagtgtgcatggtcgagagtcgcggccacggcttcagaaaaccccccttgcgcctgacagccgcgccgccatgcacctgcatggccaccaccacggtcctggcgacggacttgtaggcctcccggatgaacgcccaggagatgtcctgtcccgcctcagcgccgatgtatcgcgcaatgaggcgcgcctcctctggccggcacccggccttgtaccagcccagcaccgtctgattgtcgtgcgtgcctgaggtggcatggggttgggaagaggtgagcgctttggcgggcgtgccctcggcaggcgcgcggagggcatgcgtgcacctagccaccgcgtctccgctcaagcttgccgcacaccggggtatacgaagctgttctggtagatgttgtgtggcaggtgggtgttggtcgcgccgccgccccaagcaaactgcagcacgaccatgcccggcgctccgatggcctccctgcaggacaagtggagggggacagggcttgtggagatccagctgacagtcgagcgcctgagaagcacccgctttgcattcttatcggctccctttcccaagccacattccaacctgaagccacatttttgtcctttaaacgccagacatctctcattgccatgcacaacccgagtacccccatgctggacaaatggcatgaannnnnnnnnntaacgccagacatctttcgttgccatgcacaaccgaagtacccccatgctggacaaatggcatgaacccgctgctgcatcccctctccggcctcacactgtgcagggcccctcacaatcaaactcacctcagcgccgtcacgtcgggcgtgatcacacccaggtcctctgccaagatggggacgtgccccagcgccgcttccagcgcctcaaacagctcgatgcccgggcccttcttccacacgccattcatggctaggtttgcgagtggtttggaagggcaattgggtgggtaagcacgaggggtgagaggcagaattaggtgccactgctactcctcagcaagcagccgccggcacgcccaaagctagcccccctgtccccccgccccgcctttgcacannnnnnnnnngcaggtgccactgctactcctcggcaagcagccgccggcacgcccacagctaggccccctgtccccccgccccgcctttgcacacccgtctcctcctgggcgcctacggcccagtacccggcaaaggcccggaagtgatccacccgcgtctcgtcgtatagctggaggctgcgctggaagcgctgcacccaccaccggtaccggtcctcgctgtgcgcctggcgcatgggtggagggggggcgaaggtggagggggtgaggggtgacgatggtgcctggcagcagtgagcctgggcgtgacgggtgtcctgcgctggacgcccaaccaggtgnnnnnnnnnnagggcgaaggtggagggggtgaggggtgacaatggtgcctggcagcagtgcgcctgggcgggacaggtgtcctgcgctggacgcccaaccaggtgatgctcctcctgctccagcatcacgccttcttcgggaccagggcagagaggcaggtgcggcatgcgatctcaaccccctgcacagacccacctgccagtcgtagagggggctgccnnnnnnnnnnaggaccagggcagaggcgcaggcgcggcgtgccacctcaaccccctgcagaaacccacctgccagtcgtagagggggctgccccacagctggcccgagtcggagaaggcgtcggggggcacgccagagacttccacgggcgcgccgtctggccccagcgcgaacagtgtgcggttggcccagacatccgcggactggccgcccacgtatatgggcatgtccccgatcagcagcacgccccgatcgttggcgtaggcctggacaaggggtgcggggggtgggttggggtgtagagatacggcgactgcatactgggcttccagcacagtagcaggtacaagagtgggagggggaggcagtctggtaaggctgtcaatgcccgcatcaccgaagattcccctactgtgcacccccaccccccccttttgcttctccccctgccccaacacccatccctcccccagccatccccctcccttgcgcaagcaccttgannnnnnnnnnacccgcatcaccgaaaattcccctactgtgcacctccccccccccttttgcttctcccccttccccaacacccatccctcccccatccatccccctcccttgcgcaagcaccttgaccgccttccagaagcggtcaaagaggtactgcagggcgatgaaggcgtcgatgcgcccggcatgctcgcgccgcgcggcctccagcgcggccgggtgcctgtcgcgcacgccctcaggccagtcccaccaggccagtcccgccaggcccggcacctcggtgagcgcgctgaatagcgccgactgctccacccacgcattttcctggcggaacgcggccatctccctgcgtgggtgaggaggaggatggcgcaggggccgaggcgggggagcgggaggcgggaccaggctcccgtgcatggacgcgcgctccgaggcaaacactggacccatgcgctgcctgacccannnnnnnnnntgaggcgggggagcgggaggcgggactaggctcctgtgcgtgaacgtgcgctccaaggtaaacactggacccatgcgctgcctgacccagcgggcatgaccccatccgccacgctttccccaatgccacctcacgtgtgcaggtcggcaaacctcgccgggtcggccagcagcaccgcggcggccttctccagcagcggcatcttggcagcgtagacggcagggaagtctgggatggaacggggggggttggaaccagtgattgtaaggacttggcgaaccagagctcgggccaggtcatggctgtgtgagaggctcgattgccacccccatgaagtagtctccaggcattgtcacagacggcagcggggcgtgcagacctgcgtcgcnnnnnnnnnnggaggctcgattgccacccccatgcagtagtctccaggcattgtcacaaacggcagcggggcgtgcagacctgcgtcgcctggcggggaagggaccgggaggtccgtctccttcagcagccccaggtctttgaggccgttcaaggggatgaggagcgggttgccgcagagcgcatccaggccggagtagggcgaccaatactcggtctccggcgggcacaggggcaggagctgcgggggtcgcgaaaaggggggatgaaaggccgggtggaggggttgaaagggcagtattctggaagagactttatgggaaggtcgacgggaacccagctgatgacaagcagggtctgggctcccaggcatcaacacaccatccatgcagggagcatggctcagcacgcagggtctgtcactgacatgcaagcgaaatccatccaggcatggcgtcacagcgctcgcagagcccgggcccacctgccagatctgctgcccggatgccaccagccagtccacaaaacggaaggcctcctccccaatctccccgatgccgtagggaccggggagggaggtggggtgcaggatgatgcctgagcgtcgatgctttgggggagcagaggggggctcgccatacccctcgggcaggggggcgcccttggccagggtggggaatgggtcggggtgagaggctggggtgacagcctctggggacagatcagggcctatagggctggcaacgcgagtgctgattcggcgatgggagacgaatgcaagggaaggcctggatctaggggaccatatccgcaggaatggcgctggggtgctggcgatggtcattggcatggcccgcattggaagcggggccttggcggaagggaaacgccagtcactcaatggactcgatttcctactggcgtggtatacaactggtaatgatgagctcgaccgattgggattgttggcaggggtgggatgtggtcacggcgtggtgggtcgttcccacctggggtccactggttggagtggcaagggccgaaacctgcacttcctaccccaagccgttcgaacacgccgggtgtatccagcgatcaaccgtattggccagtatgtgtccgctgtcatggacctacgattggctcgacgcgattggcgttgattcnnnnnnnnnntgggtgtatccagcgatcaaccgtactggccagtgtgtgtctgctgtcatggacctgcgattggctcgacgcgattggcgttgattcgccagacgaacagctcgaacgccaggcgcgctcgagttctcattagaaagcggggaacgagcgagttttacatcggccgccctgccccctcccgccaggaaaggacccagcctgcgacagtgggcccctctttcaccgcccagtctcggaggtgtataaagtagcgcaatggccaaggaggcagtgaagcccgccggtggccgcggccgctctctgagctacaagaagcggtgaggctggaggggagggtcgagagggccttgaggggtcgctgcgatgggggatggggagcttacatgtcctgatatggtcttgttcgagcgaccgctcgcgagtggtcgagcgctgcccggatgcccgggagggtgggcagttccgcacccggcgctggattccggggtggccagagtcctgtctgtgtgggcgtcccgtgcgccgcggttcttcactgaaatagcgatagcagcttgcatggtggacccgtgttcagccgcgcacgccctctttaggagggctccgtgctggggccaacccctggacccagagccctcacccaagccccggtcctttaaaacccctcctccctccccaacccgcacgcagtggtctgtgggccatcaagaagaagaatggcggcactttccccgtgcacgccaaggccgagaaggccgaggtggcggtgaccaaggccccccgcttctaccccgcggaggacgccaagaagccgctgaaccgcagcttcgtgcgcaaccccaccaagctgcgcgcctccatcacccccggcaccgttctcatcctgctggccggccgcttcaagggaaagcgcgtggtgttcctcaagcagctgccctccggcctgctgctggtcaccggccctttccgcgtcaacggcgtgccagcccgccgtgtgaaccaggcctacgtcatcgccacctccaccaaggtggacgtctctggcgtggataccgctgctttcactgatgcgtacttcaagtccacggagaagaagacgcgcaagtccaagggcgaggccgagttcttcgaggacaagctggagaaggcggcgctgccggcagagtacatcgctaaccagaaggctgtggatgcctccatcctgtctggactcaggtggggagccagggtttttgaggggggctgggggg

SEQ ID NO: 41229 - DNA, 78 bp, Chlorella protothecoides
cttcaggtccatggggaagaagccggcctcgtgcctggatgtccgggcgggtgggatgcgtggttaagggatgcgagt

SEQ ID NO: 41230 - DNA, 116 bp, Chlorella protothecoides
cgccaccgcactgtccaggatgatcatctgatggagtggggatggaggtggagggaggagggaagctgggctttttgaatctggggaatgcggggcggggcaggggtgccgggggg

SEQ ID NO: 41231 - DNA, 510 bp, Chlorella protothecoides
ccgcggcacggcggcttcttcgccggggttctgtgaggatgaggcctccgggtcgtgcagccggcgcaggcccggcgccatcagcccagccatgagtgtcgcggtccacgccaccaccgacagcggccggaggggggacgcatgccggtccaggacctcggccatgcggaagaggagaggggaggggcgcttgctgcgccgccggtcccgcggcgcgccgcaagcctggggtggggtgggtcgtacgggtgttcaggctggaattgagctgcaagaggagtgtggggagcaaggggcaagaccacgccggggccggcagagcggtgcttgcacaccccagcctgccagcccattagcccaccagcccgcgcccacaaaactgcagtggtggcctccatccgcccacgtccctctcctcgtggcagcgcacgcatccaagacccgagcactcctcagtgcaagctcctgttcctccttccaagcactctccccactctataaccccccccc

SEQ ID NO: 41232 - DNA, 61 bp, Chlorella protothecoides
tcacccccccccttccccaatgcacaggtacctccccgcggcccgggcagttgccttcaac

SEQ ID NO: 41233 - DNA, 76 bp, Chlorella protothecoides
gagcacgaggtcggccgcctccacggcgacatcggcgccggagccaaccgcgacgcccacgtcggcggcggccagc

SEQ ID NO: 41234 - DNA, 70 bp, Chlorella protothecoides
ctctgccccaccgcccgctcatgctgcatgcagcagggtatgacggcagggtgaggcaggacatcgcgca

SEQ ID NO: 41235 - DNA, 61 bp, Chlorella protothecoides
gctccccttccacggcaccgtgggcttcgcggtgctgggcgccgcgccggacgccggcgca

SEQ ID NO: 41236 - DNA, 61 bp, Chlorella protothecoides
tccagcacccctgagcgctcccttctcccccttgtaacaggtgctcaactcctgcccccgg

SEQ ID NO: 41237 - DNA, 61 bp, Chlorella protothecoides
actggggttcaaggagaaccacaagacccttcaggatgcagggtttgaggtttacgggctc

SEQ ID NO: 41238 - DNA, 61 bp, Chlorella protothecoides
aatgaggagtaaccatgtccagagcggcggggaggtcttgtgggagggatccccgccatcc

SEQ ID NO: 41239 - DNA, 61 bp, Chlorella protothecoides
gcacaatgcggaagggatagatgaggtcccggtgtatgtagtgcacgaggaacatggccat

SEQ ID NO: 41240 - DNA, 97 bp, Chlorella protothecoides
aagtggacgaccagtccggcccgctggagttcttgtctatgatcgcgcgcctctaccggcaggacatggatgccctggtccggggggacacctccct

SEQ ID NO: 41241 - DNA, 66 bp, Chlorella protothecoides
ctgcgcccgcatgctggcgtgcctcgggtcctgatacagtgacgtcgtgattacagagcgtgccat

SEQ ID NO: 41242 - DNA, 61 bp, Chlorella protothecoides
accagcgcaaaggcgggcgggcgcgtcagcacctgccatgtttgagggagggggagcttga

SEQ ID NO: 41243 - DNA, 79 bp, Chlorella protothecoides
ctcggacctgtgtcaccgagcgggcccagtatgggcactcgggcagttcctcctgaccctcatcgccttcaatgcctgg

SEQ ID NO: 41244 - DNA, 61 bp, Chlorella protothecoides
gagtgtgcggacattctcgggcatggccggtggaccgatcgagatctccatcaaggagtac

SEQ ID NO: 41245 - DNA, 922 bp, Chlorella protothecoides
  modified_base (303)..(328): a, c, t, g, unknown or other
ggcgccgcgccggggcggcctactgcgccacgtcatgcacgcgcacctggccggtgcggcgccggaccccgggccagcgctggctgcgctgggcggcgcgcaggctcggggcatggcgccgtcggccgcctacctcctgctcgcgctgtgcgtgcggtctggcgagggccggcgccgcctggccgccgagatcgtggccgcactgacctccgagtctgaagcggtggcggagccgagtgtcgcttcgggagaggccggcgccgaccccagcccggcgtccgaggaccggcgcggcgcgttcgnnnnnnnnnnnnnnnnnnnnnnnnnncggcgccgaccccagcccggcgtctgaggaccggcgcggcgcgttcgtggacgtacccgggcgcacccccgcgcacgaggtgcgcgtgctctgcgacctggcggcctcgctcctggcggcgcctgcctcgcagtacgcggcccccggggccgccgcgtcaccagccgccgcgctggtgccgggcgagatcgcgcgcgcgatgcgcgatgcaggcatggtccccgccctcgccggcgtgctggaccgcgtggatctcgaccaccccaaggtaggggaggagcctgtgtttccgttgttgttttgaggggggatggagaaggagggggaggagcgactgacgtgcagaagtcttgtgctgggctttggggtcgggcgacctgatcaccgacgggctccgtcgccaagcagcagacccttcctgtcgcacacaagatgccgccccccccccactcaaccccctttccctgcccacctctgtgcaggccatggaggcgctgcagccggtgctcagagcgttggacacgctgacgcgcgcgtcggcgcgccgcgcgggcggccgcggcgccggtggcgaggccgagggcgagggcggcg

SEQ ID NO: 41246 - DNA, 19181 bp, Chlorella protothecoides
  modified_base (1038)..(1047): a, c, t, g, unknown or other
  modified_base (1450)..(1459): a, c, t, g, unknown or other
  modified_base (1553)..(1562): a, c, t, g, unknown or other
  modified_base (1616)..(1625): a, c, t, g, unknown or other
  modified_base (2318)..(2327): a, c, t, g, unknown or other
  modified_base (3422)..(3431): a, c, t, g, unknown or other
  modified_base (4637)..(4646): a, c, t, g, unknown or other
  modified_base (4976)..(5045): a, c, t, g, unknown or other
  modified_base (6684)..(6693): a, c, t, g, unknown or other
  modified_base (6770)..(6779): a, c, t, g, unknown or other
  modified_base (6895)..(6924): a, c, t, g, unknown or other
  modified_base (7046)..(7055): a, c, t, g, unknown or other
  modified_base (8312)..(8321): a, c, t, g, unknown or other
  modified_base (9343)..(9352): a, c, t, g, unknown or other
  modified_base (9872)..(9881): a, c, t, g, unknown or other
  modified_base (10582)..(10591): a, c, t, g, unknown or other
  modified_base (11491)..(11500): a, c, t, g, unknown or other
  modified_base (11859)..(11868): a, c, t, g, unknown or other
  modified_base (13409)..(13418): a, c, t, g, unknown or other
  modified_base (13886)..(13895): a, c, t, g, unknown or other
  modified_base (14037)..(14046): a, c, t, g, unknown or other
  modified_base (14114)..(14123): a, c, t, g, unknown or other
  modified_base (14335)..(14344): a, c, t, g, unknown or other
  modified_base (14456)..(14503): a, c, t, g, unknown or other
  modified_base (15032)..(15041): a, c, t, g, unknown or other
  modified_base (15732)..(15741): a, c, t, g, unknown or other
  modified_base (17819)..(17828): a, c, t, g, unknown or other
  modified_base (18462)..(18471): a, c, t, g, unknown or other
  modified_base (18625)..(18634): a, c, t, g, unknown or other
gcggacgacggcgcgaggtacaagcgccgccggccgcggggagagggcgccggcaacggagcgccgaggcggtacgcgcggggcccgccgcgcgagcggcaggcctcgcccgactccagcgccgcgtcggccgacaccgccgcctgaggcgggaggatggtgttggcgtggagctcgtcagtcgcgtcggcggagacggggtggaagcttccgctgtgcgacaccgtgcccatctccagccgagccatgcggttttcaagccgggacgtcggcggcgttctgtcgcgcagagttcgacacccgctgatgcaccgccgagcatctccaccgccttcatttttgttgcagaggagcacccgattttaacgtctgcaagcagggtgcgccttgtctccatcccctcagcagctgcccgaccagacattgagctccccttgcctttccttgactgccccgcgagccctaagctggccaggcaggctgctgcttgccaatatccctggcatgccgtcccagctgccccttgctcaggcatgtaccctccccgagcgaccctgctgtacaccctatgctccctgttaccctgcactgtgctccccctgcacatgcagcctgccatgttggaaacgacgcggcttgcccgcgcagtatcgatctatcaagtttgggagaagggagagcgtgccaggtgtattgagtggcagcgacacagcagccgtcggttgtgttggagagacagagacgtggccatcgtgtcaaatggatgctgcccatgacgcctgtgtcacgtggcggagacgtagccgccgtcgctggagtccgagctgtggctctcctcccccatcgcagtcccccccagctcagcgccccagccaaacgggctgctgcccggggccagtgtggacgcgaccctggggctggccacgggggacatggccatgagtaggccagcctcgtcccgcgccgtgtccatgccctgcgccctttcctccaggggcatgatgcccgcggtggcggcggccgtggaggtggccagcnnnnnnnnnnggcctcgtcccgcgctgtgtccatgccctgcgccctttcctccaaggggacgatgcctgcggtggcggcggccgtggaggtggccagcgccgcccgctcctcggccggggtctccagcgcagagcccgcgtgcacgccgacccgctcccccaccctgaccagcgtctccagcgacttcctcctgtgcgtgtgaacaagggggtgggaggctgttgccttcgaatgcagaggaatctggggatgtagggagggacaacagcggtgggagggggggaggacctcctcgcctgggcaagtgtgcgtgtgtctgaggagttgccatgcgcagcttgggaacggtccttcctgggcactgaacctgcgaccctcccccgccactcaacccttcgatctcctcctcccnnnnnnnnnngggggggtggaggctgttgcctccgaatgcggaagcatctggggatgtagggagggacaacaccggtgggagggggggaggacctcctcgcctnnnnnnnnnnctcccacccctccacccctccttaacacccaattccccccacccgtactgcagnnnnnnnnnntccgacccctccacccctccacccctcctcaacacccaattccccccacccgtactgcaggaggtcctcgtcccagaccacggggtgggcgtccgggagcaggaggatgcaggtgctgccgccaaaggcaaagtagcccagctcctggcccttggccacggcgtctccgggccccacagtccacacgatggaccccaccagggtcgcgcccacggccacaaaggccacgcgcccaaactcgggcgtgtccagccacaggatggagcgcttgttctcggtgaacacgtctacgaactcgctgtggatggcgatggggttgacggtgaagagctcccccgggacgggggtgatggacaccacgctgccccccagcggcgcgtggaagcggtggtagtcctggggggcgaggcggaagatggccagggtgccgcgggcgtagggcgccgagagctcccgctcgggcgaggcgtcggccagcaggccggccaccgagaagcggcggcccttgatccagaaccgcgtcgcctcgtccacgctctcgtacacctgccggaaggagaggtggttgtggagcgtcagaagaggggccacgtgttgtcggctgtcacaccactggcaagggaatggccagcagagggagaatgctccaaggtctgggcacatctggcgccacgagctccgggcctgagccgnnnnnnnnnnagagtcggctgtcacacctctggcaagggaatggccagaagagggagaatgctccaaggtctgggcacgtctggcgccacgagctccgggcctgagccggaaacacccccgccctgtccatcgccggtcctcacgatgaggcggcagtcggcgcaggagacgatcacgctgtcttctgtcggtgaggcgatgggccgcgcccctggcttcagctccctgaagaagaactggttgaaggtccggaagctgtcgatggggtcccggatctgcgggcggaggagggtgtgaggtttcaggtagaagcatggctagggtgacaggagacgtgaccgcagcgatcgcgagcatgcggtgttgggatgctgcatagccgcctgacgtccgcacgggacctcccagaccgggctcagagcctcaaacatcaacccgccgtcatctggcacccctctgttcccctgcgcccccccttggcacctcggacaggttgaggtcgtccttgaagaggtggaggaatatagggatgtcctgcgatgggctttgtagagagcgctgagtgaaggagtgtgctgtgctgtgtgtcccaccacagatgtccgtagcctcctgcctgatacgccagcggatgatccctttggcaactggggtcccactttcacaagcagttcatccctgtcaatatcagcccccctttccctccctctcccatccgcccaccttgacactctccgggctgtccatgtaccgccccttggtctcggacatggatttcaggcgggcaaagaagccctcccgcatcagcacccgccccatgcgtgactgatacatgttgcgcatggccagcgacagcaccacgcccagcttctcctcgacgaccagccgcgagcggcggtccaccaccaagatgtgcgccgcctgggcgcccaggcgcaggccacccaccgcgtacttgttgccgcgcaggatgccggaaggcgcgccggccagggggtgcgtcagccactcggtcatacgcagcatccaggcacgggacgcctgctgcgccgtgctgtacccgccctgtggggaagggtttgcgggagggggggcattgatcgnnnnnnnnnntgcgcgggacgcttgctgcgccgtgctgtacccgccctgggaaagggtttgcgggagggggggcattgatcgagagggggtgagagggggcgggtacagcatactggagtggggagatgagggaatgggaacttcacattcacggctgactttgcggctggtggactctaacttggtgtcgcagctgggggatgccatgccatgaccgcaatagaacgagctttagtgggtccccagtcactgctgagagggtcctgccacttctaccagcctccatcccacccccaccaccccttttgaactccacctccacctccttccccgccgaccttgagcgtggcggagggcgtggtcggggccagcccctcgtccagcaccagggtcatgtagatgaggttggccaggtcctgaccggggactagggccgcgccgtcaacagggcagcgcttcatgagcgaggccaggtcgcccccgctgtgcacgcgcgtcatgcggtccgccagctgagcgatgggtgtggcggcgccctcagggtcagccacccgccgccacaggccctccaggtcgtgctcctccaggtcggcgccaaaggcctgggagggggggggaagaaggggtgacaatttcgcgggggggaggggttatcaccatggtagagtatccatgacacacagaggttcggcccagagcctcctgcggcacacgggacttccaaaccacccttccctcctttccaatgccccactcccctaaaccccccaaaacacacctgcatgagcatgacaaactcctgatcattcaggctgccgttgccgtcaaagtcggccagggggagcaggcgcgtccacagctgcgactccagggcgcgcggcgaggaggccgccgccgacaccttcagccggccggcgtgctgggaggccgagccgtcgctgccgtttgccgacagcaggtcgtgccagccgccctcgggcagggacctcgcccccggctcgttgtcaaagtaggtggcgaggtcaatctgacaccagcactgcaggagcgagagggtgtgatgaggtttcaggcagggatcttcccctctttccggagggactggcagggtcagctgccgggaacagcagcgcatagactcgtcctcaaccctgcacagtgtcaaaccaccttccacccatatttcctacctccaggaagttgttgagcgcgccnnnnnnnnnnctcgtagactcgtcctcaaccctgcacagagtcaaaccaccttccacccatatctcctacctccaggaagttgttgagcgcgcccttgtacttgccgccacggtagatcgcgacccgcgccagcgtcgggccggagcgttgcagcacaaagtggctgctggcctcccatgtcaggcacacatcctcgtgggcaggggcccgtatgcgcgcagaggtcagggtctggctgccgatggagagcacggcaaagtaggggcggtcccggcggacttgcaggagctgcgcgcagtgcagggtcagcttcagcaggcctggagcggcaaggggtgnnnnnnnnnnnnnnnnnnnnnnnnnnnnnnnnnnnnnnnnnnnnnnnnnnnnnnnnnnnnnnnnnnnnnnggacccaaccgtggacacgagcgctgtacctcggtctaatgcaccctgtaatgaccccagggaggcctggcactgatatttgattggtaggtcgcccccctctcctcttccgggcttctcaccgaaagtctcctcctcggacacctggcgggggccgtcgggaaagatgcgggagggcaagcgggcctgtggcagccccttccccgatgcatcgtgatcggtgtcctccgtgtgcagtctagagcgaggggccgctgcgtcctggccgtgaccacggcgcagcaacccagacaccttcctcagcatcgcgtgctacagagcatgcatggctcacagatgctgcatggggtgggattttcctgctacgaacgctttcacacggtgcttggatcgctgtgaacagtgccagatctgggtgcgctcggctgccattgtgattcttacaccggaacacgcaaggcgcgagatagtacagatgcatgaagcaacgctgtttgggaagacagcgcctgcgctccatgggcaagcgaatcatatgttgctttaaacaatgaactgattaaactctgtggaacttcacaccgccaaacgctcagcgagaggggcttcagcctcgcgacaggattcgtgtccccagagaaagcgcctaatcctgcatctgcacgcctaaaccggtcatttgtcgctcactggctcaaaaggatgtggagcaccgccgcatgcatgtccccgacggtgccaacgttcgagcatggacgccagctgcgcctcctcagcgggttggcaggggagcgtgtgttcaagcatagcgttgtcgggcccaggtacgagggaccccgtggtatgatctttggaagctacctgctcacatgtgacgccgggttgcctgcatcgactccttctggcctgaagggtgggacgcctcagctacctcgcactcacccttgccgccctcatcaaagcaggcgatgcaacctcaagcgcacaatccacgcctctgccaccacctctgggtctactctggtggaggaggaggtgtacatggaacgtttcaatgggtacaggcggcaaggaggtgaggagctatgtctatcgctagcaagggataagctcagaagaccttgcaatttacgagatgttcaatgagattgacaacactccgaccatagctgcataacgccagctccctccaaacacccaataatcaatgcagactacactccatttgagctgatcgagtacacagacaaggcaatgcagcacgagattgtcatgccggtggctgcagggatagaaaagtgctacagcatctggagtgaccgcctgaactggttgcagtggtttgacatgattgaagaggtacgttgtgtttgcaggggccagtcaccacctgcggcatgcatgctgaacggggagaagccgttgtcatccttattggcagggtggaatgccatttctggtggctctgagaaatgatcagatgatgatgaaggccagcgcaggcaagcaatcagattgttcacggcggcaccacattctaaggcatatttctccatgcaggtggggttccatgaggatgaccccagcctcgtgtctgccttctacatgtaccgatggggtgagcgcaaggatcctgtgnnnnnnnnnncccttgcagtttacgagatgtttaatgagattgacaacactccgagcatagctgcataacgccagctccctccaaannnnnnnnnnattgtcatccttgttggcagggtgcaatgccatttctggtggctctgacaaatgattaggtgatgatgaaggccagcgcaggcaggcaatcagattgttcacggcggcaccacatnnnnnnnnnnnnnnnnnnnnnnnnnnnnnntagcttgcctcggagtttcttaatgcaccatgtatggcaagtgggtttctgagacagacactgtttctcagtcatgaagggttggccctgtgatgcctcctcggacaagcatggcccctttnnnnnnnnnncagcttgcttcggagtttcttaatgcgccatgtgtggcaagtgggtttctgagacagacactgtttgtcagtcataaagtgttggccctgcgatgcctcctcggacaagcatggcccctttgtcaccctcctccgtgctgccaaaccccactcctgcccttcttacgtcctccaccccagcccgcacgccttacctggagttctacacgaccttcaagaggacagaggccgagccaaaccggtgcattctggaggaaccagtggagggcacccctttggttattgcagtcctgttccagacggtggaggaggccagggcccaagcgtctgcatctggcacagtttccaatgtcctggagggcaaggaaggcggcacagtcgtgacgctgcgcatctcctaccagctcgcaggtaggggtggaaattgggaggtgttcaagtacagtgaaggctagatcattgaatgagattggagggcatgatggccaagcatcatcagaaatgccttggttacacataaatgtcatatgatgtttgctacccttccactcggttccaccaccacatgcctcagtggtcctggatgagtttgccgggcagctggcggtgtatgctgacgtggaggagaagctgaaggcgtgcatggtgcgcatggcagcattcatcgaaaacgtggatgaggcggcgctggcagagtgccggggccaggaccagaccctgatcactgatggtgaggggaatcaaaagggcgtcggcggtggcgggaacaatcctaaatccatattgaatggcacaatcttagctcgaaaatgccacataccaaactgcaggcttcccggagcagcgagcgcggaggggggaggtggaagcagagcgccaggccgccatcgcggcccatgaggcgcgggtggaaagcgcgctggagtacgtcacgcaggagggtcaggtgatgcaggacgaggcgacggccgccagcgaggtggccgccgaaaaggcggtggttgcccagcaggccgcgcaggccgaggcggcggccgcggccgccgcggcgccggtcgaggtgaagaaggcgcccacgaagcgagggcgcaaacccaagaagaaggacgggaactgagtgtgaggctcgtggtgtgattcagggtcgcaagggtcgtggtctcctcctcatgccgctctgattggagactggccgaggactcgagcgcgcttcgagggtcagtccgggggcgagggcagcgggtcaggagggataannnnnnnnnntgtggtgtgatttagggtcgcaaggatcgtggtctcctccttatgccgctctaattggagactggccgaggactccagcgcgcttcaagggtcagtccaggggcgagggcagcgggtcaggagggataacctttactgtgtaattaccttcgtatctctgtacaaggaatgcaccgcagttacacatcagccacagagcgcactcaaactcattccatcacggagcgtcctggcggtgtgccgcatgaggacgaggcccatgggcagggccagcggcatcaccacggcggcggcgtgttgaggcgggaaagcggggcgcagcatcatgtcggggtgtgcggccagctccgcggcgcgggcaatggcggcggcgtgcgactggtttccgtcgcacagccccgcgtcggcctcctgcaaggccgccgccagcgccgggctgggactgcgcaggcctgcggcggccatcagccccgtcagcgagcgggcggctcgaccacggcaccaccgcgccagcccctcctcgtcgcgccggcccatccagtccgccacggcctcggccgcctgcgctgccgtctcctgcccccgacctcgcacgactatgaccaggtcgccatctgggctgggtcccaggacctgcaaggcagggtcatgcgggtcaaaaggggcctgcagcagaaggatgacggacaccgcgacctcgggggcactcatccccgccagctggagttgccaggcgagctcgcccagcgtcgacaggtcgccggtcgagcaggcaccctccgcacaggcgaggggtggggcgtgcaagggcttgatctgggggaggctgcctggaagagctcgtgccagttcggaggcgaggtatgaacctagggtgtggagccatgagggttcctcctcctcagcacccatggggacgagtgtcaccgcgatgacagggtcttcggcgcacgatgcagggggtctcgagtgggacccctcatcttcatcaagagcgagcgcttgcagtgtcaggcttgccnnnnnnnnnnaatgagtgtcaccgcgatgacagggtctttagcgcacgatgcaggaggtctcgagtgggacccctcatcttcaccgagagcgagcgcttgcagtgtcaggcttgccctgggaacaggaccacgggggtctacgagtgctctccaagccagcccagcgcctgcagagatgatctgggcgaggtgttaagctgtgccgcaggggggggggggaggatcgggaggatagtttacgcccccctcaatcgcacctgtgaggtacatcagccagcagctggccaggacgagtgccctggacgtgtacctgtgcatcctggcgtttcagattcatgctcacgattcgcgacgaaagatctggccgcggcaagctgtcttaccctgcttcgataagatagattcaatcatccttctttatttgaacatatgctgtatcactatttcatcgcaggtcggcacgggtacacacatttttcacttgcttgcgtatctgccccggggtggattctggcgggaaacaaccctnnnnnnnnnncaagatctggccgcggcaagctgtcttaacctgcttcgataagataggttcaatcatcctcctttatttgaatatatgctgtatcactatttcaacgcatgtcggcacgggtacacacatttttcgcttgctcgcgtatctgcgccggggtggattctggcgggaaacaacccttgatgtcgtttccttcggatagctcgttgcaggagctgatatctccatcactgggcgcgtctgaccccatcaaaatctgtgaattcgacatttcgtgagtgaacaagccatgcagtgcgcagtacaccgtgctggttcgagcttcctctccgagactcgtgtgaccgggagcgcgcacaaccactcgactctcatctggcccgatgccacgcgggcacgccagcatgcctgcccaacgacatgcaggatgttcgcgcgcacttcccggcccatgaagccgtccacatccaccaaggccatcaccagcaccgcgcccagggagttcaaatctcaatctggcagccccgcttcgcctccaggtcggtgttgaaactggcaggcgtgctgattctggcagcgggcatggcaccgccgtactcacggccatgatggccttgcaaggggggtgcaaccagtaggaacgcagtgagacatccttcatcatccacatgtccggcccccccccagacgacagcatccgcttccannnnnnnnnnaagtaggaaagcagtgagacatccttcatcatccacaagtccgccccccccccccagacgacagcatccgcttccacggggtgcaccatgtcggcctcctctgctcctccctctcccgctccctggacttctattgtggggtgctgggcctggccatcaaccccgaccgccccgacgccaagctgccctacgccggggcctggctctggatcggcccggagatgatccacctgatggagctccagaatcccaaccccaaccccacccccgacggcgtgggggatggcatgacgcgcgaccggcacacgtgcgtgggggtgcacaccgtcaagcccctggaggagaggctcgaggcgcacggcatccccttccagcgctccgccaaccgtcccgccatcttcttcaaagacccggacaacaactgccttgaggtagtggagatccggccgtggcggcagggtcagtgacgttcttgtaccatcgatcgccggcgatggcgggaagagggtcttgaccgcgcaggccaaaccctggtgagccccacccacctcatgaagaaccctttcgtccacctgatatccaaaacccctgtatacaccctggtatgcgtcccatatccccttgagtctgccggtctccatggcgtccaggaatgccgtgcagcgtaacagctcggcgcccgggccgatcatctgttgattcgagtgtttgattcaccaattccatcccctcatctgtccttgccgtgtccttcgccgccttcaattacctactcgctttcatgctctgtaaaacatcaccttacattgctcggagttctattgcgcatgacgcccctttgcttcccgaggtctgaaatgctgccggtcttgaggtaggggacttcgcgcgctgtactcnnnnnnnnnngctgcacatgacccccttttgcttcccgaggtctgacatgctgccggttttgaggtaggggacttcgcgcgctgtactctgggcgcgaaggcacccttcgagacaaagctcgtggaatcgtcccagcggggccgatggagggtgtatggtgaatagtttgtcaactttacatattaacagccagccaacatggctaaaaatgagcccacatcgtcggaggcaggggtcgcggcaggggagcacagcggggacacagacacagctgcagacacagaaagaccctccccagctcttccggcggttctcaataagaagaagctgcagaagctgcaggaacagtacgagcggcgcggcattgnnnnnnnnnncacacagctgcagacacagaaagaccctcctcagctcttccggcggttcttaataagaagaagctgcagaagatgcaggaacagtacgagcggcgcggcattgtatacatcagtcgcattcctccccacatggtgggtgctgtcgcaaagctatgatccgtaagaccgcccgcacttggacctggcgaggtacatcaaaccgccaaacaacttcccttttctcccctgtagaaaccccaaaagctgagacagctcctggagccatatggtcagctgggacgcttgtaccttgccctggaaggtatgtgcactccccaggtccagtgcaggccgtatgcacgattcttgctcctgcggtggcctggtccgcagcaacatgcccccgatctcgtcctcagatcctcgcctccggcgcaagcgtaaggagaagggcgccaacaccggcaagaacttcacagagggctgggtcgagtttgaggacaagcagaatgccaaggatgtgagttggctgaaggcacacggtgcgcggccatggactggagggtaccctgtctcagtattcgctgggcacacggcacgtctgccacactgcctcacaacctgctgtcgactcacccctcctctgagccaggccgtccagctgttgaatggccagcccatgggtggcaagcgtcggtccgcctacttctacgacctctggtgcctgcggtatctgcccaagtttaagtgggaccatctcaccgaggagatcaactaccagaaggcgatcaaggagcagcggatggcggtcgaggtgtctgcggccaagcgtgagcgcgatttctacctggcgcaggtggacgccagcaaggcccaggcggccatgctggagagacgccgcgaggtaagagacccgggtgctgatgctgggggaaaggtggtggtggagcggtgcctcgccgccgtgtccttgcatgtggacacaagtggtgcacagctgtcccatgtgaagagttgcaagcagttccagatgcctcttgatgcacgtgcacatccctttgcgcctctgcctttgcagcgctcgggggcggaggccacacctccagcagacccctcgggcggcatgcctgcagagcagccgcaggcggccgacaagccggccaagcctgtcgtggtgaggcgctatgggcagaggaagcccaaggccgaccccatcctggacgacggcgtccccagtctctctgggggcctgctgaagcagctggcaggtcgaaagaggccggtgcacgcacggagctgatgactgacgtctaccactagcagctgaccttgccgcggcgcgtttgttgcatttgctgtacaaacagtttgtcagttcatgcattaatcagcgcagcttggggacattgcctcctgagctggcggccggagggggcactcgaggggttatggctcggcctcatgagaatcaccgcgacctctgcatgcaccaatcgacggagtgtgtttcaaggacgcagctttccagaagcccacacgagcatcagcagttgccggggttnnnnnnnnnncgcctcctgagctggcggccggagggggcaatcgaggggttatggctcggccttgtgagaaccacagcgacctctgcatgcaccaatcggcggagtgtatttcaaggacgcagctttccagaaacccacacgagcatcagcagttgccggggttgagaagagaggcggggtctggcagcacgtttgggtcgccttgcttcaatggggagcttgcctggatcgcctctccctctgtcgaggcctcggggatgggtgtgggtgcagcgctgcgttcacccggtgcacccagcagtgccgtgtcctggggggtttgccaccagtggggatcaggcgatgatgcggccatgaaacccgtcaccaccaggccatcgcctgcagcaagacacgtgccacagcctctgcacgtggcagaggcagggtgctcctgcccttgggcagacagcataccatacccacagtcaggcccannnnnnnnnngctggtgcacccggcagtgccgtgtcctggggggtttgcaatcagtggggatcaggcgatgatgcagctatgaaacccgtcacaaccaggccatcgcctgcagcaagacatgtgccacagcctctgcacgtggcagaggcannnnnnnnnntgcaccacccaccggcagcaggctctgcgtcccctctagcagggcgattggggcagctggaactccannnnnnnnnnagcacctaccggcagcaggctctgtgtcccctccagcagggcgattggggcagctggaactccattgctgccatccttgaggtcctgtaggtgcaggaggtggcaggtggatgtctacacaatcaagctgagactttgcaccacgaccaagagtgcaagggacaatgcatctggcagagcaccctgccggtgagggctgccgccgcagcgcnnnnnnnnnngagttggcaggtggatgtccacacagtcaggctgagacttcgcaccacgacccagagtgcaagggacgatgcatctggcagagccccctgccggtgagggctgccgccgcannnnnnnnnnnnnnnnnnnnnnnnnnnnnnnnnnnnnnnnnnnnnnnnctctccaggctgtgcggcgtcatgttgaaggggtcctccggcagcggggaggccggtttggcttgcactgcaaccaggtgagggggcagaggggggagagtgagcgtctgtctgagcaggaatcatccacaccttgtggtatgcttgcaccatcagggatcatacacagcagcaggcatcaatgtccaccatccacccacctcaccaggcgcaagctgcgggaagaggcctgggctgctggggctggggctggcgctatctggtgcgtggtccggggtcaaaccctccccctccagtgccttgacggccgcggcaacgtcgctggtttcgcttgtgctcaagttctctgcaagaaaagtaccaagtgcacggagcgtgactgacatgcgggcgggcggcgtcctggaaactcttcatgaatgtgtacatggtggccctgtgaagaaagaccaacacaggctccactcattcccacacctcatccctcaccctggctcgtgccccgctcgaatgtgtgcgcagcttcccnnnnnnnnnngacgaccaacacaggctccactcatccccacacctcatccctcaccctggcttttgccccgctcgaatgtgtgcgcagcttccctatcgttggaggcctccatctctttggcggaaaagttcagggatgcgagctgctgccggaagtgctcgatgtctgagcgaacgtcgcgtggaatgtgatgactcttcacagcctccagtcctgagtagagggggacaaagagagtgtaggcagacaggcggtgagcagcgaggggcgaggaaggctcagatcttcaaaacgctgggcgacaccctccccgcatgtcctgccatgcaagaccccggagtgcataccctgcatcccggcgtgcagcgaccatgccacggcttgaaagtcggcagagtcctcgaggggccagacgctgccggcctctccctcctggcaccggctgatcagcgcatctgcctggcggatggcgtcgcccagctcgtccagagcagccagcagcgactgttcccctgtggtggcggtacacttgtgtttggggtccacgcaagggacagggacgcaaatacagaggtcccaaacacagagctttgatggagagacgtgccacatggagtgggacccccatggaaaacccactctgagcagatgagacaaacaggctgccaaggcacatacctcatcgcctccaccaccgcannnnnnnnnnacacacgtgggacagggacgcaaagacagagctctcaaacacagagctttgatagagagacgtgccacgtggagtggaccccccgtggaaaccccactctgagcagacgagacaaacaggctgccatggcacatacctcatcgcctccaccaccgcacctccaaggagctcgtcataggcagcatgcatctccagctcagtgaatatgagggacaccttggccacataccgtgccagacgcaggcattctggccggttggcttcggtgtgcagggcatgcatggagatgctcaccagagaccgcttcaggtcctcgaatatgggatgcatggtggatagatagacctgcgaggacattaagtagtcgttgaggtgtggtacacggcattcctgcatccgtttgcatcccatcatggggtgctcacccctgtcggaggtgagacgatgctcgacgagttctgggccaggtagcgagcgcgaaacttggggcaatgtggacgatgatagcacagactgtcagggaagaagctctggattgttttaggtcttaatgcagagcgcggctgctgtgtgttggactgacaggtccaggtgcgctccagctccctgggaccccccgtgacgcggttgatcgaagcatgcaggtggagcaggatcgagcatggcatggcaaaggggtgcgtgcagcaccagcgccatgccatcgcatcttaaagctccctctttcaccatgaccctgcccctggcaaggtgtcgggtcacagctccggctggacctgtgcttctacaccctgcacccggtcggctggtggcacggggagtcgggcctcctcggcccttcacacactccctgcaggccgtgagacgagtgtgtcgagcaggatcagggcccttggacatcagcgagcccttccatgcaatccagaccaccgagtcggttgcgaccaacccagtagactacgacgccgaagccccgtccccgcgcttgctgggcttcacctttcaagatgtgcgctgtttctatggcagggtccggggccgcggctcactcccagacgcggaagtacggctccctagacaccctcacttcccaccagtactgttcttggatcggagggtgcacacacctggctccccccgcccgcccgccggcctctcaccctcaagactacaagttccactctcctctccccattcccactccaggtatactactacttgaacatagcgtactggagcctgctcctcctgtcggtgctcactggcaacgacttcctgtcccgcatcgcccagttcgagacctacaccaccgccatgtttgtggcctccaccgcgttttcgaccttcttcgggctgaagtggtggcatgacgcgcggcgggagctgcgcagggagcagaccagcgactggcgggcactgctccgttactcctggaacgccctcttctggctaggtgggcgagactgaggggggcactgcgggtgtgacgctggaggcaggcactctgctagagtcattcaggcggggaccaccagggttgcaacatcacatgtggaagcacaatcacggacccacagtctgcatgtgatgtgcctgcggcaaaccatgactattcaggccagattcagcaccccttggccacccccccaccccggggctccctgcaggctttgtgttgtggtactcagtgccgcccctcaccgttgtgaccgactatgcgggcactgccggctccatagcctgcgtctacggcgtggtgctcacactgtcctccgcgctaatggtgggggtgtacagcttcctgggcgagccgcagctgccaaggaagctggtcatgattgggccctactccgtcgtccggcacccccagatcctgggcaacttcctgttcatcatgggtgaggagctttctttggggaaggggggggggttgttggtgggggagaaggcgggaggcaaaggggggggggaggagcaatttgcaggtggaaatagggactcgcaatgcacggaggtcgaccagtgtcccttttggaaagaccaatagcatgactaccttatgtgcgctctcatcggtnnnnnnnnnnctggggaagggggggggttgttggtgggaaagaaggcgggaggcaaggggggggggggcgatttgcgggtggaaatagggactcgcaatgtacggagctcgaccagtgccccttctggacagaccaataacatgactaccttatgtgcgctctcatcggttggcccctcacacctttgcaggcttctcgctggccggtggcgcggtggccgccacggccgccttcctcctttcctttgcgctgtaccgggtaacggtggtgccgcgggaggagcagctgatggagagcaagtacgggcaggtgtaccgcaagtacatggagcgtgtgcccgccttccggtggggctgggtgatcctgggcgtgattgaggccgttctcctctggaggttctccccttggtccatcacccccgcatcagcctactactaaagagccgcactgcgccgtcaaaccttcctctcctcctcgctgcaccatgcctcagtactgacgtaagactttctcaggacgctgtaacagctacttctgtttcgagtagggggaggggaggggagtgcagggttccaggggtggggtgtcggcccatgagaagggcagtcccaaaggcgggtgcgcagggggggggggggggcgnnnnnnnnnnccgagtagggggagggggggtgtgggagagagtcagcccgagagaagcagactctccagggcgtaggggttacggcgtccatgcgcgcgcgaatctcccgaggcctcgtctcgtgtcggggtacgaatcccgagacacaccgggcggagatgannnnnnnnnntgcgcgcgcgcgaatctcacgatgtcggggtttcgaatcccgagacacaccgggcggagatgaatgccctccgactccagactccaccataccatgcggtttcatgaccagtactgggtccttgccacgcccgcatcgtcagcgagggccacgcaaacatcgcaggcatgctctgcctgagggcggtgtggcgccgggcccggccagcagggcctgcaggctcgcgccgctggctggcctctccgccccccctccaccgtgacgaccgcgacctggagctgctgaggcggtggcaggaccgtctgtccctgccacccaccccccaggactcccgcctgggcgaggaggtggccgagctgctgcacaccgtggtgcgcctgcgccgcgcctcgccccagagcgccgtccccgacgacctgtgcgccgccttcatggcacactactcccgccaggacgccgaggctcggcgcgccatgctgcgccgcatggcccgcgactttggcgcgcccagcggcgacgtggcggccgccgcggcgcggtacgccgc

SEQ ID NO: 41247 - DNA, 123 bp, Chlorella protothecoides
ccccccccccccccccctcccgaattccactcagcagatcttggcccgaccttggcttccgtctccctgcggctgtacggccaccagccccatgagtgggaggtgtctggcgtccaggtcgcg

SEQ ID NO: 41248 - DNA, 61 bp, Chlorella protothecoides
gggcgactgctttgattccggtaccaccggcccgatggtaccgctcggccaatcacccatg

SEQ ID NO: 41249 - DNA, 99 bp, Chlorella protothecoides
ggtgggcggtggggaaggtggcggtggactgggaggtggtgggctaggaggcggagggctgggaggaggggtgggcggtggggaaggtggcggtggact

SEQ ID NO: 41250 - DNA, 69 bp, Chlorella protothecoides
ttcctgactgtacaggcacggcagtgctttctgggagaccgaatttgtcaaccctgatcctcaccactc

SEQ ID NO: 41251 - DNA, 74 bp, Chlorella protothecoides
tcctcgcgctggcaggtgtgggtgggtaatcgtaggtggaaggcttgggggggcaatatgtgtgtgtgatgggg

SEQ ID NO: 41252 - DNA, 15103 bp, Chlorella protothecoides
  modified_base (909)..(918): a, c, t, g, unknown or other
  modified_base (1188)..(1197): a, c, t, g, unknown or other
  modified_base (1312)..(1321): a, c, t, g, unknown or other
  modified_base (1829)..(1838): a, c, t, g, unknown or other
  modified_base (2244)..(2311): a, c, t, g, unknown or other
  modified_base (2571)..(2580): a, c, t, g, unknown or other
  modified_base (2664)..(2673): a, c, t, g, unknown or other
  modified_base (2801)..(2810): a, c, t, g, unknown or other
  modified_base (3341)..(3350): a, c, t, g, unknown or other
  modified_base (3747)..(3756): a, c, t, g, unknown or other
  modified_base (4391)..(4400): a, c, t, g, unknown or other
  modified_base (9274)..(9283): a, c, t, g, unknown or other
  modified_base (9488)..(9497): a, c, t, g, unknown or other
  modified_base (9734)..(9743): a, c, t, g, unknown or other
  modified_base (10447)..(10456): a, c, t, g, unknown or other
  modified_base (10508)..(10517): a, c, t, g, unknown or other
  modified_base (10593)..(10608): a, c, t, g, unknown or other
  modified_base (11352)..(11383): a, c, t, g, unknown or other
  modified_base (11638)..(11647): a, c, t, g, unknown or other
  modified_base (12036)..(12045): a, c, t, g, unknown or other
  modified_base (12868)..(12877): a, c, t, g, unknown or other
  modified_base (13078)..(13087): a, c, t, g, unknown or other
  modified_base (13435)..(13444): a, c, t, g, unknown or other
  modified_base (14230)..(14239): a, c, t, g, unknown or other
  modified_base (14393)..(14627): a, c, t, g, unknown or other
catcccccccctcaccccctcctgcgccttctcctccaccctcccccccactcccaccatctcctccaccctcaccgcctcctccgccttctcctcctccatcccctcctccccctcatcccatcgggacacgacccagccttttcattacaagaaacgcaaacgccacgtttactttcaccactgcatgtctgcttccattcacgtttgttgagattatgaaagatggattcgacattgcaacctatcatattgacactcctgccacaaccagcactatcactccagctgccactcacacaggaacgaaacggtcgttttattgggttacggtgttgtacacaaacaagcatttcgcccaattatcagacgccgtctacatgatcggatgatggccaagtgaggtgctctgtaaaggatgcgccagccgcagccactcttctgcctgctgcggctccagctgtgaaacatggtgcaacatcggtcaccatgctcaacgcgctccccttggccatgttatttgagttcaatccttgcggatcagagtgccgagtgccagggagcattgtttaagggattgttctctctacagtttataggtcattttgcacattgtcaaaggaagatcatgtgtctggagcatgggcagggaggcgaggtagtggttgagagtaatatgctttagggggggcgaagactctcccgggacctgactctgtcaagatacaacacgacctacatgctgtacagattaagaccattaaaacgttgctccggcgtttctcattctcaaacgcgaataggtgggatgagctggcgtggagactgagcaaggaagggagtgtgctgtgcatgaaacgcaaactcccgttgcaggccttgcgcaagatactgtagaaccgaaaatannnnnnnnnnaaacccagcgcatcgtacatctcccgttgcagggcttgcgcaagatactgtagaaccgaaaataccgaaagctcctgatccctacctcagcagcagcgagcctgtccctgttacacgcacaggcaaaggacatcacggtgtaatgacccctcggaggcgtctccgacggctactactttcttacagctacgtccaggaaactcagcaattgtgtacatatgcatttatgttggtcgataaacggtacttcaatatcatacatataaggtnnnnnnnnnnggacgttgggttcttagtaaatgtccgggcaagcagcgtgcatgagcgtaaactgttcatgccgtaggacgtgagaagaaaatacacaagtcaccatcgcgtggcttcagcgatnnnnnnnnnnggacccctcggaggcgtctcccacggctactattttcttacagctacgtccaggaaactcgtcaagtgtgtacatatgcatttatgttggtcaatgaacggtacttcaatatcatacatataaggtctggaaggagcccagcaacgcactgtgcctttctccattccagagtcacccggcgcctgcaatggatcagatgttggtttcttaggaaatgtccgggcaagcagcttgcataagcgtaaattgttcatgccgtaggacgtgggaagaaaatgcacaagtcaccatcgcgtggcttcagcgatcttggtggaataggtatcgtcattgagacactcaagagtagcaaatacaagtagatataatcatcagccacgcgggggattggtgatatgcaaggcagcacagggatggatgatgggatttccaggcagggcactcgatatctacccatgcccaagggacaaggaacggtgggagcctcagagagaagattaaacaatcnnnnnnnnnnaattggtgatatgcaaggcagcacagggatgaatgctggaattcccaggcagggcgctcgatatctacccatgcccaagggacaaagaacaatgggagcctcagagagaagattaaacaatcagatcattgcttgcaaacgtcgccagaacggcgacacaaactcatctgacacgcatgaatgagaatgagttctcatcatcggcagcccaaggagtgaaaggggtgatgcatggcgggtgtgtgctcagacatatgatccagcgttatcgtatcacgggatgtcagtagcagaactggcataactggagtttggtcatcagtgcacactctgaacagcaagactggaatcatggcataggggcaagggctgggattccaagcaagggcgatcggctgcccaaggnnnnnnnnnnnnnnnnnnnnnnnnnnnnnnnnnnnnnnnnnnnnnnnnnnnnnnnnnnnnnnnnnnnngcatctaccacattccctgccatcacgagttacctgtcgcatccatgggatgacgtggatgtgcagcagcaaggaaagcacggacgcttgccaaagcgaaccggtgcaatccctacggcactgtgaccttcaccggacgtcaggttgggtcactgtctttgtatgtgtcatgccgcagctcacatcccctcctcatcctcatcagcctcatcagcatcgctgaaccgggttgggtctcctcccaaagcctgcaaataccnnnnnnnnnnggtacacggcagaaccgggggtgggcgtctaccacattccctgccatcccaaattacctgtcgcatccatgggatgacgtggannnnnnnnnnacagagcttccacaggcacactgggtgggagggaggttgccgcaccaggccacctcccaaagcccaggcatgccgacccagcatcactcacctcttcgatctccaggcgatgcagtgcagcatccgtnnnnnnnnnngcagaacttccacaggcacactggtgggagggaggttgccgcaccaggccatctcccacagcccaggcaggccgacccagcatcactcacttcttggatctccaggcgatgcagtgcagcatccgtgcccgccaagacctcctcctcatcgaagaagatgccgccctcctcgtcctctccctcctcgcagtcgtcgtcggggttcctctccgcgccctcgctcagggcagcaaacaagggctctaccagggcgggatcggaggggatgagccacacctccgacgcaccctccccttcctcctccgcctcatcgtcgtagtcgctgtcgccgccagcgagctggaggtacaggcaggccgcctggtccccggtggcgctcaccaccgcatgcatggcaatttcggtgaagggcagtgcgagcgcgggcgggccgccctcttgaggaagccacgacaaggcactgggtgaaaggaggtgagggggtgccctttaataccacagggcatgaacagacgacggtgtgcaaagcgnnnnnnnnnnccaaagcactgggtgaacgtaggtgagagggtgcccctcaataccaccgggcatgaacagacgacggtgtgcaaagcgatcgcggcgccttgccagcgctccctcacctcttggtgcactgcaaggatccgggccatcctgcgtccgagctcgatcgcttcagtacgacgcccgagaaggactgcaaaacggtgtcatcgtcctgcggggcctcctcgcctccagcctcccgaggagcgtggccgttgccacactgggcgggcgtcatgatggtgtgggtccccaggcgccgcaccaaaccgcgcacaacttcagcgacagtaaaagctcctcacatcctctgcttttgcattgcggtgttgcattatctgcagagacaaagccgcctgtttctcgnnnnnnnnnnagcgcacaactcagcaacaggaaaagttcttcacatcctctgcttttgcattgcggtcttgcatcatctgcagagacaaagccgcctgtttctcggggctgcagactttgatcccgccaccattgccccgtacctccaagtgaaggtaccgtttccaacccgcgcgtcctccctcccttacaactcggtgcctggacaagtgagatcctcccaccctcgccccgacccacccaccgacttcctcactcgttccttccttttcggtaaatacagaagtatttagggtccgagtaacctgtgtgctccgtctcctcccgcattttggcaccaataaaccccgcggacctcctcctcgtgacgggcccagcatgcagcgtctgcagaggtgcgcacggtgatccgtctgagtttcatactgcacacattcatctgcatcgcaagccaatcccgcccacctgattcgcacagggttgccgcacaagccttggccccgctggggtcccggctcctgagcaccgccgaggtgagagtgcgtggccgcgagggccgctcccagtgcccttcagcccaggtgtcgcgcccatcccaccccttcacatccctgctccaaccccgcagacccccgccgtgttcgnnnnnnnnnnaggctcctgagcaccgccgaggtgagagtgcatggccgcgagggccgctcccagtgcgcttcatcccaggtgtcgcacccatcccaccccttcacacccctactccaaccccgcagacccccgccgtgttcgtggacaagaccacccgggttatcgtacaggggttcacgggcaagaacgggaccttccactcccagcaggccatcgactacggcaccaacatggtcgggggtgtgacgcctaagaagggtggcaccacccacctgggcctccctgtgttcaacacggtggcggaggcacgggcggcgacgggggccaccgccaccgccatctatgtcccgcccccgtttgctgccgcggccatcatggaggcgctggaggcggagatccccctcatcgtctgcatcacggagggcatcccccagcacgacatggtgcgcgtgaagaaggcactgagccagcagagcgcgtcgcgtctcatcgggcccaactgccccggcatcatcaagcccggggagtgcaagatcggcatcatgcccggctacatccacaccccgggtcgcgtcggcgtcgtttcccgctccggcaccctcacctacgaggccgtgttccagaccacgcagcagggcctgggccagagcacggtggtgggcattggcggcgaccccttcaacggcaccaacttcgtggactgcctggagcggttcgtggcggacccgcagaccgagggcatcatcatgatcggcgagattgggggcacggccgaggaagaggccgccgacttcctccgcgcctccggcactgacaagcccgtggtgagcttcatcgcggggctgaccgcgccgccggggcgcaggatgggccacgcgggcgccatcatctcgggcgggaagggtaccgccggggacaagattgctgcgctggaggccgcgggggtcaccgtcagccagtcccccgcccagatgggcgtcgccatgaagaagttgtttgaggagcggggactgctctgagaggggcgccgggggcgtgccacgcccaacagaatgaatggaggtgcccctgtcccatgtcgcgcctgggtctgtatcttcagcactgtgcaaagggggcgggtagcaaggacggtgtgcatatgtttggggagagggtgggggggtggtagctgaggagatgcaaggggtgatgccattgcgactaaccccaggagcagacagcgttcatgttgcaagtatagatagggagagagcatgccccactcgatggacaagtcgggcgaaacatgcgctcagtgtgtggaatgtcgcattggcgaggagtgcgtgaggaaaggaggattcattgttagctctgccatgaggggagccgagctccgatcccatgcactgccttaccttgatcctggatgctcgaatgaagaggtagatcatcgcatgcgatcgcaaaacatgagagccttgctcgtcatcctgctgatgatcgggaatggcatggcctttcccaacgtcgccatgaaggatgctgccggaggcctcccctcaccggtcgtcatcatacgggcgcatggagacgcttggtgcttaccgaggtgcaggcttttcatgcaaacatccaacggctcggcgtcgacatcgcgactgcaccgcctgaacacggtcatgctcgggtcgggtcggcggcaggcgatcggagttcccggcatcgagtgccaggacgctgaatgcgcagccaccctcgagaccatgatggacgagggacatggagaatcaagtcaagaaaggtatcctggagcgcacctggaggtcctgaccttcaaccttacacgcagcacggccccagctgtcatgcccacgatgttggagctcgaaaccgctgggcctcctggtgatgctctcgactccgacgacaagcctgtggacgcccttgatccatgcttgcgtgattcaaggctagcacctgcactgctcatgtgcttgacacttgcgtgttccaccgctgctgcgtatacatggctggtgctctcaagtgtggagtaagtccattgcgagtgaaatttgggtcacaagatgttacagatgatgaaagcacatgcagaacattactccaagcgataagctggagcaattgccaatagttttaagcgtgtcacctgcattgattcagttcaaagggttcaggacgtgaagcgctgctaagcttgctgctccctcagccactgtgtcaactcagccacaccgcgcagagttcttggatgcgacgcatcaccaaacacagaggcctccggtctgtaacgctttaatgcatgctgctcctcccgggtcaagatcccatacacttgatctgcagcgcctgtggcgaccagagttgagagtcgctgaaaaacaggcgcttggggtcgctgccataccctggtgagtcgcggcggtgcctttgaccaatgtagaaactcaatcgatgcacaagatcatagttcagctcacctgtcgcagcacttgggtccccctgcacatgatcgcagatttggcgcagcagcaggtctgtgtcttgagtggcatccagccagcggaattccggccggtttcggaaccaggtcatctggcggtggcacagcttgcgagtggcagactggatgtcgaccaccagactcaactaagtagagatgggggggacggtcggtgaggggatacagctgggcaaagggtgagcaggcattcaaagttgctctcgagtattcctcaagcctgagcatgggatctcacggggggcctgcggaagtcatggtggcgactccagcaaaattcccacgtgcagctcctgcctcacacccgttcaacccccgcccacgcaccagaataccaggcagctcagcatcttttatttcctcctttctcaggcgttctagtgccaggagggcctgacggtacccgatggcccgcgtggcacaggttgtgtttggcgcagcaccgcaggcctggaggtgggccgcctcctgtgtgcgccgagggggggtacgcgtcgcctcgatccagacacaggctggagctcgggtggcatggtgggcccgagggctgtggcaggagctccacaggcacacgagccgcatcgacgtttttttaccgtgcagcaccaccctgccaaggtcctttctaaccccctcacccacaatgagacaccctcaccccgatgagcccgctgctgaccatgtggtccaccctggagtcgatcctgcggtacagatccagcctcggccggaccaggaaaaaggggtggaacgcgaaggccctgcgccgctcctggcccgcctgcgcaaagtccgacaggcgagcccccggcgctgacagcaggacctccaccaccctcgccaggcgataggtgttgttgggctcctctgccagcctgggcgtgcggtgaggggtgtgtggtgcggttggaagcatcctcatgctgcagccaaggagctgcagacctcagctgggaaggagcaatgacagtccccaccattcccctcgcctcaccccggaaagctgccagctccccgatacctaaaggcccttcaaacccctcttggatgcatctccctcactcctccttggtacctttctgcggcttgggcgtcccccaggtcccgcaccagccggcacccgagggcccaggcctgctcctgggagagggtctggccctgctcggctgcctcctcccaagcctgggccagcctcgcttgggcagcggctgcggtttcgggggtggacaccggcgtccctggcttgccatgcatgaaccattggaggtacaggcctgtcccgccgacgacaatgggaactttgctcctcttaaacatgcgcaatgggaggggagctggagtggaaggaatgggattgaaacgctggtgaggcccacgaggcatccctcttcccagggcacacatacgatccacagccccacctgcacgatgtcatccactgcagcccaggccaggtcatggaagatgcctgccgagaagtcttgctgggggtccaggatgtcgatgaggtggtggggcacgccctgccttgcttccacaggaatctgtttgtgtggtgagaggatgagccagccacaacaagggtgtttgttgtgcggtgttgcggaacatgggttgcagggtggacaacccaccaggtgtccatgtcctgttggtcctcaccttgtcggagcccacgtccagctgccgatagacctggaccgagtccgcgctgatgatctctccgtccaaagccttggccagtcggatcgacaggtccgtctttcccaccgcagttgggccggtaatgatcacgacggcagggcgaggcctggcctggtccgatgtcatgcgcgccaagcctcgagctgcaagcgcagcgtatccagcacgtgatgcgatgcgcgaaggaccggctatcatggggttccgatgggggcgcgcagtacgagccccgcaggggcagacagggctgtcggtctcatggcaacacggccatgtatggcaactggacacgccatgctcccgcttctccggaaacacttccgtgacatggcccaatgtggacgataaagccgtatctagccgtgacattcgatgcacctccatccggacgggtactaaattttccgcgcgccgagttgcgagctgccgtggatcgagcgcgggaatcgtcgacctgtaggcaggcctccctacccggcatgcaattcttctcggacgagtcacagggcacctcgccagcatggcaccatcaaacaatacatttgtcaacttcgtcagtcgttccggagcctgataccactcggtgctcaatcgcaggccgtgctgacggaagctgctgcgagccgctacccggcaactaacgagaacgagnnnnnnnnnncttgaacacgccatcctcccgcctctccgcaaacacttccgtgacatggcccaacgtggtcgataaagccgtgtctagtcgtgacattcgatgcacctccatccggacgggtatctgatcgcccgcgcgccgagttgcgagcagccgtgaatcgggcgcgggaatcgtcgacccgtaggcaggcctccctacccggcatgcaatnnnnnnnnnngcaatacatttgtcaatttcgtcagtcgttccggagcctgataccagtcggcgctcaatcgcagttcgtgctgacggaagctgctccaagccgctacccggcaactaacgagaacgagttttgggcagtggacgtgccaggcggagcagccagccatacttggcattcttctgtgctaaatcggctcaagctcagctcgatcaagccccatcctagtcaactgcacgcggacgcgcnnnnnnnnnntcagccatacttggcattcatctgtcctaaatcggctcaagctcagctcgatcaagtcccatcctagtcaactgcacgcggacgcgcacagatctgttgctggcccaccagcatggaggccttttacatctaccttttcatggtcggtgcagtggcagcggccgtattcgagtatggaaatcggctggtgaaggtgacggctgctcccgatctggccttcagggggttcaagaccaattacctcgtggtgtactccttcatgatgggtacgaggggccggggcgaggggcattcggtggcctctgccgggccagttgatcacagtctgatgcagactacctcgctctcatacctcatgccgtgtgccatgcgcagctggggactggctgcaggggccgtacgtgtacgccctgtatgagcactatggcttcacccggggcgagatcgggcgcctcttcatcgccggctttggctcctccatgatcttcggcaccgtgatggggtccctggccgataagtagtgagtggcctgccagggcagagcgcctggggtggggatcctgggaagtgcatggcagggtctccgccgtggctgaaacccagcgacactggatgcgcataggctcgtgccaagcactcctgtacctattcgccacccgtggcatgccatttgctccgctcttacaccccgccaactcctcccnnnnnnnnnnggatcacagtctgatgcagaatacctcgctctcatacctcatgccgtgtgcnnnnnnnnnntagggtctccgccgtggctgagacccagcgacatgggattcgcacaggctcgtgccaagcactcctgtacctattnnnnnnnnnnnnnnnnctacgtcgtctgctacacgctgggctgcttcacgaagcacgcgcccaacttctgggtgctcttcttcggtcgcatcctgtgtggcatcgccacctccctcctctactccgcctttgagagctgggtcgtgggcgagcacaataaggtgtggtcctgggtggctccagggtggggagttcttgaggcctgggtggcccccttctgctcacttgctctgggagctctacagccatcagcgtgcatcccgtcaccctcaccagtacaccctctcacatcacctataccttggcagaggggctacaaccccgagtggctgggcggcatcttctcccaggccgtcttcctgggcaatggcctggttgccatcctggcagggctcttctcccactccctggtggacaccttccgcctgggtccggtgtcgccctttgacgctgcagccataggtgcgtggaatggtggccgatgtggattgttggggccgggctgattgctgtggtggagggcagggggctgctggtggtgtgggagcttccacatgagagtgccggagtcctggcctctggtaggcagccttgggtttggggtcagcaccctttgtgaagctagaggcagagagggttccgcaccgagtgcttccaccatggtccatagcatggggagaggaatgatgttggggccttggccactggagatggggacacattgcttgcaccctgaggctgcaagggtctcacatgcacnnnnnnnnnnnnnnnnnnnnnnnnnnnnnnnnttgcgctgacctggacagaaaactacggcgattcctccgagtcggccagtctggctgagtcctttggcaaggcctacacactcatcatgagcggtgcgtggggagaattttcagggagcgaaggggacgaaggcattggattggctccggtgatgtatgtatcaccaaggttggcccttgtttcgtgcctctgggttcccccctctcatcctccggcgtcctgttcactgtccccaccccatgccctccatcacnnnnnnnnnncctcatcatgagcggtgcgtgggaacaattttccgggaacggaggggacgaaggcattggattggctctggtgatgtatacatcaccaaggtcggcccttgtttcgtgcctccgggttcccccctctcatcctccggcgccctgctcactgtccccaccccatgccctccatcacccacccgcagaccccaagttcgcgctgctgggagcgatgcagtccctctttgaggggtccatgtacacctttgttttcctctggactccagccctcaggtaaggcccttgattgggcagcaggagggtggaccgaggcactccccgccgtcgcgtgtcttgctgtgccaggtactcttgtgtactcggccttgacgccccattctacagcactnnnnnnnnnnatggcgtgtcttgctgtgccacgtatacttgtgtgctcggccttgacgccccattctacagcactcctccacttcctccatcccagccccaacggcgagcacctgccgcatggcatgatcttcgcctgtttcatggtgtcctccatggtcggctctgccctggccggcaagctcatgtcgctgaccacgtgaggctgggaggaagggcgagggagctggtggagtgcggtgcaggcttgcgcatcggacagtcaccctttgtgtttgacagggcaatcggagcggtcaagatgccactcgggatcgctccgcattgcttccctctcaccctgctaaccctcaaatccacattctccacctttgcaggatcaaggtggagcgctacatgcaggtcgtgtttgcttttgctgccctgtgcctcaccatccccgtcgtcgtcccgcctgccaaggccagcaacaggttggacgaggggagggagggaggatgtgcagggggtggctggctcgagaggaaacatgccgtggcatggttcctgccctcgagacatgagctcgtacaatgttttccggcgcagcatgtctggtcacacatgccctacccccaccgtcctccacgctctgcagcgatagcctgtcgctggctggcaagctccacctcctggccttctgcggcttcgaggtctgcgtgggcatcttctggccctccatgatgaccatgcgcaggtgggagcgggggtgatcaggccggggaacgatgaatcagtggggggctggcagcacccccccctttcggggcatggctcgtggtggggtgtgatgcnnnnnnnnnntgcgggggtgatcaggccagggaatggtggattgggggggggctggcagcacccccccacctcccggggcatggctcgtggtggggtgtgatgcagctgcatcagggcatcatcaagaagatggacttcctgatgctgggagcagctcattgtgtcggtgcccccagcttggcaacatctgcattttcatgtacaagtctnnnnnnnnnncgcgagcagatcattgtgccggtgcccccagctcggcaacatctgcattttcatgtacaagtctgtccccaaccccaatcattcagcgcccacatcccggaggagattcgatcgacggtgatcaactgcttccgcatccccctcaacttcttcgtttgcgtgatcctgtacaatgtgagcttgcagcagcagccggtgcagactttgatgcttcagggcaggcggtccaggccttttgcatcacaggcacagcaccagctccgtgcatgtcaagctgcaacccccttccgcacctccagccatccagcatgcactcaacgatgcgcaggtggggagctactccttgtnnnnnnnnnntggtccaggccttttgcatcacagccacagcaccagctccgcgcgtgtcaaactgcaccccccttcagcacctccaaccatccagcatgcactcgacgatgcgcaggtggggagctactccttgtccaccatgtttgggatgtgcgcctccttcctgggcatctgcttcgcctgccagcgccagtttgccgttctcatccaccaggaacaggtgaatggcttctcgggaacgagaccagaaagtgttttccattttggaggggtactttagtggccatgcatgggggccggccggccagtggcaaggtctgcccacatcatggtttccccgcacccacgcctcccttgcctccccccgcaggccggctcccactttgatgaggaccagcgtctggtggccgccgccaagctggagaaagggtccctggctgctgaggcagaggccgccgcggtgtgagcgggcagggcccggagggctcgattcttcccaccatcccccctgttccccttccaaacccgtcaccccatggtgacatggccggcccccaatgccccccgcctcgccctcctgggggggattgggaccttggctgcccccctcgctgccttgactttcaggagcttgtatcattcttcccctcatccctcttgtcgagtggggacctggtgacggccgcgcgggggggtgctgccctgcgtgccacagtatgtgcaggcagaccttccccaggcaccggcacgccaccgccccctcacggcctgtggtcccctgctgtgcgcctcccnnnnnnnnnntggtcccatgttggaggggtaccttgctggccatgcatgggggctggccggccagtggcaaggtctgcccacaccatgctttccccgcacccaggcctgcccttcctccccccgcaggccggttcccactttgatgaggaccagcgtctggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatccctcttgtcaagtgggaacctggtggcggccgcgcagggggtgctgccctgcgtgccacagaatgtgcaggcagaccttcccaggcaccggcacgccaccgccccctcccggcctgtggtcccctgctgtgcgcctccctgtctccccgccccacccacccgctgtggcagtacagcttgtctccataacattcacattccttcatgccctgaaggccttgtaagcagactgggtgacggcacccgaggatgtggagggtcggggttggagcgaggcacaccttgcggcggatgtggggacctcgccgtccaccatgcgtgcacgtcaccgccgtcgggacgaagcctgcgtggggcgccgtggcgccggccccgcccccgcgcgcgaggctcggcgcgtgctgtacccatgcgcgggcgagggcgaggggccccgccccgtcccgtcctccccgctcgacgcgtcgtcg

SEQ ID NO: 41253 - DNA, 128 bp, Chlorella protothecoides
ttcccccagcagcccactctcctcctcccatttccccccccacaccctcacaaaattcactcacaaaattcactcacctgatgcactgctccagggtaaagcgttcgcgggtgacggcggcgcactcc

SEQ ID NO: 41254 - DNA, 76 bp, Chlorella protothecoides
gggccctccgtggatgcctggcggccagcgccccaacgcatcaacagcgcctgtccaccaccacaacaggcagccg

SEQ ID NO: 41255 - DNA, 76 bp, Chlorella protothecoides
caagttcccatcaggcctgggctgcatcctccttcttgagatcgccaagctgggagatgaggtcgggcagctgcca

SEQ ID NO: 41256 - DNA, 118 bp, Chlorella protothecoides
ttcagggcctcaatcacctgatgtgcgggggggggtgcacaggtgggaagactgagacgcaggacggtggagctggaggggtggctttgcagacctgagatcgatctacgattcccca

SEQ ID NO: 41257 - DNA, 458 bp, Chlorella protothecoides
  modified_base (106)..(359): a, c, t, g, unknown or other
tttcccctcgctgttcccagaaatcccaacacaatcacctccattcccagctgggcgccgcgccgagcgaggaattccgtgtctccggccgccttgtatccaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgcatccccctgcagctccaggtctgcatcgcatcgcgtacctcggcaaagggtatgcgcagctcgcgcggcgtcaccccgaactccttgccccag

SEQ ID NO: 41258 - DNA, 145 bp, Chlorella protothecoides
cgtggccgagaggagggacagctgggcggcccgcgcgtcgtgcccgccgccgcctccgccgcgcaccgcaaaggtctggcccaggggggggatgggtgcctcccaggcctgcacccaggtcacgcccccaaaggccgacaacctg

SEQ ID NO: 41259 - DNA, 62 bp, Chlorella protothecoides
cgcccacgaccgtagtcatgcccggggggggccggaactgctccgccagccggttgatggcc

SEQ ID NO: 41260 - DNA, 23609 bp, Chlorella protothecoides
  modified_base (287)..(296): a, c, t, g, unknown or other
  modified_base (783)..(792): a, c, t, g, unknown or other
  modified_base (966)..(975): a, c, t, g, unknown or other
  modified_base (2085)..(2094): a, c, t, g, unknown or other
  modified_base (3356)..(3365): a, c, t, g, unknown or other
  modified_base (4058)..(4067): a, c, t, g, unknown or other
  modified_base (4148)..(4157): a, c, t, g, unknown or other
  modified_base (4235)..(4244): a, c, t, g, unknown or other
  modified_base (4898)..(4907): a, c, t, g, unknown or other
  modified_base (5986)..(5995): a, c, t, g, unknown or other
  modified_base (6511)..(6520): a, c, t, g, unknown or other
  modified_base (6595)..(6604): a, c, t, g, unknown or other
  modified_base (7648)..(7657): a, c, t, g, unknown or other
  modified_base (8313)..(8322): a, c, t, g, unknown or other
  modified_base (9522)..(9531): a, c, t, g, unknown or other
  modified_base (9756)..(9765): a, c, t, g, unknown or other
  modified_base (10378)..(10387): a, c, t, g, unknown or other
  modified_base (10642)..(10651): a, c, t, g, unknown or other
  modified_base (11637)..(11646): a, c, t, g, unknown or other
  modified_base (12076)..(12085): a, c, t, g, unknown or other
  modified_base (12211)..(12220): a, c, t, g, unknown or other
  modified_base (12294)..(12303): a, c, t, g, unknown or other
  modified_base (12590)..(12599): a, c, t, g, unknown or other
  modified_base (13515)..(13524): a, c, t, g, unknown or other
  modified_base (13893)..(13902): a, c, t, g, unknown or other
  modified_base (15401)..(15410): a, c, t, g, unknown or other
  modified_base (16719)..(16808): a, c, t, g, unknown or other
  modified_base (17132)..(17141): a, c, t, g, unknown or other
  modified_base (18766)..(18775): a, c, t, g, unknown or other
  modified_base (18986)..(18995): a, c, t, g, unknown or other
  modified_base (19284)..(19293): a, c, t, g, unknown or other
  modified_base (19605)..(19614): a, c, t, g, unknown or other
  modified_base (20015)..(20024): a, c, t, g, unknown or other
  modified_base (20713)..(20722): a, c, t, g, unknown or other
  modified_base (22591)..(22665): a, c, t, g, unknown or other
ggctcgggcacgggcggggccgggttcaccggcagcaccccgcacctgcccctgtttggcaccgcgcccctgaacccctacggcggcatgcacgcctctggtgagtcgttggtttgtgggattgtggggggaatcctcgctgaggaggcgctaggggagggctggcatgtgctcacacagacgcgcaaagggcattcagggacatcgcaggatgagagccaggaggcgaaacggagacctggtgcgatgctgtgccgggccttgcatttgcaccacagtccctgtcnnnnnnnnnntgttggtttgtgggactgtgggggggtcctcgctgaggaggcgctaggggaaggctggcatgtgctcacacaggcgcgcaaagggcattcagggacattgtaggatgagagccaggaggcgaaacggaaactcggtgcgatgctgtgctgggccttgcatttgcaccacagtccctgtcacgaagatccccaccctgctccttcccagcgttccggccgccgctatcgcaccgcacgctgcaaaaggtggcgtccatgcccgccatccacggcctgggcgccggcggccacggctccggctcgccgccggaggtgcgcgcgcagttcgccgcgggcgggctgcccgccaagcgcatgcgcgacagcagccccatcccggaggcctcaagtatgcctgtgctgatttcgaatgtttgggggtgataagaggggggaaggagtctgagaccggttgcacacatgtacgtcaccctgaagacgggactgnnnnnnnnnngtgatttggaatgtttgggggggtaaagagggggaaaggaggctgagaccggttgctcacatgtacgtcaccctgaagacgggactgctgctgcttggcacatgcacctgtgttggtgacagctgggcagttttgtaggccttgtgcccgcccatggagttccacaccccaccnnnnnnnnnntcagatgggcagtttgtaggtctagtgcccgcccatggagttccacaccccaccccatacgcaacgcaaaactcatgcaaaggcttcctcgaccctccatgctgcaccccacacctgcaggcgaggagtcgccgccgcggaagaggagcctgggccagcaggcggggttgggggcgcgcgcggcttccacgcccagcccggcgacgggggagtcggagggcgtgaaggtgaagctgcagccctccgacgccgccagccccatcgcgctgtttgccggtcccagccggccgccgtcggtgggcctgacgggcgaggcgccgacgccgccccccatctccccgctcctcccggcacgaggcccctgagtctggtcgaggtggtgagcaggggagcaaagtgagaggcccaagacggcgggcaagacgccgacatgttgagagaggagaggaggagtcagggaggctagcggctgacagtcgatgacggggcgaggttccagtgccggccctggctgccatccacaccacggaaacagcgagcgcgttgatctttgtgcaccgattctcgagccgtcgaggccagttctggtgcgaggctgcgagcatgctgcctcccagtgccttccccgaccctgaggagtgccggcgtggcgcctgccccctgtttgacactgcttttcgagctggccccgccatgcaccacaccatacacattccttgctatcccattttgaccagacgatcaatcgtgatggaggcgggcccttcaccgacctggggggtgggggggcgatgggcaggctcctgcactgtctacggtgcccgggcggccctgagacccgcctgcatggtggtcactcccttcccgctcggctacagcctgtctgatatacagcctgagttgctctgtccctgcaccacaatgttcacgcacagagcagaagggtcgctggtaattcaggcgcaggtctgaatcatgggctgctggatgtaattgtgctgtcctttattagaagatggatatgcaagggcctcggagatcacccatgacatctgttgctgcaggggaagagtgaggcctactgtatgatgtaccaaacgactcggccannnnnnnnnncattagaagatggatatgcaagggcctcggacatcacccatgacatctattgctgaaggggaagagtgaggcttactgtatgatgtaccaaacgactcggccaaccacctacgctctaagcctcatcaagaaaccaactcgcagcaatcggcgcgggcgcgagctacgttgagagcaggagcacttgaagatctgccatctgatcgtgagttgtcgaataccccaaggcacaatacataatgctgtattaaatacatcgatccctcggtttcacgtttcgtgcgggtgtctgccgcgagggatcacttcgcacccaacactcggtagcgtatggggaccacctgatctgaactccctgatgttctcatgataatgcatctgcctgggctgtagatcaaagtcccggtaatcgtcgccggcaggatgacatcggctgccggcaaggctcttccgagtctagacaagggtccattatcactgcgcgagttgcggtgcgtgatggggggtctgtagtgtcgtgtatagggggggttgtttataatctctcattgaacttgtagccctacgcccctccaatctactcctcagggatggcgatcgcttggcactcctagacctgcttgacacggtgggaggtggctggcacccacagtagaatcttcccatgaggcaccagggactcggttcaacctggccgcattgaacacctcccagcacccccacacgattctcacttccctgattgcaccgcacagatccgtggccgcaaggcgctcgtgctggaggccgactttgcggcccccctgagcctcctggtggaggccagcactctgagggagcatggcgtcgagctgtgagtggggggcctgcgtgtcagtgcaggggggagggccttcctgcaggtccatggtgctggtcgtgagaggacctggcggaagactggttgtgagagagtgcattctgaggtgtcccctgacacacggatcttccttcccagatgtttcagctactcacgccccaagcaaccccgcaggttcggggtgctgggcgacgtttcggcgctggccagccagctggaggaccgcgagatacggcaggtggtgtacctgctgcacacccggctggaaagcgtgcatgctgccgtggcgcacgtggcccagtgccggcggtgaggggtggaatcaccctggtctcgttattgagggcgtccgtttgtttttgaaagagatagaaggcagagcaggagcttgctcctgtctccnnnnnnnnnnagtctcgttattgagggcgtccgtttgtgttcgaaagagatcaaaggcagagcaggagcttgctcctgtctcccatgcgcacctgtgatatcgtctacctccacctgactccctctgcctcacctgttttcaacaggctgtgctcctcccccctggagtttgcgtggctggtgatgccgcgggtggtgagcctcgtcccccgcatgctggagcgggcagggctgctggccgacgtcaccctgctccccacgccactctcctggatcccgctggatgaggacctgatctccctggagctaccagacgtcttccgggtgagttttgggagggggccgaccttcctccccaccggctgccactggctgcgccgcacgctcattttccggggtgccctgccactgaggactgtgcatgctgcttcccccgaggccttgccctcaacctcccccaaccccttcccaagccccaggagtggaccgcagacggcgaccccagctccctgcacgagctggcctccgccctttcctccctacagcagcgattcggcgccgtcgcccgcatcaaggccaagggcacggctgcggtggaggtggcggggctgctggggcgcatacggcgggagcagggctccgagggacccgctgtaggtaaggatggattggtgggggtgggaggtagccctgtatttcagannnnnnnnnngcggcgggagcagggctccgagggacccgccgtaggtgaggatgggttgttgggggtgggaggtagccctgtatttcagannnnnnnnnnggcagaccagttctgggacttgggatctggaatgccctttgccaggcatgtgcgggcccaggagcatgccaccaggcnnnnnnnnnngtgtgtgggacgacaagagtgcaggcggtcaggaggtgggttatttgagatatgtgctgtcaggagcaggccggttctgggacttggagctggaatgccctttgccaggaatgtgcgggcccaggagcatgccaccaggccccctggtgtcaaacttctcctgcagccagtcgtctcatgagaaccctgggaaccagccctgtgcatggcgagagtggagcatcattccgacaccgcccctcacaggccagtctggcatagacggcatgatcctgatggatcggtcggtggatatcgtctcccccgcctgcacccagctcacgtatgagggcctgctggaggagaccatgggcatccgctgtggccaggtcgtccttgaatcggaaggtgggcgaggccgatgtggccggtctggagattgggaagggggacagggcggagacaatgctgttactgctgggctgtctcgcttttacacctccatgccatgctgggccgcgacacagtgtactccccaggaagtgccgggcggcgaagctgcacctctttccaatgcacgaggctggctgcatgccctgagctgaggcgtgcattgcatccgcgcggcgcggctcactccctccacgaagctcatgcattctcgtgcatgcaggnnnnnnnnnnagcgacacagtgtactccccaggaagtgccaggcggcaaagctgcacctctttccaatgcgggaggcgggctgcatgctctgagctgaggcgtgcactgcatccgcgcggcgcggctcactccctctacgaagctcatgcattctcgtgcatgcaggtgggcgcaaggtgcatggcctcaactccagcgacgcagtctttgtggagacgagggacaagttttacatggatgctcgtcgctggatcaacgagacgctccggtgtggactgcgaagggggtcatggttccatgtagggcaccatggatggagtccagaggtttgagggcctgttgagtgctgctgcgggggtgtcaggcctgcacaacccttgaacaacctgtaccagctccaagcctgtccccatctccttacccttgccaggaccatccagcagttccgggaccagggaatccacagcgccgacatctccgcgctgagaggatttgtttccggtaggtcggtggtgactgcttgtcgtgcatggcgccacgagtgcgtcaagctcagagatgtacagctgtacggccaggcagccaccatgcagggcagcaggccttagtctgtccacccaagcacctcaggcacctacctttcagctgtccgagagcctgaacccgcgatccaacccatctctgcagagcttcgcgacaagtttgtccgcatcccgctgcacaccagcctgatcgagcagctggcggccagcctggcgtcccctggctttgccgcccggcagaaggtcgaggcggggctcctggacggcggcgacgagctgccagccatcctggtggggcgtgctgtagtgttggggcatctgcagggtcctgggcatgtgtgatctggtgactgggaaggcaaaccttggtcactgcaagagcaagcgccggaccctgggcagtcatggctgggggtgggctgccccgcacaccgtgctttctggctcgcacagctggacactggttccaggagtcttaccagtcaagggcgcgcccaggcgctgcctcccctcctccagcatgcaccacacccttccacacacacnnnnnnnnnncgtcatggcgggggtgggctgccctgcacaccatgcattctggctcgcacagctagacacttgttccaggagtgttaccagtccagggcgcacccaggcgctgcctccccttcaccagcatgcaccacacccttccacacacacaggacctcatgtacaccggcgagggcgcggctgccgtgctgcgcctgctgtgcctctactgcgcggtgcacggcggcatccctcgcaaggcgtacgacggcctgcgtcgcgatttcctcaacacctacggccacgagcacctgctcaccctggcggcactccagcgcgcaggttggggagggtggggacggcggtgtctttgtcaaggggagttattgtagagagccccgggagccggccctctcaccggcccctgctagacgccaggggtacatcgcggtgtgaatcccggtgcgcatgctacccagcctgacaatcgtcggtccctccagtctccttcccccccacccacccccaatccccaccctgcannnnnnnnnntgcggtgtgaatccccggtgcacatgctacccagcctgacaatcgtcagtccctccagtctcctcaccccccccnnnnnnnnnnaggcctggtggatcggagggagagcagacgctcggcattcccgttggtgcgtgaagccttcgggctgctggcccaggaggacggggccggcgccgacacgaccccggacatccacttcacatacgccgggtacgcgccgctcagcgtgcgcgtcgtgcaggccgcgctgagcgggagcgggtggggcggcgtggaggccgcgctgggcgcgctgcccggcccgaccgccgagctggcgcagggcgtggggcccgaaggccagccgaccacgcgcacagaccggggcccgctgctgggcggcggcggggcggcccccgccggcgtcgacctggggacgggcgcccgccgccccctcgtcctggtggtctacgtcggcggcgtgacggcggccgaggtggcggcacttcgctggctggccgcgcagcggcgcgtcccctgcgacttcctggtggctaccacgggcgtggtgtcggggcggagcctggtgcaggagttcatgccgccggggggctgagtgtgctgtcgtctgtggcacaagcagggaggggcgtgaggtgtgggaggatgctgctacccggtgcatgtaactctgatccccaacatgactggcggctccccatggtctgagggtccaggggcgcaagaaccccccgattacagtatcacgggcttgggtggggagtgcacagccattatcatgatgtgacgatgggcgggatgcgtggaggggccagccctgcactcgccagggcgcttccaggcatcggcatgcacatgggcatggaggctcctccctcgtcagatgcatttaagtgcgagcagcgaggctgggagcggctgcatccatgcagcaacatctcactgcgaccagtaggccccgccgtagacggcgatgcctagcagggcgccccccaccagcgagtgcagggtatatgtgtaggcgtggaactggtcgggatagaccgcagagaatttcacgatctgcgtggggatggagagggaggaaggaggaggatgaggggggcgaaggggagcgtgcgagtnnnnnnnnnnaagggcgccccccaccagcgagtgcagggtgtatgtgtaggcgtggaactggtcggggtagaccgcagagaatttcacgatctgcatggggatggagagggaggaaggagggagatgaggggggcgaaggggagcgtgcgagtgccgcaagcaaggaagtccatgcttggaggactagtctgggacccttgaccgaggcagatctgcctggcccacccaaccaccagccacaccacactctccctttcctcgccgtacctctgccaccagggtggaaaccgtggtcagcgcgccgcagaacccggtctggacggcgctggtgagcagcgcgccccagtaccccagcccggctcgagcctgggtggcggccatggcgaagctggtggccgtgccgagcatgttggccgccagcgtgcccgtcgggtaccacgggcaccggctggactgcctgtagttgagctgctgcgccaggaaccagcgcagccagcacctggtgagatgggagaatggccatgggaaggtgggtgtgttgggttggcggggcaagggacgcgcagctgcaggcggcgactgcgctgcaactcccatccctccggagattttggcgcctgcagaagagagaggcgccgccagcgcctgccaggctgaggctctgnnnnnnnnnnaggagaatggtcatgggaaggtgggtgtgttcggttggcggagcaagggacgcgcggctacaggcggcgactgcgctgcgactcccatccctccggagaatttggcgcctgcagaagaaagagaggccgccagcgcctgccaggctgaggctctgtcgctgatgcggcggcccaaacctgccaaggacagtcacggcagctcccttagacccccccggcagctcccccagaccgccccggcagctcccccagactgccccggcagctcccccagaccgccccggccccccccacaataccccggcacgcccagcagaacggagaagaaagcggtccggatccaggtgtgctccctttccagcccggcgcccaccgcccagccagcggtgagggccgccagggccagcgcggtcgcggcgtgcgtgcggttgccgcgccacctcgcccacgggcggggctggggccccggcgcgccctcctccgcgcccagggccgccttgggcgtgccgtcggcgagcgcggggtcggcggggtaggggccggaggagatgcggggcaggtccaggtcaacctccagctcctcagcctgggaggggctgatgcgcggggggcggcgcccgcgctcggcggccacctcctcggcgaggaaggcggcctcctgggccagcacgtcctcccgctcaggcagcaagtacctgtgtggggttaacactcggggagggttggtgagggacagctcaggtggcgtgtgggggagttgcggtgcacttggcagggaggcgagcggacgaagggcagcataggttctgccttataccccggccaaaccatgcacatccattcaaagcgccatggatgcaggaggtgcagaagttcccgctcccgcacggcgttcacagcctgcccaggctccacactgttcccctcctccccacctgtcgattcccagcgcaatgtggcagccaacaatgtaggccatgaggctggcagccaggcccacaatgtaggccatgatggcattcacccactggttcaggctgatggcctccgtcatcagctccacctgccaggtcccaaaggttgtcagggacccgcagtatcccgtgcgcaagcctggggagtggtgggagggggcaaaggggagcagggcgttgaacggaggccggaaaagtggtccgcagatggcccaggaatgggagnnnnnnnnnnagtgggagggggcacaggggagcagagcgttgaacggaggccggagagtggtccgcagatggcccaggaatgggagccggcgcctcttcagggttgcaagagagcatgcgtgccaggcactcgccgcatgccaggggtaatgtagaacaccgaccctcaggcgctcgctgcacagcctcaacccacgagcctggatctctgaagggccccccccccccccccccnnnnnnnnnncgagcatgcatgccaggcactcgccgcatgccaggggtagtgtagaacaccgaccctcgggcgctcgctgcacagcctcaacccatgagcctgaatcgctggagccccctcccccccaaacacgtgccaatgtgcagcgggatgttcttctgccaggggtggctggcggggagcagggtcacctccttgggcgtgctcaagcccaccaccgaggaggacacgagggctcccatgatcatgctgcccaggaggttggggggcagggacccatagtaggtcccacccgtcaggcaagggccccactgaccagagcatcccagcacgaagaatttgctgaagaagatgcgggtgagcaccccgagctgggcccacagggccaggtgcgtgaggatgagcacatcccggtgcagggccatcagggtttggccgcgcaccccgacactccgagaacagaggaccggatggtacccgggaaaggagtggggctctggaaatatgctcaaaaaagttgttcaaaggggtggcaggggtttgcggatgcctcacaagagccgaagactagggggtggttcggaggaacctcaggtgaaagctgaaagtgtgggtttgatgnnnnnnnnnnacgcaccccgacactcccagaacagaggacgggatcgtgcccgggaaaggggtggggctttgaaaatatactcaaaaaagttgttccaagggatggcagaggtttggggctgcctcacaagagcgaaaggctagggggtggttcggaggaaccgcaggtgaaagctgaaagtgtgggtttgatgagccctcgccgggtacgctcgttcacaaaacacatgacattgcccaggctctgaagtacgacagagacaannnnnnnnnncccctcggcgggtacactcgttcacaaactacatgacactgcccaggctctgaagtacgacagagacaacggatgcgcagcctttcgcgtctgcatgcggccatctctgcaggcagggcgcgcaaggggttatgagctgtcgccgcgttgatctcctctgtatggagatcccaggaactgaatcatctgagaacagcgattccaccaaaacgaggcggtccaagccgtctgccatgctcttttccaaccgaagtaggtaactgtcccagttccagctcaaacatggtagacactgcgctagactgagggcaagaaccatgtgcttggcgtgagcatcatcctttacccagtgctgctggtccaggaagacggaggttgtagttccataaggttgaagggagagtttgccaccgcgatggggtctacgctgttagccctcaagtttgaaagcaattaggatgggctgtgcaaagcttccgcaaccgctccttcacaagctcgattcaccgccacaagctaaaaccccccggggggtgcgggtcgcctgggtggcatgatgggtcccgcctcgccgtcctgatgcggtaccgtgccggtctggtactgcgcaagcagcctgctggccgcctcgatgcgctgctgttcgtaggcctgccactccagcatcttggtcaggtgataggcggaggagatgatgcccagggctgccagcatgtttcccccagggccggcctggggggcgaggagggtcacgaggatgggcgggagcgggtcgtcatgtcctgctgttaacaactgcaggccctgcacccatacatatgaggataccaggcccgcgggatgcaggagttcacaagacacgacgtcactcacgtaggggttggcagaggcccggtaccccatggcccctgcgaagaggactgacgagatcagggacatctggtgtgccgcctgatgtttctccggctggttggtcgtcacccagnnnnnnnnnncgcgaagaggacagatgagatcagggacatctggtgtgccgcctggtgtttctccggctggttggtcgtcacccagtacccaccgacggcaaacacagcgccaagtcccagcccggtcaccaactgcgagcaattgatgaagggaaagcagactccagcaaggcccccaaccaaggcgggccgaggcaagcctcacacgcccctgacatcaatctggatgagactgcaggcatgcgtcgcaaacacaagccctttagcacgatgccccagcatgcacatccccgttgtcaagctcatgagaccctctgtgatgacatacacccttgagatagacccgcatcgaatgcctcatgcttccctgcattatcctgctgacaactcagcactgctcaaggccgactcacccctgggatgctgcgcttgctgaagnnnnnnnnnntctttaccctgcagacaactcagcaccgctcaaggccctctcacccctgggatgctgcgcttgctgaagtaggccgacaggcctcccacccctgtgacgaacgccatcaccagactgaggtctggnnnnnnnnnnactctgtccctctcgcgtgtccaatgatgcttacacaagcatctatcttacataaaggaatcggcaagtcattnnnnnnnnnngggcgcctgtgtgagacagaggaggggcctcaggtcaagcataaacactgtgaccccagacccatcacccactctgtccctctcgcgtgtccgatgatgattccacaagcatatatcttacataaaggaatcggcaagtcattcagcaccacgccgtacccgaagaatgtcatcgtcgacgtgtacactcaggagaggaacttgacacttttggagctacgccgcgcaacctctagatgataaatttactgaaatatagtaattggtgcagtcatgtatcaggcgcnnnnnnnnnncgacagttttggaactaagccgcgcaacctctcgatgataaattggctgaaatttagtaattggtgcagtcatgtatcaggcgcacaacattagttcactactcaagagagtgtacccctgttgtgtagtgtgtttccggacgtcgattttacctaggttctcagcagcggcaacagaccccagtgctcccggagatattgacaggccactgacgttaccggtttcaaactttctccgcacagtcttcttctccagcaaacgtccttccgaagtgaaggagtctgtttcccgtcgtcgacagaaacgccgtagcctgacaacaaaggccgcagcatgccgtctcttccatccttctccatcgacaggcgaaaacttcaacccaggaacactcctatcggtgatggggatgtagcggagctcaacgacgccatggataagagcttggagcctggggcggtgctgctgcctgcagggatgaccattcgcgagggccaagagttgtgggaaggggtcaagttcgggcgccttctgggggcaggagtccaggtatgtggaatatgagacgcttgtaccatgctgggggtttgaagggcgtccaatgcactctatgagtgcagtcctgccgggaggttactggttaatgctcacgaacggtcactgcaaaatcctccccctcatcctgaaggcacgagtcttcgagctggtgcgctccgatggcacgccctctgggaaagtgatcaaggtggcccacgccgatcttggacacaagatcctcaacagtccagtcgtctggatcggcggggaacgagaatgggagatcggcattcaggtttgctgagggttggattgctgtggcttgagcacgagcacctggggttttgagtctcatggagcaggagtgcaagcatgtaagcnnnnnnnnnncgagggttggattgctgtggcttgtgcacgagcacctgggggtttgagcctcatggagcaggagtgcaagcatgtaagcttatccccacttccctgccatcacatcagatgcgagtggcgctgcagaatgaggacgggacgctgcccggttttatgcgtgtctatgactgcgtcgtcgtggaggccaatgaccgagtcaccttcaccggcatgaccatggagaagctgcagggtaggcagggactgcgcactgttatggctgggcactaccctgttgatcgtgtgttgcgggcctttgcctgcttcaatgccgtgctgtcggccgggtgctcctcacagcaccttgccactcagtgccatttgcgtgannnnnnnnnngtatggctgggcactactctgttgatcgtgtgttgcgggcctttgcttgcttcaatgtcgtgatgtcagccgggtgctcctcactgcaccttgccactcagtgccatttgcgtgatcgcaggctgggaggtgcacaagcgtctcttggagcccgatttccacaacatacactatgtccgggaaatgctgtaccaggtaagccaagcctctgatcgttactgtgggtaaacttgaagatcagctggttttgttagcatgccacagatcacacggttcctcagagcctgccgcctctccctccaatgtcctctccctcctttcccccgcctcccagtccttctctgcactggctgcggcgcagcgcaagctgggcttccaccacgctgacctgggcatgcggaacatcatggagtgttaccctcggtaaggcatgtgccgctgtgtgtgctggggtcatgttatcccctttcccccctgcgcaataatccgagcaagctggggcttggggtgcctggccctcttgcgggcatcatcccttcttctcatcatgcttccctgctcgctcattcacaccggcgaccttccacagggtgttcacggatgtagcagaggagcagacggcgaagagcctcgagtcgctgcggcaggcggagagcagcgggagcgaccccgccccgggctcccccaccagctccgcgggcgagcctgcgggcggcacctcggcggcggccaagctcaacgccgcggacgccgacctgccggagcgccactcccaccgcagggtgaagcctgtgcgtggtttcacctgcagcgcctcgggcgagatgctgcccctgggcccccaggtggagttcaagatcatcgactacggcgtggcgatcttcgacgagcggctggcggagtccacgggcggcactgagtacaagggcgtgctccagcgtatcaagcacgtggtggcggccaaggaggtggtgttcccctcgcgggagggcacccaccccgggatcaaccgcacggtgcccctgcagacgagcacgggcgcggtggggcgtgccagccacgcctggcacctgctgcccacgaagctgaagaacaagttccgggtgaagcagacgcctgtgggcgctttccccgtggtgtcggacgagtccttcacggatgcgccggcgggcgtggcgctgggcgccagcaagcgcatcccgcgcctgaacaacgccacgcgccgcctgatgaaggagtctggctttggtgagggggtggtgtggatgggttggttgggggtggggctacccacttggtccaggcaagggagggtgtggcgccttgctccagagggatttgcaaggttcgtggcctggaattgccagggaacacagcgtgcagcatgccatgcctctgctggcatcacttgcaactgagcattccagaggagttcacaggcatgcagacaacatcccccttttcctgcccgtgcagccctggatgatcccctggcaaannnnnnnnnngtgcctctgctggcgtcacttggaactgagcatcccagagcagatcacaggcatgcagacaacattccccttttcctgtccgtgcagccctggatgatcccctggcaaacccccaggccaagggggacaacatcgaggctgtcagcatgagccccgtggagagcatgtaccggtgagcgattggattctacagggtgggaggggctgcatggcatgaattcgcaagcgcaactatcttgagaggggctggcacctctggcaggttgccaacccagttgaaaagggaactggagactcgtgagcgtaaatgtgcctctcggtggcgcccctgctcacagtgcgcagggcgtgccacccattaaggatgacgactcgattccttcttccccatcatcgaaatcactcacaggaacttctggcggcgcaagggggatgtgtttcacatcttgctctctgtggggatggccctggacaacaggtgggagtgggtacaggtcaaacagagagcccccaggggtgattgctttcggcgcggtgtggtctgccaaggtcctgactgaaagcacacgcgtcagctcctaccatgtgttttgccggggccgcagggtctggccaaagcatgacgaggacctggtaaatgccttcatcagcctcgtgttccattgcacgggcgtgaaggtcaaggcctcctttgccgcggccagcgagactggcaccaacaacctgtacggaaccctggaccgagcagagagcctgcaggtactgtggctgctgttgtgttgcccgccagtgaagggaaaggggcttgggcgacagcagaggggacctgggggccaagctatcggtccggcatgcaactgcatgccggagggtgcctgctccctctgcttgctcccagcaaggcagtgcaaggggtgagacattgaaggcaggcaggagcgatgatggacctcgctttttggccatcctggcatcttgagtctgttccattacctcactcccctgccgttttatgccctcgcaggagatgaacaaggccaacctggcaaggcagacggggcacaaggaggagaagagcggcgagaagagccaccgtcttcgtaactttggggtcaaccgcaagtggtaccgccccatccgccgctaccgcatgatgtgagcagctgggtcactgggctgtatgcatggctcatacgagtggctgctgggccgagtaagtggctgctagtctcaggcattcctgtcattctcaacccctcccacctctccccctttattacaggttcaaggcccacatccatccctacannnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtttcccagctgataggaaccccttgaagtaatctacgtgcctccccttcacattcccggctgcccctgcagccagaacctgtcagaacccaccctcgccctttcacctatcctgcccatcatcataatattgcaagatcaatgttactgtttccatgacgcctgcccttgtctcagatggactgtactgcaacttcgacaacaatgacagagaggtttcagcattgcagagggaggactgccggagacaccctacttgctgacatgtgtgctcatacacggaagtcgaggcgccccagtaggccaccatgctgatgaggnnnnnnnnnnaaggactgccggagacaccctgcttgctgacatgtgtgctcatgaacggatggcaaggcgccccaataggccaccatgctgatgaggacccctgccgaacccctctgatcgctgctccgcccatcacagagacgagtcgccatcagcaagcccaaaggtgtgtaattcagggcgacctgtgattgcaatcatttcgcttcgaggtgaccagcctccgcatgatcacatccctgggacccacacggcaggagagcatgccgtctttgccaggatcctgatcacggtcagcagcgtctcagggtatcgtgaggcgggatgaaccatccagagggacgatggtctggcctggacaacctgctcacccgccccggccgcttcgtgggcccaggcttcgagccgggccccgagctccgtgacttcctgcacgatgactgccggtgcggtgcacggcgtcgggtttggagcttggctgggactgccaccacgctcccagcagccatgagctgcatgatccctggggagggcgaggtttgcaccctgcccagcctggccggtcgttgggccccacctaccctccaccccatcccgcatcgccctgcccaggattttggtggtgggcgccgggggcctgggatgcgagctgctcaaggacctggcgctgtctgggtttggctccatcgacgtgatcgacatggacaccatcgacatcaccaacctcaaccgccagttcctcttccgcaccgccgacgtggggcgcagcaaggccgaggtggcggcggcccgcaccatgcagcgcgtggcggggctgacggtgaccccccaccatgccatgatccaggtgggtggggtgttggtgggtgtctggggagaattgggtcgtgagtctgggtctggcaggtccagacagagtctcactggaaggaggcagacgatgggaacctctcgtcccccccctcatgccagaattgtgccttctttccttgcaggacaagggcctggatttctacgcccagtttcatgtcatcgtcctcggcctggactcgctggaggctcggcggcacatgaacgccgtcgcctgcagcttcctgtgtgagttcaggccttgcatgtattgagagggaggcatgagggagggagggtagtgcagggcagacatgagggattctgaatgtgggtcagccctcgcagcaatcaggaactggctaacaggcccaggcaggggtgtccctgccaattccctgatgaccgcgttgaagtgctgcggacctcgccattctcttaaatgtgtcaaggcccccgtcctgcttgaggactcacgcatttgctccctctcaaaatccatctcacagcctacaacccagacggcaccccagacctggccaccgtgaaaccgctggtggacggcggcaccgagggtctccggggtcacgcccgcgtgctcctgccgggggttaccccttgctttgattgtacgctatggctctttcccccacagaccaaatttcccttgtgcaccatcgctgagacgccacggtgagtacaagtggtgggtggggtttgagaatgttacgtacttgcaggactgcgcaaaaaagggtgcttgcatgatgcatcgccgggacctnnnnnnnnnnttggtgggtggggattgagaatgttacgtacttgcaggattgcgcaaaaatgggtgcttgcatgatgcatcgccgggaccttttgagtgtgcatggacggccattgggcagctgatggttgtaagagcaagtcgcattgctgtgcgagagcaaccatcatcgtacctttgttcacctccttctcacgtagatccccggcgcactgcatagnnnnnnnnnnatgctttgagagagcaaccatcatcctaccttcgttcacctccgtctcacgtagatccccggcgcactgcatagagtacgccaagatcatcctgtggccacgtgaacaccaagacacggcttttgacccaggtgagtgttttgggggggggttgaatacgactttctggcatggtcatcaccatcagcccggcacgtgagttgcaatgattgtcggcataaaaagaatgtagctcgtttccgacaggcccccccccttgtctgtcctcagtatgtaagaccccaccctnnnnnnnnnnttgggggggctgaatacgactttctggcatggtcatcacaatcagcccggcatgtgagttgcaatgtttgtcggcataaaaaaatccagctcgtttccggcaggcccccccctcgtctgtcctcagtatgtaagaccccaccctctgtgagcaccttgcagacatcgaggcgcacatgcattggatgtttgccagggcgcaggagcgggccaaggagtttggcatccaggtgtgcagaggggttctggaggtgtgggtggtccatgtgctgaatgctggcagggaagctgggccccagagtactctccagcnnnnnnnnnntggattctggaggtgtggtggcccatgtgctgaatgctggccgggaagctgggccccagagtactctccagcagtcggctgggagcatttagcacactcctctcgccgccaacctcttgcctttgcacgactcttgtgcagggggtgacgctgcagctgacccagggcgtggtgaagaacatcatccccgccatcgcctccaccaatgccatcgtggcggccagctgcgcgctggagaccctgaagctggtcaccctggcatccacggggctggacaactacctcatgtgcgcgtgcagggtcctaggggagagcagaataatgaggggttttgggacacacttgcttccctgtggaccatagacggtccgtccgcagcaacatggagctgccttgatgcnnnnnnnnnncaaggggggttgggacacacttgctttcctgtgggccatagacggtcggtccgcagcaacatggagctgccttgatgctcgccctgggagccccccttgcgcagatcgccaggtgttgaagccacccgtcttccacgcgtttcccccctttccccccgtgtcttacctttatcgtccctgcttgactcattgtgcggctttcccttcccaatctcttgctcatccaggtactctggcgtggatggcgtctacacgctgaccacgcagtacgagcgggaccccgcctgcccggtctgcagcgcgggcgtgcccatgaccgcgcccccgacatgcacgctgcgcgatctgctgggcctgctgaccctgcaccccgcgctgggccgcctgctgcgcgagccaagcctcagcgtgggcagcgtgcccctctacgcgcgcggcgtgtttgaggaggagacccggcccaacctggaccgccagctgcgggagctggtgacaggtcccctggtggagctcaccgtgaacgacaagggcctggtagccccgctcaaggtgaatgaaagggaaaggagatgggaaggtgtggtgcgtggatggaggagagcgaggcagacgagctgcttggggggaaaagagggaggggcgggaggtgcctgtgcgttcggggtctaaaccacgcgtggcgtgccgcnnnnnnnnnncaggggatgggagggtgtggtgcgtggatggaggggagcgaggcagacgagctgtttttgggggggaagagggaggggcgggaggtgcctgtgcgctcggggtctaaaccacgcgtggcgtgccgctgacgggctgcattcgcgcttcgcctccccttgccaggtccagctcaggctgcaggttgcggaagagtgaggcctgccacagatacaaggacctgacctgacctcacgcttggctgccctggagcaggttgcaaccagtcactgcgcccaggtctccacccacgtggccgccaagtgctgctagcgctgcactgttgacccactcctctcattctgaggatgacagtaaccaccctggccggcgctcatcggtcctggatgcagttgtacactggaaatcatggggtcagacagagccaggaagcggggtttccatgggtgtgagcgcgctccggtgccacactcgccgcaggacaccacccaggtctggggcagagcccttcactgatcaccgccgggcctcccgtccacagcatgtgctctggccactcctccgctcgctcaggccctgacaccagccggcagcgagtccaggaagttccggacgatggtcaggccgttgtcggtgatgacgctctccgggtggaactggacgccctgcacgcccggcagtgcccggtgcttcagccccatcaccgtcccgtcctcacaccaggcggtgacctccagctctggcggcagcgaggcggcgtccaccaccagcgagtggtagcgcgcggcgcggaaggggttgggcaggccccggaacaggccctccccgcggtggtgcaccagcgaggtcttgccgtgcatgaccccggtgggggcgcgcaccacgctgccgccaaaaacctggccgatgcactggtggcccatgcagacgccgaagacggggacacccgctcggcccagtgaggccaccgtgtccaggctgatgccactgtcctctggccggcctgtgagttgggagggcgggcgagactgagggatgggtcgtgagcagggcaggttgaagaggatggccttgtgcatgagccaaccagtcaatacccctactttggcacctgggccgggggacaccaggacgcccagcggctgcatggccgccagggtctctacgctgactgcatcgttgggtaggacgatgtagtcacaccccaggtcgcccaggtactgcagggacaaggtggcaggcgtgggaggatgtagcgacagggtccacaggggaagacacaccctggggagggctcctgcgagttgacctggccggccggtctatccaattcatccacctgacacaggttgtaggtgaagctgtcgtagttgtcgaccaccacgactgacccccgtgcgctgcctggggcggtcgacaccccgcccgcggtctccgccctgacgccgagacagaggcatcgcccacgacttgtgtcttgtagcctgggccctgttactcctgctgggcatcatgcgcgtgaaggggtgtagctgctgctagtagaggcacctcagcctgggctctccctgtgagaacgtgctgacccaggctcctccaatctattcaccttgggagccgttcctccgctgtgctactgtgtggaatccactcggtttcaggaataagctagtttgggattgctgagtggacctgctgcccgtcactgacaccggtcgagcggcagtgaaagcagccatcctcgtcccggttcggcgagaaaatggcctgtctttctgcgcactatcctacaaaaattattattcgtcggtcaagtatctgcccaatgtgtagacttcagtgaagggcttccagattatacattggggggnnnnnnnnnnnnnnnnnnnnnnnnnnnnnnnnnnnnnnnnnnnnnnnnnnnnnnnnnnnnnnnnnnnnnnnnnnnacagcagcacgctgttcgagtccttaaccccatgacgcatagctcgacgcacctctgatttctaaaaggcaaccaattatgagaagacaggagaaggccaaattcttgagatcatcgctgggggtttagttcgtgtattcaataggtcatgccccattgttgacttgggacccgccagcctaacactcagcgtagccatgaccagctcgagtcccgacatggcgctggtcaaggtacccgagaagaccattcaaggtcttgttccggagcacccagccctctcagcggctcaagctgccctcggggcacagctgcgagagacacagcgccgcctccatgacgagctccgtgaggcaatcaccgccgccaaggcaggccacatggaggaggatgttctcggtgctggctttgtagaaagagcagagggcaacgccaactcatcatcaattcatggtgccctgatttacacaccaacatcccccagggacaatagcaggtttcgcgtctagtattcgcatggctcccaagcgcaagcactctttccctcagaccgctcctccattcccaaccccgtggtcgtactccaggcggcttccagggcacggcaggaccagggggttcagctgtacgaggtgcaggagcaggtggcaggcctccaggcctcgctgtcccgcctgcaggcctcggccgcagaggcggcccaggagcggagccgggaggaggtggccctacagcaggcagaagccgagctcgcctccgccaagagggcgcatgcggagcgggacggcggcacggccgcgctccgcgccgccctggccgccacggaggtcgcgcggcgctcggccgcgggggacgcccagcgtgcacagcacgaggcgggtctggcacggtcgctaggctccgcggcgcggcgagagggcgccgcggccaccgcgcggctctcg

SEQ ID NO: 41261 - DNA, 74 bp, Chlorella protothecoides
ggtcccagcgcatcaggccggtgctcagccaacgagcctcgttgaacttagcgtgcggcacctcgtgtcgtcgt

SEQ ID NO: 41262 - DNA, 78 bp, Chlorella protothecoides
ccctccccatgcagacacactggctgccgtgatcgatgccgccaagcccggcgccaagatcgtggacctgtgcaccct

SEQ ID NO: 41263 - DNA, 126 bp, Chlorella protothecoides
gccccaggtctgccggtacgacgacgggacgggggacgagctcgccgtacccctgggcaccaccgccttcgtctccggcaccaccatgctggacgtgctcccgcccgccctgcgcagcctggcggt

SEQ ID NO: 41264 - DNA, 80 bp, Chlorella protothecoides
ggtacaatattccagcaggaccatgccacatggaaggcagaggagggggccccctgcactgcgcctgccctcctcgccag

SEQ ID NO: 41265 - DNA, 64 bp, Chlorella protothecoides
acctgctttcgctccccaaaacatggatcccataaccagctcacctataagaagcttctgtggg

SEQ ID NO: 41266 - DNA, 86 bp, Chlorella protothecoides
ttgtagcaacgcttacatcacgagcatgaatttcaaggtttgttttggttagcaatgaagagtgttgtgtgagtcaaggtcaggtg

SEQ ID NO: 41267 - DNA, 77 bp, Chlorella protothecoides
aagatgccgccgcgcgctcgccgcttcaggacttgattgattcatccaaggcttcaatgggacatgactgcgcgttg

SEQ ID NO: 41268 - DNA, 61 bp, Chlorella protothecoides
gcggggggcgatggggtcctgggatgagcttggtgcactgctgcacaggccttgcggggtt

SEQ ID NO: 41269 - DNA, 187 bp, Chlorella protothecoides
agcggcggcaggtcggtgggcgcggggtgtggtctgtcgggcggtgatgggttggactgggagtgacctgttgcacagagcgctggtggagggtacggggtgccgtgagcgtgtggaagggaccagcgagggttacgagaacgtggcgaccctcatgactagctgatgagaaagcacgaacgaagca

SEQ ID NO: 41270 - DNA, 61 bp, Chlorella protothecoides
aggagggggcgtctgggtgtggctgcaggggggactgggtcatacagaaggattggcgtgg

SEQ ID NO: 41271 - DNA, 75 bp, Chlorella protothecoides
ggcttcttcttgggaggcggcttcttccttggtgggggagggggcggctttttcttgggaggcggcttcttcctt

SEQ ID NO: 41272 - DNA, 74 bp, Chlorella protothecoides
cgacgccctgctcctccttccatcccagcaaaacgcagcccttgtccccagctcaccccaggagatggtgtatc

SEQ ID NO: 41273 - DNA, 407 bp, Chlorella protothecoides
  modified_base (301)..(310): a, c, t, g, unknown or other
ccgatgccgccccgcccacgccgtcgcacggcgcaggaccccccgccgcgccgtcctctgcagcatgttttgcggcctgcacgccgcccgccactccctccacgcccagcaggtcttcgtacagcggcggcgccggccgggccgcctgctccgaggaggggcgccgcggctcgtccccgggccccgcgcccccagaagaagaagcaacggcggggtgcgggtacgacgccgcgcgggaggcagccctcggccgggggccctccgcggcccaggctccgcgcggggagtgctgcaggctggnnnnnnnnnnagtacgacgccgcgcggggggcggccctcggccgggggccctccgcgcccaaggctccgcgcggggagtgctgcaggctgggaggccgggccgtggg

SEQ ID NO: 41274 - DNA, 9156 bp, Chlorella protothecoides
  modified_base (294)..(303): a, c, t, g, unknown or other
  modified_base (566)..(575): a, c, t, g, unknown or other
  modified_base (3720)..(3729): a, c, t, g, unknown or other
  modified_base (4387)..(4396): a, c, t, g, unknown or other
  modified_base (4680)..(4689): a, c, t, g, unknown or other
  modified_base (5152)..(5161): a, c, t, g, unknown or other
  modified_base (5659)..(5668): a, c, t, g, unknown or other
  modified_base (6055)..(6064): a, c, t, g, unknown or other
  modified_base (6348)..(6357): a, c, t, g, unknown or other
  modified_base (7127)..(7136): a, c, t, g, unknown or other
  modified_base (7592)..(7601): a, c, t, g, unknown or other
  modified_base (8023)..(8032): a, c, t, g, unknown or other
  modified_base (8265)..(8274): a, c, t, g, unknown or other
cccccctccctcccacctcactcccccccactcctcccccctaggtctacgccaccggcatcaactccttcttcggccgcgccgccgcgctgatgggctccaccaatgccgtggccaacctgcagaagatcatgacccgcatcggtggctgctgcctcatcaccattggcgtctggatcatcatcgagctctccgtccagttcggccactaccaccactcctgccgtgccggtgtcggtgagtgggggggtgtagggatggcgagaggggtgttgcacctggctggcggctccnnnnnnnnnnttgccgcgccggtgtcggtgagtggggggtgttgggatggcaagaggggtgttgcacctggctggcggctcccgcagcctgcctatcagattgcaactgattttgcggtttgccagcctcagcatttacccctctccccccttcttgctcacttcatctggcccctgcactattgacccacttctccttcgtacatcccttatgaccaccatcgatggccggggggtggggttttggaacacaggggtatgatgtccaaaaannnnnnnnnnggcaactgattttgcggtttgtttgccagcctcagcatttacccatctccctccttttcgctcacttcatctggcccctgcattattgacccactttcccttcgtacatcccttatgcccaccatcaatggcccggggggggtttggaacacaggggtatgatgtccaaaaacatatcaaactcaacaggcttgaagggagtggtgcgcacagtcgcccgccccccctgtagaaccttcttcaaccctgatccctgtgctctccgagccccctgctactctgcgttccatgttccgagttcctctcattctgccatgccccgcgtcgctatctcctacgctgtccctcgtcacttgatctccggctccgctgcgggtccctgcctcagccccaacctgcctgcatactctgcttcctggcaccccctggccgttgcagcacccgctccctggatgcacactgtgattacgtcaccgccttgcactcacccaccccctcccctctcccccacccccaccaccccgcaggcaactgccccaccctgaccaacatgctggtgatcatcgtgggaggcatccccatcgctatgcccaccgtgctgtcggtcaccctggccctgggcgccttcaagctggcgcgcgagggtgccatcgtgtcgcgcatgtcggcggtggaggagatggcgggcatggacatcctgtgctccgacaagactggcacgctcaccctgaacaagctgactgtggaccacgtgaacacctacaacatgtccgggcacagcatcgaggatgtgctcaagttcggcgcgctgtctgccaacatcgtgaccgaggagcccatcgacatggtgttgcacgagtcctaccccgagcgcgacacgctgtggagcgagtacaagctggccaagtttgtgcccttcaaccccaccgacaagatcaccatcgcgagcgtgacggacgtgaagacaggggagaagatgcgcgtgatgaagggcgcgccccaggtggtggtccgcttcgcgcacaaccgcgcggagatcgagtctgtctgccacgacaagatcgtggagtacgccaaccgcggcttccgcgcgctgggcatcgcgcgcgcggaggggcacgagggcgaccccacctgggtgatggtgggcctggtcccgctgttcgaccccccccgccacgacaccaaggacaccatcgagcggtgcctggagatgggcatccacgtgaagatgatcaccggtgaccagctgctgatcggcaaggagacggccaagcagctgggcatgggcaccaacatgttcaccaccgaggcgctgctgaaggcgaagcagggcatcggcctggtggagggccacgcctcggtggaggacctgatcgagaacgccgacggcttcgcggaggtctaccccgagcacaagttcatgattgtcaaggtgctgcaggagcgcaagcacatgtgcggcatgacgggcgacggcgtgaacgacgcgcccgcgctgaagaaggccgacgtgggcatcgcggtggcgggggccaccgatgcggcgcgcggcgcggctgacatcgtgctcaccgagccggggctgtacaccattgtgggcgccatcatcggcgcgcgcaagatcttccagcgcatgaccacctactcgcgctacaccgtggccatgaccttccgcatctgcttcacctttggcctgctcaccgtcatctacgactggtacttccccaccatcctcatcgtcctgctggccgtgttcaacgacggcgccatgatcgcgctgtccaaggaccgcgtgaccccgtcccgcctgcccaaccgctggaacctgccctccatcttcacctcgggcatcgtgtacggcctgtacctcaccctgtcctcctgggtgctctactacgtcgccacccacctcgacttcttcgagaacaagaccaagctcgtcagcctgaacgtcaccgaggagtcgctgaccaacttctgcaccagcttcgccatccctgccgcgggtgccaccccgggcgccaccctgtgcaccgtgcccagctacgccgagcagctgggcgccagctgcgaccagtacgacgtcctgaaccagtgcatcgccgagcagagatacgtgcgcggcgccatgatgcgctccctcctctacctccaggtgggctgagggcgggtggggtttggtttctgggggcccccttgtcgtggtggggaatgggtgtgggtgggggccccactcgcgtcttctgacagggggatcttgtgagacgatcccccaggccttgtgtgcgaggctcgtccttgccagccccgcacgatgagggccccatgagagtttccctctctcgtatccccacctgccccccgcacccccctcaacacacacacacacgctctagcaaactcccccccccctccacctccccctcgaacaggtgtctgtgtccgggcaggcgctggtgtttgtcgtccgctgcgtggagtactcgctgctgtcgcgcgcggggctgctcacgtacgtggccttcttcgtggcccaggtcgcgtccaccctgatcgccgcctttgggttcaacgggtacgaggagccgagcaccaacctggaggactgcgtcttctgcaccatgtcctccggcaaccacaaccccttctggaacaagcgcgcggtgccgctggagggcaccgagtccgccttcaccgcctctgtcatcggctgcctgggctacgtcatcgtggcctggatctggtctgccatttggtacatgggcctggaccccctcaagtgggccctgttctacgtcctgaacgaggagggcttccgcaacggcggcttcttctccaccttctacggccagcgcggggaggccatgggcacctccgccggcgtcggcatcaacaagaactccatgtcccgcgtctcgctggcacgcggctccgcacagcagcgcgtgtccatgggcggcaagacctcgggcggcatccccggcgtgggcgggtccatggtgcccggccccgccatgctcgagcgcgcctccatcgtgcgcgtgcccaagtgaggccccgccaccttgccggcggggggctgcggcgcggcgcggagggggtgtgggagggaggcggggagcggggtaccatcttgagcggnnnnnnnnnnggcgagccggcggggggctgcggcgcggcgcggaaagggtgtgggaggcaggcggggagcggggtaccatcttgagcggcgggacgcctcgaaggctgcctgctccccggcggtcccctccggccccccccgccccgccctcctccagcaacctgcccagctcttcccccccaccccccgccacctttcaaactttgtggcagtgcatcgagcaccccaccatgactcttcagcatttcctgcttccattccttgccgatgaacaaagaatagtcatgccagacaatccccccctcgctgctgtcgcatacccttgtcagatggtacccctgcctgtgcatggctgtagctccttcccgctccgtcatgtccatgggcgaggtggggggggggggcgctgccatggccttccctgtgcgatgtcaacaagaccttttgagcaagggagccacagaggagggtgggtggtctctgggctggcacgtgcagccagagccacagaagggggcaacaaccctgcggctgccacgaaattacggccgggaggtcctgggccacgcatcggctctggaactcgagagacaaccaggagctcgagcaagatggctacatagaagccctgataaggagtcgcaagtaatcacatcacaagccatgnnnnnnnnnnatcctgggccacgcatcggccctggaactcgacagacaaataggaactcgagcatgatttctacataaaggccctgatgatgagtcgcaagtaatcacatcacaagccatgaccaacacggatgacatcaaggcggcagacatgtcggaggagcggggcagcgagccggtgaaggagggagaccatgttgcctggaagtggggtgcaggtgagatggtctccaggggcccactcggaaacatgtgtggcctcctgtttgagccataatacagtttattcatacnnnnnnnnnnacccactcggaaacatgtgtggcctaatgtttgagccataatacagtttattcatacaatgatcttttgggcgtgggcatggcgagttttcacaaaccctgtcaaacgcatgtcgtgtccatgatcaccatgcaggcatggtggagggccatgttgccgagacttccaccgagaagttggtgaaggagaccaagccaggcaccaacatcacccggaacggcaccgaggacaacccagcggtgtacatcgagcgggagggtaacaacgttgtgaagaagcagagcgagctgtacaaggtgcatgacgagaagtagatgaaattatttaatggaccactaccatgtcatgtcatcctgtgtaatactgtgcccagacgccttgctccaccagggtgtctctaagaacctgtaaaagggttgagtttccgagcaacattgccatcagagtgtgatcaactgcaagnnnnnnnnnnatctcaaagaacctgtagaaaggttgagtttccgagcaccattgccatcagagtgtgatcaactgcaagctatgcacagtcctcactgcaaagcacggttgagggccgcaatcgccagctccaagcaccgaatcttctctgcacggtactcagcagccagcgcaactctctccgccgatcctgagctctgcttcccggcgagcagcagctgggccttgagcgcctctccagcctgcacgagggcctgcctgccgacctcccccatgcctgaaactctttggaatgagccatcggggcccagcaagccctgttggagcggaaagcgatctctactggaaacaccattaccctttcctcggaatgtctggagggccaaatgatgtatgaacctcttcctcctctccaccccttcccgacatacctgggcacggctctcgccgtcggctacatccagctgcacccgctcatgccggttgtcctgctccacaaatccctgcnnnnnnnnnntgccaactgacgtacggacctcttcctcgtctccaccccttcccggcatacctgggcacggctctcgccgtcggccacatctagctgcacccgctcgtgccggttgtcctgctccacaaatccctgcaagggcaacggcagggtgtggacggcctcactccatgccgacctcattgcaccaactggagggtgtgtgcagccacctgagctctccatgacatcattctagcctcccccagcccctgctcacatagtactgcagcaacgtgtcgttgctctggagaccctgtggtgccgggggacatggcgcatgggaatagcaatcatgaatgttggaccgcagggggcatgtgtgtccagcaagcatgtcccccacttcctctaccnnnnnnnnnncggaatagcagttatgaatgttggaccgcagggggccatgtgtgaccagcaagcatgtcccccacttcctctaccaccccaaaccgcccacgtacataggagatgaagacctgctcccctggctggaatgaggagcccgtcgtaagctcaaagctgtccccaaacacgcggtaggcaacatcactctgtggtggggcaaggtgatcgtttctatgctggaacacatgagctggtgcctggagcttggggtctggagcccacccggcaggagcacatggccccannnnnnnnnncctatgctggaacacatgaggtggcgcctggagcttggggtccagagcccacccggcaggagcacatggccccacaaggcacccaggatcaaacgcccgcacctccacgtggctgctgtgattgatggagtccaccccgggcaggagcgcgtaccagcgccggcgccccgacaggagcacgtcgtacagcaggttgaacagggcggctgcgatggcggcgttcagcgcgctctcgagcgggacctgtgcattgaagggggcagacaccagagcgcagctgaatccgcccagacgttcctcgcctggcatgagatgtaagaaggcagccgctcgtcgatatcccctccctcgccccccctccccttactcacatgcgcccagacgacataggcagctcccagcgtgcacagcgcggcccctgacgcgagccgctgctggatgggcggcccggggtgggggccactgaaggccctggatcggacgcactgcagcgcccagaggaatgtctgcttgtcaggggcgggggaggggccacagtaggcctccgagaaggccgtgtacaggtctgcccactccctccgctgctgcttgatctgcatgggggtgatttgagcggcagtgggcgcgtgatgggaagcgtcgggaaactccaatgtgtgctgcaggtgcaccgatggtgttggggctgcaggatcatacatggaactgtggaccggcctgggaagcaggtgatgccaccctcaccgcacagaccatggagcaagcacctnnnnnnnnnngtttgagcggcagcgggcgcgtgatgggaagcgtcggggcactccaatgtgtgctgcaggtgcaccgatgatgttggggctgcaggatcatacatggaagtgtagaccgacctgggaagcaggtgatgccactctcaccgcacagaccatggagcaagcaccttttcttgcacaggtgggtgggccagcaagtccagctcagagtcagtccacaggacaggggtgtccagagactccgggaggaggcggaggtatgccgtgtgggtggctggcagctgtcctgacctctccgcgaggaggagcaccccagccttggcatacctggggcaggggaggggcgagggcgcggagaactgcagccgtgcgtcagttgagcaatgcagaacaagccgaatatcctacagagcccatctgcagtcacaatcatattccgggtaccagataaccaggtctcgnnnnnnnnnncgggagaactgcagccgtgcgtcagtcgagcaacgtagaacaagccgaatatcttacagagcccatctgcagtcacaaatatattccgggtaccagataaccaggtctcgacttgccatggcgcctgcttccaaaagtctggtcgaacaaagttggtgcagggacagctgtcttcggggaggacgcggattgcagctgggcccagcacattgacgagcgtgtcgccggattggatgggctgggtggcctggacgccccgcaatccctcgaaatcagccagctgtaggccgttggctttcacacctgggtgggagtggacacagggcaactgatgaccgttcatcactcagcccttccttttgacatgaaaattcgttcattacaagatatcacctggataggagaggctgggagggctggtnnnnnnnnnnactcacacctgggtgggagtggacacagggcgaatgatagccgttcatcgctcaggccttccttttgacatgaaaatttgttcattacaagacattacctggataggagaggctgggagggctggtcgatggctcggtgatggcagaggacccgatggtccctgatgtgaggattgagcgagccgcacggcggcccatccccccatggctcaagtcgccgcggagcggatggnnnnnnnnnngagcgcatgaggtttcatgctcgcaccttgtgcccaccgatggagcggtgcgaagaaatcgcaagcactggtgccctcctaccatgacatccatgaggcacgccgacccgaggacgtcgcggcggcctagttttcacacccctcgacaatgcggctgcataggttttgaatgacacaggaagagagttggccctctctcaggtcagcagtgcgctgagtggatatcgtgctccatgggtcccaggaggatgggcacgctaccaactccacaccaagattcgggccccagccaatacttgggaaaataaaatcgacgacgtcgacgtccgtccgcgatccccgctccgagatacctgtgtcatcagaataaagtaaacaatacacatacaaaaagcaagtagttcgacgggtctgccctggtcaccgacagggcgcgatcagtatggccacgccggaggagattcagcagtttatggccatcacctcttcggacgaacagacggctaagagccacctttctacagctggaaacgacgtgttggcggcggtggagcagtacttcgcacacgccgccctgctccagaagcgcgagcaggagacgacccggccccgggcctcatcaggcacctctggaagccggagcagccaggcccgcaatgttcgaagcctcagcgactactcggacctggaggaggccgacgaatctgaacacaatgagtactacgccggcggggagaagaggtagggtgggtttccccatgctggtcagctggtccagcttggtgttggggatgatactcttcccctgcagcgccacttgcccagactctgggatacccccttcagcatgctgtcaacctttgcgcagccccgccccccccc

SEQ ID NO: 41275 - DNA, 61 bp, Chlorella protothecoides
cagcatactgctgccctgcctgattaccactgggagccctgcccatagtgggcaccccccc

SEQ ID NO: 41276 - DNA, 101 bp, Chlorella protothecoides
ctcgctgcaccacgtgttgtccccctagtctctcgctgcctcacacctgccgccatgcccgtccttacctcaacaggccatgtcaagatcgatcgcatgga

SEQ ID NO: 41277 - DNA, 145 bp, Chlorella protothecoides
cgccgtggtcaacgcggggcggcggggcccaaagaggaccaagacggcgcgcgactgaggagggggtaggaaggcctggaccggcttgcgtcacgcaggcagcccatctccgatcccaatccggtggccagagcggccggctcag

SEQ ID NO: 41278 - DNA, 61 bp, Chlorella protothecoides
accatggcgttctgggaccagcgcggggagctggcatccacccaggggctgctgtcgtcga

SEQ ID NO: 41279 - DNA, 61 bp, Chlorella protothecoides
ccggtgcttgcgctcgtctggaagtgtaggggatgggatggtgggtggcgggtggtgggga

SEQ ID NO: 41280 - DNA, 61 bp, Chlorella protothecoides
ggggcgggagatgcggccacgccggccgctgaggcgcagcgtgaccaggccctcctcctgc

SEQ ID NO: 41281 - DNA, 127 bp, Chlorella protothecoides
gtgtggcggccctgtgatgcactcgagcatttgcctgtatgaaccctaatctggtgtaccctcatgaagtactctctcctgccgacaggtgctgctggaattccccatggagatggtgtctgccatg

SEQ ID NO: 41282 - DNA, 459 bp, Chlorella protothecoides
  modified_base (258)..(267): a, c, t, g, unknown or other
gagcggcggaccatcgcgcggcaggcctccgacggctccagctcgctgtggaagcagggctcgctcaacctgcccgcgcccgaggacagcggcttcccgggcacccacccggacatgtgtatcgtcagaatacggcgcaaccacctgctggaggtgcgggggagtgtgtatcttggagggggtggggtgatggaagggctgttagtttctggggcgttgttactttctaggacattgtcatttcctggggcgtcgtannnnnnnnnnagggctgttagtttctggggtgttgttacttagtaggacattgtcatttcctggggcgtcgtatgttttcgggatgggaaggagggggggtcctgtcctgtggccatgaggctccctcacctcttccgtccttctgctcgaagacgcattggacgttgactgtcccgaccccagcccctccacacccccccc

SEQ ID NO: 41283 - DNA, 82 bp, Chlorella protothecoides
caccaagaaagtgggggagcggccagatttcgacgagcctgtggtgctctcagacgaccgtggcggcgtcaccgtctccgac

SEQ ID NO: 41284 - DNA, 61 bp, Chlorella protothecoides
aatcacaaagaccgcctcatgtgcccgtgcgccgtgccctatctgcaggtggatgtgcagc

SEQ ID NO: 41285 - DNA, 67 bp, Chlorella protothecoides
cagctgaacgccctctgggcaggtcccttgaagtggcggcgacgcgctggggctgggcagggggctg

SEQ ID NO: 41286 - DNA, 4759 bp, Chlorella protothecoides
  modified_base (174)..(241): a, c, t, g, unknown or other
  modified_base (760)..(769): a, c, t, g, unknown or other
  modified_base (1313)..(1322): a, c, t, g, unknown or other
  modified_base (1388)..(1397): a, c, t, g, unknown or other
  modified_base (1526)..(1535): a, c, t, g, unknown or other
  modified_base (2020)..(2029): a, c, t, g, unknown or other
  modified_base (3349)..(3358): a, c, t, g, unknown or other
  modified_base (3704)..(3722): a, c, t, g, unknown or other
  modified_base (3933)..(3942): a, c, t, g, unknown or other
  modified_base (4212)..(4221): a, c, t, g, unknown or other
ggccgagcgcgcggcgcgccacctcccgctggacctccccgccacggcggtgcgcttcgtggacgacgcggcagggctggaccgcgtgcgcgcctggctggagggcttggcggtccgcggcgcgcgcggcgcgctggtcgtcgtcggcgtggacgctgagtggcagggcccccnnnnnnnnnnnnnnnnnnnnnnnnnnnnnnnnnnnnnnnnnnnnnnnnnnnnnnnnnnnnnnnnnnnnacggagccggcgagcaccccatcagcatcttgcagctggccgacgccgagcgggtgtgggtgctggacatgctgcgcctgggggagcgagaggccggcacagcgctgcgcacgctgtgcgaccccgcgctcgtcaaggccgggtgcggtctggcggacgacgtcgccaagctggcatgggcctgccccgccctgcgcaacatgcgcagctgcctggacctggcgcgtttgcggacgttcagtgcgtattggacttttatttttggggggggggagggaggggcatgaaggcttcgtgggagggctggcgggagcccaagctcatcacatggtccaaagggaggcgtagtgctctgggtggagtggaatgattgcttgagcctggaactgatggcgctatggaagcctgagactgtggtgattgcggtcaagccttcctggcttgaccctgacctgcggtcgccgaaacatttccacctttcatactctcaaatcccctggcagtgggaccgctggccannnnnnnnnncgaatgattgcttgagcttggaactgatggtgctatggaagcctgagactgtggtggttgcggtcaaaccttccctggcttgaccccgacctgcggtcgccgaaacatttccacctctcaaactcccaaatcccctggcagtgggaccgctggccaacaagagaggcatgctgggcctctccagcgcggcggaggcgatgctgggcaagccgctggacaagggcctgcgcatgtcggcatggcagcggcgacccctcacccccgcccagctcaggtgctgcgggcgacggggcttgcaatggtgggcgttgtcagtgtataccaggcacaagggtcatcagtgggtgtgttcattgaagagccatccctgcatcccttcctgtgaacggcaggtacgccgccctggacgcgctggtgtcggtacagattgtggacgccatcgtgcgacaaaaccccaagctggggagcaggcggggcctccatgcctatctgtttgatgccgcccgcgtctgatgatgccgcccgcgtctgatgaagcatgggnnnnnnnnnngtgaagagccacccctgcatcccatcctgtgcaccgcaggtacgccgccctggacgcgctggtgtnnnnnnnnnncgctgggcccactagccagttttggtgtcgttcacggtcgttgcattccccaagtgagtctcgtgtcggaaatggggtggaaagcagggcgcgttagggatctacacggccagtgtaagacgctcttgnnnnnnnnnntgctaggcccactagccagtattggtgtcgtttacggtcgttgcattccccaggtgtgtcggaagtggggtggaaagcagggcgcgtcagcgatctacacggccagtgtaagacgctcttgggatggagctctgcctggattcgtgctgcacatcccattcctcgctatgcagcgcatcacgatcacggcctgcggccgctcggcggctgcgatagcaggagcgggtctcgcgggaggtgcagggcttcgtgccggagctgctcggccacagccgcaggtggcgggggatggtcgttgtagacaggtgtaattatcttgtgtgaacactatattgcaatcttcctgctcgtagaggtggtccgatgcctgatcggctgactgaaactgtcctctggcacctcgcagccctctcctcaactccgccacgagagcatcttcgtcgaggaggtgcgcctgtgtcacgtgtggcaatctggagaagttnnnnnnnnnncacaggtgtaattatcctgtgtgaacactatattgcaatcatcctgttcgtagaggtggttcgatgcctgatcggctgactgagactgtcctccggcacctcgcagccctctcctcaactccgtcacgacagcatcttcgtcgaggaggtgcggctgtgtcacgtgtggcaatctggagaagtttaatgtgtgcaatggatgcgtgatcgagcgagaagtgtatctgcgctaggcaatcgtgagagaggagactgcccctcacaagcaggccctcaaccatgcccgcgcccccttgtcacaggacgctgatggctgggatgtggtatggaacccggtgtcccgccaggaagtcacacaggccctgcaggactttgcggtggcgggtggcgtgggccccgagggtcccctgctgccccccggaaccatcctcctggaggacatcacctctgacgccgggtccagcaccagcgaggggagcgaggccaatatggccatgctgtacgccgagcgctgcgacgagacccaaggcttagggggcctggaggagggcatgattggggtgctgacagggctgctgaataacccagcggtgctggggcccatccaggaggctctccagcgcgacgccaacttccaccgcctgttgacagacgccaggggggcccaggccgttctggtacgatgcgatgtggggtcgggttggtgaagggggggaatggcagctccttttcgctgtggaatgccttgcagccatcggggctgccaagtccctgcccctgcgctgcctcataccatgcattgtcgttgctgcaagccctgtgcgggcgccgacgcctcgtcatcccctttccccccccgcaacgcacagttgcctgcgccagagccccgcccgcggctggccctggagggaccaggcgcagagcccctgacgctgatgagcctgctggagggcctggcggcaggcatcggcgaggtggctgcccgcctggaggacgctttcgcccaggtgacgcagctcctgaggtcgctgggcgagtcgctgcgcgcggcgctggacccagacggcccccgccccgctgtgcacggcgcaccggggtccgcagccgccgacccccgtgtgggcaaggcggtgaccaggctggccctggcggtggccgtctttgtcatcttccgccgggcggcgcccggactgctcatgcgcgtgtgatcagggcagcgcaggcctattgcttacgcgagaagaagatttctgatgcaccgttcctaccctgtacacctgtgcatgcctgttgtgggtactctgaaccctgcatgtgggnnnnnnnnnnggcgcaggcctatagcttacgcgagaagaagacttctgatgcaccgtacctaccctgtacacctgtgcatgcccgttgtgggtactctgaaccctgcatgtggggccagagacctgtggctggtcctgcaggacctcctcccggcccacctgtaccatggctgccccctgtctcagctacgagacgctggatttgtgccgtacctctggcttccacaacaagtggatgtgtacacccaaggccacgagataatcagtgtttgaagcggggagaaccctgaggaattcccaagatgggagacaagggtggctggatgccttacgacaggcacgcggtgcgacgaatnnnnnnnnnnnnnnnnnnnttgccggcccacctgtaccatggatgccccctgtctcagctatgagacgctggatttgtgccctacctctggcttccacaacaagtggatgtgtacacccaaggccacgagataatcagtgtttcaagcggggataaccctgaggaattcccaaaatgggatacaagggggtggctggaggccttacgacaggcacgcggtgcgacgaatnnnnnnnnnncctcacagcaaatgattgacgggcagtttattgaactcgatcctgcataaagtgcagcggcttgctgggatgtctggtgtaatgcctttcgaaatgtggcacgagacaggggtgcatggcgactccaaagatgcactggagcagtgtcattaacccccactgagaagaaaagctttatgaacaagtacatttagtaggtccctgatgcatatttcaaccttgaaacccttggtcataaactttactgcatatggaacgcgtgcgatactnnnnnnnnnntctcacagcaaacgattgacgggtagtttagtgagctcaatcctgcaaaacgtgcaggggcttgctgggatgtttggtgtaatgcctctcgaattgtggcacgaaacagggtgcctgacgactccacagatgcactggagcagcgtcattaatccccgttgagaagaaaagctttatgaacaagtacaattagcaggtccctgatgcatattccaaccttgaaacccttaatcataatctttactgcatatggaacgcgtgcgatactgacaagacctccatatcagcgcaccacccacttctcagcacgcttttgaggggacctcgccgcggtgagaagctcgcggacaatgctacccctccggtccatccgcacctagtccgcgcagtaagggaaacacgccagcgcggcttttgcagttaacgagtcaattcgggaccctgtccacttttcaagcagtggtacgcaaaaggttcttgggccttcttggacccataaagaagaggaagcatcggccccttgtagccatggcgcgcc

SEQ ID NO: 41287 - DNA, 72 bp, Chlorella protothecoides
gggctgcactcactcgctggggtaaaggacattgctggggacatcgatcagcgggtgtgcagtcaaagagca

SEQ ID NO: 41288 - DNA, 61 bp, Chlorella protothecoides
ggggcgggagatgcggccacgccggccgctcaggcgcagcgtgaccaggccctcctcctgc

SEQ ID NO: 41289 - DNA, 80 bp, Chlorella protothecoides
tcggcttgcccctggccacgagcctgagtcgatccctccccaacctcctgcccccctgaaccccgaacaatcgacatccg

SEQ ID NO: 41290 - DNA, 61 bp, Chlorella protothecoides
ggccgactcctacctggactgcataaacaacgtctcccacgtgggccactgccatccccag

SEQ ID NO: 41291 - DNA, 61 bp, Chlorella protothecoides
gtccatatctgttggagaggatggcgggggggagggtgaggtatagaaagacagagtccgg

SEQ ID NO: 41292 - DNA, 80 bp, Chlorella protothecoides
tggctcccaagactgtggattggggtgcattggtgatgggagtgggccttaagggggcaggaacaacaatgacctgggcg

SEQ ID NO: 41293 - DNA, 61 bp, Chlorella protothecoides
aaggcgtcggcggggacgtcgccctcctcgaagtcgtccgcgcccagcaggtagacggcgc

SEQ ID NO: 41294 - DNA, 12660 bp, Chlorella protothecoides
  modified_base (376)..(385): a, c, t, g, unknown or other
  modified_base (1521)..(1530): a, c, t, g, unknown or other
  modified_base (2490)..(2499): a, c, t, g, unknown or other
  modified_base (3220)..(3229): a, c, t, g, unknown or other
  modified_base (3543)..(3552): a, c, t, g, unknown or other
  modified_base (4057)..(4066): a, c, t, g, unknown or other
  modified_base (4365)..(4374): a, c, t, g, unknown or other
  modified_base (4691)..(4700): a, c, t, g, unknown or other
  modified_base (6804)..(6813): a, c, t, g, unknown or other
ggcagggcaggctggggcccagcgccgcgtcccgcgctttcctcgccgccaccagccgccgcgcctcgtcgtccagccgggcctggcggtcgtcctcgctctcctccagcgccagacgcggcaccgagacggagggctgggggccgccggccgcgccgcgcccctcgccgtgccggcggctgacgggccccggcaccaagctggcgggggtggatgcgctggacgtgactgggcgagactgaaagcgagggaagggaggtgagtagcgggaagggaggtgaggtgggggaggggaggtgaagtgggggatggagttggggtcgtgaacatcaatgctgcggtggcacgtcgtggaaagtctgagctcaggggctgnnnnnnnnnnggtagcgggaagggaggtgaagtgggggaggggaggtggagtgggggatggagtcggggtcgtgaacgttgatgctgcggtggtacgtcgtggaaagtctgagctcaggggctgtgcaagaccatggtatccccagaccacccttcatcactccacgaatggcagcaacgcacccggtacggggagggcggaccccccagctccgagctggacacatttccatggaggctgctggtcccgggtgaggaggccaggaacccgtgcggcggccggcgcagcggctgcgagccagggctggccagtccctgtgcgttgctggacctggcactgcgagggagtcacatgggatgtggtggggggggtaggtgcacggcatggacccttcttcatgagacaatctgatgtgcactcggcaataccacgaggccactccccaagctcgctccgctcagcgaccccctgggcgtttgcgtctggatcagctgcattcctatcacagcagcaaatcaaacgcgccacacagcccctgtgcacctggtctttcctggggagagcatggcggtcaatgaccgcctctccctggcagggctcctcgccccggacacaggagacaccagccctgcaggcgacgccgcctgcttgtgcactggcgcagccgaagccggcccgccctcgggctcgccggcctcctccgccatgcaggcgaaggccagcacctctcgcacgacatcctgcaggggcccacaggcatgcatgcgcaggggttccgaggacagcagtgcagaccacagggcagcgcacggaccgggtcaggggctctgccgacgcaagtgccctgtcctgcactggaccttgggtacggctgaaactccatgacaaccacctcccctacacccctgcgtgcctttccaaagacgacaaagggcccttgctgctggaccacctcctccagctccttccggaccccatccagttgcgcaaggatgacagcctgggtttgaggtttgagcatgcatggtgagggcgggaggtgagggtccagtacacaccctgaccatgctgagcaggcgagctggcatggccctaaggcccctgtcaccagcacgccgccagcacccacccggttctcctcgtcnnnnnnnnnntggtccggtacgccccctgaccatcatgagcaggcgagctggcatggccctgaggcccctgtcaccagcatgccgccagcacccacccggttctcctcgtcagaggctgtcatgaacctgaactcccggagcttgtcctccaggaactccaggtgctctctgcagacaaattcagagggagacgattaataaaatatgtgccataccaaggcccgccgagtgccacggtgtctgccgaaaatggcgaatgcagcctctgcttccccttccactcccaaatcaagtccatgaataggcaccttggcagccccaactcacgtgatggccagcagtgccttcctctccctgtctgcggcacggaagtcccagtcgagcgtagtgctcagggggtgggtgtcctggatggcctgccgcagggcgctctccagcgcgcaggtgcgctccagggcgttgatgacgcccagggcatccagctgcacgtcgtcctcgtggtagaaagggttgacggactggctgggccagctgtcctcctgcggcaagctgtcctcggccagaggtccggagtgctgtcgactcatgatgtcgctagtgtgctccaaagatgagagaatgctgccagatgctgccctgggcgcgcggcattactcgcagatcgtgagcacgggctgcctcgcgaacgggtgccttgacagcccaagctcccgcatgaatgtgtgcgcgatgacctcgcgagaaaactctgccggttcttaggatatcaatgagtgccagttggttgcctttccacgagctggtcctgcttctgcagagcaagtgcagtctccgtaaagcgatctggcgcgctggatcttggatgacaccccaacggcacgccaccaacacctcagcgacctggaaatcctagaccctcctgcgcattccttgcttcttcaacaaccaagagctgtcaagggacgcccnnnnnnnnnngtggatgacaccccaacggcacgctaccaacaactcagcgacctggaaagcctagaccctcctgcgcattccttgcttcctcaacaaccaagagctgtcaagggacgccctcaccatgccattgggacagcgagggcgtagcagagtcaggccagcgcaggacgactttaatgagaggcgccatggcccaacacccctcacttgccccaagcatcctgcatgacgcgctcctcgtgcgccagcttccctgcagctgcccactggccccgcaggttggggctgggcccggcccaggcactgggcttggcacgctccgcggcctccgacacctgcctctggaaggcccccaggggcagcgccttcttccccttcttgccctgccccgccgacgggccttgtaacgcaggggtgtcgggctcggctggaccccgcgacgccggcctggccctgggttgcgctgcggggagggcgggaaacgcggagccgtcgacttgcgtgtcgggactcgaccgcgccgccgctggctgcggggcgctggggccggctcgctcgctgggcgccggcgccttcttcttgctcgggaccgctgcgcccttgtcctccgctctcttcagaactggcgcctcgtccaggtccaggcccggggtcggcaggccaccccgtgacgcctccatcgccgccacctccggcgggacccacccagagcgggcagccttcggtnnnnnnnnnnaccttcttcttgctctggaccgctgcgcccttgtactccgctctcttcggaactggcgcctcgttcaggtccaggcccggggtcggcaggccgccccgtgacgcctccaccgccgccacctccggtgggacccacccagagcgggcagccttcggtgtgggttgggaggcggttgaggagcgggaatcccgccggtcctcgttaaaacccagcgggactagagccacccctccccgcgctgcagatcacagccccagcacaccctctccagcccgccaccccgaccctgcgcacccgcttgcccttgacccgcnnnnnnnnnncgaaacccagcggggcgagggccacccctccccgcgctgcagaccacagcccccgcacaccctcgccagcccaccacccccaccctgcgcacccgcttgcccttgacccgcggcgcggcctgcaccagctcctgggccttggccgggttggggcaggtggcggccaggtccgggatcaagtccgccaggcccagcgcgaccaccgccgccgcgtactcggggctcgtcagctcgctgcgcacccaggcggaggactcgcggcggaaagcgaggaactcctcggcgctcagcgacgccctgacccgctcgaccagcgcgcggttagcctcgcgcagcgagcgcgcggcctcggggctcggcggtggcaaggatcccgtcctcctcgaggcggacgcctcgtcggtctggccgctgtgcgccgcagcgtcgtcggcccgcttctttgcgggcgagatacgccgccctgtttgcgcagccgcactgctcggcatctccgccggccccnnnnnnnnnngagcgagggcgcggcctcggggctcggcggtggcagggaccccgtcctcctcgaggcggacgcctcgtcggtctggccgctgtgcgccgcagtggcgtcggcccgcttctttgcgggcgagctacgccgccctgtttgcgcggccgcactgctcggcatctccgccggccccgccgcagtgctgggccccgccgcagtgctgggccgcgccgcagtgctgggccccgcgacagtgccgggccccgccgcagtgctgggccccgccgccgcgcctggaagccttgccaccaccctggccnnnnnnnnnnccgctgcagtgctgggccccgccgcagcgcctggaagccttgccaccaccctggccgccgcgtcgacatcttcaggcaccctcacctcctgggcgctcgggggccggggcaggcgcgaggtgcgcaggctggccagcagcgcagcgtcctgctcctcgcgagaaagcgcgacccagccctcctccgggcccagcgccgcgccgcggcgcgagggccccggctcgtccccgtcgctggcggggagagggggcatggcgccgcatgccttcccccgccgcggggtgggggggctgggctccgccccgccgccgccggtnnnnnnnnnncgcgccacctgccttcccccgccgcggggtggcggggctgggctccgccccgccgccgccggtgaccccgcgccgcgccgttgccgccgggccgccagacggctgcagggagggaaaggactcggagggcctgatgacgcggatgccgggcccgagcgcctccgccatgctcctctgctgcgccttgaggcgacgcttggcggccttgctcgtgcctgggcagggagggcgagaaggagggaatggggtaggctgctgggcgaggagagtgaaggtgagagccaggtggcagggatggagcgggtccgggaatgccgcgagatccgacgcagccaagcctgctgctgtacccagagcgcccgcaccacagcatgtgcttgtctgtgcagaggctctggcggccagaggcatcgcctttcggaccctatctcctggccaggccagtccccatcccctcgctcagccacccccaacactcacctggcagggaggggaaatcggacatgtgcagactggccccgcccgcggcgccccccaccgcgccagcccagcgtcccgagctggccccatgctgactcagcacgctcccgggtcccacactgggaaagtcctcctcgttgttctggaagcccgggacgccagaggaagacggcgcagcggcggcggcgtccgcccgcgagggccccggcctcccgcccaggcccatgctggcctccatggcggcagccagctgggcggcctccacggggtcctgggcgccgccccggcgcgcaaagcgcgagggcacgccgcccgccccgccgccgatgaccacccccctgcggggcgggggcagcgcggggccggcctgctggccccgctgctggctgtcccgctggtactgcttggtgagaattttggaggggaaggtcgagtgacaatgggttttgcggagtgactcacatgctgcagcaatgaactattggtgacagcatgactttagccaaggagcctggaacacgctgccagccaggcggggggggccatccacccatctctctcccctgcaatcccagcacaggtggcccaacaaacagcagcccgagagcaggtcctcaccgagaagctgacggggacgaccatggccgcccgccgctctgccttgcccagcatctccccatgctctttcacggtgtgctgccgcagctcctgtacggaagaaagcggggatttaagcgagcaagtggcattgcatggcagggtccatgggacgcgggagcagggctgcacgtccttctccctcaccatcaatgacatggaggcaatggggacagatttggaaagcccaccctctgtacacggcacactgctgacctggacgctggcgaagacgacaaacttcttctcgaggcagctggggtgctggcaggggaagtgctgctgggagaagtggtctgaggggtacggggagaagagcgtggtggggggatcggccagggagtgtccaagtgactatggcaggctcgatgcccagcaccaagccaattgcacaatctttgttccaaggaggcctcacttcccttccttcccatgcgatcctgcattcctccacctcggcagggcgccggtcccagcggcccctcctccccaaaccccatatgctctcactttccaggtccgggtagtcgcggtagtagacgtgcttgctggggtccacccgcttgcacaggaagcactgctcatgctgcgtgtgcatgtgggtgtacagctctgtgtcgccgtagaagcggcgccggcagaagtggcactccgggtggcccttgaagccggcctcggcgagggggccctcccgatcgccctggcgcaggtggcgctccaggtccggcccagagtagagtaactgctcggcggtgaataccttgcgcccctggaggcactgcccgcagaagtgctggtccagagcctccttcacaccctcacgcagggcatggagggtgcggaatacaatgggcctgtggggggggaggggacggagggcggcctggggttggaggaggtgatacctgcggtcgcattcattgtcgtgtggtaaattctggagtgagagattgccaaagtggagccnnnnnnnnnntggggggaggggacggagggcggtctggggttggagtaggtgatacctgcggtcgccttcattgtcgtgtggtaaaatctggagtgagagattgccaaagtggagccgccggtggtaaccatccacccagtcacgtacggcccaaagcctccacgcccgccccaaaacatcccgcaacctcttctgggcgtccaggagcgcggggtgggagaaggtgcacagccccgccatggtcttgaagtgggcttgctcatcaaagtaggcctgggcctgggccagcaggaaggccttgccctgctccaccctctcctgatcacgaatgaggagggggggggggaggggagatggaatcgcatttggactctaaagtggagtggatactcctatccactcaggcccggactccagctttccctgcgcctcaccggcagctcctcccactcgtcggccgacagggtgcccgtgtaactgcccatggcgcgggtgacgaacacggcatggcatggctgctgacacagcacacatcggctgtccttcatgatggtgcgcaggcgcaggacgcacttggagcaggcgtcctggtgcccacatggcccatatgccgtgtacaccagcggctccgcgcacacgatgcacaggtcctccatgcctgtacctcagcgcattgctcgggcgcagagactctgcactcatcacggtcaggcgcagggtcggagttttatgctagacgtcgccagctgcgcgctgggcagaatcgggagcactttgcgcccaagaggcacagtgtctttccggcctctgtaaatctctcacactcccttacccagagaattgttacagccatgtacacctttcgataagggccactaacatcaactgctcgtgtgagaggccatctgcgtgtcttgccacccttccagagcagagctttctgtatgtgtactctggaagtcagcagcgctgcagcgctcacatggtgtacctgtaggaatcgcgtgtagacaatgagagatgcagccattttgctcaactcgtatcataacccaagtgcccactctacgtttggcaatgcgccttgttctgggctaagtgatatacgccaccctgcacccccctcacccattgttgtcctcttcgaggatgggcttgaagggcctctgccacttcttgcccggggttggtgctgtctccagtgcctgtgcaggaaaagcgtgtcagtaagctaagtgagagcagcttattgcttgcacaacctttcgattaccataaccagcagatggtgcttgtgaggacggcatgcccattgagaccaccccactgcaccacccacctccagggcttcaaccttctcggcagggctgaagtcgtagtactcgtacttgatggtgccgccagggaggtgtgcgcggcgagcgtcccgtgctgcaagaaagcaagaggaggagttgcccactgggcatcagaaatatggctgcacatggatgagctcccaccatgattaccctcacactcactgaagtacttgatgtcgtagacacggtttgtctcagcggcaggcaccatagccctgactccttggctcctgttatagaccgtcggcacatagggggggtaagctcaggacatgctgaaaggccatggcaaatcctcacaccagagacaaataccctccactgcagccacaccctcaaggcgcaccctggtgcgcgctcgcggtactccccggcgcgtggcagatgagaagcgtactccggagaggacagcggacccgtgacctggccatgggtgagtatttcttgtgagtatatggagaagagcagcaccgcgtgtctccctctccgcactaccgccctgaacaggatgtgctcaccgcccatggtgccttgactccttcaaggagactcttggcccgcgccaagagccctggggcactcttcgacatgactgggaggcgagggcctcaccaggagttgggcctcgcacgaaactgagccacacccagcagcgcctaaaccctgcgccgaggtatactatgcgatgaacaagagactaagatggatgaggccgaccagtctggcgccccggagatagcacagccatgcactttagcgagtccgtgggtcctttcttaggcaccccgcgcgcggagtgggtaccctgatgaattctggttcccctagttacttgttgcacaatacatcttactccacgcaacatcgattgtccaggcttcgagaacctctaatacacttggcgaatgcttggcatcctcacttagatccagcgattgcggggctctacaccaggacacagcgcccatggtgagggaacgacctctgtatgcagatctcgacgcgacgtaagccagcacgcgtcgggcagctgagcacacttacggcaatcaatccacaggggctctggctatctaggctcctctcgctctttggagatactgaggcacggattctggtgctgggcctcgacaatgccggaaagactacaattctatgtgagtgttttgcaagggctcccaaaggtggtgcgaccgtttcccgaccatcactcaatcttcaccttcatccatttgcagaccgtctccatgtgggcgaggtggtgcagaccattccaagtgaggtggttggggtgttcatggggggtgcaagcatccaggtctcgtccctgcacagggcgccatttgcttggtgcccatcactcccacccaccatcaccctgcattcccaaccaacagccattggcttcaatgtcgagacggtgacctacaagaatatcaagttccaagtgtgggacctgggcggccagaccagcattcgcccctactggcggtgctactacccgtgagttggaacagagctgtgctcttcacttcttgcttctgtaggttgactgtggttcctgcacacgtggcctcaagtttgcgccctggtcaccatcgcggtaggctgtgattggcatgatgttttgccctggtccacatgatcatgtccctcccggaagcagacttagtactctgccacccacccctcttctgaaaggaatacgcaagccatcatatatgtggtagactcctgtgatgcggaccggctgcccacaagtcgcgaggagttccaggccattctggccgaggaggagctcaagtctgccgccatcctgatctatgccaacaagcaggacctcccgggggccttgagccaggcggaggtcgcggagggcctggggctgagcagcatcaagacgcgggcatggtccatcttcaagacctctgccatcaagggtgagggcctgttcgaggggctggactggctctcaatgaccctcaagtcaaagaagtgagcggcagctgcgttgccatctctgcccataggccttgccattgagcacccgctgaggcacaccagtttaaagcattgcttgaccctgtgtcgggaaattacaatcgtcatgctgtgatatcctgtagcacaccgacgtcctgtgctgggaagctggtttgtatgtgagcgtggggaagtcaacccgcgggcgattgtccgaggcgcgttcagagaggcagatctgctcatactgactcgggcgccccatacttaccacccatctgcccaaaacccgcggtcaacgcattaacccatcattacaacagcagattgctcccctctccgtggccccgccgtgctcgagtcctccagtacctgtcgccatgcggccgacctcctggctcctcagctccgtgcacctcctgcaggtgcgcatggtgatgatgcgatggaactaaacggcccataatgtcactaacaaggctgatccaggccgatgtcggccctgctctgaagcatccgctcaccatggagcgttacgaccccgtgcgcaggtgggccttgccgccttcgtcctgatcgccacggcggtccacctccagggcattacctgggagagcgtggactctgacctcatcaacacggtacagaatgcgcagtgcttgctaggcaaggacgccaactcctccaccctctgcacctacacctacatcgtcgcgggcgcctccatgggcgccagcatcctcctgagcatcctcttggtgagctgggcttgcattaagggtatgcgtcagtctttgagatggcttagcaggtacttttcgaccggacccttggttaacctgtcgccctgccgctgaccccgccccttgcaacgcccaaacccctctcctccacctcctccagtgcatcacctgcgactgctgtggccgcggatgcgcgggcctgctggacgccatcctgggcggggtgggtgctgcctggtgggcgatcgccgccgccgtgctgaccaggtgcatggtggacgagggagtgtttgcaaatgggcgaaccaggcatggaatcatgtggggtcagggggctccgtgccatctgcctacctcattctccgctcatcaaccctttcctgccccacaggtatggagtccctgccaaccaggacggctggccacaagaggtgggttcagatggcggtattgtcacctgaagagcggaggggtgtgcgtggtggctgcctggctgcccttaatgctaatgatggcgtccttgttgccgccgtgttgcctcaccctgcccccttgccctcccatttcccaaccacatgacagaactggcgcatcgccgtcttcgtttcctcctgggtcatggccggcctctttggcctgggcgtcctgctgtccatcttcaagtgctgcgggccacgtgaggagaaggtagagggcgccggccgctccttcaagcgcatgaaggaggaggaggcggcacgcacggcccagctggcggcccagaggtcccgctatggccagttccagaccaacccccgtccctacagctccgccgtgtgaggcacccttgcgcccctgtgtgaggtaccctggtcgaacattcatggaccaggcaggcgtcgaccgtgttgaccccctcgattactattttggagacgtgccttgacccttttggtgaggccgtggactgagggcgattccgtcctcgaccccaggcccaacccacaccacacccttccaatttaattgacacatacgcttcacgctgctgtatctcgctgcttgagctgcagagctcgtcatgtaatacgcctctgacctgtgctgcaacatggacagagctgccttgataagtggttgatttgagggccaggggccgagagcatggcatgagcactatgccgggcaaaacttcgaggaccccactcacaagcctgctctgaggacacagtatgtcgatcaggccagcagctcagcatctctgtaaggcgtctaataactgcttcatggagcatgcggagcttgccaaaccgtacaagtactctccccacacctcaacaatccctggccacttcctgaaacctgtacaacaccttttctacaagaaagtcccttacacacacggagataacatcctcacccgaggaggccctggacctcctggacggagaggaaagggccgggcagctgcgcgactcggcgcaacagtgcgaggcggttgcccctgaccccctcgtcctcgatcatgacaaacaccccgtccaggaaggcgttcaggggccccaccaggggcgcgcaagcctccacaaaccccgccaggctggcgtcgggggccacgccctcttccgcggcctgcagggcgccgtgcagcgcgccctcctcgggctgctggaagagctccggcctgacctccgccggccccgccgcggcctggctgcgcaccaagcgggcggcgcgcgtcgtggcgcccaggacccggcccagcgcgccatcgggtccggcggccagcc

SEQ ID NO: 41295 - DNA, 73 bp, Chlorella protothecoides
cggcccgccgactcggctgggtcctggcgaagacacttgcataatccatgcctgcacacctgcttcttgtttc

SEQ ID NO: 41296 - DNA, 61 bp, Chlorella protothecoides
acgaaggcatgtccgcctgtcagaggctgggcatgcaagaggtttgtcctgcatggcgcac

SEQ ID NO: 41297 - DNA, 78 bp, Chlorella protothecoides
cgatcacccaccctcacccgctcctctacccaacccccctcccccctcagggctgtgggacgaagggtcagggactgt

SEQ ID NO: 41298 - DNA, 1563 bp, Chlorella protothecoides
  modified_base (425)..(434): a, c, t, g, unknown or other
  modified_base (1024)..(1080): a, c, t, g, unknown or other
  modified_base (1248)..(1449): a, c, t, g, unknown or other
ggccgcggctgcacgccagctcgactgggcgcaggacgaggggcgcagggcgctggccaagaaggcgcgggaggcgcaggaggccgcagcacacgccgccgacctggagagcgtgctcacccgcctgcgcacgcagcgcaaggaggagagcaagcgcgccacgcgcgagcgcgccgccgccgatgccaagctcaaggtgggttgggtttagtcgtggttctggaaggggacacgaggtgggcttgtttcagggtgaagaggcagtgacagggtcccggctcttgtgacgcgacgcctgctgggcaggaggtgtatgggagtcttgtaggaacaacggccactagggcgatgagtactggcaccggcaccgggtcgtgttgcgggcgagggcccccctgcgagaccgacaccctgtacctctagannnnnnnnnncgggagtcttgtaggaacaatggccactagggcgatgagtactggtacaggcaccgggttgtgttgcgggcgagggccctcctgcgagaccgacaccctgtacctctagaagcaccccttcatcgactggcccccccctcgctttcttggtcacgcaggaggcggaggaggcagccgcgagggctgaggccgccgccgccgcctcagccagcgagctggccagggagaagctggcggcggcggaggccgtggccgcggccaccgcgagcgtggcagaggcgcagcgtcagcgcgctgaggcggctgagctggcagcgggccgggctgccgagctggaggcgctgcgtgccgaggtggcggccctgaagtccgccgcggcggcggccgcggcggcagcgcagcagcgcgaggctgccgtgcaggcgcagcagcgagaagccgccgccgcagcggcggcggcagctgccgcgcagtcggcctctgcggcgcaggcgcagcagtcgcacagcgtgcacagcagccctcggaaccggggcacggcccaggtgcgaggcaagggtgggtggggtgttcattgggtggggaggacnnnnnnnnnnnnnnnnnnnnnnnnnnnnnnnnnnnnnnnnnnnnnnnnnnnnnnnnngtggggaggacggaccgaccagcgcccttggaaccgggatggattggatgtgctctgaaaggcaacgattcctcgatccctactcgatttctggagctggtttctgccctgcccatgtcacgcgattccctcccttgacaccacaacacacccgcattcacccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggccgggggactacggcgcgcgcggcgagaggcagggcccctcaccggggctgggcgcctccacgccgcccgcctcgccgcacctcaagctggggggcgggggggcggggcc

SEQ ID NO: 41299 - DNA, 61 bp, Chlorella protothecoides
gtgtggtcccgggtccagcgctgcctccagggccgggagcgagaagggagggacgcccagg

SEQ ID NO: 41300 - DNA, 124 bp, Chlorella protothecoides
gcaggggtttgagatcatctgaggggtccacagccagtcctgggtacctgtttccttgagcccggggtctcggggccaaaggggtcctggccaacaggctcccctgccagacacagagcaaagg

SEQ ID NO: 41301 - DNA, 79 bp, Chlorella protothecoides
gagaggagggcggtgtgccgagggcgcaggggcgcagtcgctgcgccgtgggtgggctgccggcgacagcctggagagg

SEQ ID NO: 41302 - DNA, 1035 bp, Chlorella protothecoides
  modified_base (104)..(164): a, c, t, g, unknown or other
  modified_base (290)..(299): a, c, t, g, unknown or other
cggcgcgcggcgcggccggcgcgttcgcgccgctggccgagggcccggccccggagccgctggcccacggcggcctggaggaggagcagggcccgctgcaggcnnnnnnnnnnnnnnnnnnnnnnnnnnnnnnnnnnnnnnnnnnnnnnnnnnnnnnnnnnnnnagcgcatgcaccatgtgcccgcccggcacgcaggcctcgcaggtgtgctgtcagcagaggggaggtgttccgggtgggggaattgggaccggagggggaatgcctgtcacaagatccccagcaggnnnnnnnnnnggtggttccgggtgggggaattgggaccggagagggaatgcctgtcacaagatccccagcaggacccgctgcgttcctgtgctcccccctgtactgcgcgggttggcgcgcgcccttcccatggtctcctggctgctcagcccagcagcatgttgcccggccctggatacggtgccgagggacagacctcgtgaggcaattccctctgtgcccctgctgaggagggccctcctccagactaccagtgcccctccctccctcccccgtcccctcacccatcccaccactcccacgtgtccctcctcaggcccaggcctcgacctgccagtcctgccccgcaggctcctactcctactcctggggcgccagcgcctgccagcggtgcatggcaggcaccttcagcagcggacccgggagcacgctgtgcaggctgtgcccttccggagtgacgactcaggacggcgccacgtcctgcgaggccggggtgggggccggcagcgcggcgggcgcgggggcgcagcagcgctttgcggtggtggtctcctttgcggtcatggtcaggggcatcgacgtcgatgccgccgtgctccaggtatgcctgtgtggagggtgtgaagggggtgggctcgggtgggaaggggggcgctatggggctgggtgcgtgccttgggggggctgtgagacctgtagacccccccctcccccaacacccacccacccacccatccaccatcta

SEQ ID NO: 41303 - DNA, 100 bp, Chlorella protothecoides
cggtgacgccgcgcagcaggcgcagcgcgataaggcgcggcaggtgcgcgaatttggccgtgcggcgcggggccaggaacgctgcgggcgctgcttcacc

SEQ ID NO: 41304 - DNA, 61 bp, Chlorella protothecoides
gccgcgccaagctgctggctgaggcggagggcgcgctgcgggcctgcatggccatggaccc

SEQ ID NO: 41305 - DNA, 69 bp, Chlorella protothecoides
cgcctcatgctgccccggcctcgccagggcatgcaggacgtcgatgatcaccacgcgagccacttgcgc

SEQ ID NO: 41306 - DNA, 110 bp, Chlorella protothecoides
cggaagacgacagacactgtggacggtccttgcgcacctcgatgactccccttgaacaccaggaccccccctcgtacacaaaggaagcgcacctgcgtcggtgttgttga

SEQ ID NO: 41307 - DNA, 77 bp, Chlorella protothecoides
ggagcaggtgggaggggaggccggccgtgccagccgccaccaccactcggcaccggctggggctggcgtaggggtct

SEQ ID NO: 41308 - DNA, 80 bp, Chlorella protothecoides
ccgtcgagcgccagcacgtcgagcgccagccgctccgcattttcctcccagaagagctggacggaggcagagctcgtctc

SEQ ID NO: 41309 - DNA, 113 bp, Chlorella protothecoides
tgcacatcactccccctcctggctccagatgacgccccacaggctccagatcccccttccaaaaggaccaaaaagaaagcacgacaagcctcgcctcacccctcatagccagg

SEQ ID NO: 41310 - DNA, 72 bp, Chlorella protothecoides
gagccagcatgcacctccaatgcctctggctcgcagtccgtaaccctttggaagaagggatgtctggccgta

SEQ ID NO: 41311 - DNA, 794 bp, Chlorella protothecoides
  modified_base (145)..(154): a, c, t, g, unknown or other
gccctggagcggccggacgccgcggccggcaccgaggcggccagggcggcgctcggcgtgagcctgggcggggcgtgtgcgcgtggaggagacggcgccgtcgtccgggccgctgccgcgcacctacgtgacctggccgaagctnnnnnnnnnngccgaggcggccagggcagcgctcggcgtgagcctgggcgaggcatgtgcgcgtggaggagatggcgccgtcgtccgtgccaccgccgcgcacctacgtgacctggccgaagcttgccgccagatggtcgagggcaggggaggggcaggtagagaggcagcgagggaggcaggtggcaggtcacgaagcccaccccaagcctggcccggcctcgaggccggcgccgcaccgggctcagagcaacaatccctgcggtcggcgagcgaccccgactcggacctagacgcgctgctgggccggagccagcgcctggtgctgggctggggctccctggcgctggacctgcgccccgccttcccctccgacctgctctggggcgaggggcggctggcgtggctggcccccgcggtgcagggcatggacgctttgaccatggcggccgcggagctgcggctggccgtgcccctgctgctggagggcatgcatgggggttggggcagggcaggggggcctgcagaggcgggggaaggtgctgaggcgggcgaggccccgggcggcgagccgggcacggaggcgggcgcggatgccggcatgcacgcggcgcgggcggccgtggaggccccgctccgcgccgcggcgg

SEQ ID NO: 41312 - DNA, 81 bp, Chlorella protothecoides
ggcactgcatgcagcgcaccctcccgcccatgccctgacctcctcccacacggccccaggcccccgccagtcctcctgcat

SEQ ID NO: 41313 - DNA, 24480 bp, Chlorella protothecoides
  modified_base (201)..(210): a, c, t, g, unknown or other
  modified_base (615)..(683): a, c, t, g, unknown or other
  modified_base (1651)..(1709): a, c, t, g, unknown or other
  modified_base (1897)..(2008): a, c, t, g, unknown or other
  modified_base (2430)..(2439): a, c, t, g, unknown or other
  modified_base (3474)..(3483): a, c, t, g, unknown or other
  modified_base (8185)..(8194): a, c, t, g, unknown or other
  modified_base (8294)..(8303): a, c, t, g, unknown or other
  modified_base (8807)..(8816): a, c, t, g, unknown or other
  modified_base (9492)..(9501): a, c, t, g, unknown or other
  modified_base (10495)..(10504): a, c, t, g, unknown or other
  modified_base (10823)..(10832): a, c, t, g, unknown or other
  modified_base (11747)..(11756): a, c, t, g, unknown or other
  modified_base (13963)..(13972): a, c, t, g, unknown or other
  modified_base (14169)..(14190): a, c, t, g, unknown or other
  modified_base (15491)..(15500): a, c, t, g, unknown or other
  modified_base (16752)..(16761): a, c, t, g, unknown or other
  modified_base (17151)..(17160): a, c, t, g, unknown or other
  modified_base (17564)..(17573): a, c, t, g, unknown or other
  modified_base (19316)..(19325): a, c, t, g, unknown or other
  modified_base (22914)..(22923): a, c, t, g, unknown or other
  modified_base (23798)..(23807): a, c, t, g, unknown or other
  modified_base (24341)..(24415): a, c, t, g, unknown or other
gcccagccggccgcgcccctgccgcccgcgacctctctgccagggacaaaggcggtgcgtgggcggggcaggccgcgcgggtcggggcggggccgccgcggcggggccggcgcatgaagcgacgcgctcgcaggcacgccgcggtcgaggccttccttgccagagacgagggtggtcgacccctgagcgcctgccctgaannnnnnnnnnagacgcgctcgcaggcacgcctcggtcgaggccttccttgcttgagacgatggtggtcgacccctgagcgcctgccctgaatgggacgcccatgtccaccccaccccatcatccccaccccttcccctggaagaggggggggcccccagtggtctgctgccccctcctcctttgtgacctccctgactgatcccacctgttgccatagttttggtttcgacgcctcgccccagccatggggccccagcgcgcactcacaccacccctccccctcaggggagggcgccatgctcgacgaatgactcctccccctcccgctgctgcgcacccttggaaagcgtggcgggtcgccgggcccgctctctatcagggtcctctgtacttgccgggccctgcgccccccgnnnnnnnnnnnnnnnnnnnnnnnnnnnnnnnnnnnnnnnnnnnnnnnnnnnnnnnnnnnnnnnnnnnnncccgccctgtaattgcctggagtgggcaccctcgcagtgctgggtatggacaggccggggatgagttcggtgatgttcaggggatggcactgcagtggctggcaccgcagagggcccctctcccccccacccccttctgccacggcagccattccgtcagaggcagcgcatgtgcacggcgccggggcccgcctcgtcgtactctccgcgcgtgacccactgctcctgcgcggccactaccttggccagcacggcgccgccggcccaggccgcgctgcgcgccgcgccacgcggcatgtggtccggcggctccagcgcggccaccgcctgcgcggcggggagcgcggcgtgcacctcgcgcgccagcgccgctcctagtcccgccacacccgccgcgccgccggccacgaacagcgagcccagcacgccctttgggtgtggggaggggatggattggtttggattcccagggtggaggcagcgatgagcggcgattggaggagacaggatgggcggggcgctatcgtcgggcgcgggcatgatgtacgctggcgcggaggggccggcgatctcccaaagcggtcttcaccccccccgaatcaaaactccagcgagccaggggcgcaccttgcgcgcctcgcggtcggggagggcggcacccatcgcggcgacgagctgcgccaggggcggcacggcgcccggcgtggccccctgcaggctgccagggtcaagcagcgcggcgctggcctcacgcaccaccgcctccacctcgatggtctggccgtctggcagggtgtgcgtcgccgggggtcccgccggcaccgcctcctcgccgggcgcgccgctggcacccgacgtgccgccggggaaccagaggcaggccagcttcagggcctcggccgcctcccagcccagggtcacgccggggccatgggggtgcggcgcggccgccagccgccgcaccagcnnnnnnnnnnnnnnnnnnnnnnnnnnnnnnnnnnnnnnnnnnnnnnnnnnnnnnnnnnnggccgcccgccgggatccttacagcgcccactgggtgcacctggccctccagcacgggactcacatctgttgtgtttctcagggagcgggatgtgggcggggggtgaagaggaagggactgggtccagagtgcacgctgtggctgggggctcgaagaaccgaatattggtgcgggggggggggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccccacctccctctccctcacaagaatacccagccagccaccgatcgacgcgcctgtcttgtccaggccgtagtccaccaccaggcccgaggtcttgccggcggcatagagggacagcaccccctggtctgcgacaaacagcccacgcacgcccaggccctcaaaggcaagctggcacaggcgctcgcggtcggagcgggaggaaagcacggggtccgccaccagcagctggccctcctgctctggggcccagccaagctgcggcgtgtgtgttgtgggtgcgatggatggtgggcggccgggggaagggcagcccagggagcaagccagaaggttgtcacccactgagcaccccggcaggcacggaaaggaaccataagggcctgtgcatgctttgtattcctaccccctgcggggctnnnnnnnnnntagggagcaagccagaaggttgccacccactgagcaccccggcaggcatggaaaggaaccataagggcctgtgtatgctttgtattcctaccccctgcggggctgctcctccgccccactcacctcctcaaacagggtgtaatggagcagggtctccaggccctcccagtcagtcaccaccccagcgtgcatggggtgcaccagcttttcaacgaccgtcacacgtgcgtcctggaccgtgcagggcaggacctggaggcgatggaggagggggggtggggatggctagctttcgcttacaggcacccctgaacagcgtgcccgcctcacccatctcatgcatggatgccctcgtaccacgctgggctcggtgtcgctggggtaccccacagaccgcccggccttgatggcgtggctgcccaagtccaccaccacgggcgaggccatggccccgaggggtcgtggtgcacagcagggtgcagcaccttgtgcccgggattgggactcgggatctccaacgattacaaaatcgtaatgagatagctacttttagaattattaatattcagatagagttccggaagtgcaagtagcaggacgccagagtgatcgagtgtcgaatcgtttgaatagcacgaggccctggactgtatgaagctccgatcttgctggaatgcatgcgacgaggcgttttgatgatcactcatgcactgcgatcaccgtgcctggacataatgaaggggactgctgcccagggcaggcgatccagggcgcgcgcatgccgaacatgccgtctgcccactgcaatctacagcgagaacaggcagtagctgccagtcatacaaactctgctggaaggagcgacatgcttgcgacatcgagctgtagggcatctgttgatgccctccttgtgcagcaaatgcattggctgcatagtggccctcattgtcaaactctctgaaatgatgtaacacccttgtcaatgctgcttgattacaacccgtcgacacctccctcatttgaccaggcccagcnnnnnnnnnnatcaaactctctgaaatgatgcaacacccttgtaaatgctgcttgattacaacccaccgacacctccctcatttgaccaggcccagccatgcgtcttcgtccctgccgccactcaggctctgctccccaaacatgaggaggtcctgcgtggccttgaaccctgactggactctccgggcccagagtccccggtaacttccgtccaggtacgccaggcaggagttcatgagacgcaggttgaggggggtgtgggtggggagcgcgacgtagtcatccaaaggcatccaggcagcgcactccagctcggcggcctgaaagctgaccttctgctcgttggcgggggtggatcagaggcagggctgacacgagatgttggccgtggcgagcactgggttcactcatcacagcgatggtgcacctgaagcaggcacggcggctgctgggcgtcgcttcaaacagcacatgcccgcaaaggctgcaagtgagcatcccgaaccctgcccatcagccaaactgccgggcacaccatgcctcccggcatcactcacctcctggcctggctccggcttcagggccatcaggaaaaacatgtcgctcttgccaaaggcgacgccatgcgcctggcgcatggccagcactgcgtcaaacctgtcggttccaagcagcgagggcaggtcgtctgtgactgtgcctgctgtgcaacattccaccactgccgtcgtttatcaaagtccccaggaggtgactcccctccaagctggaacatgtgaccaatggtgcttgggaaacgtacttggccttgataccggtctcctcaccgacctccctctcagcagcttcggtgatgtcctcgccagcaatcacgagtcctgtcaggaggtatcggcagggctggtgagtgagagcatcaggaacccactggcacagctaaggacctacgtgtagacagaattcatccatagtgaatgtgcaatccggtctcaagctccaaactcacagtgcatggaaagcttgcagcacatcctctccccaaccctgtcgttcctctgcaccagcatcccccttcatcggacctgtgggcagcttccagacgccctttcctcgtagcgggcccagtctctcctggaccaccagcacctcccgcttttcattcaccacaaaagcccctacccccacttgatgggaggcattgggcgggaggggggaggggacatccctgggtagccagcaggtcagcatgacatactcctgggaggcaaggattcggggatggtggacatcatatacataatatatctctgactccagccgtgcagcagttggtgatggggtgtttgcattatcctccgccaaccccccgcaccttctcggcatggtggaactcgaagccggcatccacggcgtgcccgatgcagtgggcgtgggtgggcggcagccgcatccacacgcccttgaccccggcccccctccacgcggccatggagacctgcagcgcctcggtgaaggtggcggggctctgtgggattgattccgggtccaggattatgccatcgtatgcatcgtggcggccggccaggaggccacaggacacctccgtccctgcagccgccatgctcgagctgttctcgaccagtctgggtgcagatgagaagccgagcgccggatgaggcctagaggtggctgggaagggaggacagggggaaggcattggtgccggcaagccacatgcggattgacaaaagggtctccgcagggcagtgacctaggggcggagcccgtgcatcgccctcggtgacaaccaccagcccacctggccagatgattttccgtggggatgctccgatcgatcggagcaggactgaacgcagggcagcgagtcgcgcgcaggccatgcaagctggccctgtgcagggtcacaggaaccctaccagccttgcggcgcgcctgcgaggtctcctgcacggacacaactcgtcctgtgagcacaaattcacgctacaagcttacaatgagtattctgcttgctcgtcctgcccgtgcccctcaggggtaggttgtgttttggtttcggcgcccatgcgatgagttcacgccgggaccccgactccgcgcccttgttcgcccccttcagatgcaccccaccctcaggggtgtgggcccacattaccagggatgtgcacaatatgagttgcacctagcatcagtttacatcctaaaaccatgcgatgatggaggagaggggctgagatggggcaattgtctgacaggggggtggggtcccccctcccccctgcccctgtcttccaccccagtcctgaggagtggacggacccggcagcctacatcgcctctgttgtccgccctttgacggaggggctggtgggcctggccaagatccggcctccggcgtgctggccacgggctccgcccatcgaccctgccagccttcaactgtgctcccagctgcaggctgtggcccgcctccagcacaagaccactgaaggtgttgcccggatttggagggacagctacgccgacttctgtttggccaggggccagaggccagggcgcaaccctgtggtggcggggcacgaggtggacctccatgacctcttcacgcgagtgactgctgccggcggttggaactctgtggagcaagactgccgctggggcgagatagcagcttgtttagaggtgcgggagggggtgagggatgccccgacggacgccatcgtcggggcgcacacctgcccgccacgacctctcgaccctcccgatgaccccatggtggcattcctgataccatagattgatgcatccctgggagtcccggctctcggcctgcgctcggcctacgaaaacctcctgctggcctacgagaacgtcactctccgcggggacgagggcgacgcctgccttcgcggtacgccgagacatcgacgggtgatgcagttgggctgttggatgcattgtgcagggcatgggaatcgcagatgatgctcatgctggtcacggagggcattccgggcgtggctgggtcgggagtcaccacggtcggccgtttcccgtgcagttgcaggccttgacgatggctcggatgcagaggacgcgcatggcgtagagaacgacggtggcggtgagatcgatgccacagcagcagcagaggtactgggtgccctgcttggaaccacgccggcgagtggagcgaaggctgtcggcaccaagaagcttatcagcgcgggggtgagtgtcagtcggggtgttggcaaattgttaccttgacatggtaattctggtatcgcccaatcgtctcagggcgaggctgtgccatcgaccctcatccccgctcgaggttcacaggaggcggtggaggagccctcgcctagtccatcgctctcggctgacacatcgggagggaaggtcccgcagaacatcttcaccatggtttgtgaggcttgcagagggggccatgcggaggatcgcattatcctctgcgaccgatgcgacaagggctggcatctgcagtgcctcgagcccccactctccagtgtcccggtgggtgactggatatgccccagttgcatcctcgaaggtgacgttgggtttttgagaataacttaagggaggcgaacatgttatctcgcggcatttcgggcaccctgatgtcgcgtttgcgccctgatgtccgggttggcatgcggagggttgacgcgcgcgcggaatcccggccgcccgacacgtagggcaggcccctgatcgctgagcgccaacttgggcccccctatgggtcagcaacggtgagtctcatacttcacccacttgaccatctctcaaagtcatccaacagaggtctccaaaagtgctttcaaagctgggaaatccttgactctgctcgagtttgaggctgccgccagaaagtttgaagcagcctggttcggccggggcgggaagcaggtgaggctgctctctgcaggccccatgccagcatgggatcgtgtgcagaattcatcctcctacgctcaccaacgccctatcacgctcacaggagcgcccaccgcacgaggttgaggctgcgttctgggggattgtggaggggggcaccgagcgagtggaggtcctgcatggcagcaccgaccccacggccctgtcccaggaggcaagcgaccttaggaccctctgcgacctcggcccaggctcaatcctggcatgcatggacgaggctgaacggggtgaggaggagtggattcctgccgggtgtctgccactggatggggctggagggtccacagcgatggcctcgcttttgcttgggcaggaagttccagcacatatcgattgacggtgtggcgtgtaacccacttgacctccaccctcacatcccacagcaacgctggctccaaggctggaggccggcatggtcttctcctcctcctgctggtctgcccacccagacctcctgtactccctctcgtacctcaagtcgggggcgcccaagatctggtgaggcgcgggttgttgcgggcaggggttgcctgcgttctcctggaagccagtggtgagaactcgcggctggtcgtttgtgcacttcccaggctacttcaggatcctctcggcctctcatcactcataatccttgacaaacccctgcctcgctcgccttgccaggtacggagtccccgccgccgccgcgggcgcgtttgannnnnnnnnnagaggcacgggttgttgcgggcgggggttgcctgcgttcccctggaagccagtggtgagagctcgcggttggtcgtttgtgcacttcccaggctacttcnnnnnnnnnntggtggacgccgcgctgtgcatgcccagcccccgtcagctcgtcgcacgcggcgtgcccgtggcgcgcctcacccaggtctggcagtcagcgcctgcaagagaggggtgttcatcctgaacgggtttggtctgttgcaaggggtgggtgcggcagagccaggatgcacaggcaatccattgtggattgccgtgccccctccagctgccccgacgtctacacaccctcctcctgccacacaccctgtcaggaccccggcgaggtggtggtcaccctccccatggcatacgcggcctctctgtcctgcggcaccaacctgtccgagaccgcggcccttgccacgcccgacagcctgcgctacgccgcggcgcggctgcagcgctgccgccgcctgcgccggcccacctcctggccccacgagctggtcctgctcaaggtgtgtgtgtcggcatcctgccgcgggagcgggaaatttgagattgctgtgcttctttgtgggacgttnnnnnnnnnntggggcgtcctgccgcgggagcgggaaatctgagattgctgtgcttctttgtgggacgttcatttttttgggaggaccaggggattggaccccggtggtgcagcttggaagggaccagtgcgctttcagtgttggggtcgcggatctgcagcaatgcaggggcacctcaagctcccggccatcagcaaggtcggaccagcagcccagggatgcgtctgtgggccatcgttacaaaacacgcacgtacccccccccaaaaaaacaaaatccatcagtgggcggaggaccccgcactgcccgccggcgcctgcccctggctggcgcgggagctgcgccgctgcattgacgacgatctggccacgcggttggcggtgtgggcggcaggcacgaccgactcgcgccgcgcggagggcgaggcggcccgctgcgcgctgtgcggcgcgcactgcacgctgagcgcgctggagtgcccgcgctgcgcacccggacgccaggtctgcgccgcgcacgtcgccgcgctgtgcgagtgcgagccggcgcggctgcggctggccttccgccacacgacgcgcgagctggagggggtggtggggcgcgtcgccggacgcgcagcgggcgagggtaatggggccgtcgacgcgggggtcgcgggcgccgacgcggcacagagcggcgnnnnnnnnnnacgagggtaatggggctgtcgaagcggggttcgcgggcgccgacgcggcacagagcggcgaggacactgccgcgcaggaggagggcgagggggaggaggacgacctggtcggcctggcgggtttcatgaccgagctggccggggcagcgggcggcggacgggagggggggtgcccagaccctgcatctgcgtcgactgccagtacccctgctcccccgcccacgatacccacgccctcgctggcgccccccggcgcggccgcggcgctgcaggagcgcctcgcccggctgggcgaggcgcacgcgctttggcgcgagcgctgcgaggcgacgctggcccggggaggacggctggccgctgatctggatgagctgctggaggaggggaagcagtacgcctggggcgcaggtgggcgtgtgtggatttttttaggggggggcgaaggaaagtacaggggctggagagggctgaggcgaaagaacgcgaagtgggaagtttccggggaggctgtgcactgaggcctccattttcatgtccaacagcctatcatcatctgattctacaaacagaatcacccacacaatcatcttgcagtggacgacgaggacggcgtggaggccacgttcgtgcacctccgagaagcggcggcgtacctggccagggtcgaggccgcgctggcctcccgcccggcggcggaggagctggagggcatcctggggctggacccgccacccctggccgccgcgcctggcctggagcggctgcaggagctgggggagcgggcgcgagagtggcgtgcgcgcgcgcaggttgggggtggggtggagggccgggcggtgaggtgcgcggtgctgtcgtcgcttcgcgaaagcaaaagtgtgcattggcgctggggtcatgagccagtaatccccgctgcccatgtcgtttcgtgctcaccccaacctctcatccctcgggtgccccctttcctgcaggcggccatggctgctcnnnnnnnnnncgggtgctgtcatcgctttgcgaaagcaaaagtgtgcattggcgctgggatcatgagccagtaattcccgctgcccatgtcgtttcgtgcttaccccaacctctcatccctcgggtggcccctttcctgcaggcggccatggctgctcgcggcagcatggagatgaaggacatggaggcgctcatctccgatggcgccgccatttcaggttgggaaaggtggatggcggggtgggagggctgggcaggcccggcttggagcgctgcagcaatgccggctacctgcaacgcactgcacgagggttaaatgctgtggcatnnnnnnnnnnttggagggcagggcaggcccggcttggagctctgcagcaatgccggctacctgcaatgcactgcacgagggttaaatgctgtggcatatctgccagaccagagccctgtcgagcattcagagggttgatcgcaggcgccgggcgcaattcttctctccccattgcccgctcctcccaaccctgttccccactaacgcatacgtgcaccagtgatcatgcccgaggtgcgcctgctgcgggagcgcctggctgctgcccggaagctgggcgagtccatccgcaccgctctgccggggctggcgggcggcccccgccgccgcaagggcgaggcagagacgacgctggaggggctgcaggcgctgcgcgccgccgcggtgaccttgcgctgtgacgtccccttctaccccgtgctctgcttcgccctggaccggctggaggcgtgggcggggcgggtgaagcagctgctgggcatgcgggcgccgctggcggacctgcgagcactgattgaggagagcagggagctcccggccgccatgcccgaggtggagaccgtcgaggtgaggaaggaacggggtctggggtatttgtctgttgccggactcttcaaacccctcacctcctcattccctgctcattctcccgcactctcctgctccagtcgctcatcgccaagggcctggcctggcagtcgagcatgcgtgccctggtggccgcgcgcgcgcccctgaagaggatgcgggacgccctgcacgccgggctgcgcctcccggtggagctgccggaggtggaggagctgcgcggcatcatccgcaggtgatggggctgctgtgggactccttgtgtcggtgctctgccaggtcgccgtcggtccacctggtttggttttgctgcgtctggacatggcggtttcgcacnnnnnnnnnnggcgttgggacgccttgtctctgtgctctgccaggatgccgtcggtccgcctggtttggtgttgctgcgtctggacatggcggtttcgcactctgcatctcagcgctgcacacccctgtatacactcgtaaccccccccccatcctgccccaaccccctatctactcacaggcgggagtgggaggacgcggcccggcgcgccctcaacaatcgcaactccctgcacgccctgcacgaggtggacggccaggccgaggacgtgggcgccggggactgcgagctggccgtgcgcctgcgggaaaagatcgccgcggccgaggcctgggaccgggaggccgcggccttcctggaagcggcccaggcgcccggtctcggcgaagaccagcgccccgaccgcggccccctggcggccatggtagagcggggcagcgcgctgggagtcaagctggaaagggggagcgcgctgcagggtgcgctcctggcggcggagggctggctggcacgggcgcggcgctggctgccagaacctgctggagagagcagaggaggcgccacggcgggggggaaaacacctggcaaagcggaggccgagtccgtggcggagaaggagggctctcctgctcccgctgaggccagcgccggggagcagggcgatgcagcgcccgaggcaatcacggctggtgcaggtgcagacatgccgctcgatggctcggctcctgcgccgtctgccgacgacgaggccgtgacgcaggcccagcctggaagcatgggtgcaacgatggaggaggcagcaccgccctccaccgcaaacagcggcaggcgcagcggcaagcggtcgagtggtgacggggctggcgcccacgctgggccccggtcgccggtcggggcggtggaaggcggccgcatgcccaccctggccaccatccgcggcctgctggcggagtacgagggcctgctcatccgggcagatgaggcaaagggtacgtaggggagtttgggttttggtgggttgagttttgggccatgtgcatgccatgtcaccaagagagccactcaagggcttcttctctcacatgccgcgctggtttgaaacaccgcccggcgcacgtcgaggacacctccatttcgtgaacaccgcataccctctcggcaggcctggcggcgctgcagcagcatgcggaggcgtggctgcaggcggcctggcccatgctgcagttggaaagcgtgggcgacgcccagctggaggagctgcaggccctgctggccgccggcgcgggcgtccatgtggagatggaggagcgggatcacttgttggcccaggccaaggtacgcagcggagtttggggggggtattgtgagtggagggagacggcgatcaggtgggcgcaaatcttcaccgcgtgcgacggcagcagagctggcaccctaagctctgggtcttgaggcgcaggacgattgcgcacagtcgagtgcacgcaaggttagggctacctgaccattaatcccatcactctccctccctgagagcaggggctgatctggaatcgacaggcgcgagaggtgctggcccgcctgcagtcaacagagcgtggtgctgagcacagcagtggcggcaatgccgacgtggatgaattccatctcccaaccaccctcgggcaggcccccttggacgagagggtgcggtcttctgcagatgccagcacatcggcgccaagtgccgatgagccgccctccctgccgggcaagacctcaagcgtggaaaggccggcggcgacggcaccaaacgtgcacagcgagggcccttgcgagcctggagctgagacagacctcagcaatgctggtcagtatgtaaagcccgaaccaatgcagggcgatgccgacgcagcatctggagacggtgtcggcccacccgaggcgctgccggcagccaggtgagtgtccggcgggtccctgttcaggattgtgcgggagcccggtgtcattgcaagatggcagtgagagtgcacaccgtgtgccgagctccggcaattcacaaaggtccagtacatacagctggtggcgcagtgcaatgttgagccaccaccagcatccactaatccactgcctccctcccagggtcccactcgaggtaggggtggcactgatgcagggtgccgctgacatcccggttgaacagaatctcttctctgagcttgaaaggtgaggcnnnnnnnnnngggggtggcgctgatgcagggggccgctgacatcccggtcgaacaaaatctcttctctgagcttgaaaggtgaggcggggctctggcgcctgtgtggcacataatgagcatgcgtcagcttcggcacgcccagggaattagcaggggtcaaaccaaggtacacctctacgctgctgaccctttacttatacagtgcnnnnnnnnnnnnnnnnnnnnnntttgccagccatagccccacctctccaatgggccccttctcccatgcttaccctcttgcaccccccacgctgcctcaaccccagcactcacctgtcctccacccccgccaggcacgtcaatgtggggctgcggtggcaggagcaggcgcaggccgtgctcgccatcgggcgcccggggtccggcgacgcggccccggtcgaggcgggcgccctgcagcggatgctggccgagggcgcggggctcggcttcctccaggcccacctcgttgagctggaggccgtgctgcgagaccaccaggcctgggagggcagagtgctggccctgcgtgatgcctgcggtaggtttttcttttgctttgggggggtggggtggggtggaagaggtgtgcaaagctgcattgcctgctggagtacagagacaaagcttgggtggggtggctgattggatctagccacatgggggctcgaatgtgcgttcaagtggcacagacctgccgcatcccgcgtcccaccaaggagcatccaaccttgtaaaaacctcccaggcaattcacgcccctgccatgccgccctggccaagctcggggatgaggcggcggcgtccccggtgacatccctcctgcggcgccacatcgaagccgccgtcctggcagccggcaagtggagcgccgggtggtttggtctgatggcttgatgaggcagctacctgcccctacggctgtgtgcgtgtggtgcccaggagggatcggggtcatttgcgaaaatcccctcgccccatcctcgcaccccatgctctcgcttgccagatgattgggtggctcggtgccggaggagcactgtgaaacggaactcggtcctgaccctggccagcacctttgaaaccattggcagcagtgtggatgccgccgtggagcagtttgagaggcgccttgaggtactggtgtgggcggtgtgcctgggagcggtgtgttggggtggagaggaggggaattggagggctgcctgacatcgcagaagcgaatatctcatacagtccagggcccggactctgcaagggcatgcccaaggcccacgtcccaacccccccgccgctcatctcgctctcttttccatcgtttcctccagctcgagaagcagctggtggccacgggcggcgcagagcctgaggggagtgacgaggggggcgagctgtattgcctgtgccagcagacctacgaggcggacaccagtgagtgggaatgccgagcgtggttgtgcggcggcacactgtttccctaagtttggggtgcttgggggttgtnnnnnnnnnngatgtcggagcgtggttgtgcggcggcacactgattccctaagtttggggtgcttgggggttgttctgcaatgttccatgccacttgctgccagagcacagtatgaacacggcgaatgaccctcaggggggctatccggccctgtaatatgcaggtgcttggctcccatgtagcacccctgaccctttcgcccctcctcccttccaggcatgatcatgtgcgactcgtgtggggagtggttccacatgcgctgcgtcggcatctcccagacccaggccaaggtgaccaagaagtacacctgccccgtctgcgccgccgtgcgggtgagtgagggggcctctggtctggaaaagtcgccctgtgtggagcgcggctgcatgtttgcaggtcgtgctacaagatccagcgccagcaataatggctggggcacatgggaagttgtttctttacatcatgagctcctgaggcgcatcaccctgcagtacaacggcgagcccctgcaagccgccctggccaagctgaagaagacgcggcggccgacccgagccgggctgggcgcttttcttgaacaggcaagtggtggctgaaaggccaaatggtctctcgcgcatgcatgagggagcacaggcggctctctggcatcccctcgccttggcacggtaacacaccagggccagcttcacacttgcaacacacatgaactcatggaggtcactccactcctcctcccctccaggctcgcggcctgccagtgtccttggcggaggaggaagatctcgaaaaggtgttggtcaagtttgaccgctgggcggtgagtggtgcttggagggagccaggatgaagcggggtggatgcatggcacatgagatgatgccgccgtgtgcattgcctccagctcctctgcgactgctgctgtgatcccgttgtacagccgcccacgacccttcccccgcattacttccccactcaaaactctgcctcgcagacggccaccaatcgcgccgtggaggtgcatgccgcctcgcgcctggtggagacggggggccagatcctccccttgtctgagggcatgctgcaccagctgtgcaagtcgggtgagccaggggaaggggcagcagacggggcagcagaaggttgtcagtggcaggcaacagggcatggggctacatcggatagtttggccgacgagcactcgctgcccctcgggcgtgaggcctcagaaatctccatcatcccctcactctctcaaccnnnnnnnnnngttggccgacgagcactcgctgccccttgggcgggaggcctcaggaatctccatcatcccctcactctctcaaccgcagctctggccatggagctggatgcctccgagtttgcggagcgcatcctgagcctgctgcgctgcaaccgctggcgcacccaagtggaggcgctgtggagcgcgagcagcgcaggtgaggaaggaacggcatcggcactgcggcaggcaggacagccctggacttcaatggacccagatggttttttcttgcgctgactgtactgcgctgcagcgccacctacgcccggcaatgtacatcatgccaacccctcgccccacccgtgtatcgagcagagaaaccgacgatggaagctgcgaccaggctcctggcgnnnnnnnnnnattttttcttgcgctgaatgtactacgctgcagcgccacctacgctcggcaatgtacatcatgccaacccctcgtcccacccgtgtatcgagcagagaaaccaacgatggaagctgcgaccaggctcctggcggaggccgtgcgctgcggcgtggtcgccgagaccgacatcgtggggttcaggctcgcggcggcagccgcgcagtgcagggactggcagcgccgagccaaggccgtgctcgcccacctccagccgtcgagcccggtgcgttcgcggtcgggaaggggggtgggaatgccgggcaggctgctcgatggggcgtgcaaggatgggatttacatgacggcaggggcagtggtgcagaggcgagtctgatagggatgctggagaagaatcctccagnnnnnnnnnntgcggtcgggaagggggatgggaatgccgtgcaggttgcttgatggggcgtgcaaggatgggatatacatgatggcaggggcagtggtgtagaggcgagtgtgatagggatgctggagaagaatcctccaggcatgcatgtcaccatcaagatcctttctccgggcagcccacctgttgggaaccccccctcttctattcccgtccgtcacccgtcaggccgagggctttgaggctgctgcggccgccgccgcggccctcaccctggaggcggagcgcctgccgctgggcgtgcctggcgaggcggaggacctggcggagcgcggcaagctgtactgcctgtgccgcgcgccgtacgacgagcagcgccccatgctgggctgcgatcactgctccgactggtaccactacgagtgcgtgggcctgcccggcccggcaggcgaggagggcgccggcgccgaggcggtgccggaggacttccgctgcccctcctgcgccctgcgcgcgggggtgacctaccccgccttccacggcctgcccccgcgctccgtggaggccctgcgccttgcagcgcttggcctgggcgggggtcaaggtaagggagacggccaaggtgctgctgcagcggcggagggggatgtagccgccgcctggcaggctgccatggcggctgcgctcgcgggcggtggcgaggcggacgctgcgctgggcccgggcatgcgcgagatgctggccgcctgcccgccggggctggcgggcgccatgttcggcggctgctggccgggcagtgtggccgcggcgggcggcgaggtcgacgcagcggagccggccgccaagcggccgcgctcggactctggggtgcaggcggatctcggcgccctcgggcccagcagcgacgcaggcgggccctcggccacggtggagctgagtgccggcacgcaggaccctgaactggcagatgggtgtgcccagaacgccgagcagggaagcatgagcgccatccctctgcaggaagcggggccggccggcaccaacacccaggatacaaccagcatgcctgtccccgtcccagaagcgcctcgcaagctgtgacctccgcacccagagaaccctttgctgtgcactgtgcccttacgcactgttacctccgcattcttttcctcgacgctcacacctgtcatcggcgaacctgaactgcaatcccctggctggatgactgccatgaagctcaccgccagtttgacaacggattcgtccgctctgtcccagtcttgccggtcagcgctgcccagagtgcagtgcttgttattcgcggcctgagcctgtgcagggtgatcatggagatgtctgcacagcactttaagctccctttcatgagccaatccccagccagacagccatcatacactcgactcaccaccgacacacagaagagacgtcaagttgaggtctgtacgagggttgaacaacgagggtagagacaactgcctgttggacctgacgctggtatcaccatctcactctgacgcgtgttcactgggaatgaaatgtttacatcagtgcatctgcctgcggggaggaataaatacacgggatcaagtctgtctgtcttctcgacgagagcagcatcacaagagtactcagtgaaagatgttggagggtcgagctataaaatctcgggcccggagaccctggaatggttctatcatcgcgtcctactcagtgctggtctgcaaccatgttnnnnnnnnnngggccctcgaatggttctatcatcgcatcctactcagtgctggtctgcaaccatgtttctgcgcagcttttcgatggctgctgtgtggagctggtgggtgcgattggccgacacgcccatccaccgccccagctcctgccaggtcatgccgggcccaccctcctcgagcatgccgtgtcgcgccagcaccaccgcacactcagcggggggcaggtgcgccagctggctgcgcagggagatgccctgcagctccctgacagcctgggagctggggtccaggccctgggcatgcacctcttccctgacccaggagtcctcctcgccctgccccgcctgctccagggaggccgccgcctgggcgtcagctcggagctcaacgatgctctgctctggcaactgcatgacctctgccacctcggccacggtggggggccgacccagctgcctctccagcgcccagctcatcgaccgcagctgcagcgagggggttcggtatgagatgattaaaattgcttggatgggtttacttcccaccctcatggactcccgtgacaccattccataagtcattgcacttcccactcaagaaccctcaccttttttatctggatcaggcggctagatggcaggtagatggagcgagacaaggactgcgcggccctttccaggtggcgatgcagcacggggatggcaaaggttgcaaaggcatgacccttctctgggtcgaatcctcgggcagccctgtggagcgccaccatgccctcagcatacaaatcctgcagatacacgggagaagatcgtaacaatcttgacaaaaaggagactggcgtgcacctggtgcgagcagattgcggagcatatgccagataacatgatggggtgtagcacacatagcacgctgctctgccccaccgcacacccttgctcacctcagcgtgcacactgtaatgcctcaaacgcttggccaccaggtatatcagccgaacattccgtgtgaccaggacctgctctgccagctgtgcttcacgcagcagcgcaccgtgcgggctggcatcctcttggccgtccaaggagccatccaggagatgccttgctgcctggatgcattcgcctagttgtcgctcctcctccaagctgagtcgtgggaggtgctgcgtgattggtgtgatggtgagtgtggtgaggaagtgcagaatggctttgctttcagtgcctcaccaggcctgagtgcagacaatccccagcattcctcatccaatccctgccaactcatacctcctttccatcgcctggggtggagagctgcaggttggatgtgaagtgggagcctccggacgagcgcgatgggcggctcctcgcgagccgctgcggctgtcgacgaccaaagggtttggtggatggcgtccagccgggggaagtggacaatgcgcgcccggaagcagatcttggcacctttccgctgctgcgtttggcaacgctcaaacgtggggcgccgaaggaccgctccaagctggctaaccgggccatcagggcatcccgtggacacgtcgcagcgaggcctgccgccttcacatcgacttccgcgatgccagtactcgacatgggccgcaccgacgccctagctcgcctcattgtgccagatctatgtaaggccagatatctaaaaggacatgacggagcggtggcaaatgccgtgcgtgttgcgggcccggtatatgtggccagcagcgttttcatgtggagcccaacgacctgggccatgcagagtttcagtcgagatgtgcagtactctgtcactagaatatgctaattaaatatatgttcccctcctcgcggcttcgatatgatgcaattccaccgagtatgtgggtctcctcgaagcttcagccgaatcctggggatttgtggacgacaataaatcacgggaaatcttgatgagctggtgccaagactttggcaaccccgtgccctagttcccccgctgcgcactgtgtccctctcagatttacacaacactgaccgcttccactgttttgagtacactgtctctaggtttgatacagcaggcccagccacggtggggcctgaccgcccctcatgcggtgggtgccggctgggcctgctcctgcctgctgctcgagatgaccgtgcccacgctccagtcccccagcagggcttggagcatcgtccccggtgtggttaggttgaagaccaccactgcagcaggggaacggtggtggagttgggagaggggtgggggggagaatcgacgggaaacacggacttggagctgcagcacacgatcttggttctcattgatcgtctcatgcgcagccgacaaacccattcacccccaccccatactacaccaccgtctcatgatgacccaccctctctaccctcaccccttcccaccctacctgggatgtcgttctccttgcacaacgtgatggccgtgccatccatcaccgccagcgaggcatgcagcacctcctggaaggtgaggctgcggtgcaacgtggcgcccgcgtggtgcgccggatcgcggtcgtacacgccgtccactttcgtggctttaaggaacgcgcccgcgccgatctccgcggcgcgcagcgcagccgcggtgtcggtggtgaagaaggggttccccgttcccgcaccgaagatgaccacgcggccacgctccaggtggcgcattgcccgacgccggatgtagggctctgcaatctcccgcatctcgatggccgtctgcacgcgggtgggcacgccctccgcctccagcgcgctctgcaggcacaccgcgttcatcaccgtggccagcatgcccacgtagtcggcgctggcgcggtccagcccgggccagcgccccacgccacggaagaagttgccgccgccgacgaccaccgccacctgcacgccggccgcaacggccgccgccacatcgcgcgcgatgccggagaggatggccgggtccacgccgtagccggcagggccctgcagcgcctccccgctgatcttcagcatcacacgccttgagggttgggggggaataggggtttgagtgggaaggggtgtcagaggtgggagcaggctaagtggtgcggagtgccgggtttgtgatgatgaagcaagtctgggccgcctgagagaaggacagtagctgctctgtaccctgggcattgcgagcttttgagctccaggaccaggtttatatcagaaatccttccctcacctactccacgccccccaatcaacgtccgaggggcccctcctgctactcacggactggctaggccttgtgggccggcctgtggggctgcatgggcttgtacatgccaggcaccttgccggcctgcagaccctctaggtacacacatctctcgagacatattgctccatacaggcttgggcgctccgtacgacgcgctgtgtggccctgctggggagcagccgttctgggcagagcgcctggctccgacacatacaccgccgggctgcggtgcagtacgacacagcgacatcttggggctgggctggtatcggggattgtattaaatgttaatgcaacatgcgcatcgtcgcatgcgcnnnnnnnnnngcgacacagcgacatcttggggctgctggtatcggggattgtattaaatattaatgcaacatgcgcatcgtcgcatgcgccgtcaaaccatcgacggggaggagggctcccacgcgcgcgaccgtctccccacggcctttcgctatccggcctcctttcttacactccagcaagctcctcctgcccgtccctgagcgcgcggatgtcgggagtctgcccttctcttcacctttgagtccttttgcttcaccaattgccaatttccggtgcggcagtccccagcacggcctcactgaccagggcttggctgctggaggccccttctctttggcccgattcccagccagcgatcttctgatacgtctgcctgcatcgggcctgcctccccaggccgggacctcgtgtccgcggagccgtagtacatgacgaacgaggagccagtgcccctgcacggcaaggctgtgttcgatgcagacctctatggcggagcagagggcggaaacggctacacggcctccatcgccatggaggaggaggatgaacaggacgatagggagcgtctggtggccgggtgagtggcctgcggtcagtgtggaggggttgcaggggctgggcgcgcgaccgtgaactccactgctgtcccgtctgtgggtcgtggtgtgcacccggtgggccctctttacagccagtgttcacatcttcttgttaacaggaagctggcgtcatataccgccccgaaatcggtgctgaacgacatccccgtgtccgacgatggtgatcaggtacggagtgactgtgtgtggggatgggtcggtcatcatgatgctggccttcaactgcaccgatatgttgcaggccgggtcttccgatgtatnnnnnnnnnncggatgggtcggtcatcacaagggctggccttaaactgcaccaatatgttgcaggccgggtcttccgatgtattgggtgtgtcgctggcgcgacgactgggtttaggggagcccagcgacacgcacagaggatgtcacggcggtgggcccccctcctctggtttgtattctcattgaaggctgcgacgctgagccacccacctgcctcaccatcactcacgcccccctcccctccgacccccaaagcaggctgggtcctttggcggctccaaccgcatcgtggaccgggagagcgagtactctcgccgccggctcaaccgcatcatttcccccgaccgcaacgacgcctttggtatgggcgaccagacccccgacgcgcgggtccggacctacgccgacgtcatgcgcgaggcgcagctggcgcgggagcaggacaacacgctgcgcaacatcgagctgaagcggcgcgcggaggaggatgccgcggcgcttgcggcgctggacgccgtgcccaccaaggcctcgggcctggcnnnnnnnnnnnnnnnnnnnnnnnnnnnnnnnnnnnnnnnnnnnnnnnnnnnnnnnnnnnnnnnnnnnnnnnnnnnccgcgccggcgtccagcgcgggcaagcgcagtcggtgggacgcgggcgacgcagccgcgcggccc

SEQ ID NO: 41314 - DNA, 61 bp, Chlorella protothecoides
ggaatgccacagatgggcccccctccgatgatgctgcccgggtagacctcgtcacccagga

SEQ ID NO: 41315 - DNA, 2445 bp, Chlorella protothecoides
  modified_base (153)..(262): a, c, t, g, unknown or other
  modified_base (1249)..(1258): a, c, t, g, unknown or other
  modified_base (1361)..(1370): a, c, t, g, unknown or other
  modified_base (1823)..(1832): a, c, t, g, unknown or other
  modified_base (2223)..(2232): a, c, t, g, unknown or other
cacgggcgcggcggccaggtcgtcgcgcgtggccaggggccccgtcagcgcgccgcccacccacccggcgccgccgcgcgccacgtcccaggccatgagccgcccctcccgccgctccccgttccagtgccccgtcaccagggtctgcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcgacaagaacgcgcacagcgtggcctgcccagactcaggcgcgacatcggcgcgcagcacgccggactcggcctcccacacccggcaccgcgcctcgcccacggcggcgagcagagcgccgtcgggggaggcagtcaggccggcgggcgcgcctgggcccgggccgggcaggttcaggcgcggcggcgcggctaggtcgcgccacacgcgcaccgcgccgtccgaccagctgccggccagctgcccggtgtcgtgaaggaagcaggcgcgtacggggacgggcgccggtgcagcgccggggacagtcagccgcgccgccagggccagcgccgggcgtggcgcgccagcgctgctatccaggcgccagaccgccaggctaccgtcctgggagcaggaggcgagcaggccggcactcgcatcgtgcgccagcgagatcacgcgcccggcgtgggccgcgggggttttacccaggcaggcccccgtcgcggggcaccacaggcgcaggctcccgtcggcgcccccgctggcgagcagggttgtggggggggatgccggcgccgccttgtcgtcaccccttgaagcctggcgggcggcagagtgcagtgggatgagggtggggcggcttgcatcgggaagctgctctcgcaaggtggcctcaccattgggcggcagggcagcagaggtcaagcagccgcaagcttggacatgtgtacccctgcctgcccctcttggcggtcctcctgccgacccctcaccctcctccaaaccccctcgcacgatgcgacggtccctgcaacgctgcagccccttgagacgcacatcaccctcctcccacaaaaccatcacccaaccgcaccggcagcgcagccaggcaggtcacggcgccctcatggccgcagcacagcgcacgccttgcggcccgggtggccactttcgccagctcggcgcgggcaggcgccaggtcggccgccagcccggggtccnnnnnnnnnnatggaatgagggttgggcggctcgcatcgggaagctgctctcacaaggtggcctcccccttgggcggcaggtcagcagaggtcaagcagccgcaagcttggannnnnnnnnnagctccagcgcgcgggcgtaggccgcagccgcggcggcgtggtcccccaccgcggcgtgcgcggtgcccgcccgcacgtggcctttggcccagcgcgggcggcgggccagggccagctcggcggcacgcaccgcggcgggggcgtcccccgcgcgcagggcgcagagcgacaggttggcaagcgccggcgcggggtcggggggcaggagggccaggtgggcgcgataggcggctgccgcccgggcgtactgcccctcccggcacagggcgtccgcctgagccttcagcaggctggggtccggggcagccacgctcgccatgctcgctgcggcgagctcggtgccgtggccgatcaaaacctagcgaggaatcagtgtagcgcgggtgtgtcgggtgagagggatatgtcggcacgagtcctacaacctccgcacttgctaccgttgacccagnnnnnnnnnnggccgcggcgagctcggtgccgtggccgatcaaagcctagcgaggattcagtgcagcgcgggtgtgtcgggtgagagggatatatcggcgcgagtccaccaacctccgcacttgctaccgttgacccagaactttgcactgagtactcatggacccggatggggtgctgcccttctataccgaattccaattcctaaggctgtgaagcaggtcgtgctggatacgtctgtgcacgttcgacaatgatcgcaagcgactgcttgagagacgaccatgcacgctgttatcgtaagatcagacttcataccgagccatggccaggtcgacagcataccacttctaaggttctctttccatggcatggtggtgttcaaaaacaccagtgagatcnnnnnnnnnncccgcaagcgactgcttgagaaacgaccatgcacgctgtcatcgtagatcagactccataccgagccatggccaggtcgacagcagaacacttctaaggttctctttccatggtatggtggtgttcaaaaacaccagtgagatcgagggttaaggcgttcaagcgcgctcgccacggatgcgacgggccagctggatgtccttgggctggatg

SEQ ID NO: 41316 - DNA, 78 bp, Chlorella protothecoides
gacgtaggcggagcccctgcattgggatgggaggggtagggaggggcagacctttgtgggcgagtagttatggagagg

SEQ ID NO: 41317 - DNA, 75 bp, Chlorella protothecoides
acccccagatgctcgccggtcagcgtcctggcaggggaatcgtgttcgaggagcttctaagtgggaggaggtcca

SEQ ID NO: 41318 - DNA, 61 bp, Chlorella protothecoides
atttggcggctgtgcgcgcgggcacatgggtgcgaccacccaccctctggccctgatgctt

SEQ ID NO: 41319 - DNA, 77 bp, Chlorella protothecoides
ttgagcacagccacatacctgtggttgtgtaaaggaggtgttttgagggggggaggggtgccgactgtgtagagtac

SEQ ID NO: 41320 - DNA, 61 bp, Chlorella protothecoides
gtcttcgctcccaaggtcgacgcgctgggcgcgctgcgcgcagcggcggggccgggcgtct

SEQ ID NO: 41321 - DNA, 127 bp, Chlorella protothecoides
agggtccagaggtgggccccctcaccctcacccccctgccccagccccaaaccccttgtaaacccgccaacaccacagcctgcccaccttcttggcgtcgaaccggctctccagcaggcgcggcgcg

SEQ ID NO: 41322 - DNA, 112 bp, Chlorella protothecoides
gatgagacagggtggggttgggcagaggcgcgcgcgctgacgacggttttgagggcgcaagccgtgcttcgagtggtgccctggggctggtgggggaagccgtcgagggcat

SEQ ID NO: 41323 - DNA, 145 bp, Chlorella protothecoides
ctccacctccagggacaccatgccgccgtcaatcacaatctcgtcgcccacctgcaggagttttttttcttggtggggggggtgaattggcattggtatcatgaagatgcgatcgcttgccagggactgcgctcagcactccagg

SEQ ID NO: 41324 - DNA, 1748 bp, Chlorella protothecoides
  modified_base (149)..(266): a, c, t, g, unknown or other
  modified_base (489)..(591): a, c, t, g, unknown or other
  modified_base (1057)..(1135): a, c, t, g, unknown or other
ccgggccctggcgagcgccccgcgcccgccgccctgcaggccagcgccaagcgtgcggcgccggggccgcgcctgcccagcggcgcgtcgctgccctcgggcttcctctcctccacctcgcgggggggttacacggcaccgcaggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacctgtctcccaccatccccgcgggctggtacgaccccacgcccgagcagcgcgccggtgtgagccccgcgccggagcccgccgcgcccgacctggcgcccatcttcacccgcgcggcggaagacggggccgcacgcagcgggggggccacgcccgtggacggcgcgcgcagcacggtgagtttgttcggggggggggaggtgttgtgaggttggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgaggggcggcggcgaggaatgcagggccggagcgcgtgggagaagaggagaggctcaggtcgcaaagggtgtttggggcgagggtcgcaccggttcccgctgcggtggctgggaggctcgcgccgccctgccaccgctgaaggggctgggaggctcgcgccgccctgccaccgccagaggtgcctgccatgcgagggctccaatccctcatcgcgcgccaaaccccggcacaaccccccctggccacgcagacgcagcgcggcggatcgggcgacgaccgcgcgggcctggagctgctgcagtccatctgggccatccacggcgcctaggcggcagtggctcgagccttcctttggacgcctcgggcctggcccccgatcggccggccacgcgcccacttcctctacgccccggcgtccctcagcgctcccgcccgccactcctgcgccactctcgcagccgnnnnnnnnnnnnnnnnnnnnnnnnnnnnnnnnnnnnnnnnnnnnnnnnnnnnnnnnnnnnnnnnnnnnnnnnnnnnnnncatccctttccatgcaccttcccctgcgccccactcagcacctgagcagatgcaggcaggctcgggccgccgtgcccgcgcctgcccgagcacgtcctccccctctgacgcggcggggagggtggcagcgtgcaacgccctcccctccccacgtctccttgtccctgacgcgtcgccgagttgaattggagcaggcccccacccccacccaggacgggcggcccggcctcgctctgcaatgccttgtcggcgccctgcgtgacgcagccaccccgcccgcgatccccccgcacacctcccacgctcctctgcgctgccgatgatgtaacagcacgccgcatgcgggaccagggcttcagaagccgcgggagagcggggcatcggcgggggccgccttcttcgccctcccggcgtcgcgccgcgccaggatgtagtcccgcacctccttccagcgcggcaccgcgcgcagctccaggcggtcgccggagcccagggtcagcaccatgtcgccccagtagcccaggccccggcccaccgccaccacgtccctaatctggtcgtacccggcgtccagctgctcctctgtgtgtgtgtgtgtgtgttgggggggggg

SEQ ID NO: 41325 - DNA, 109 bp, Chlorella protothecoides
cgccgagcagggcctggtccagcaggcggggctggcgggggaggcgtacgccgcgcactccgcggtgcagcccggccctggacggccccccgtcttcgtgcacacgctg

SEQ ID NO: 41326 - DNA, 61 bp, Chlorella protothecoides
aacgtgggttacatttagcgcagagcatctctgctgtgcgctccaccaggcagtcttgggg

SEQ ID NO: 41327 - DNA, 653 bp, Chlorella protothecoides
  modified_base (185)..(194): a, c, t, g, unknown or other
  modified_base (376)..(432): a, c, t, g, unknown or other
cgccgtctccctgctctgcgacctgcctcacacccaagcagaggccacgatgcccactacccttccccctcccccccgccccaccttccttgacctcctgggccttgggcgcgctggggtcctcgtacgactgcgggcagggaacgttggccaggggcttgccgggctcgcgcgcgatggagcannnnnnnnnngtcctcgtaggactgcgcgcagggaacgttggccaagggcttgccgggctcgcgcgcgatggagcaggccacgacctcgaagcccacgatcatgtacagcttctccgcggcgccaccgggggtctcgcctgccagcatcttgcgcccagccagctgcacatggggagggggggggggggggnnnnnnnnnnnnnnnnnnnnnnnnnnnnnnnnnnnnnnnnnnnnnnnnnnnnnnnnncgtgaggaggggtctcgagcccctcgaggcctctggcgccctgcacagcccctcgccgctcgatcgtgctcctcctgctcgccgacgacgcgcgccgacacagctgctcccaggccccagcgcccatgcccaacgtcccagcatgcagcccaacacacctcaatccccccccaccccctcctccttcatctcctgcagtccccccccccccccttggccca

SEQ ID NO: 41328 - DNA, 66 bp, Chlorella protothecoides
gtgcgcggcggtctgtttgtgtggtagtggtgggggggtggggggggcacggtggcgtgattcatg

SEQ ID NO: 41329 - DNA, 14151 bp, Chlorella protothecoides
  modified_base (208)..(356): a, c, t, g, unknown or other
  modified_base (421)..(430): a, c, t, g, unknown or other
  modified_base (1608)..(1617): a, c, t, g, unknown or other
  modified_base (2375)..(2384): a, c, t, g, unknown or other
  modified_base (3382)..(3391): a, c, t, g, unknown or other
  modified_base (4042)..(4127): a, c, t, g, unknown or other
  modified_base (4181)..(4190): a, c, t, g, unknown or other
  modified_base (4585)..(4594): a, c, t, g, unknown or other
  modified_base (6132)..(6141): a, c, t, g, unknown or other
  modified_base (6277)..(6286): a, c, t, g, unknown or other
  modified_base (6392)..(6401): a, c, t, g, unknown or other
  modified_base (6482)..(6491): a, c, t, g, unknown or other
  modified_base (8648)..(8657): a, c, t, g, unknown or other
  modified_base (9801)..(9810): a, c, t, g, unknown or other
  modified_base (10026)..(10035): a, c, t, g, unknown or other
  modified_base (10691)..(10700): a, c, t, g, unknown or other
  modified_base (10998)..(11016): a, c, t, g, unknown or other
  modified_base (11078)..(11087): a, c, t, g, unknown or other
  modified_base (11336)..(11345): a, c, t, g, unknown or other
  modified_base (11427)..(11436): a, c, t, g, unknown or other
  modified_base (11518)..(11527): a, c, t, g, unknown or other
  modified_base (11664)..(11711): a, c, t, g, unknown or other
  modified_base (11979)..(11988): a, c, t, g, unknown or other
  modified_base (12188)..(12197): a, c, t, g, unknown or other
  modified_base (12455)..(12464): a, c, t, g, unknown or other
  modified_base (12567)..(12576): a, c, t, g, unknown or other
  modified_base (13258)..(13267): a, c, t, g, unknown or other
  modified_base (13579)..(13588): a, c, t, g, unknown or other
ggggaaaggtttgggggtggggggtgggggcgatgagaaggggagggtggcgcgtgggtgagacgatttcagccggagatgcaccacagggggacgatgttcgccgcatgggggcagagaatggggctgtggggagagggggatcgcgctgcgtggcgtgccgcggcatagactgacgaccgccacgtgggagccctctgctcgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacgaggaggagtacgccgccgggcccgggagcgaagaggaggaggcggcggaggggcagcggnnnnnnnnnnacatgggggcagagaatggggctgtgcggagaggggaatcgcactgcgtggcgtgccacggcatagactgatgaccgccacgtgggagccctttgctcgtgacgcgccgttctccgtggtttctacatcaacgggacccagccttacgcaaccacacaagcacacccccctccactgcaggcggggaggatggcgaggaggcgcccggcaccgccgccctggctgctgcgggcctactctcctcagacgaggaggagtacgtcgcagggcccgggagtgaagaggaggaggcggcggaggggcagcggccgcgtaagcggaaatcgtcgtcggcgaaggcgagcgaccaggccgggacgaggaagaagaaggccaagctgctccgcaagggcaggaggggacgggacggaccggcggatgagcgtgcaggggacatgggcgcagagggcgacgccatgggcgccgcgcacgacggtgtggaagcgagggacgaggacggagctgacgccagggactcggggctgatcaccacggacgcagatgtgccagggacagccgagggcaggacggccgccgaggccatggccgacctctttggctcagactcagacggcggcagctatgcgccggaggccagtgacgacgacgaggaccaggaggagctcgaagaggcggccgaaggaggggcaggggaggagagcgacggcgtcgtaggtgtgtgactcttgtctggtgccggggggcttggtggagggtgccgaggtctgcgtcggcagtcctggggtgccatggatggggctgtgcacccccaaagtgccccgcacctgtgcagggtcccgaccagtttgtcatgccatcctcgcagagggtgtggagcaaggcactgatgcagctgcagcaccgggaagcggcggaaagcgaggcaggcacgtcgttcttgacgactcagattcagatggctgacatgttgccccgccctcgtcgtaatgcctcaccggtgccagactctgtgggccgacacaggcttgggctaggcacctggcaatgccattcatgtcttgaagggtcctacatgattcagacccctcccttggggtgccagatgcgacacctatgcgttcactttcaaggcggaatgcgcgagctattgtatcagccaaacggcacgaaacaaaccnnnnnnnnnncaagggtcctacatgattcagaccccttcccttggtgccagatgcgacacctatgcgttcactgtcacggcggaatgcgcgagctgttgtatcagccaaacggcacgaaacaaaccataaacactcctaatgcagcatatggcatgatttagtgctgcatcacgcgacatcggtgcccatggccccaaagctccaacccctgctcgtgagccaggaggcacgcagtgcgtccccctcgcagagggctctcgcggggctggaggtggtcatcctcaggtatgctgcatgaatcaatgcgacagcacgaagtgcatgtggagtcctgccgtcactcgcctgcctgcccccttcgcagcggcttgctggtctccgccttctggtggggcctgcacgagatcaaggtgacctgggaagaccccatggagggtaccgtagaggcatctgctgaacatagtgagcctcttgtcgacctcctatcccagtccatgtatcgcaggaccacctgcgcacctcccccaacctggtctccctgtatcccttgctggcgctgggcctcatcgtcacgctgctgccacccctcatgtacctaaccctcatggacacctttggggtgctccaccccctctggcccccccactacatcttcatcgcacggcagtgcctgcgcaccctccggaacaacagcctcaaggtgcgtggagggtttggatgcttggtttctctagtggccactccccagcaccaccccgctccatgtnnnnnnnnnnagtggaggggttggatgctgggtttctctagtcgccactccccagcaccaccccgctccatgtcctgccgagcatggcctctgtcggtcaggtgcaccgtccctgctcacgcctctgatctcaacaccgggcaggtcacggccaaggagttatagcttgggagcagcgatctgcactgctcacccatgggttcggttctggcgggagcccttctgcagggcacttgcactggggccagaggtggacgtgcggcacgcgccaatcagctgaacaatgcagcctggcggtcaggctcgctgcacactgtttcattgcgtgggtcgactccatcctggcccggccgctctggtcccattcctgatcccagggggtggacctccgcctgggtggccagggacccttgcgctgggtcctctcagatgatgatgccctgctttcttcggttgctgaacatcacacgcactcccaccacctgagtgcatggcgtgggaaagccatgacagtgctccgctggggttcccagaggcaagcctcaggtgccggcccctccccggtcctgcgtcgcggatgtgtgcaggagggccgaagcctccccgtagccgcattcgtcgtgcagcatccccacacccctgcaccccccgggcgcaacaccggcagtggtgctcacctgcgcaaaggaggccgcgactatgacgccgtacagcgcgacatagtaccatagggcgcgagagtgcgtggagcgcacggtctgcaggtggcgctccgtgcggctgctcaggtagcgctgctcgttggtcacgttatgcaggtagtagtccaggcgctgcagcccgtcggccaggctctggacctggtcgttggtgcctggggagtgggggtgggattcgtggggatgggaggggtctcagtgaagccagggatgtggcgcagggcgctgcccggtggggtcatgctctggggggggggtggcacctggcggctcacagtcgtccgccccnnnnnnnnnnggcagggcgctgcccggtgggatcatgctctgggaaggggtgggcacctggcggctcacagtcgtccgccccgtccctgccgcctcgcgcctcgagagcccagcccctcgtgcctctccctgctcctatgcaccgtcaaacaccccccagaaacacacacacacacgaataataactcacccagctcccccgccgtcacgccgcccgggctcagctggatgccccccgcctcgggcggcgtgcgctgccactcaaagtgcgtgcccaccagcgtgggcgagtttacggtgaagtaggagaggcgcacgatgacagaggggcgcaggatctgctgcctgctgaccttgaagcaggcgcgccagggaccctgcccgccgtgccccgtgacagtggcctcggcggaggacaccgcgacctcgctgtggatgatgcgccccgcggggtcgtacagcgtgaagtctaccgtggctttggtggcctcagtaccgtaacggctgctgatctgggggggtggggggtggaggagggggaggcaccatgagcttccagggctttgcagagtgggagggctgcagggggacagcttgcccacaatcacacaagaatgcagagcttggcatcccccaggtacccaggtcccagctcaccagnnnnnnnnnnnnnnnnnnnnnnnnnnnnnnnnnnnnnnnnnnnnnnnnnnnnnnnnnnnnnnnnnnnnnnnnnnnnnnnnnnnnnngtttgagtgatgcaagggtgctccaggcagtgctccgaaaaggggagcccgatnnnnnnnnnnggcggagggacagcttgcccacaatcacacaagattgcagaggttggcaacccccaggtacccaggtcccagctcaccagcactccaatgtcgacgatgccttgtgcgagtgacacatctgttgcatggctcttcaccgcatcccactgcagcagggattggagtggtgcaagggtgcttcaggcagtgctccgaaaaggggagcccgatcgatgtgcggagcccctctgacaagcttcaatgccaggccatgagctcaacgcaggacccgacgcacctggtgctccggtatgtattctgagatgcactcctccctgccaagagtatggcacgacaggtgtgagtactccaagcatcccaaaggcattgagaaaacactttcatgttgaattcannnnnnnnnnaatttaatgccaggccatgagcccaacgtagtacccgacgcacctggtgctccggtatgtactctgagatgcactcctccctgccaagagtgtggcacaagaggtgtgagtactccaagtatcccaaagacattgagaaaacactttcatgttgaattcaacctcacctcccggcaaatagccgccaggagaggccatccgctcccagaacgaccgcactgagagccagcaaggtggccaggagcgcggcagtgagtgccatcacccacagtacctcacgtcaggatgctcccaaatcagctacgtgtttttgtcaaagatactgtgcatcaagggggcgccgtggggagaatgggtcgaggtatgtgggcgttcgagtatcaaacaaagggattccctcggttgacgtggcactcgccatccactacctagctcggacctccggtagatgaacctcaccgccgcaacgcgttgcttcctccagcggaaaggaactttacgttcgaccgtgcaaacagatcttggactgtgcatgatcaatcgacgggtctcgcggctgtcctgaggtgcagcttcccgagatctggcaggcagcacacaccaccaacacgcaatgtggtgacgccctcaccagtgggccgacacggccgtatatcaacagtatgcgagaaagacaccgaccggcggtgctcttgctcttgagtgcagcaggtgtgctcctgctcatacacggcttgatagggtaccccatcctgacaagccgctctgggaccgtgcagcgcagcctgttgagtacgctcgtctccaagaaccttttgaacaacactggggcggctggtgacgattatgagctcagggagtggcttcgagggacgcgcagcctgggcaggagggtggtgctgaggtacagcgcctgcggcgggctcatcaatcagcagtacagccacttgtccgccttcatcctggccacagccctgagggcagaggtgagggcctcccctgcactgaggtcgtgcctgcgtcggggacccaagcgggcgcgcactttgagctgtgccacacgcacgcgcctgcccggggcagcacccgcgcagatgccctgagccccatcctcggccctgcctcgtcccgccaggtggtgctaccgccggcctgcttccgcaactcctttggcctgcactacgacatggacatcaagcgcaacaagatggagtggttcaccacgcctgtgaataccctgctggatgtccctagggttatcgagaactggaaggcattgggcatcaaagtttacgaggtgaggggcgggaggagaatggagggaggggatggggggaaagagggaggggtgggtagccttgagctgggttgtgcccccgcctcggcttctgcagctcaaccccttcactcagcaaaccttgcactgagtcggcagcctcttggtgcctgcccgctcctaattgtgctgtggagcctgccaggcagtgcaccttccccaggaactttgggagtctcacacccacaacccggcacatgtnnnnnnnnnncagcctgccaggcagtgtaccatccccaggaactttggagtctcacacccacaacccggcacatgtgtcaggaatgattgcccgtccctgcctctgtgctccttgccctcactgattgcccatgccccgaacctcnnnnnnnnnngagagggaggggtgggtagccttgagctgggctgtgcccccacctcggcctctgcagctcacctccttcactcaacaaaccttgcactgagtcggcagcctcttgnnnnnnnnnnactcccctcccccagctctgatttgcctcccccctccccaaacctcctttctccaccaccccacacagacgcccggcttgnnnnnnnnnngctcccctcccccagctctgatttccccccccctcccaaaacctccttcctccaccaccccacacagacgcccggcttgcagcccgcccccaacctgacgcagccctccacggccttccccgccttcattcagcgtgacgtggacccccgcctcatcctgcgcctgcccgacgtgtacctggcccgcagcccgctggcggcgctggtggcgcgcagccgcgccacgctggcgcggcacctgcgcgacctggatcccggcctggctgcctccaccgactacctggtgctggacttgccctgcaccttcttcgcgctgcgcaccgcgcgcatcccggcccttgccacgcgcgtggcggcgctgctccccttcaatgccgcgctggaggcgctggcggcgcgcacggttgcggccatggcggccgccggcgtgcccgccttcaacggcgtgcacctgcgcgtggagaaagacgcgggcgactggaccatcatcatgggcggggtggggcgcatgtggcacctgtacacccagaccatgcgccgtgcgggcctggatgcgcgcacgccgctgtacgtcgccacgggcctgctcacctacggcgcctccaaggagtgggcctacgcgcagcgcgtcctgctcagcaagggcctggcctcgcgcgtggtcatcaagaaccagtttgtccccgccttcgaactggcggagctcaacacagagcagcaggcgctgctggacttcctgatcctggcccgcgccgtgcgtttcgtcggcttcggctcctccaccttctcctactacctcacccagcaccgacgcatgcgtggacacgcgcaggaggccagcctcctggtcgacgccgcgcgcatcggcaccgacgccatgttcgaggccgcggccgtcatcacgcacccgcccctcatgcacgtcgtgcagtgagcgctgccgggatgaggaggaaagaaagggtggccaggccggtcagccaggccggtcggcggcgccgccgcggactcctccccgcaccgccggggcctgcgtcccgtgaccggcggcgcagatgacagtggcgcctccctccttcccccctccccccgaagaaacaaactcccatgcaccctgttcaccctcaaccccgcagcgctttcctgcctgtgcgcatggacccctggacccggaactctcatccccacaaccttggggacacaccttgccacactgcatgatgtcttgtcaacttgacggtcttacatgttatactacgcagcagtgcatcgggctagtgtacagggcatgcgcgggcctcgcatcgacgacgaggatctttatgggtacagacggcggcgtgggaaaattggggacggcgggggaaaattggcgctggtacaggtcactcggggtcggcgtcggagaagggggtgggctgggcccagcgcgacgccggctgggcctcgggctcggccagggggactagctgcgcgccggcttcccgcgcaaacaggcgctttaggtccatgaagctcaggccatccacctggcgcaccaccgagtcggcggcggtcagctcgtacgcgggccggcgcgcggccagggctaccaccttcatcccggcttcccgcgccgcctcgatgctcaggttgctggaggccagcacgacgcagcgcagcggcggccggccgatggactgcgagggtttggatttcgggggatgatgaggtttgaggtgctgagagaggtaggggaagagggcaggtgagtccatgagtgaagacgacgtgtgaacaagaggaaaaggatggtgcagggcagcctcagccaccagacccgcacggcattcttcttgtgggattatcgacacaagggcgcaccggcttcacccacgagcatgccaccccttcctggcacccctacccaccaggctcgcagagaggtagcccgaggggtctgggaggccccgcagcacatcctcggagctgatgacggcgtcgaagcgcgtggccagcccagcattctcaagcatgctcagcacgcgtcgttgcgggcccgaggaaatagccgcgatgggcacctgttgtgggaatttgagggttcttgtgggcacggaaggcatatgctatacgatgcgcatggactgaagtgaggcacagcagcagcatcacggnnnnnnnnnngcggaaggcagatgctatacgatgcgcatcgtctgaagtgaggcacagcagcagcatcacggatcccagggaaccctgcggtaggctgagcccaccccagccagccacaagaggaccgcacctggagccgcgccagggtgtccaggaagaccgggagacccgggctgaccctcagggacgtcgacgccagggcctccgcatacagctcctcccgccttgcggcgagccgagcgacctccagcctgttccacgcccactcaaaaacctcctggatgacctgttggtggtgagtggggaaggaggggtcaggggaaaaatacagcgcggttgggtggtgtggggcgtcaggggaccagaagcggcctcatgcagagcccggcactcacacccaggggcgtcaagcgtgtgctcggtaggtctatgctggtctgcagggcctccaggctggaccacatgggaccccaggaccaccgatccagccagggttggaagcatccactccacccgagccacacgttccccacacctgctcattcttcatgtgctccgccttgcgcaacgcccatgcgggaagaggcttgcgtccttcctcctcggccagctgctgccaggatcggtctgagacctccgcggtatcgtagtccaggaccaccccctcgaggtccgctaacactcccagccagccggggctcagtcgctcggcgcgttgcagagggttgcccaggttcacattatcgaccgaattctcgtcctcgcggggcaacggccgcaagccgggggtgggagctgcaggggctgcatacacggcagagacctcctgggccgggaccaccgaacttcggaagcggggggcgggcttgtggcggggaggtagaacgggggtgatggttcttgaaagtgtagcgttgctggcaccggccagagcctggctggagtagctggtcgtggccatgtgcggaagggctgactccggtacgagcaaagatgggctgaggcaaggccaggtgtaggaggtgaaggaacgaagttgaggagaagattgagagcttggaatacctcacaagtgcttggttgtttgacggtatgaggatgtcgacgtcctcttcaccacagggaagctgtgtgagattgaaaatctctcgcnnnnnnnnnngggatgtcgacgtcctcttcaccacatggaagctgtgtgagattgaaaatctctcgcctgaagacctttccacagggtccgaccgatcgacatggggcttccctcccttaagcaagtccgaggtgacatccgtgatcgtgctcatttgaaacacatcggttctcgtcttattcattttgagtctgggcgtccacaaagcatcgctgaaggcctctnnnnnnnnnncgaatcacatcggttctcgtcttattaaatttgagtctcggcgtccacaaagcatcgctgaaggcctctgaaggaagacctccacaagtcctgtggggaggatggcagacgtagaggagatggaggtggggtctcgccggcgcgtgattcaaataggaatgtgcagtggtacgggtaccaatcttcagaacgctgggcgaagttgctgctgacctttccctgcaggttgatcccacgacggtggaagaggcagaggagaaggagaagcaggtcaagccaaagtccggcgagaaacgcttcgtcatcaagaaatggaacgcagtcgcaatgtatggcgaggatagggtgtgacgctgtgcgcgcagtggcccacatgggaggatcaaaactggagacccatgccgtgctctgcaagcatggctgctgagccccctgccaatgtctccactgcaggtggtcctgggccatctgcacagacacatgtgccatttgccggaataacctttacgagcctagcattgagtatcaggccaatccctcaggtgtgttggggggagttgtgaggtgttgccatccgaggtccacctccctcaaatgatgcctctgttatgcctccctgccctttccgtgccattctgtgcaggtgaccctgaccnnnnnnnnnnaggtttgtgaggtgtggccacccaaggtccacctccctcaaatgatgccgctgttatgcctccctgcccttaccgtgccattctgtgcaggtgaccctgaccaccctggcctgagcattgcgtggggatcttgcgggcatgtcttccacctcgactgcatccagcgatggctcaaaacaaggagtgcatgcccgctctgcaataaagagtgcgtgggtgggtggtggcgtgcaggccaagatggtactgaggacttcgttatctttttcagaacgcgagttgctgatcggggtgtggnnnnnnnnnnnnnnnnnnnaccctcaaatagtccttctggtgcacctctcccctgcctcgcctctccagctctgctctgcnnnnnnnnnncactgaggactttgttatctttctcagaacgcgagttgctgatcggggtgtgggagtgttgtgccatttgcacggtctctattccctcagattgtccttgtggtgcaccccttccctgcctcgcctctccagctctgctctgcatgctgtcctgggatttgggatcctttcccctcaccataatgtgtttcaaccaattcaatacgctcatccccttactcgcaccatgcataggtgggagttctcaannnnnnnnnnccctgccaggcattctgccctctttgcacaggcacgcatgtacccctgtcatggtgatcctgccccaccctccttgcgcccnnnnnnnnnntcctgccaggcattctgccctctttgcaaaggcacgcatgcacccttgtcgtggtgatcctgccccaccctccttgcgcccnnnnnnnnnncttcccctcaccatgatgtgtttcaagcatttcaatgagctcatccccttcctcgcaccatgcataggtgggagttctcaaagattgagaaaatcctcccgggaggcactgccggcacagactgaggtgccatgtgnnnnnnnnnnnnnnnnnnnnnnnnnnnnnnnnnnnnnnnnnnnnnnnntcgcttcctctggctctgtcaaccacagcatgcttacattggccttatgccaatcagggtgccatcgccaatgacccgccggcacggaaagccgccggaatggctgctggtgcaataatcggcggggggtgcgcctcgacaatgtgggaccatgggtctcaaaccggatgacccaggaggacagacacaaggggaagggctacaataaatgagcgttggaaaggtggttagtgtggtgcgggttggaaggcacgcagacaaggtagannnnnnnnnnccgcttcccctggctctgtcaaccacagcatgctaacatcggcctcatgccaatcagggtgccttcgacaattacccgccggcacggaaagctgccggaatggctgctggtgcaatggtcggcggggggtgcggctcgacaatgtgggaccatgggtctcaaacaggaggacccaggaggacagacacaaggggaagggnnnnnnnnnnaccccgggctgttgatggggggggaatcacaccctgatcgatatcaaaccagggcaggcatcactacagcagcaaaggtgaagaggagatgacaagaaaaatacgtcgtcgctggcttgagtacagaatatcacaaggtccttgttccttgaaaggctctcgcacaagagggaggtccttgtggggtggagtgatgtttgtgtgccgagcctcaggcgccagccaggaagtgcacggcgccgtggtcggagcccacgnnnnnnnnnngccccgggctgttgatggggggagggaaacacagcctgatcgatatcaaactagggcaggcatcactacagtagcaaaggtgaagaggagatgacaagaaaannnnnnnnnncgtggggtggagtgaagtttgtgcgccgagcctcaggcgccggccagtaagtgcacggcgccgtggtcggagcccacgagcacaacccccgtctcgctatcaaactggcagcaggtgagccccgcgtcgccgacgaaaatgcccgccagggtcgcgctccgcacgtcccagaggcgcagcacgccgtttggccccgccgcggccagcttggtgccgtcgcccgacagcgccaggtcgcccacctcgccacacgcgtcccagcgccgctcccaggcgctgggcccggcaggggccgccgccgccgtccacacgccgccgcactccagcgctgcggccagcacgccgccgcgcggctgggccagggccaccacctcgccctccagctgccagaggcgcagcagtgcgccggagtccacgtcccacaggcgcagcgagcagtccaggccgtgcgtgagcaggagcgtggcctgcccggcgccgggggcaggccccgagggcgggcaggccagcacgccgcccttcaggctgtcggcatgccccgtcagcacgcgcaggcaggcgccggaagaggtgtcccacacgcgcgcggtgccgtccttgctcaaactcagcgcgcgcgcgccgtcgggggtgatcagcacctcgttcacggctgtatgcgggggggggggggggggggggnnnnnnnnnngacttagcgcgcgtgcgccgtcgggggttatcagcacctcgttcacggctgtgtgcgttgggagaggggggggggataatgctcattggggatgagatcaagagtggggacgaggatgaggctggcaggggtgcatgtggcagtgtgggcattttcttcctttccaaccacggtagtggtttacgaatgtataggatccgtgcgtgccgatctccagcatgtgcttccctgtcaaggccccacatccacaccctctcgcgttgccatggcccgttgggttccccctcctccccgcacgcacccacagacacnnnnnnnnnnattgggaatgagatcagcagtggggacgaggatgagcctggcagggttgcatgtggcattgcagtgggggcattttcttgctttccaaccacggtagtggttgactaatgtataggatctgtgcgcgccgatgcccagcatgtgcttccctggcaaggccccatacccacaccctctcgcattgccacggcacgttgggtttcccctcctccccgcacgcacccacagacacagctcctcttcacacccaccccacgcactcccccaccattacctgcggtgtgtccctgcaggtcctggctggggcctccccagcgctgcagggtgtgcaggggttgggcgcgctccaggtcccacaccacgacggtgctgtcccataggcaggtcaccgcgcgccgcgcctcggcatccacagcaaaggacttgaggcggctgccctggcccggctccagcccgcccaggcgcgcgccggtggccgcgtcccagacgcccacgccgcggtcgggcgaggcggtgaccagcgccgcgccggcgcgcacgaaggccgcccaacgcaccggagc

SEQ ID NO: 41330 - DNA, 433 bp, Chlorella protothecoides
  modified_base (137)..(243): a, c, t, g, unknown or other
ggcaggccgcgctgcacggcctgcgaggcgcggcgcagcgcggcgcagcgctcggcctcggccgcagcggcgcggcgctgcgctgcatctgccgcatcctcctcgaagaagccgtccggcacggcgccctcggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtactcgttgcgagggcccggaagctgggccagccccgcgcgcaggtcgttgcgcagcagggccaagcgcgcggcctcctcgcgcttggagcttgcgctggccgcggcctcgttcagcccgagcgcgtcgcgcagcggcgtgggcaccggcgccggcgtggcaccgccgcccgagacccgcccgccgcgc

SEQ ID NO: 41331 - DNA, 61 bp, Chlorella protothecoides
tgggtcggcttggtaggatgaggatgctccctgtggccagcaccttgagccagtccaatct

SEQ ID NO: 41332 - DNA, 105 bp, Chlorella protothecoides
aagacccccgaggagctcaggcaagcactgatggggtgtgtgcgtcgccgtgataccatccatctgctgtcccttgaccagcctgccctggcctgggtaggattg

SEQ ID NO: 41333 - DNA, 142 bp, Chlorella protothecoides
gggccccagctcctgtgccggcgatgggacgccccaacggactcgggccccggcccaggctggacctgcctcgccagcacagcagccgtgggggcggccagcacctgcccgtggccgacgtgctcggccaatggcgcggcgc

SEQ ID NO: 41334 - DNA, 72 bp, Chlorella protothecoides
ggcatccaccagaggcctgtgcagcacgaggccgggggggggccacacatgtgacgtgtcatgcgtggcatt

SEQ ID NO: 41335 - DNA, 97 bp, Chlorella protothecoides
gccatcgaatcggagcgcaggcatcggcggtggatcccgccgacacctgccgacgcaggtcggcgtacgccagccccgccgaccgccagaccagccg

SEQ ID NO: 41336 - DNA, 80 bp, Chlorella protothecoides
tgcccacgcccacgacagtggtcatgccagagggggcacggaactgctccgccagctgggtgatggcccgctccctgccg

SEQ ID NO: 41337 - DNA, 61 bp, Chlorella protothecoides
aagggtgtgtccatgtgcaaagtcggaggggggggaagggttgcaggccaaacgcacctcc

SEQ ID NO: 41338 - DNA, 69 bp, Chlorella protothecoides
aaatttggccctgtgtgctctgcatcataccaacaaagctagatgcctggcagagcgcccggtgtggaa

SEQ ID NO: 41339 - DNA, 101 bp, Chlorella protothecoides
ggcccggcgaccccccgccccgcccccccggcgccccaaagaccagcggcaaacgcgactgcggcggggcgcccttgggcgccccaatggcaggggaattg

SEQ ID NO: 41340 - DNA, 109 bp, Chlorella protothecoides
gcaccacttgcaagtgtcccaggcaatcacagcagcatgtcgactagccaggagaactatccccagcagcacacacctaaggagtccatggtgcagaccactcaccggt

SEQ ID NO: 41341 - DNA, 71 bp, Chlorella protothecoides
cttcgatgatgcgccgcacgggcacgcggaaatgcggttccagaacgtggtcgtccccgccggcgagagca

SEQ ID NO: 41342 - DNA, 61 bp, Chlorella protothecoides
tcttgccaagtgacgcagtggctgctgagggtgtttggtagaggcacattgagggagttct

SEQ ID NO: 41343 - DNA, 82 bp, Chlorella protothecoides
gcccgtggggcctgtgctgtgggggccgattccggcccccacaggcacagggggaagcagtggcccgccactagggccgtcc

SEQ ID NO: 41344 - DNA, 79 bp, Chlorella protothecoides
aaggcctggcatactgagtggtgtacatgtgatataaggtctggatcagaatcatcctgatgtctgggcgccagctgaa

SEQ ID NO: 41345 - DNA, 63 bp, Chlorella protothecoides
cggcacggtgatacgcgaggcctgatacgattgcgaatgagcgcccagagcgtgatcctcgag

SEQ ID NO: 41346 - DNA, 80 bp, Chlorella protothecoides
agacgggcggagcctcagggcgccgggaagaggccgacgaggatgtcgcccgcagtgggactgcgggcgcatccagaccc

SEQ ID NO: 41347 - DNA, 61 bp, Chlorella protothecoides
atctcactcatggaggcattgactgcaaataatggacctcggcaagcaaacgaagcacaca

SEQ ID NO: 41348 - DNA, 61 bp, Chlorella protothecoides
ctggcccaccacgatgagcagggagccacccacgtgcagcaccgccccgagggcgctcagg

SEQ ID NO: 41349 - DNA, 66 bp, Chlorella protothecoides
agcggtccgtgactgtaccactggggtgtgcgctgatagggatggctctcctggcttgtcgacatg

SEQ ID NO: 41350 - DNA, 98 bp, Chlorella protothecoides
cagaaaaggttgggtctttggagatgatgggtgcagtgctgcacggtccgctttcccagcgcccatttttttcccctgagcaggtgcagggaggaacg

SEQ ID NO: 41351 - DNA, 79 bp, Chlorella protothecoides
ggagatgttcgtgggcgtgggcgcgcggcgagtgcgcgacctgttcgccgcggcgcgcaaggcggcgccctgcatcgtg

SEQ ID NO: 41352 - DNA, 77 bp, Chlorella protothecoides
gtacatgcacggtacacgccctgtgaaaggaaaaaacagcgctgagggggggtgcagcgcaggcagcagcagggtgc

SEQ ID NO: 41353 - DNA, 61 bp, Chlorella protothecoides
gcgggcctctgtggggagatggagtgagcgcgaagcagtcgagagcaccctgggtaccagg

SEQ ID NO: 41354 - DNA, 110 bp, Chlorella protothecoides
ggcggccaccgcttggtccagcgccacgctctccaccccggacagcgacagcgtgaccaccgcggggcgcgccgcgttggcggccagccagtccagcgcggccaccgcat

SEQ ID NO: 41355 - DNA, 26862 bp, Chlorella protothecoides
  modified_base (760)..(769): a, c, t, g, unknown or other
  modified_base (1033)..(1042): a, c, t, g, unknown or other
  modified_base (2701)..(2839): a, c, t, g, unknown or other
  modified_base (3625)..(3634): a, c, t, g, unknown or other
  modified_base (4126)..(4135): a, c, t, g, unknown or other
  modified_base (4523)..(4532): a, c, t, g, unknown or other
  modified_base (4974)..(4983): a, c, t, g, unknown or other
  modified_base (5077)..(5086): a, c, t, g, unknown or other
  modified_base (5168)..(5177): a, c, t, g, unknown or other
  modified_base (6119)..(6128): a, c, t, g, unknown or other
  modified_base (7329)..(7338): a, c, t, g, unknown or other
  modified_base (7667)..(7676): a, c, t, g, unknown or other
  modified_base (8629)..(8638): a, c, t, g, unknown or other
  modified_base (8884)..(8893): a, c, t, g, unknown or other
  modified_base (9797)..(9806): a, c, t, g, unknown or other
  modified_base (10335)..(10344): a, c, t, g, unknown or other
  modified_base (11131)..(11140): a, c, t, g, unknown or other
  modified_base (11756)..(11765): a, c, t, g, unknown or other
  modified_base (11856)..(11865): a, c, t, g, unknown or other
  modified_base (11962)..(11971): a, c, t, g, unknown or other
  modified_base (12217)..(12226): a, c, t, g, unknown or other
  modified_base (12329)..(12338): a, c, t, g, unknown or other
  modified_base (15631)..(15640): a, c, t, g, unknown or other
  modified_base (15923)..(15932): a, c, t, g, unknown or other
  modified_base (17343)..(17352): a, c, t, g, unknown or other
  modified_base (18338)..(18347): a, c, t, g, unknown or other
  modified_base (19133)..(19142): a, c, t, g, unknown or other
  modified_base (19684)..(19693): a, c, t, g, unknown or other
  modified_base (20202)..(20211): a, c, t, g, unknown or other
  modified_base (20616)..(20625): a, c, t, g, unknown or other
  modified_base (21173)..(21182): a, c, t, g, unknown or other
  modified_base (21954)..(21963): a, c, t, g, unknown or other
  modified_base (23505)..(23514): a, c, t, g, unknown or other
  modified_base (24591)..(24600): a, c, t, g, unknown or other
  modified_base (25371)..(25380): a, c, t, g, unknown or other
  modified_base (26389)..(26493): a, c, t, g, unknown or other
  modified_base (26753)..(26762): a, c, t, g, unknown or other
cgccgcccgcccctgccgtcgccgcccttgccgcgcttcctgccgtcgccgcgcgccttggcggcccagcgcgcctcgccgctgcgcacgctctggcgctcgtgccgcgcctccagcgcgtcggccacctcgtagtgcacacgcttctgcttccagagcgggaagccgcgggccaggggcgtgccggggacgaagtcgtagtccaggttgtaccggtcccacacgcggcgcgcgttgcgctgggcctgggccatctggcggcgcaggaggggggacgccgggatggcaaagcactggcccatggggccgggggccaggaagccggtggcgtgcgggtagtgcagcgggtcctgcatcagcggcagcggctttccctccgcgtcctgcatcatgcgcacggtcacctccccgtccggcttgtgctggaacatgcgggccttggccaccacgccgcggacctcctgcacggtccccctgcgacgcggcaccgtggggtgggctggtcgaggattctgggggtcgggcgcggaggtgaccccgcaccaaactcccgtccggctgccatgccgctgcaccagtcctgccacaggaggccaagggcttggctgccaccagtgctccttggcctcgtcaagatccagcctgcgggcctgagaacaacgcccgggctcccaaaacaatgagcctgccgcatccccccgccccccgatccgccaagccccctttcttcactcacatgatctcctccagcgagcagtannnnnnnnnnaaaggagaaatgcgtcatgcgttagccgaactctacgcacaagcttctgggccatgccacggactgtaggaaatggaaacatagacttcatttgaccaccagggtaagcaggagatacacacggccacctccgccgggaccaagtgctcaccacgttcgattgggattccctgccatgaaagttccatgagaccctacacctgagtggtccacaagcgcatctgcgatggatgaaaggccgcaatgacgatgtaatgcctcttnnnnnnnnnnccggccctctgggtccgggccggagcggaagtagtcattcacccaggttcccaggcgggcattggagatgatgccgggggcggtctgctgccacgcctccaccgggtcctccccagccatcacacgcttgaggtaggggttgatgtcctgctctatgccacacctgagcgttaggaggagtcgaagagaggggggccgtgttgcaggcaagcatggcagcggcctggtagatcagaggctgagaggactgccagagacgatgtcttggctgggggggaggagacatgagcccagcgcatgctctgaagcacgcaaccaccgccacccttccaagttgcgaggtgacccccctgatgctcccctggtccgcactcttcgccctcgctctcacccttggcgccggccgatggagtactcgccgcgatagatgtggccatccgcggctgtgtactggcccatgccatgcgcccagccagactcaaaatcgccctcatacctgcgccaggcatttgagggagggggaggtttacatgcaagccacgccgcgacgaatcctcagccctcaggtccagtcagctaagttgaaccacccgggcactaccaccgaccattccagggggtgtagcaccccgatggcacccatcatggccgcttacaggcccgaaaacaacacgtctgctctccaacactataccctgccgcagaaagaccacccaccgatctcccagcttggtgttcccgatgccaccgcctccaaatgtgccaaagctcatcactccaacgttgtgagggatgttgagctccatcaagccttcgtacctgcatgcatgctaggatcgtggtataagaaaactcgcagctcaatgaacatctccggtctccaggtcgaacccgagagcgagcttgcctccctaagagtgtccccacagcccttgtacatggcagctcaggtagacccccggcgtacgtggaagcgtcgtcatacacgtagctttgccacatcaggggattccctgtaaatggcgcatacggatgattggatccggccagcctccaggccgggttgatcatccgcccagcttgcttcgtaggggccttccccacgaaggtcgcccttgggaagggatccttgtcattgggatccatctcgtccctcctcctgtgaggatatcgactgctccctgctcccggctggaactgcgtgttgcgcggatgcaaagtcgaggggttatcctctgccagcggggtcgggtatgtacatgcgttgcgtgctgggaggtacccatctcccatgatccccggtgggcagttctcgacctcatcatggacgtaaagctcacacgttgtgccctggccttggtctgtgtgtgtatgtgagacatcttgcctcctttcagcaccccatttttgacgcagagatcctgaagatgcagagcatgctggctaacaggggggcgtcgtgccgcatgagtcactgcaccccccccaagccagggtgagtactgggtgtttgacgcggcgcgcgtcggacataggcattttctaccaatttaagaggcattacatcgtcattgcggccttttacccatcgcagatgcgcttgtggaccacttaggtgtagggtctcctggaactttcatggcagggaatcccaatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgcatatagttcagctaacgcatgacgcatttctccttgtgctagcagcaagccaggattcccagaagcttcagctgtgtacaaagtgcacaacgtggccgggtgctggctgccgcaactgcaaactcaaaatccaaccaggaggagacctttgttgaggtattttttaagaatgctggagtagacatccgcactggacgttccgagatcgatcgagggagtccgtatcccgccctgccctctttacacctacctatgggcatgacactgcaagaatttctccagtaagccttcctctctgcattcaggtgaacctggccaagccgctgggagtgaagttcaagagggggaacgatggggcagcctacgtctccatcactgacccccgtctgggcaacaccgacccaaggatcaagccgggcgaccgagtggtggccgtgtctgccagcttcgggggggacgtctgggaggctcgcaattttgggcaggtgatctatgctatcaagacccggaatggcgaggtcttcctgcgtctggagagccgaggtggcaacctggacgtatttgaggtcggtgggtgtgtggtggagatggggactggggattcaagggtgccaatgggagttcagagacaggagggcggtgtggcatgcaggtgagggtttggaatgatgcagggagtgacagggaaaccaccgggtggggttgagcccgaccccccatggtatcagggggaagtggttttgtgttcacgcgagcaccacacagaaactggacatcacnnnnnnnnnnaggtggggtcgagcccgacccctcatggtatcagggggaagtggttttgttttttcgcgagcaccacacagaaactggacatcaccagtggaggggtttcaaaggatcatgcggtcccaagcccgcacaaacctctccttcacatcctgtgcgcagaacctcgaggagacggaggagcagcgtctgtggaaggaggatcggacggtgggcaactacagcgcggggacgaaggaggtccagctccgaaactacgactccaagaagagggcggagcaggagcgcaaggacctcttcaacatggcgctgtcccgattcaaggcccagaacgtggaggaggtgtgggggggggaggggcgggggtctgggtgcctgctgggagggcgcagggagccccggccatctgcctcgttggggctcgatgacatgcacagccctcacgttcccctccccgcgccccgcccccgtatgcaggccctgatcgactttgagaannnnnnnnnngcctcacgttcccctccccttgccccgcctccgtatgcaggccctgatcgactttgagaatgtactgtccatggagccccccaacttcttgggcgacgacttctcccgcgtgaccaacatcgcccgcgtgacgcagtacaacatcgcctgctgctatgccgcgctgggccaggtcgactccggcctcgaggcactggagagcgcgctggactctggcttcgaggactacgccaaggtggggctggggcagggtgtgtccatgaggtcgcatgctgtcaatcgtggggatgatgaaagggttgtggggagactgcgccttcgcctccgcgcctcgatctgccctgccacatcggcgtcgccccccccccccccccccaccccccccttnnnnnnnnnncggggcagggtgtgtccgtgaggtcacatgctgtcaatcgtgggaatgatgatagggtcgtggggagactgcgccctcgcctccccgcctcgatctgccctgccacgtcggcgtcgcccttacccccctcccccaacaccccttggccaggtccgctctgacaagaacctggagaagctgcgcacctccccccgcttcaagaccatcatcgacaagtacgacgagcccttcatcaacgaggccgccatcaggtggggtggttcttcacgctgctgagaggggctcgaggtgaaggagcccccttgaggagcagcatggtcgaggatctgggacgatctggtgctcacaggcaatgtagttgccctgctatgagtaacacactctcacctactcacgcaccctcaccataccgcagtgcgatcaagaacatcttctcttttgnnnnnnnnnntgcaatgtagttgcccttctataagtaacacactctcacctactcacgcacccccaccatactgcagtgcgatcaagaacatcttctcttttgnnnnnnnnnngtatgattgcacccgtgtacctgccgccctcacaccagcacagcccttcctctgcatattcctgcagctgtgcgcgtccctnnnnnnnnnnggaggaagaagtaggccggtgatcgactgccagcttttgcgccacgggcttccgtatcctggactgcagatatgattgcacccgtgtagctaccaccctcacactagcacagcccttcccctgcatattcctgcagctgtgcgcgtccctgtataccacagtcagttgctgtgttgaggcccagagacaagggattaaagaatatatcaacatgaccatatgcgcatgactggtcgaaaaatgtcagctggcaggcacccagtgatgcgccagtccctggttcgctcagaggcccagcttctttcgcagctcactgagctcatcttcgatggtaggcgacgccgcccgctgcgcagccgccgcatcctcctcccgtttgcgctgtgcagccgcgtcctcctccctcttgcgccgtgcctcggccccagatgcagcgtgggcaccactcccgttccgctgttcggatgccttgtccctagctccagcctctgcctggtccttccctgcaccctcctcgtcttggagccccaagccctgtgccgggcacaagtcgcagatcaagagggggtgggcagatcactggaaaggagtgcacggggccaggagcatgctcgaatgcatgctcggcggcagggcaatccatgcctgcaagaggcaaaagtctcccacctccaaaagaatacagaggctcactccccctaccgactccaggaactctacaaactcctcgcccacgccagcgaggtcgtcccagaaggatgtcggccccatctttccctgcttcttccttcgcttctccaggtaagcagcaatctcacgttcaatgtcgcgcaggacatccgctggtcgggagaagattgggggggcagggatgggtgtgttggccagggcccgggtctcgtgatgatgacaaacacgagatgtggtcccagcatgccatcnnnnnnnnnntgtggccaggccccgggtctcgtgaggatgacgaaacacgagatgtggtcccagcatgccatcggccttgcctgcaggaggctcctggcataacatacagcctggtcatatagcccacccctaccacaagagagaaacaaagttcccacccaggctgtaggcttcctcctgtgcctcgccgggactgaaccccttgaggtcccagttccagaagtcgggaccgggggccggcgggggcttggcgctgctgctccccctccccgccctgccacttcttgaaagcagggtttggtaagcctccttgcactccatgaactcagtcttggcgctgggctgcgacaggggagcccaccatggcgagtgggaagagaggactcgacgatgactgggccccagccctactgcactacccgctcagcactatcatgggtcagacgtggctgtctggcagactaggtacaggaaggttccggcctgcatgcccgcttgagcattgcctgattccctttccacagggccaccacacacccatcacgcaccgctctattgacgtcaggatgcagcttgagggcctttttcttgaacgccttcttgacatcctggatgttgcttccaggagccactcccagcacctggtaggggtctctggcggcagcaatgcggaggcccctggctggtgagcatggggttcttgctgggctgctccttaccctgtcggaagcaaacgctcgaatgggatagtgaaggcattttcaggctgaaagcctggctgataatgcatgccaaaatgcactggggcacagggtggagacgacattccccatggatgtttctcggtggtcgctttcgacgacacgcaccttgctccctggaacgccttctggccgggcggcaatcggaccacacccctacccgtcgcccagctcgacatggtggagcgcgacgcttcgaccgtccagtctggggcgtgccagtctatgtgtcgtgggagcctgcatctccatttcgttgtgggaccacgtggagccaacccagctcagcgagtctcatttcccagatcactttctacacgggttttgagtattctacattacacagggggagggggtacaaccatgctctcagtcaaaattcaggacaaggggttcagtgccacaacatgagccagtatctatgtgccaaagggttgcacgccgagcgnnnnnnnnnntcagctcagcgagtctcattccccagatcactttctgcacgggttttgagtattctacattacacagagggagggggtacaaccatgcgctcagtcaaaattcaggacaagggattcagtgccacaacatgagccagtgtctatgtgccaaagggttgcacgccgagcgtgtgtgtgtgtgtgtaggggtgggggggggaaggggttccgtcgaggaccggcagaggttagggtccctccacccctcccacaggcagcacatcacgctgcggccgccgcagcgtcgtcctcctcctcgtcatcttcgtcgtacaccacgggctccagcnnnnnnnnnnatgtgtgtgtgtataggggggggaaaggggttccgtcgaagaccggcagaggtgagggtccctccacccctcccacaggcagcacatcacgctgcggcccgggcagcgtcctcctcctcatcatcatcttcgtcgtacaccacgggctccagcagctcggcatccacccaatcgtccggcacgccccaggcgcaggctgtctccaggaggaggttgaagttgccgccctgcccggcaaaggcattggaggtgacgatgcggaagaggccgcgctcgccccagggctcgccccaggagttgcgcaccacccagtactccacgccgtcctcgacgccccaccccaccaccgacacgatgtggttgatgctggcggagggcgcgaactcggcgtacagcccgccgttgtaggcgtccaggccctccgtcgcggcgatgccgcagctgatgggtccgcgcgcatagatctcggccttcatgtcggccacgccgctgacgcggccgtgctcggccacggtcaggcggcggtgggtgggcaccgctgcgcaccccgtccccggccagcaggtgaagcactggtgcttggggttgcagcgctggtcggcggccacgtacaggttgcaggtctcgtcggggatgccgtggcgcgcggcgtactcatacacgcgcacgtcggagccgccgtggcaggagcccgcgccgccgcaatcgatcacgttctggacggagaggtaggcggagggccaggcgccgccgcgcttgatgttcatgcggtcggccagggaggaggtggcaccgtgcgcccagcaggaaccgctgtttgagggaggaaggggcgtcgggggtgggcggggggagggaactggggcgtgaggagggagcatcagcggcatagcaaaggctgccccttcatgcatgagggaatggcagtggaacggcagccacctaccatggcnnnnnnnnnngtgagggaggaaggggcgtcggggatgggcggggggagggaactgggcggggggagggagcatcagcggcagagcaagggctgccccttcatgcacgagggagcggcagtggaacggcagccacctaccatggctacgacagccagtgacactgctggacccggcgacatccccctcatgatgaggtcatgggtgcccagaccatcccgaaggcacacaaccccatccacccatccaccgcgatcnnnnnnnnnnggctggacccggcgacatccccctcatgatggggtcatgggtgcccagcccatcccgaaggcgcacaaccccatccacccatccaccgcgatcgcgcaccagtactggggaatgtgctggttccgggtggtgctgaggaagttggtgccattgacgttgcgccaatcaaaggcctcgggcaggtccgactccttgaggtaggaggagggcttgggcgtcgacctgtccgaggtggcagtggggttccgggcaagggtttcgggaagggcccctcgcacaaccgcgcagcctcccgatgggctgccatgtgcgtaacaaccacatcgatggagtgcggggccccaaagagggcggtggcaggggtggcggaggcaggcaatctgctggcagatgctggcacgaacttcaaatttgtcgcacgtaaccccacaagtcgcacctcagctccttgtaatcatcgggataggtgatgaccgtcgcgaaaaccgatggcttccagtccgtgccggacttgacagccacactctcgggaacatcccgagcccagacccccaccaagactgccagggacactacaaatatcagtttcatggtgcttttattgagatgtacttctttgaagaatgaaattggatttcgctgccatgggaaaggaataagttcactttggttccggcggagggtggtgaggggaagctgtggaagttctttctttgttcccggttatccggtcagtcaggccgtgagggtttgggtatgatgaaaatccttctactacgtcaccgagttcctcattgccagcatttaaggtaacacagtctggtagggatgatgggtaattatgttcgagcaagtttgtggcgtcggccaagcgtcaggatgcagaattcttgcccacatccannnnnnnnnntgttcccggttgtccggtcagtcaggccgtgagagtttttgggtgatgaaaatccttctactccgtcaccgagttcctcattgccagcatttaaggtaagacagtatagtagggatgatgggtaattgtgctcgagcaagtttgtggtgtcggccaagggtcaggatgcagaattcttgcccacatccatacggtgtcagcgaatcaatgcacagccagtgatgctggcagcttgatgaaaggcagaatgtcacccagttgcggcactcctggtaacaagaagtgggacttggagggtgacaggggtgaagggggcaagacttgaaccccattgtatccttcaaagtttgaaatgtagcaaaccccaggagtattcgccatacctctatggtattcccccctaatgctcgttcgtttctctgtcaacgaaatgcatgtacccatacaccccaaaaggcagctagaatgccggaacgaacgagtgcgatgacaacctccctgcataccgcgctcgcgctcatgcagttcnnnnnnnnnnggtcaccatacctctactgtattcccacttatgctctttcgtctctctgtcaacgaaatgcatgaacccatacacccaaaaaggcagctagaatgccggaacgagcgagtgcgatgacaagctctctgcataccgcgctcgcgctcatgcagttcccgcggcaggttacgaccttcaaaggtaatcatggcaacaggcacttgtctagctgcaagtgacttccagtcgcacagaagagctctaaacgcacaggtatatcgaatttggcaccttggtcccacaaaacggtggacactgggccaaacttgtcgtcgtgcaccagagacaaccccaggacacgtcgaccacttggtctcctctgcggacgacagggagttgtagcacccggatatcatcgcaatggacatgtcgatggaccatgccgggcataaccacagcgcccacgcaagcgtttccccccccatggcacacgaccacggcgctgtcttacggcacgaagacggcagctactattacagccacggagcctggcttggtcacgtagtacctggcagttttttcttggtgcgaaaaggatggaccgggagtgctttcaatgagggagggtccgtttgctctcaacctttgcaagtcgagctgccgactgacttggctctgctgggtttccgaaggtcatctttgctgtacagataatatcttcccaaagctgtcactattccacgtgcacagctttggggcgtctggtggatgctggccaccttttatgagcacctggcatctgcagcannnnnnnnnngtttgctgcacagataacatcttcccaaagctgccaccattccacgtgcacagctctggggcgtctggtggatgctggctaccttttatgagcacctggcatctgcagcagggggtccgcccttcaggtcaaggggctggcaccgcttgttcttcggcaccgccagggcgcggcgttttcctgtggagcctttcatcaagatagtcctccccctcttcggcatcctgggcgagctctggctgggacacgaccagtacatgtgcgcacttgtgtccctgagggaagagtgaggttgcgctgggcatccctcatgcaagctcctgaagttcctggatcaccggctcgaaatgcagaggttgaagtacaacccgcttctctccaactatcaacaaccctattcatcagccgtacgcttgacgctgtcacaggaacctgtacgcctccgacggaaggtttgtgatggaccatgtcaacgactggcagcactctgccatgtactctgcgttcatgctgtctggtctggtggatctggccacctggtatggcaggctgccagagggcatcgagcatgtaaggggttgggtgtcagggttcaaatctgatgcccatgcagccnnnnnnnnnnaagccctggtttggcacgcaggggactctttgtctgccttggtctggcccctgcatctgtgctctggtcgccagctgtctcgactgggaannnnnnnnnngcttcggtgattgttacttctgtcgaagcgttggggttggcccacttgggcttgttgtcgagagctgcgcctccatgtagtggaccagcgactggcnnnnnnnnnnacttcggtgatcgttatttctgtcggagcgttggggtcggcccgcttgggcttgctgtcgagagccgcgcctccatgtagtggaccagcgactggcagcgagatcacggtatcaaatccaacaaattccgtggcaggcgtcgctgggcatggccttcctgatcgagggcatgctcctggtcttccacctcaagggccctaagatcgagatcctggtgcacctcatcctcgtcatccaggtgggggnnnnnnnnnngtgtgggtttgggagattggaccacacactccttttgtgcaactgcacctgcacttctgcaggccacaagctgtctcgagatgcttcattcccccgacacctnnnnnnnnnngagccctggtttggcacgcaggggactcttcgtctgccttggtccggcccctgcatctgcgctctggtcgccagctgtctcgactgggaacaggtgatccaccagtcccccccgcgcgtcgcagatcttcctcaccgtggtggccgtggtgttcgaagccctgatgcccaccagcttcgcggccgccctggcgcgccccctgtccactgtgatccagggcgtgtggtggatccagacggcatacatcatgtaccgaggtgcggcgaggggcgctcatgcgggtttgggagattggaccacacacactttttgtgcaactgcacctgcatttctgcaggccacaagccgtctcgagatgcttcattcccccgacacctgcctgcagcaaagccgcagtgggatccggaggacatgagctccgcgatgatggcgcccgtggcgtgggtcacgcatgtgctgtggatcacagccgccatgctctcgggtaaggggtggcagcgcgcggctgcccagacgcacgcgccgtcttgcgtttggcgatcggcggcctcagcccggggtgggctggtgctgaccttgccaagtattcccaccctccgctgcagccaggagctcaaaccaactccccccttccccccccccatctccgtcagtatttctgctgatgcgctgggttacagagcggcacctgggctgggtgtacaaggaggagcgcggcgcgccggggctgggctcgcccatgcccgctgccaggtacggcgcccagcggcccagtggccgcaccaatggccacatcgacctggagctgagcgccctgacctctgacaagtactgatctgtgtcgattcagcgctgcccccccctcggttgtattacatgttgcgaggggatgacgtgtcaagcctgctacagagtgtacagaggagctgggcgggcaaccgcgggggtgcacggcttcagagccacgccgtgctttccatcgccgctcggcgccagggctcagctctgcaccacggccagctgggcggtggttaggcgcaggccgctgccctgcaccgagtaggccaccttgaccgtgtcctcgctccaggcgacgatgctgggcgagctgattacacctggcatggtcgatgcttgggggaagggtctgcagtttggtgtgaacacctgtaactggcctggggctgggcacctggacatcggacatgccatgcacgaagtcaaggatccccttcatacaagcagaggccaccgacccccagggccaaccctccgtcccagcgccccgcacctcccggcagtttgtgcagggaaaccacctcctcccaggtcctgcccgcggtcagcgacagcgagatggtcaggctggcccggtccttggagccgacgttgtgcaccgccagcagctggtcgtccagcagcaggctcgccagcttggagttggggttggccagcgccaccgcgcccggcttgctccaggagctgccgtcgggcgtgcccacggaccggaacacttgccctggcatcagagaggaggggaagtagacagagggaggtggtgatgagggtgagcgacggtggtgccggagggccaagagtcttcgcaaccaggtccggtcgcggggagggacagcaacctggcacgcacacagcaggggcattgccggcaaacaggcatgccgccagagggcacagacatgggagcgaccagatgccaggggcatgaagtccaccctcccggcctgcggggtgaaatgcccaaccctcaccccatatttccccctcttgccacccccacgcccacccatgcagctgcggaagagggccacgagcgtgccatccgacagcacctccagcgccggctggttcagccaggtcttagggtggtcgatgatggacgccagcgcccagttgtcacccccgtcccgcgaaaccaggatcgctgcgggagagaggggccaggacaaacgcagggggtcacagcagcaggtggataaggtggggacgtggagttggtgaccctgagacgaggcatgttggacatgcctcccaggaatacgtccagggacaccatgcagtccgcacgcgtatcgtcgatgtagtgatcgcaagagtcgccaggctggaaccatgcccatggtcaatacagcgcctcttcgcttgagatctaggtcccccggccgaatcaggcatcacgatgaaggtgctttgccttcccccagcgctacacatcgccgctcccaagccccgtaacctacgacacccacccgcagccgagagcaggctgggcggggttgcccccggcggcgccgtcacgcatggcacggccgcccgctccgcccccagctcgctgtaggtgtccttgttgaagacggcgtgcgcgccctggggttccaggtgcaccgccaggaagagctcaccgctggtgccgagcacggggcggctggaggtcaccttgggcaccggctcgtgggcctcgtgcgcccacaccaggctgggcggcgaccacgtggtgccggcgtccagggagactatgcgccgaatgtcgccaccgggggagggggccttccgcgattcggagtaatacagggccagccgccgccccgccgcgtcccagtgcagcacgggcgcccagagcggggtcaagccccactgcacgggccggtgcggctgccacgtctccccgcctgcgggcaggtggtcggccttgtgtggagagcatcgtgcggcttgcgagtcgggggctcccgggctgcaagctcgcgagcttgccggccctgctccgaccccacatgtgcaggggcggggactcgcgacacatccctgccctgcagtctttggatccccatgtatgcagtattcattcacatgcatcgcttccaccctcaccgtccttgctggtggtgaaggcaatgtactgatccctggagccctggtggggcagggacgacacctggtatgccagtgccagcaggggcgctccccctggctggggaatgacggccaggctgggctcccccaggctgccgccgtcgagttccttcgcgatcacgccatgcctcagtttgtgggaaaagtctgccggggtgctggcactagcccccatgactcggcaggctgatcccgacacgcactcacactatctacgcttggataaaaatgcacagatgaactcgaatcaattttctactcgcgccggatggcacacgatcctgcttcggcaccgaatgctccggctggcctggctcgtccatcccgtgattttgaactcgcagcacggcagctcatcaccnnnnnnnnnngcgcttggatagaaatgcacagatgaactcgaatcaattttccactcgcgccggatggcacatgatcctgcttcggcaccaaatgctccgcctggcctggctcgtccaccccgtgatttgaactcgcagcacggcagctcatcaccctcgtgggaatccggtgatcgaccttcgatccaatggatggagccaccggacacgcacggatcgcgacgacggcataatcgcagtaacgcatcgataatccctgcctattcgatcggagaagcgctgtcgggagatnnnnnnnnnnttcgcgacgacggcataaaagcagtaacgcatcgatactccctgcttattcgatcggagaagcgctgtcgggagattacccctgccggcctggtccactgtcctatcagcctgcacggcttggtgtgcgatggccacgaatggcgatatagtcgagggctaccttgtggtgaaggtgctcgaagttgcagggcacaataaaaacgacgaacctgtgtgggacccgtcattccaggcgggctacgtcaaaggcgagtccacaagctcttgcctgtggttggagggggtaacggatggtccctgatgccggccccggcaatcttggttgatctgagccgtatacagtcactctttgaatgcagttgagatccgtggaggctcccgcatcgtcaaggtgagacaatcgctcggtgtgactgcatgacaccgtgagcaccagttggtcaagctgcggtcttcaatggtccgttctggtcaactctttccacagaagagcacaagcttgcaaaaagtggtcgacaatgtcatcacctgggaagagcagctcgcactgtgagcctggttgctggtgtcagctggctgctgggtgttgtggacacggccgtgatggagcgctcactcacctgccccttccgtgacccctcccctcctgtctggacattgcagggaggcgctgaaggacgctaatgaactccgcatcatgctctgccaggagaagaagtccgatgagaggcctgccagatccagcatcgtcgcggcctgcggtgagtgcaggggcttccctttgtggtgcagcgcgctccaaaacaatggcccgcgaggtgcacgcttgccccctcctgccctccagtgcagtgggcgctgatgaggtcatccatcttggctgtgccccatctgcaggcatatacattcgggacctgttggaggctgtgccggtcgacaagtactttgagctgttccagcccagtacgtggcgcgagcagtgtctggcatgttgtcacaggaggggggagcagtacagcatgcaagccaggcctacatgccctgggtcgaaggtcacgacgggaaagctgcctgccccagtcgacacgatatgtgcatgtactgacgcgcgtggcgtagatcttgcccacccttcgctccccctcaccccacctcagagctgggcaaggatggcggcttcatccgcgtctctgtcaactacctcctccccgaccaagtcaggaatggcgcaccccccctggaggcagagccgtgagtggaggattgggtagctgcgtggcggtgcacaggttggagctggacatgcacatgcctggctgcatgtgtgtgctggccgacacagcgcttcagggccgcaagtttgcaacctacctcctcccaatggagcctccctccctcgcctcgctcannnnnnnnnnggctgcgtggcggtgcataggttggagctggacatgcacatgtccggctgtgtgtgtgtgctggccggcacagcgctttagggccgcaagtgtgcaacctacctcctctcaatggagcctccctccctcgcctcgctcaggacggagctcagcgagcccgccaagaaggagaagggcagggcgccctgggtccagctggccctgctggcggccgcggccgccttggctgccacgcgagtgctggccaagaaaaactgaacccccgcgccatcggccccccccatgtacacctatgccacgacgttgcccctccctccgtctgcatcccacagtgaacgtcgctgcagtgcttgcaggctgtacacctcccctgactttactgcggcacccatcctgggtggcagggacatgatggtggacgcatgcaggggattgcagtcccagggtgggtggcgtgggagggcgtgccaccctccatgcaccgtcgggcagcgcgcacgtcgtagcaggcagggaccgtcggcgcttccttgcagaccgcctgtgccgcgccctcaggccgcatgtctgtcgtccttgatggggacgaggcgccagaccaccgccagcgccgccccgatccagaccatgaagaggatggagacggcggagggcatggccaccagcacgtcggcaaagtgcttggtggagagcgcgtagcccatggccgcgctctgcatccccgtctcgatgctgacggtgcgcgaggttcgctccccgaaccccagcacgcgcgggaggaggtagccgaagaagtagcccagcgtgtgcagcagcaggaccggcaggcaggccgaggcgccgtgcagcctgcaggtggttgtgatcgtgggtgtgagaccctggggcgcaacgtggggcttgctcgggtggtgcactgtcgtgttgcagcagggggcagtggacaccgcgggtcggcggcacatggggcagccgggtgtgcaggnnnnnnnnnncgttgcagcagggggcagcggtcaccgcgggtgggcggcacatggggcagccgggtgtgcaggggggagcgtggcgcccccaaggactcgtctggaggcctgaaggacggcgtgacaccccgttttccccatggcacgggcagggggacccctcaatggaaggggtcctcccacccccccggtctctggatccaacaaggccagtgccccccccacatccacacaaccccccgcacgcacgctaggaggggcgcgacctgcgcgacgggcgtggcgcagaggaccacggtgagcaggatggccaggaggggcatggcggggcgcacgcggccgacgaggcccggcagcgtctcgttcagcaccacgccggccagcgtgggcagaagcaccagcttgacggtggaggccgccagcgcggcggtgctgaccgggacgaagcgcccagccagcgtgctggtgagcagcggggtcatgaccgtggcggccagggtggaggcggcggtcatgatgaccgacagcgcgacgtcgccgttggccacgtaggtggcgatgttggaggcctggccgccggggcagcagccgagcaggatcaggccgacggagaggccgggagacaggcccagcgcgcgagagatggccagcgccaggctgggcatgatggcgtactgggccgcgaacccacacagtatgggcaccgggttggacacacactgcggcgggtggtgagtttggcggtgggtgggtggctgggtcggtgttgatgaggggatggaggtctgccacccnnnnnnnnnngatgggcaccgggttggacacgcactgcggcgggtggtgagtttggcggcgggtggatgggtgggtgggtcgatgttgatgaggggatggaggtctgccaccccctccccctcccccctccccctctctacacaatcccccgagcccgcgtgccttccggaagtcgtccttggtcagggagaggcccatggcgagcatgagggtgcccaccccggcctcaaactgcgcgccggtgatccagttgagagaggctgggtggcggtacgccaccacgccgctgatcagcgcccagagcgggaacatcatggtcagcacgtccgccagcttctccaggcgcgtggggccggtgggcagcgcgtcgccggccgcagcggatgaggcgtgtgttgccactgccctgtcgcaccgctgcatgggcggcgaccggctatagaggccatgaaggaggctatgcctgcatgggcaagtagagggctaggggattctaattccaaagctgcagcccgaagatgtgtacaccaggcgtgtgccagctctgtgcnnnnnnnnnnacgtgttgccactgccctgtcgcactgctgcatgggcggcgaccggcggcggaggccatggaggaggctgtgcctgcatggacaagtagagtgctaggggactctgattccaagctgcagcccgaagaagtgtacaccaggcgtgtgccagctctgtgccctggtgcaggaggtgaaacacccagatcagctcccttgccctggctccagggaccctagggttgcgcgacaatcagatatcgcactttgatggacggtctagactcgtgcgagcggattttgtcaggggacattggttgacacgcctcgccgatttaaaggggacttgcgaggctgcgatcggagtacatcgccccgttgtggctgcagttggggacaccagcactccacgaccggccgcatacatcttccttggatgcgatgtatcaccgcaagcgatgggtgtctggtaattatgatacgctccgcgttttccctatactaattgtacttttagcagtatcacgagnnnnnnnnnnctccttggatgcgatgtatcactgcaaacgatgggtgtctggtaattaggatacgctccgcgtattccctttactaattgtacttttagcagtatcacgagggattcagcagtcgctgggcaatgggagcacaccattttcgaaatccaaggaggatgtcgtacgtggtaagaaacctacaaattccttcgaggaaattgcccttacagtggaggactgtgaagggactcaacctgaaatttaccgacacctgagcagcacatgagcaatctcacatgagcagttccagctttaatcgactggttgctgaaaatggtaaagtactttgatgacacacaacctagcaagggaacaagggcttggtactgaagcgctgtacctggggatactctgctggcaatctannnnnnnnnnagaggactgtgaccagactcaacctgaaattcaccgacacctgagcagcacatgagcaatttcacatgagcagttccagctttaatcgactggttgctgaaaatagattaagtactttgatgactcacaacctagcaaggaaacaagggcttggtactgaagcgttgtacctggggatactctgctggcaatctattccaattcgagcatgccagcagaccgtgggcagtgcctgttaggtggctagcgagtaatccagacctccagtgagagttgggactctgagatcagggtcatacctcagtctccagtgcctctcattgggagccggggtcagaagtctccacatctgtatgaattttaaaaattcatggcagaatgccaatgcatgacaaatgaaagatgatcagaatcaccattcccttcccaattggcctcacctccaggaactgcccggcacatgaccaaatattgataagacacaatgcttgtctataattttagtgcgagcgtgccgaaatgcgttctgttgcggcgggctcatcagnnnnnnnnnntacagctgtatgagttgagaaagtttctggcagaatgccaatgcatgacaaaggagagatgatcagaatcaccattcccttcccagttggcctcacctccaggaactgccccgcacaggaccaactattgataagacacaatgcttgtctatatttcaagtgcgagcgtgccaaaatgcgttctgttgcggcgggctcatcagtcatggattcaaccacccgtgcgcctggctccaaaacatttctcagcgatgcatgacacaattcaatgacaacgctgctcctgacaaacccagaaaccagcgccatcaccactccatgcatccgtgctagcctgctttcgccatgctcccaggccggagtgtagtacccgggccgggttttgtgactaccacctattaatagccagtgagggggtaatcaatagctgtagtctcaaagcagcactcagtcattgcagacaagagcggcagctgtcgcggataacccgtctcatgcacggtctttatgggagcgacaagatccatatattaaccattgagatcaacctacctgctcaaacggcaggtaggttgtatgacacaaactgtatggcccatgcgggtgccacgctggcaggacattcgaatggagtcccatccatctggccagtgtcggcgagcgtgcaagagaaaagaatgcgtagcagcgagcgtggggcccaggaactgcgtgcatactcgcgtccacatatatgctgataggttgttgtggcatgccatttccagatcannnnnnnnnnaggggccaggaagtgcgtgcatactcgcgttcacatatatgctgacaggttgttgtggcatgccatttccagatcacggtcgatgtcgtcggggtttggaattttcttcaccggctgcacaactcccattcccaacaccgccttcacgcaagcggactccaggcactgggtacggaggcctgggtttcatggcaaaagaacagcgccatgcatgagatggagactgccgctcgtgcctccgttcagaccgtgatctccttcgggtgtccttctgcgctcccaggttttagacgctaccagcctggtcacatctggccataccgacctcaaagaggtggccttcttcttagtgcagcccaactcgctgccctctgatgctgcactgtcactctttgtgtccacaggcaagtcctgacaatttgacatgcccgtttgtcaaggccttctggaccggctaccgggcctggctggccgtgacaccgcatgcaggggtttggccaacctgctcaagcgttgctgcgtcagtgcaacatcactggctttatcctgcatgtctctccttacctcgcaccagcgctgctctgccccactctccacccaggcggtcaagactggtcctaccgcgggtgcgtgaccaacagccatcccagcgatgttttccccctgtcctggcctgagctgcccccatgcacggtggtggggccagggtatgctcaaataggcgtcctagccgagcccttgggtgagtcactgccctgtctagctgtaggttggggtcgggggtggagtcggagtgtggggggtagtaatgcatgcacagcgccatggagaagcaaggcagcgggagtccctcgccagcgtgagtgcccgcatgctcagcaggctcaaatgcgtagggctgatgtttcagagtcttccccactgcgccctcccaaacctggctgcagaccaagcgcgggccaaggagggcagcaagctgggcgccaaggaggagtttgccaagatggtgggcctggacctcttcaacttcatgcagagttttggcggagtgcagaacgtagggagcaacaaccttctggtgcccatgaatgtgctggatgcctggtaccagcgtctcgaacggcggctgaggaaggacccagactttctcacacgccagcgcgacaaggtgtgagtggacgcctggtgcagggaacccctgctcggctctggacggtgatgtagcaatcagtgctctggcaccttggctcacacaggtgtgcattgcaggtgcttcttcccctgcaggtgattcatcccctgcaggtgacactgtacagcttgctctcctctgtccccttcagctccacaactttgtaagctcagctccagaagcttcagacagcagcaaacaaaaaatgacagaacgcagcagcaacaacgtacacaaccagctgcctctgggcgcagaccaggtccctatatgaaactgatgtgctcccagctgccctcctgatcaggcgacgctcagtccagcctccttcagcatctccttgagcttgnnnnnnnnnngagaaactgatgtgctcccagctgccctcaggcgacgctcaggccagcctccttcagcatctccttgagcttgccgctgtcattggcagccattgtgtctgagggggagcatgggggagacatggggattgtcatgagtgtcctcacatcaatgcacctgtcatgcaaagcgatgctggcaccaccgtgacagtgcctgccacagaaatttgaggatccctgcaggaaactactccttgcagtgttcaggtgcatggccttgcatagggatattcatcacttccctttgtaaactcaccgtcgcagccgccgatgtgctggccacccacaaacacctgaggcaccgtcttcttgcccaccacctcgaagagcgcctgctgaacgtcgttgccgtcggccaggctgtccagctcaatgaccttggcgtccaccttgagcttctggaacaggctcttcacctccgcacagtctggccatcggtggatagcagggggacatcgggcaatgacgtcatgcaagtagactttgtgaggctgaagggcctcagcatccacatcaacaccccaccagcctcacatgggcagtaggtcttggagtacacgaccacggggttcttcttgttcttctccttcagcgtggccaccaaatcccccgacatggcacgggtggtcacgctcagggcgcggcgtgggttgggcagggctgcggggattgcatggtgtgatcccgtcgttacatgggcatcgaggcgttgcaaggccaaaccggcatgcatgaaccccgaggcgcaccctttgtccggacagcagctggcctagcgagggcaacgcgatgcagtgactggggacgcagcacacgggtaaaggccagggaagcacccgtggtggcgagcgcaaaagacgccatctttgcttgttgaatatgcttttggttgaaacttgggttgttgtctttcgaatgacttgtcagcccggattcagacaaaacatgaggatgatcgccgtccatgtcgccaacgacaaaagcgcgccccggcacctgcccccccctcgagattgggaggaacggcagcgagtnnnnnnnnnngtttgcttgttgatatatatttttggttgaaacttgtgttgtcgtctttcgaatgacttgtcagccctgattcagacataatatgaggatgatcgccatccatgtcgccaacgacaaagcgcgccccggcacctgcccctccctcgagattgggaggaacggcagcgagtaaagaccacaggcccagcattccgacttggacccccgcatccagtcaaaatccatatctacaaatggattggtaacaaagaggcacccagaggtcttagatcatgtcgaaccgatccggaggtggtggggatgcgctgggatccctgctgtcgggcttctcgggattggagggggacatactgggtcgacccaaggcaatgtccgacatgaaaaagcagcggcaaggtgggtggcgcgcgacggtcatgcggggtgtactcgtacgacaccccccaagcaacccacctcttcacccgcgtacactcggtgccgcagtctcccatcgagctactccgcctcgcccggagacgaagagccccgtcgaggcatcagctccctttagtgtcgatgacttggagcagctggtgcaaccgaggtgacggtttggagagttgtggagggcagcattcttgcctggctgcaccctctggtgcacaggggggtgggccaacaaggagcaccacgttcctccacaaccacaaagacacaccttttctgttccaggaacccgccgcgatccacctccaacctcagtctctccagcagtcggcccagtgttgnnnnnnnnnnttctggtgcacagggggttgggccaacaaggaacactacattcctccacaaccacaagacacacctttcctgttccaggaacccgccgcgatccgcctccaacatcagtctctccagcagtcggcccagtgttggatcaggtcggttggcggagggcgcgatgatgaagttgatgggacggagtcagatacctacccatgtagccccatatgccagaaatggcgactatctgccgaggtatgaccccacccatcacctctccaccccctcctcctcacaccacgcagcgctcaacgactttgacgcgctcttctctggtcctcccaccctcaccgctccccagccacccgcctctggcacctccctcatggatctgggggtctcggcctcccctgacccgagcgatcctttcggcatggacctggcgtgccccgccccgccctcgccgtccggccaggcggcttgggaggcgggcgcgtcgccctctgaccctgtgaggcccagcccccgcgcccaggcgtccgaggacaatgacctgctgcctggcttcccctccagccagacgctggcctccccggcggcgctccgtcagcacatcccggcggagtcacgcggcctggacgcccgcgaggatgcccagccgcgtcggccggcgcccagggagaccagcccctgcccccaccccggccacggcattccctggaccggggacgaagcctcggaggcccggtccccctccccgcccggatacctagacgtggtcggcggggcgggccgcaccgcgagcgaggaggggtggtcgcccccccgccgacccgcgccccgcccccccggcgggtcggtcctgggtgggcagcccgcctccccccctcaggcgccccacgccctggcggcggaggtgaagcagcgcgcgcagcgcgccttccagggctcggcggcctggttcatgcgcgccggcaagaagctgcaggagtcggtgcgggagctgcaggccccgcgcccgtcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccgccttttactacgactgggcggcccagatcgcgcgccagtcgccgcgctcccagtccgccacgctgggcgcgctggggctggaggaccgcgccgtggtccagcgcatcatggacgaggcggcggcgggggagcgctgggccgagcgccggctgcgggaggagggggggctgcagcgcgacgacggcgaggaggacaacgacgacgacgtgtgggagcgcgcgctgccgggcgcgcgcgcggcgcgcagcgacgnnnnnnnnnngacgacgacgtgtgggagcgcgcggtgccgggcgcgcgcgcggcgcgcagcgacgacgaggacgaggaggcgggggacggcgcggggtggagctatgcgc

SEQ ID NO: 41356 - DNA, 77 bp, Chlorella protothecoides
gcccatgttcgggttcgccacttgcgcaaggcaccccccgctcttgtcgacaaaacgggggttatggtcacccctcc

SEQ ID NO: 41357 - DNA, 61 bp, Chlorella protothecoides
agcgcggtggccgtgtccaggcggggcaggtgtgcggtggccgccgccagcgtggtgcggc

SEQ ID NO: 41358 - DNA, 6087 bp, Chlorella protothecoides
  modified_base (634)..(643): a, c, t, g, unknown or other
  modified_base (1333)..(1342): a, c, t, g, unknown or other
  modified_base (1784)..(1876): a, c, t, g, unknown or other
  modified_base (2157)..(2166): a, c, t, g, unknown or other
  modified_base (2466)..(2475): a, c, t, g, unknown or other
  modified_base (2717)..(2726): a, c, t, g, unknown or other
  modified_base (2971)..(2980): a, c, t, g, unknown or other
  modified_base (3175)..(3184): a, c, t, g, unknown or other
  modified_base (3546)..(3555): a, c, t, g, unknown or other
  modified_base (4454)..(4463): a, c, t, g, unknown or other
  modified_base (4535)..(4544): a, c, t, g, unknown or other
  modified_base (5057)..(5066): a, c, t, g, unknown or other
ctgcgcgaaggaccagcccggcggcgctgccggaccccgcgcggcgcgcggcccgcgccgcagcgccgcgtgcgtcagcaccgtccccgtgcccagtcccgcgcccagggccaggatgggcaggcaccgcgtccaggctaccaccgcccaggcccccgccgccagcagcagcgtcagcgcctgctgcccaggccccgactgggcctgggaggctgccagcgccgcctgctgcgcagcagcgccctccacggcgtccgtggcagcggggtggccgccaggtgtggggtccgccgcgcccgccagcgcagcggcacggagcatggacagcgccagcgccgccgcccccaggagcgcgggggggcgcaggtagaaggtcagcatcacaaccagcagcgccaggcgcaggtagtttggcgcccagcgcaccagattctcctggtgagtgtgatttgtcggtgtgggggtgatgtcgtgaatggtagcggcgatgaccgaggggttgactcgcacgtgcctcggccgctgcgcccagtcaaccatgcggcacccccttccaccctgctccatccccatgccagctggaagtgtaaatacctgacctcttcctgctcacctccgccctgtccaggaggcnnnnnnnnnngggaagtataagtacctgacctcatcctgctcacctccgccctgtccaggaggcagtccaggtcatggggcaggttgtaagcggcgtccaggcacggcgccccccagcctgaaaactcctcccaggaccggtggggccgcttcaggtcgtgcagggtgagggcgctcaggcgtgggcccttgtatcgggcgacgcgaccggggctgggggaagggctgggcccgggcagggaccccaccgccgagcgctcgagggcgtgcaggccccgcaccctctcggtgccgtcgagggggacggacaggcacaggggactacactgcagccggtggccctcaaaggcccgcattggcacggtcgcgccgggcggacttgggggcggtgggcatggggaatcgctgatgtggggagggagagccgagctgcgcaatgcatggatccggggcagcctcgcaggcgcagcacccctcctcccgggagtcgaatggatcagggaggaagcccattctccactgaagtcgacacgtccctcacgagcggttaagtatccgatcgtgcctcatcagcatcaattctattttgccgggatcggttgaccaggctgtcccccattcgcctctgggcggtagagagtggcacacccctccctgaactcacggcctcattccatgtcaggaatgcctggcctcacannnnnnnnnnattaagtatccgatcgtgcctcatcagcatcgattctattttgccgggatcggttgaccaagctgtctcccattcgcctctaggcggtagagagtggcccacccctccctgaactcacggccccattccatgtcaggaatgcctggcctcacatctagcttccgcacatggtgtcccttcactgctgtccctcgcacatgtagaagctgtcggcctggaaccagcggcgcggtacgaccatgggtcactccagcatggggagggaggaggcccttctccgaactgcagatgccggccacctttcgtaatgatgcctacccggcagcatggcccacaccgaccgaggatgggtacgtcagggttgatgaagtgggctgctcgagttgccctgccatgtgccaatgtggcagagctggctgcatggacaggtgcagacaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctgagagacggaagtgatggggcagcggctccaatgaaagcactcgccgagggtgatgaggccccaacccctgcgtccctgccggtcaagcggagaaaatcccctgcagagagaaaaaaggtgatctgggtgccctcagctgtgcctggctttgatgtcggggcggtgcagcgatccctttgacacactttttgccaaacggatagccatagacagctctctcaactcctgatttctcccccttgccatgttacagcgcaagccgctgtcactggagcnnnnnnnnnnggacagctctttctactcctgatttctgtcccttgttacagcgcaagccgctgtcactggagcaccgacagaagatctcgcaggccaacagtggcaggacctttacactgagtgagcttgtggtaatcgggaaaaggcgggggggggccttctttggtcagattcgtaggccatgggctcccaagcattgttttgggtatgattcggtgtgcaccctgatttctgccatcagttcgctgcttggcatcacttcttaaccctgtgtcgtcagcatgatcccgatgcacaaccccccccccnnnnnnnnnnactgcttggcatcacatcttaatcctgtgtcgtcagcatgatcccgatgcaccccccccatccccccgtccaccatgcagaccatcggtacaacctgtcacagtgccggatggggaccactcacaccgaggaggtccgcaaaaagatctctgcggccatgaggctcagtcacgcaaagcgacgacagaaggcggaggctgccaggtaggcgagtggggtgtcgccaaacgaaacggagcagnnnnnnnnnngagtcatgcaaagcgacgacagaaggcggaggctgctaggtgggcaagtggggtgtcgccaaacgaaacggagcagaggcgtgtgaaggcgtgggcgcatccaactgctcatgctgtgctccaggaaagcagatggggcaaccaacattcctcccccctctggactcttgttcggtgtgctggactctgcagccagcaggcatcatgatgttttgcatctcctcactcccaggattgagtccatnnnnnnnnnntcccactctggactcttgttcagcgtgctggactctgtagccagcaggcatcatgatgtttcgcatctcctcactcccaggattgagtccattatgttttcctcttcccttctccccccccaccccccaacagggccgcgtccggcgtgcagatgctggagcttgaggccacgctcatgcgcaggcacgaccccnnnnnnnnnncccccccccaaaccccaacagggccgcgtctggcgtgcagatgctggagctcgaggccacgctcatgcgcaggcacgaccccgcccaccagaatctgcccagcctgctagagctgctgggcccgcaggagctgcgggacatcgcggcggggggcggcggcaccgagggcatgcgcgcgctggcccgcgagcgcctggtcatgtcggtgacctcgctgcggcacgagctgtcggcctggatgcaggcccaggccgcggagcgaggggcgacgccctccatgcgcgccaccgcgtcctcccaccccgcagtgtacgccaagtttgtgcgctttgtggcgctgaagcaggcgctgcggcacctgnnnnnnnnnngcgccctccatgcgcgccaccgcatcctcccaccccgcggtgtacgccaagttcgtgcgcttcgtggcgctgaagcaggcgctgcggcacctggaggaggggcggcaggggtcgggcatgtgaagaggggtgtggaaggaggctgggtctgtaacgcaaagtagaagggtgattcatggttgagaaccaccgtcagctgagcagaccatggccatccgcctggcatctgagggggggcaagcatgggatgcgattcgtcggcttcaaatcgaatcgtgagggcgcgagcttccgtaactctggcggagtgatgatcatagggaacggtgcgaccggcttcgcgtcacgaactcgaattcttatgtagccacagggtcgacagggcaatcatggaccgccctacctgcaaggttcccggccgggaggcctacccgtccgggcgactcctttgcttgacgctggtactgctcgccctcccctgggcatgggctgtgcccagtgcacccatggaggccctggacattgagatcgcggctgcccaactgtttagctcgcaggcctccgccagggactgcaccccggccgaggacctcccggtcgccggcctggacctgagcgcggaggagagggtgctcctcaaatacctgtgcataccccagagggacctgttactcgaggatgaggacattgccgtggtccggcggggcattccccccggcgtgaactgcacggaggtccagtggtcagtgaaaaatgatggggatggggctctcattaatgggaccctcgggactgggatgctgaagaaggaccccatgcctttgtaccatgtggtcagtacctgccagccgcctgcagtaagcaagggcctgcgtggcatgaagcacttgcaccccccnnnnnnnnnnctctcgcaatcccccccccctccacccacacccacacccacaacgcaggtgcgacggggagagccagtgctnnnnnnnnnntcaggctcgtgccccttgcacagaaggaaaccaagctttggagtccccctctcctctcgcgatccccccccccccaaaacacacacacacacaaaacgcaggtgcgacggggagagccagtgctctctggtgtgcgaacgtggcagcgtggtcatccccgactggcaggtgcacgccatccgcactcagctggacgcgcaggccgacgtgccgctctgccgggcctcgctgctgggctcccacaactcggccatcactctggcggacggctacggcaacctggacgagtactggcagggctatttccgctacatcaagtgggccatccccgccggcgccagcccccgcctgcgcaccaacaaccactggctgtcgctgacggaccagctgcgcatgggcgtgcgcgtgctggagcttgacgcgcagtgcgttacggggaaggggggggattgtgctggttgtgagggggggtgcttctgttgttcaagggaggagggtgtgcacggcagggannnnnnnnnntgcgcagtgcgttacggggaaggggggaactgtgctggttgggaggggggttgcttctgttattcaagggaggagggtgtgcacggcagggagggcaagagggaatcgaggcgtctgtgtaaaagggggaattattggatggctgagggcagaggctgtgcaaggggaggggatgggactgtctatgacgctggcgaggaacgtctgtggccgggaatgctcgcgaagatcgctggcatcctgggtcgcagcagcccttggactgctaggtccggcactggccccatgtggcttccgacgcatctccctcaccccaccctcccgcctctgtccgccccctcagggcacgacacgctccccccacccccccaccgcctctccctccttcccctccctcgcagttgggtgggcggtgcgctgcgcatcgcgcactgcggcggccttcacgtgccccagctcaacgcgctggtcaaggccctgaacctggtggccaagctgctgggccgccgcatccgctgggacacggagacgctggggtgcagcccgtcgctgtcctccattcccgcgctcgaccagcgcacgctgctggacgcgctgggcgaggtcgcggcctggatgggcggcgagggagccgcgggcgacgcgctggtcctcttcttcgacgaccaggccgacctggcgcactggggcgtggtgggcgagctgctgggcgacgtcctgcgcgccttcccccgcgcctgggtctacgaccgcgacgaccacgcgcgcttcgtggccggggtcgcgcgggagagcgaggcggcgggcctgccgccgccctcccccgccaccacctggccgacgccgcggcagctgcgcgccgcaggcaagcgcctggtgctggtgtcgggggcggactacggcgaggccatggccccgctggtcttccccaaggacgacggcagcgtgtgcgggtggcacgagccggcgctgcgcgcggcgcgcggcgcgccggcctgcgacgtgcagggcggcgacgccg

SEQ ID NO: 41359 - DNA, 7772 bp, Chlorella protothecoides
  modified_base (406)..(415): a, c, t, g, unknown or other
  modified_base (1676)..(1887): a, c, t, g, unknown or other
  modified_base (3721)..(3730): a, c, t, g, unknown or other
  modified_base (3788)..(3811): a, c, t, g, unknown or other
  modified_base (4044)..(4053): a, c, t, g, unknown or other
  modified_base (4255)..(4264): a, c, t, g, unknown or other
  modified_base (4960)..(4969): a, c, t, g, unknown or other
  modified_base (6233)..(6242): a, c, t, g, unknown or other
  modified_base (6842)..(6851): a, c, t, g, unknown or other
gggttgtgatcctacaggactgagggttggggttctggctggacgatgatagatggtctatgcacaggttgcccaacctctttgctgaacagagggcaacttgtctatactgctgcggaccctctccagactcattcctaccattgcagtgcactcttgagtgtgcagaatattctccttgcctctgcagatggatgagccaatgagggagctccagcatcgtgcagaagaaaccaggtactgtaggctaaccatggctgagtggggtttgcagttggctgccgtgggcacacaccaatgccaaagagtaagcgcacgtggcctgagtgtgacactggtgtgcgcggaagaatggatcactgtggaagcgcgtggcccctctcacccttccctggccctgctacannnnnnnnnnagagagtttctctacagaaggcacacccctccttgctgatggcccactgctggcccttgcaacacaccccttcctacctggacgtccaccttgacgccatccacgccgcagccagccaggtaggcgtgcatgtctgtgtgcaaggcggtggggtcgcgcgggatgcggaccccggccaccgagggcgggatccaggcggtctccgggttcagcgcctgggttgttgggtgagggggtaggatgctggagactccatcaccccaacttgtgacgtgagagggtcgggagggaacaatgaacgcaagtcaaaacggagctgatgacctggattcacaaatctctgacagataccttaagaaaccctgcccccactgcacccaaccaccatgtggccgcaccagaagattcgcggggggctcgggcatgatgagctccgcctcatactgctcgcccagctcgtcagacaggccgccccagaagccacacagcgcgtgccaggcgatgacgtggcgcacccccatgtccttgatcttgtcgacgacggggcccaacttgcccccggcctcctgcaggttgatggggaagggtggttggggggggagtaatgagcacagcgacggtccgcaggccagcagggaagggcatggaggtgccccctacattcctgtcccagcaccgacagtgattccattgcctcacgttcagggccagggagcgtggcttgcccaggccccggaacttcgagttggccttcacagtcagcagccgctgtccgtggttggtggcctgcgtaaggggtggcaggggatagacgacctcaggctcttgcccccaccattcaacaggcatccatggagcaaggactgccggggcgcctggcacagcaaccaagcactctgccagggcaccgcaaagcacccacctttgcgtagaatgccagcagcgccggccggagtgggcccctgaccagccaaatgacggctcttacgaaccatgaatcggcactggaggcgtccactgctttcttcaggcccctgaacagtgcgccggggacggcactcgccgccccctggatcttcctcactactcggtggacggaaagcaggccgcctaggccagaagtgctggcttgcatgctgtagcagggccagggaagggtgagagggggcacacgcttccacagtgatccatacttccgcgcataccggtgtcacactcaggccacgtgcacttactctttggcattggtgtgtgcccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattcagcacaaaggttgggcaacctgtgcatagaccatccatcatcctccggccaggacgccaaccctcagtcctgtaggatcacaacccaccctgtgctctggggcatcaaggaactcggccacgctgagctcgctggggtccaggccgggatggtgctcttggatgcctgcgctcatgtgacgtggagcagggaatgttgattgtcatctggggacggagttggacggatctttcagggcagaccccgcaatcttgcaccctgtgcctgctggaaacttgccaggtcccactccgacacctgtgggttcagcaagtccctccagccacccccgacagaccagcgtaccttggccgcggtaaggaacatccacatccgtgtgttgccaccctgtatgaagggacgagagctattggtaaataatgcgcggaccgtttgccagtcactcgttcaaagctttcaggggggcttgcccacgcagctcgaaccaggatgctcaccagcccttgccccagactcaccatcgtcaatgatcacgaatccagggttgatgccgcccacttgcagcgcctggacgccatccagaatgcctacggcgcgggtgttggggcctgagcatgcagtctagtgaggcagaggcggtgaactcacagtccccggggccctccctgcatgcctgacgcatacaatgcagcaatcgggtgcaatcctcacacctgccggtgttacgtcgtagtagaaggcgtcccaggtgcaccatccaaaggtgtccacgaagtcagggacggctttggatgtccgcggccgtgccccgccgctcagtcgcccggccgtcgccaccgctgcatccaccagggggtacacctcctttccagccgcgatgtaaagaacgtccgtccaagtctgcgtcatgaccccggcgtcgccactgtcgacgtggaggtggagggcagggtcctctgaccccgggcccgagccggccagggacgctcggaaggtgccgtggttgctgaggagggggagcaggaccgcacagccggcaccctctgggagttccaggagcaggaactgcgtctccagggggaccctggaggcacaggagccccatgcgggcgtcatccaccacacgctggtgaggcccagggcgaggaagcgggagggggcggggagctgcagggagggggtgaggtggcccttggtttgtcggtgggtcagcagtggcgcgagcaccggccagcacagcagctgcacaacctcacccctctgcccacctttcccagacggaaggatgtgcttgacactggtccgtcagggctggccagggagaggagcacgcccccctccagctcggacccgcgtgcggtggagggtaggtcctgcaggatggggccggcctcacccaccaccgacccattgacgaacgccaatggcaggggctgatggacgtacggcacggggcctgaagtcccagctgtccaatgcttgggtctagggcgggttccactcatggcgtctgcgagatcaggcccggatcgtgccgacacaggctgtagctgtgcgcagggaagtcgtcggtgtcgggaccctctaccgcgcttgctcagattgcgagatctaaaggatgcacacgggataccaagccttgcaattgttcgtctacaagacaacaaatggaatcatgggttgcatgccgagagtccgatccgctgcagtgctacaagttactattgacgtggaggtgatccgcagattcccaactgagacagagggacactccgagtgtccagtcctcttacaatcgatacacatgccctgaacgaaggacaatacnnnnnnnnnncctcgagtgtccagtcctcttacaatggatacacatgccctgaacgaaggacaatacnnnnnnnnnnnnnnnnnnnnnnnnattttggaaagcagggaggctaggcgatgacattgctctgtgtacaccttctgacctcagcctattacactccagcaaaagctgctgttgcaacccgcttgcaagttcatttgactttattcaagccgagcgcagttcctcttgaagcccctccaaagccgcctccaaggagatcgtgccatacaacagcggcagggcaaagctcagggcccgctcctccagcctctccctgnnnnnnnnnncagcccctccaaagctgcctttaaggagatcgtgccatataacagcggcagggcaaaactcagggcccgctcctccagcctctccctgcatgaaacagccggtgagggtgtggagcttcctcatagcagagcaagctgtccagcaagcagcagactttgtgattgacacacgcaggcagctcagcaggcatcacgcgcccannnnnnnnnntttcataaaagagcaagctgtccagcaagcagcggactttgtgattgacacatgcaggcagctcagcaggcatcacgcgcccagaccctcctcccgccctccacgcacttgagctggggatcttggatggtctccaggtccgccacacgggcgatgcccacgatgcgcctgatcatgaccgccccggcgaagcgcgccgcgtcgcgcgtcacgtcctggaggaatgcctcgatcacggggacgagctcgtcggggccctcgaagaggctggcggaggcgacgccgccatcctcgctggcgccatgctggagccagagagtctggaaccccgcgaggaagccgtcgatgctctcgcgagccgtctgcagcagccactcctcttgcctgcgcgcctttgctgtgtctggatgcggagaacaggagggtgggtcggaaagccagattgaatgtagatcgcatgagcatgggcatcatgggggcggctcggagcaaggcccagcgattatgacgcaatagggtcccttcacgggaaggtgggggcgaccatcctcatagctcatgtggcatgacaccatcactccctcctcctagcattcccatgcatggcgagatgcccgtgccgacagtcaccccccctcctccctccaaaaaataaactcgcaccatgtccgtgccccgtcgcgccgaagaaggctnnnnnnnnnngattaatgtagatcgcatgagcttgtgcatcatggggggcggctcggagcaaggcccagcgatcatgacgcaatagggtcccttcgcgggaaggtgggcgaccatcccaatagctcatgtggcatgaaaccatcactccctcctcctagcattcccatgcaaggggagatgcccgtgccatcagtccctcccccccccaaaagaaatgaaataaactcgcaccgtgtccgtgccccgtcgcgccgaagaaggctaggagcaggtttgccacccacttgcccagctcaaaggcgatgggcccgcagaaggcaaactcggcgtctatcacgtaggtgctgtcctgggcgaccatgagggagccggtgtggaagtcgccgtgcagcagggcctggggttggtgcatgaaggtctgcttgagccgcgtggcggccagccgcgcccgcggccgccgcagctcgccgacgagcgccgcgaggtgggggctggcggcgcggttgtgcggcgcgccgtggtaggggtcggtgaagatcacctgctccgtcagctcgcacatcccgcggttaacaaagcgctctgtctgctccctgcacggcgaggggtagagggggtgcagggggcggtttaggcgctgagcgggggggtccggaggtgcttgcgctcaggcagcagacgcgcatgcaccgatcctggcctcgaggcagccgccctgcccccgcatgccggtggggcactattttgggtggggcccttctttctcccctcccacccacaaacagataactcactggaaggcctgggggctgagcgccaggaaggaggtgttgaacagcgtggctgcgaggaaacgggcgacgtgctcgctgagccgggggaagacctcccccctgaccagcgcgccgcgcaggatggtgtgaggcggcggcacgcactgcatgcccaccaccgccagggcgcggtcgaaggtgtagacggcggggacgtggcgcgggcagagccgggcctgggtgcgcagggcctccacctccaccgccagccgcgcctgggtcaagggccagcccgcccccaccatgcgcacgtagggcagcgactgcttcaggcacagcgcgcctgcgggcccggtgacaatgtacacgaagttgatgttgccgtccccaacctccctggaaatggtggaaggggttgggggttgggagggggagagggagggatgggggtgtaggggtgtatagagaaagcggagcagagcacggccggtctggatgannnnnnnnnncggtggaagggggtgggggttgggagggggagggggagggatgggggtgaaggggtgtatagagacagcggagcagagcacggccggtctggatgacgacgcagcaggaacatgaatgtttgtggacggtccatccagctgtctgccgggatggccactgtgacgccgcagcctgagcgtcacgccatcctccgtctgcacaccaccgcgctgccacccctccccaggccaccaagcccccctcacaccgctcgggaagccaggagctcacgcgcccaccaacccctcgcacctgacgtcccactctgaggcggtggagggctcccccacgtggacggccagctcggggcgctgactcacaaactcgcgcacgccctgccttcccaggggctgcgccgggctgcttccttgcggtgccgcggcgcctgttggcctgctgtcgcctgagtctacgcctcgtgcctgtgtgccctttgcgggctgctcagcggctgccacctcacccttctcaggatccctggcgaattgcgcttgactgccatgctcattctcagcggcagctgcctgcccgaccccggccttgtctctccgcgcggccannnnnnnnnnaggctgctcagcggctgccaccacacccttctcaggatccctggcggattgcgcttgcctgccgtgcccattctcagcggcagctgcttgctcgaccccggccttgtctctccgcgcggccaggaaagcgggcacatcgtactcaccccccgggcgcgacggagagatgaccccggcctccgtgataatgccggtgatgagcgcggcgggggtcacatcgaaggaggggttccagacggggacctccgctgccaccctgaccccccggaagtgggtgatctgcaggcatgtggaggcaggagggatgaggaggggtcttcgggcgggtgctgcttccttgctcattggagtcgtgagtggcaaagcctggctggtcatacacatggccccccggagcctcgtccttccttcagcagctctcgtcatcaccattctaaccccccccccgcccgcccacctcctgcgggtcgcgctgctcgatggcgatgtcggcgccggcgcgcgtggcggggtccagcgtggttgtgggcgcagccacgaagaaaggcaggccgtggtgcgcggcggccaccgccagcgcgtaggtcccgatcttgttggccgtgtcgccgttggcagccacgcgatccgcgcccaccaccacggcgtccacctcgcccgcggccatgcgcgcggcggccgcgccgtccacgatcagcgtggccggcacgccgtcggccgccagctcgtaggccgtcagccgcgcgccctggttgtagggccgcgtctcggtgcaggtgacgcgcgccaggcgccccgagccccacagcgcgcgcgccacgcccagcgcggtgccgtaccccgccgtcgccaggctgcccgtgttgcagtgggtgagcaggcgcagcggcgcggttacccccgccgcgcgcgccacagcgt

SEQ ID NO: 41360 - DNA, 64 bp, Chlorella protothecoides
gggctgctgcgtcgtcgagccacttggcttggcagccagcaccccgtcgcgttgctcacacaac

SEQ ID NO: 41361 - DNA, 1844 bp, Chlorella protothecoides
  modified_base (349)..(358): a, c, t, g, unknown or other
  modified_base (1236)..(1245): a, c, t, g, unknown or other
ggtacctggtgatcttcggcggcgggtcggtggcgcactgcttcgacgacgtgcatgtgctggacaccgccaccctggaatggagccagccggaggtggaggggcccgtgccgccaccccgcgcaggtcagggccggtgtgcgtgtgtgagggtgtgatggaggtgctgtggcgcggcgtgtgtcggggtcagcgtgggaatggcgagtgggaggatggcacacgggtccctcctcgccccttgcacaccgccgtcacagtcgggggcacagggggagccccccttcaccccctccctgggtcacacacgcccccctcccccctttcctcccctccgcaaaggccacgnnnnnnnnnntgatggaggtgctgtggcgcagcgtgtgtgtcggggtcagcgtgggaatggcgagtgggaggatggcacacaggtccctcctcatcccttgcacaccgccgtcactgtagggcacaggggccccccttcaccccctccccgggtcacacacgccctcctccccctttcctcccctccgcaaaggccacgcggcggcggtgctgggcagcacgtggtacatcgtgggcggcggcaacaacgccgccggctgcgccgacatgtacgcgctggacctgggggggctggggcggggcgagccgctggtgtggacgctggtcggcaacacgccgccttcctccgccatcgccagcgagggcctcaggtggggaggggattggggagggacggggggggaggagggggtgatgaccaggtggagagcgggtgtgtgagcgggcggccctggatggacgccgagcgggcgtgcttgagatccttggttgcgctcccgcgatcgcaatgtttcgggttgtgctgtcccgcgtgtatctcttgttgtcacacgcacaagagcaggtcgacgtctcctttaaaccccaccaccactccctgccccccacccctccccagcctgctgtcggtgcccatggcgggctgcctggtgtcttttggcggctacaacggaaagtaccacaactcggtgcacgtctaccgcccggagggctacgtcctggtgaaggcggcctcggcggaggcgcggggcgcggagcgcggcgcgctgccagcgggggagggtgcgtggctgctcggctgcgcgatgtgcccatggggctgccttgtgacacccgtggggatggcgtgatggggtgctggctgtgtggggctggggtgggtttggnnnnnnnnnncgatgcgcctgtggggctgcctcgtggcggccgtgggcatggcgtgatggggcgctggctgtgtggggctggggtgggtttggtgccgcgccgcggcacctcgccagtgcctgcgcgaccgctggcacatgctctcagcgggccgcggcatcctcctccagcagggctccgcgcgggcctggacgtgggcacccggtcctcggcccagcagccggaagacggcgagatcgagcgcaagaacaggcgcgccgcgggatggacgagggtgtcgtgggggggcggtgcctgcctgccgccgccgccgccgtcgctccgcagcaccacgagtctgggtgctccagccgggcgcgacggcccatcgtggccggcctgcctgccgcctgcccggctctcggacacccctcctcccccctctggcccacgcagcgaggcggcggtggccaggcgggaggccgtggtcgcgcgggagagcacggcgcaggagctggtgctgctgaggcgccagctggcgaccacgcaggccgccctggcggacgcagagcaggtgcggcgcggctggtggcggaatggggggggcagtcccgggggggggggggggg

SEQ ID NO: 41362 - DNA, 61 bp, Chlorella protothecoides
ctgcatcccggtgctggagcggatcgacacgtcgcgcaacgagatccaggccctgctgctg

SEQ ID NO: 41363 - DNA, 19000 bp, Chlorella protothecoides
  modified_base (571)..(580): a, c, t, g, unknown or other
  modified_base (642)..(651): a, c, t, g, unknown or other
  modified_base (729)..(738): a, c, t, g, unknown or other
  modified_base (1479)..(1488): a, c, t, g, unknown or other
  modified_base (2206)..(2215): a, c, t, g, unknown or other
  modified_base (3612)..(3621): a, c, t, g, unknown or other
  modified_base (3978)..(3987): a, c, t, g, unknown or other
  modified_base (4227)..(4292): a, c, t, g, unknown or other
  modified_base (4433)..(4442): a, c, t, g, unknown or other
  modified_base (5883)..(5892): a, c, t, g, unknown or other
  modified_base (6316)..(6325): a, c, t, g, unknown or other
  modified_base (6452)..(6461): a, c, t, g, unknown or other
  modified_base (6758)..(6767): a, c, t, g, unknown or other
  modified_base (7250)..(7259): a, c, t, g, unknown or other
  modified_base (8464)..(8473): a, c, t, g, unknown or other
  modified_base (11800)..(11809): a, c, t, g, unknown or other
  modified_base (12709)..(12718): a, c, t, g, unknown or other
  modified_base (13119)..(13128): a, c, t, g, unknown or other
  modified_base (14114)..(14123): a, c, t, g, unknown or other
  modified_base (14760)..(14769): a, c, t, g, unknown or other
  modified_base (15584)..(15593): a, c, t, g, unknown or other
  modified_base (17164)..(17173): a, c, t, g, unknown or other
  modified_base (17587)..(17596): a, c, t, g, unknown or other
  modified_base (18212)..(18221): a, c, t, g, unknown or other
cgcaccgcgtcgtcgcccgcgcgcgcgcgcacgcggcgcagcagccacggcagcagccccggcgcgcgcaggatgggggccgccaggccggggtccacctccaccagtccctccagaacgcccagcgcgctatgcacggcctgtgcctcctcgggcacgccctcgtcaaaggcgggcaggcggtgcgccagcgccgccagcagcccggccgaggccagcgccgccgccagcgcgcgcccctcctcccgcgcctcgtccaccgcgtcctcagaggtcagttctgccagcagctccatgaccgccgccgcgatgtcggcattgtcgtggtgcaacagggggagcagggtctccagcgcgccgctggcgatcagctccgggtacagctcgggcgtgctggccaccacctagggaaaggagaaattggtcggggggttgggaggtgagggagggtgtgaagatgagggcatgcaatgtggcgggcgcatttgatctctcctgcgtccccggcactctcatattcgatgagccttacacaccacagccacatttcctccctctcccccattccaannnnnnnnnngagatattcgtggcgggatgtgctgagtgcaaaaggaagggctgatgcaggcggggcatgcnnnnnnnnnntggccgctccactggccccaggcatcccccccgaccctacccccccaccccctccaaagggaccttgcgctccagagnnnnnnnnnnacatattcgatgagccttacgccacacggccacatttcctccctctcccccattccaacccaccctcagggcgttcacggcctcgtcaagctccacctccgactccaggaacttctccggctggtctgcaaagcgcgtgcgctgctctagattctgggtggcctgcgattgtcaagttattcgtggcagaatgtgctgagtgcgaaaggaagggctgatgcaggcggggcatgcaccgccaagtgtgcagcggagtattcggccaacagccgcacggctctggcacaaggtgccaaaacaaacagcttgaacatcagacagacgtgaaggccgctccactggcctcaggcatccacccccaccctaaccccccacccccctccaaagggaccttgcgctccagagccagcaccaggcgcctgagccctttggcgtccactatgccgatgtcgctcggccccgccgcctcctccgcctcacgcaacagctcctccgcatcccgcgccctgactcgtgggggagggggcggcatcgaggaggggcccgggccggccgggccgactccgtctgagcccgtatttcccccggccggatgggactggtcatcgcggtagtatctgcagggttggttgagatgagagtggtgaaaacattactgcgacccagggaacggagtgccgatggggaccacgaaccgcaaggccaaaatatagcaagcctccactggcacctgacagtcannnnnnnnnntccgtctgagcccgtatttcccccgcccggatgggactggtcatcgcggtagtatctgcaggggtggttgagatgagagtggtcaaaacattactgcgacccagggaacggggtgccgatggggatcacgaaccgcaaggccaaaatgtagcaagcctccactggcacctgacagtcaattccccgcgcaccctgtgccctgggcacccttgctgaaatagtatccgtgctttggtccactccaggaggcggaagggatgaacgggtctgtttggggcacagcatccccttcaaaatcccgcaaggcttgctgtgtgtgacatggagggagaggagccccatgttgcgatgggacaagtggcaaggaagcgctgcaccaggtctgaaagataaaaatcagccagtatcctaggatcaagcctgcatgcagccactgatcacctggagaattgccgtgggagcggaaggtcttgcccctgacatcttcacgggctcaatgtggaaaggggctcagaaaagacgacacatctgagtaggtcctaggctgatgacagttcactccactcgaacagtgcttatgaggatgagtcagatcggattggcaaggcacttgctcgtggttcctgaaatgcgatcgagtgcgctgtcgaggtgcagtaccggtggtagccctccccagtgaggtgttcagtgtcgggtaaaacctttctcgggcacnnnnnnnnnnaaggtgcagtaccggtggtagcctcccccagtgaggtgctcagtgtcgggtaaaacctttctcgggcactccgccgcgagccacaaccaccccgatcactttgcaccatctctgacatcatccgcatcatccgcctaccatgcctttcgctgtgcgcaagcccgacgccgcggctgcaaacgcggaactccgccgcaacctgactctcttcggagccgcggtcgtggccgtccgtgccgcgccctacattttcgccctgtttcagagcaaggcttgaggcggaggcggcctgattgcaggagtgagtgtcgtgaaagttgtccgtgggtctcgagtcgtgtcgcgcgcttggctcaggtggagggttaatgacctgtcttcgcatcgatcgatgccctgcgatccttgccaagtggctgtggcatccactcggcttcgtcttcgagcggagtcaaatccgatgcccacctcctgcggccctgggtccaacattgttaccatggatcgggagtgagtctggcaaggccatgttgctcagggtcccttcccttacaccctccctcccccctcctccccctccccaacgcgcccagtgtgtggcatcttcgggtactacaactaccaggtgccccgcacccggctggagatcctgcacctcctgctgacggggctgcagcggcaggagtaccgcggctatgactccgccggcctggccatcgacgcggtgcccatggccccggacgcggcccccaatgcccccgcgccccccgccctggtggtcaagggccccggcaagatcgtggaccttgaggcgctggtctcccgcgagatggcggcgggcgggcacgacccgacctcgcgcttcgaggtgcacgccggcatcgcgcatacgcgctgggcgacgcacggcgtgcccagcaccgccaactcccacccgcacgcctccaacgccgccggcgacttcctggcggtgcacaacggcatcatcaccaactacaaggccctgcgcggcttcctgcagggccacggcgaggtgtttgccaccgagaccgacaccgaggtggtgcccaagctgtgcgcctacatataccgcaccgcgcggggcgcgggcggcgccccccccgccctgggcgaggtggtgtgccaggccatgcgcatgctggagggcgcctacggcctgctggtgaagtcgcggcaccacccgggcagcctcgtggcctgcaagcgcgggtcgcccctcatcctgggcctgcgtggcagccccggctgcgtcagcgtcgctagccccgccaagggtggcgaggccacgcggggcgcggccgccgcgtgcgcgccgggcgcccgccctggcgcctgggagtgcttcgtggcctccgacgccgcggcggtggtggagnnnnnnnnnntgcggtcgccgcgtgcgcgccgggcgcccgccccggcgcctgggagtgctttgtggcctccgacgccgcggcggtggtggagcacaccaagcgcgtgatcgtgctggaggacaacgacctggcccacatctgggctggcgggtacgagatcctgaacgcggagcgggagggcgacggggatgggatcgaggccccccgccccgtgccccgcagcctgcagacgctggagatggaggtcagccagatcatgaaggtgggaaggcgtggtgtggatggggtgtgttaaggagggggtaggtcgaggacagacggggcccctctgtcataccaggaagggccccatactgcgccgtggcnnnnnnnnnngcggcgtggtgtggatggggtgtgttgaggaggggggcaggtcgaggacagacggggcccctctgtcacaccaggaagggccccatactgcgccgtggcgatgatgaattcatcacaaacaagtagatagagacaactgaggcctcgtgtcacgtcgtgatgtgaacacactgtgggaatctctctgagccacgcatgcatgcgccccttttgtttcctgtggtacgggtgttgcaagannnnnnnnnnnnnnnnnnnnnnnnnnnnnnnnnnnnnnnnnnnnnnnnnnnnnnnnnnnnnnnnnnccatttgtcgaaccgagttggacgatcatgcagaacgaccaggaaccttggtgcccttttccaaccacaactcacagggcgggtacgaccacttcatgcaaaaggaaattcacgagcagccggagagtgtgctgcagacgnnnnnnnnnnacctcgtgtcacgtcgtgatgtgaacacaccgtgggaatctctctgagccatgcatgcacgcgcccctttgtttcctgtggtacgggtgttgcaagagcgtcgggaggggggggcaccccctccatttctcggaccgagttggacgatcatgcagtacgaccaggaaccttggcaaccttttccaaccacaactcacagggcggatacgatcacttcatgcaaaaggagatccacgagcagccggagagtgtgctgcagacgatgcgggggcgtgttaagtttgagcgctcctcgtcagaggtgcgtggttgtggtttctttttttgtgggggggccggcggcggtggcggggagggggtgcggatgcccagcctgcgctacatgttcacctacattgaaaccatcccattcaccaatgccccccctcccgcccactggcagacggaccgttaccgcgagcgccgcatcaagctgggcgggctgacggagtggctggacaccatccgcaccggccggcgcatcatcttcgtgggctgcggcacgtcctaccacgcctgcctggccgcgcgccagacggtggaggagctggtggaggtccccgtcgcgctagagctggcctcggacctgctggaccggcgcgcgcccatcttccgggacgacacctgcgtcttcgtcagccagagcggggagacggccgacacgctgcaggcgctggagtacgccaagtcgcgcggcgcgctgtgtgtgggcctgaccaacacggtgggctcctccatcgcgcgcgccacgcactgcggtgtgcacgtgaatgctgggtgcgaggttggcgtggcctccaccaaggcctacaccagccaggtggtggcggtgaccatggtggccctggcgctgagcgaggacagcatcgccaagcgcgacgcacgcgacgccgtgatcgactcgctgggcgcgctgccgggcgcgctgcgccgcgcgctggcgctggaccccgagctggcgcgcctggcgggccggctggcgggcgagacctcgctgctcctattcggccgcggctacaactacgcgacggcgctggagggcgcgctcaaggtgaaggaggtggcgctgatgcacagcgagggcctgctggcgggggagatgaagcacggcccactggccctggtggacgagagcctgccggtgatcgtgctggccacgcgcgacgcgatgcacgccaagatgctgagcgtgatcgcacagctgcgcgcgcgccgcgcgcggctgatcgtcgtcgcctgcgaaggcgacgccgaggtggaggaggcctgcgggttggtggggggggggaggggggatggaccaggggcaaacggggcgggcgcgggcgcgaacggccacgccgcccacgccgcccacggctcaggccccttcccgtccaccgacccctccccgtccaccgannnnnnnnnntgccgcccacggtgcaggcccctccccatccaccgaccccctcccatccaccgacccctccccgtccaccgacccctccccgtccaccgaccccactgaccccaccaccaccaccgcgccatccctgcgcccaagcacgctgatccgcgtgccgcgggttgcagactgcctgcagcccatcgtcaacgtggtcccgctccagctgctggcctaccacctcaccctcctgcgcgggcacaacgtggaccagccgcgcaacctggccaagtcggtgacggtgtctgaggaggacggcagcctgaactgcagccgcgggaagcgcgggaaggccgtgcccaacggctttggtgcgcgctgagggcggggactcactggtgccagagttggggaggaagctttcggggcatcgggcatggagttcccnnnnnnnnnntcttggtgccagagtcggggggggagctttcggggcatcgggcatggagttcccgtgctagagccttcggcgtctcgctccagggacgacggcgacagccaaacacgtctcactaggaccccccacnnnnnnnnnntgtctcgctccagggaagccggcgaaagccaaacacgtctcactaggaccccccacatcaagcccttgctgtgtgacgcactgagcaattgttgaaagcaagagaaattgtacacacagttttcggttttgcaggcctgagacgggaatgcaccgccggaaacacagggggactcgctcgctcgcgcgctccggggggggggaacagacagatggacagggaaaacgacgcagcgtggctagaactggagtggcgcccggcgctgacgggtcaaactaggtgctagatcgtccagtnnnnnnnnnnaggcttgaggcgggaatgcaccgccgaaaacacagggggactcgctcgctcgcgcgctcccgaggggggaacagacagatggacagggaatacgacgcagcgtggctagaactggactggcgcccggcgctggcgggtcaaactaggtgctagatcgtccagtccaggatgaaatcggcaatcctgcgagggagtcgggtgggaaatgacgcggcggcgattgggcggcgcctgctgcacggtgaggcctcgagacccaaggacacaaaatcgcctcctacttactgctccatggatgccctggggagcactgaggagtccagctgcttgatgatcttggccggcacgccgactgtggagggcgtggtgagggggtggggggaggatcggctgtgccaagttcctacaaatagaacaagacacagctgatcgccttttgatcggcagcttcgaccgctgagagagcgacacgaaaggagcacnnnnnnnnnnagggatggggggaggatcggctgtgccagttcctacaaatagaacaagacacagctaatcgccttttgattggcagcttcggcctctgagagagcgacacgaaaggagcacacctgccacggtggagggcggcaggtctgtgaggacgacggagccggccccaatcttgcagttggcgcccacgatgatgggcccgaggaccgagaccccggcgcccaatagcgtcccgttgcctggaggtgaaaggggaggggggtggaggggctgaagaggtgtggtttgaacagtaacaatggtgaacaggggcagggtcgtgactggaccctgcaccgcactggctaccgcagaaaccaacactccgctggccgacccctgcagcactgggtcttcccctacgagactccagctccaccactgtgccactctatcgtcctcaccctgcacctcccacgaccccacccccccgggctcacctatggtggggtgccgtctgccgcgccccgtccccgacccccccagggtcacatggtgcagcatggacacgttgtcgcccaccaccgccgtctcgccgatgacaatgcccgtggcgtggtcgaagaggaggccctggcccagccgggcggcggggtggatgtccacggtgaacacctcggccatgcggctctggatggccagggccagggtgtgccgccccttcttccacagccagtggcccaggcggtagctctgcaccgcctggaagcccttgtagaagagcaggcactggacataggtgtcgcaggcggggtcgcgctccatgacggcgtgcaggtctgccacgccagacgccagcaggcccgcgtcgtcggcgtaggcgtccatgaagaggtgcaccagctgggtgcccagcagcgtctcgttggccagcttgttggaaagcagaaacgccagcgacttggacaggctggggtgcgtcaccaccgtcatccccagctggaggaagaaaggggagatgggaaggagtgggggagtgctgaggacagagggccgaggagagagggctgggggagagggagccgctgcagggaggtctggtgcgggagcaggcgtgaacaaaaacaggccgcagatatcccgcgttcctaggagagaggctggagtggacacaggcccctcatcagcagcccgtctcgccgcacgcttgccacgcgtggcaaacaccccannnnnnnnnncctggtgcgggagcaggtgtgaacataaacaggccgcagatgtcccgggttcttaggagaaaggctggagtggacacacacccctcatcagcagcccgtctcgcagcacgcttgccacgcgtggcaaacaccccatgtgcagccccattgataacgcaccatccacaacacaccttgctggcgatgagaggctcggactttgacagctcggcggcctcctcctggatcttggcccacagggtgtcggcattcaggtcctgggcggagtccctgccccctgcgagcgctgcctgccggtcgccctcccgagccgacactgcagggcttgtaggaagccgggcatgcaggaccaggggagcggacgctggcagggttgcagggtgcaaccacccagcgtcaagcgccaccctcccgcgatccacagacatgattcacctcccccttcccgtccacgagggcagcagccagaacctaaggcccccccctcgaccccactcacgggaggtcagggccaggctggatgaggattcgcccgcttcgaggtgactccgccacacccgttcgttgaagctgggcatgggggaggtggtgtcattcgttccagtcttttttgcaatgtccatgcccgccggccctaagcaagcccgagccccggtggtggggaagcgggcggtctgggtcaccagggggtgcacgccgggagctgggcccaaggagcgcccacccactagcatgcccgcatgtgcgctgcacagggagggcagtgaggcaataaagtgggatgtatggtcacgcacaccgctccaggggatgaattgctggcctagcccaccttcacggaccagcaggcgtcgaggggtgcacggccaagaagaggccacgcacgcacccagcgtcagtgcgttgcgtttcgtctcacccactcgtgttgtgtcgcctggtctcccacggcgcgacagggtcgtagtcacgtcccgtacagcgggcccgtcctccgactggtccacggggctctgtcagcaattgctggtacgtggtggtgccctccaacctgatcgccgcaagcccgttctttcgatgcaccaaacctaccgttacggcttggaagagaaattgggcgactgagtgtggatgcgcacaggccggattatgtgcgaggctcgcctctcgcgcccgggggggggctggcgtgtagggttgttccggcatggcggggcgggcgggcctggggccctacactgttggcgctcacgcacctccaagcccctactccgtatcttacgcccataatacctcctacatgcatgcctgaaaaccctgagtcgtcaattcaggtcgcaaaccgtgggtccctgttttacactctccttagaattaaatgacatagtccagcacgtcgtccagcgtctggtccatggacttgcagggctccatggtgacggggaaccggcgaataacgcgcgcggggatgcccaccgccaggctgtgcgcggggacgtctgcgaccaccacgctccccgcccccacgcgcgcgcagtggccgacggtgacgggccccagtaccgaggcgccggcgcccaggagagcgccattgccgatgaccgggtgccgcacgcccttgcccgtgcccgagccgccgagggtgacgccgtgcgcgaggctgacgccgtcgcccacgacgcaggtctcgccgatcaccacgcccgtgccgtggtccaggaagacgccgcggccgaggcgcgcggcggggtgcacatctacaccccaggccccgctgccgcggctctgcagggccagggccagcggccggcgccccgcggcccacagcgcgtggcccaggcggtgggcctgcaccgcctgccagcccttggagtagagcaggcactggagggggccggggcaggccgggtcgcgctccacgctggcctgcaggtcggccgaggcggcctccagcagcgacgcatcggcgccgtacagcgacgccgccagcagtgccagctgggacgcgggcagcgtggcgtcgcccagcttgcccgccagcaccgacgccaggcaggcggcgaagtcagcgtggcgcagcaccgaggcgtgcagcgcgggcgccagcaccggttcccgccgggccagggcgcgagcttcttgccgcacctcgtcccacagcgccaccaccgaccggtggccggggcccgggctccacgagtgcgcggacagcgactccgtgctgtccacctcgtcgaacgaggctgcaggagggtgcatgtcgggcaggggggggttgatgacacgggatggcaggttggtatggagccatgcaaaacagtcactaccagggaaaacgggctgctcccctgagcatgtatgggccatggctgatcccagcatggccccatgtcatcttgcattgttgcggctctgccccacccagccccccaccacacacacacccaaacgcacctctctccggtcctcttcgcaggacatgatcccagaaagactcgttcaccccactgccgtgggccagctgctgctgctgccggatggagcgggcctccagcaccgcgtggggcgcccggtcggtcgccacagccttggtcggcacgccatgccgtccatcgggcagcgcgacgctgttgacgaccgccacgcaggacatacgacactgtgtatggctgctcaggctgccctggggtcctcgcgctgcagcatgaggggtgagcgccggtgtgagagggcgcatgagccgtacgaagccaccacagggagggggggtgcccggacacccagcatacctccacacacacctgaacggctctgcgactgaagttggagcacgtgctgactcatgcagcgggaccctggcgggccactgtgggaatgcttcaggtcagtcgggggggggtgtctctggttgcggcgccaaggacactaacttccttcgagcctccaatgcctggcgaaacacacgcgttcgatgggtactggtccgggttttggttaattgagtgggaaagggtcccaagatgcccccgaatgtccgaccgcgttcgaataatggggcatctcggggtcggtcgtgtgcggttgggtgatccataccctcacctccggcttcacggtgggtgcgtttcggattcttcctcaccccccacccagggactggctcagcaggagtggaggtcacctgtccaccattcacacgcctttccatacaacaaaagcgacccccacccttgtcgttcgctggtgcatccctgcagcccatacattgcctggtgacatccttgatcgaccctgtattgcaacactaaagagttgctctcatgccgnnnnnnnnnntattcgctggtgcatccctgcagcccatacaatgcccggtgacatccttgatcgaccctgtgttgcaacactaaagagttgctctcatgccgccgcctccccctgggctttaccgcgcgccttcgcccgcttctcgtgacgcctcaggttcttctggtgggcctttggaagtccggcatactttgacgcaggggtaggggccccctcccgctccaccttcttcttcttcttccgcggcgggaggagggacgaggacatgcccgtcttgtctggccgatgcacccggggcgctgcatacgtggcggcacgcagctcctccgcgctggctgccgactggctgctggggctgaagcgggccttgtgcgtgccctctgaggccccttcccgcacgtcgccgtggcgccagaccggccccttctccccatgcccactggagccccgcttgcgcttggcgccggcctgcgccgcaacctgctgcttcagggcgttcacggccccgtagtttggccgcaccttgcggtgctcgtccctggggtggtaagtgaggaggagggggtttagacgtgtggaccagtctgccatccagatgtgagccaggcgaggtcgaggcgtcccaagcagacagcaacgccacgaaacagggcattccacccttccaaccccagcccatgtgcacctgtagggcgcgagcagcttgaggcccaccacctggttcagctccttgtcggccatggccaggatctcgctgctggaaaggccgaacgattgcgcatccacgcccttgtacctggaagggtgacgcgataggaggggagtgcaggattgggggaggcccagtgccgcaccggtagattgggttgccgggtgacagtggagcagctgcatcagcctcccacgatnnnnnnnnnntttaataggaggggagtgcaggattggggggggcccattgccgcacgggtggattgggttgccgggtgaaagtggagcagctgcatcagcctcccacgatgcgatcacccacatgagcctgcgtcgcagaagctgcgtgtggccagggcatcggctgtcactgcagtgcgcattccctgcggcccgccaaggccagacacactccgcccccgcttcccccagcctcacctgaagcgggtgcggaccccgcccgccacaccctcatagtccagcttgtagtactcctccagcaagcgcttgacctcggcgcgggccgccgcccccacggccccgcccgcctcgtcggcctcctgtgcagcctcgcccccggcccccgctcccccgcccatcgccttgtgcannnnnnnnnntgcccccccccgccccgtcggcctcccgtgcggcctcgcccccgccccccgctcccccgcccatcgccttgtgcagcgcggcaaacgtggtggcggaggtcgggcgctggtcgctgccgccagcatcatcgtcgtcggtgccggagccaaaggcaagagcctccagctgcttctcatactcagcctccagtgcctcgggatcctcctcctccgcctgagggtttgtgtgtgtgaggcggggctcatgggaagcacgggctcggggcgggccagcgggtagccaggggtccagtgccactggcaggaccaaggcgaagcgtcgatgcaaccccaacaggaacgacccaccccttcccccatggggtgacgggtcatccgtccccaacccctcccggcaggcccgcgccgcacctcgtaaaagtcttcgccgtaggcggctgccatctggcggtcgtactcgtctgggtcgaactcgtcgtcagccagagcctggagcagctccgccggcggcgccgtcccgccggccactgcctggatctccctcagcctgtcgagcaggagcaagggtgttggcggtgcgagttctggagcgcgggcagtggaggtctggtcacggcgcgggccagcaccaggagaacgatggcacaccgttccggccgccccacgcacctggcattcacttcctccttcttcaggttcttcagcctgcgcatctcggccgccctttcctcctcctgcgcggcgagccgcgccgccttctccgccctccgccgctttcttcggtcgtcctccttcctcaccgtgccctcgatctgtgcggcgtgggcaggcgatggggaatgagggccgatggaaaggcagcgcacagggcatcgccagccagagggcaaggctggtggacacaggcgcactcgtgcagatgccaggccatgaaccagggcgtccccgctgcccatcctccgtcgcctctcccctccccccgtacnnnnnnnnnnagacacaggcgcactcgtgcagatgccaggtcatgaaccagggcgtacccgctgcccgtcctccgtcgcctctcccctccccccgtacctgtctcggatgggtgaccagggtctccgaacccgggtactcgaacctgaagttgtacttgtgctcgtactgctccgcctgctgcaggtactcctcctcctcttcatagtccgggaccgtccctgcctcatcccccgaggacgaggcctcgccgccctcccggtccacccaccccttgctcaggatgtagcgcttgaggaagcggtccccctcgtcctccagcgtctcgtctgccccaaagtagccgtccagcaggcccttgatcctgtcctcaccggcctcagcctgaccgccggcatcccccccggcctccggccgagcgacaggcttccgggcggcaaaatccagctcctcgtcgccgtcgacctccgccacggcctgtggggtggaggagcaggtgcagcgagtcaagctgctttggcaggggaggcctgggtgtgcatgcatggcgaaacgagtagggacaccatggctgggagcaatgggctggcatggatcgaacaaactgcgccaagcagatccatgccctgcacccacctgcaggaacgnnnnnnnnnntaccatggctgggagcaacgggcaggcatggatcgaacacactgcgccaagcacatccatgccctgcacccacctgcaggaacgcagactttgcgtcgtgctgctcatccttgtacgtgtgtggcgcctcctcatcagtggagtcctgctcaggcacgccctccatggcctgcaggggggaaggatggggccgggcttctgcattggaaactgggcagtactgcataccagagctctgctccactggcgggcatgcatcgcccagaccaggcttaaccagtacctgcttgtatgtgtagtctttaagcagcatgggtttgtctggcttctgcttacgacctggcggtgaggtgagggtttgagttgtgggggcatcggcagtgttggggcatgtggcaagcttacggagcacacgaggagactcatgacccgagtaacgaggctgaagtagccccaagcagcaggctgacgctggactgttcccagctatgcatctactagctactcaaggctgatcaagctggtgtcatgcgctcaaggacgcaatctcaggttcaatcgctgaccggggaataaggctcaccttttgcatgatcctcctgctcctccccctcgctgtctgggaagaacttgaccgtagggtcaaagacagcagggtcctttgcacggatcttctggagcacttctaggatacgagactccttctcatcagggatgagcccctcgtcctgtgcgagaaaaggcgtgatcagaaaagaggggttgatatacctgaggagagcacagcaagtctctacctgtgcagttccaatcannnnnnnnnnaaaaaggcgtaattagaagaggggggttgatatacctgaggagagcatagcaagtctctacctgtgcagttccaatcactaatacatgtgcggttacgccaccccttctcagcagcaattctcacctcctcctcgtccgagctggagtctgatagatcctcctgtggttgcccagttgcagcagcgaccccttgtctcatcatctgcatatagatatgtgtatatgtgtgatctggctgaagggatcaggtcatgccttcaaagggtactttatgctccttccagaggtctggaacccctccctcctggactgcagtgtctcagttgacggcacagttgggatgatggttcacctggcgctccaggcgtgcagcctgctcgggatacttttccttgagtcgatgtagctcctcccgcttcttgttgtgctgtggtgggatgtaaatggaggagctggtgtatatgtcggaggagaaggctcgccaaggcggcctggcacatgccgtcgtctcatgagtcgctggacggggtcgcaacccacctcgaatctcgacgcatactgcttgtttactgtaagtcccccagagcctctgggcccctcctcatcttcgaacagctgcatgctgccactgtatgctacccgctgcggtgccacccactggatagaaacacctcaactacggcggtactcccatgtaccaggtttatagggagaacatatgtgctcgggtcatgagtgacggtagacttgttaaaggaaggttgtatttacaaggacttccaggttcgcgcgcccggagctctcatggtgtgccttatggcgcgcgatgcgatacttgaatcgggcaaaggctccccaaataccgagcaatctcgaggctcagcactgtagactaataggtaatcgttggagcgcaatgctgggggccgaggctccagtcggggtggccgacgagcctgcccgtctgattcgccttaagaggaagagaacagcggctagtgacgatgttattggtgagtgcagagtgcagtcaaggacctcttgcaacacttttaacacctgcatactcagcttctccgactcgaacaatgccatgcagtcgtggaagccatggagacgaccagtgggctgacagatcacttcggtggagtgggcatccacgactcccagcagaggcagcggcacgatggcagcaagcgctttcgcttcgtgcgactcagcaatgtcaatgctggagacctgtcgtccctgacgcgcgagggtcttgccgagctcctcacctctgagcggactgccctagccgccgcggcagccgcatccaggtgacctagcgtgggggatgtctcgccatgcgtggtcaccggcagcctgacgagaggtgtcaccgcaagtgctactttgcactttcaagacgccaggctgcaccaagggcctctgttcaaccgcaggtgcaaccctgtgggagggacacgagaagaggcaagcgaggctgggcccttgccttccatcccgcccacccatcctgcccttcagcctggactggagccatggtaccagcagaccaatacannnnnnnnnntttccgcccaccaatcctgcccttcagcctggtctggagccatggtaccagcagaccaatacactacaaggggccacccctgcctgggcaacggtgctcgacttggtgcggcacgaagcaggcccaggcgcctgggacccatccgcgcaggtgcctcacgaggatgctgtggacgaggatgggtacgtgatggatgtgtacgccgcactccccgccgccgccgaggacgagcaggaggagactgacgcggcctgggaggcccacctcgccgggcgggcccccgtcgtccaggcgagtcgggtgggggcgattggtggccaccggggctgcatgctcacacaatgcccctgggctcatgcgtgccagcagcctgacgcccaccccgctcacagatcatggacgatggcacgtggnnnnnnnnnnaggggcgattggtggccacaggggttgcatcctcacacattgcccctgggctcatgcgtgccagcagcttgacgcccaccacgctcacagatcatggacgatggcacgtggctggtccaccagtcctcggatcgcgacgacaccagccaggacagccaggacagcaacgccgagggccactttgcgcacgactacccaggtgggacagcagtgaaggaggaggctggctgggggactgtgtgtgccaagatgggccaatgctggaacttcacccgtctcttggtggtcctcagccctgcccccagggggaacactgtgcagtacacactcatcacgtcattgcctcactcacatgccttccgccagacgagtattcggcgagcacagactctggcgactacgaccccgacctggggtactttcctcccacgcggcaccgccgacgacacatgggaagcagcagcggcagcagcagcgacgaggatgcatgcaggacaggactgcgctccaaagacgatggccgtcgccacttctattgagccatgactttccttcccctggttgagtgccagcaaggcttgcggagcgatacaatacctcaacatgaagacaaggnnnnnnnnnnaactttcatttccctggatgagtgccagcaaggcttgtggtgcgatacaatacctcaacatgaagacaagggggagtccaagggtggtatgcagagcggctggcaacgccaggggcgatgtcagggacgcgagccagtacaggcagccgcccattcacgagccgccgcgtcacaggttggactcgatgagcgcccggtactcgcgcttcatcttgaccccgggctggtgcagcacccgctccttctgcttgaagaactggagcgtgggcgtgctgtgcactcccgccgcctgtgcaatctccgagtcctcctcgatgtcgatctcgacaaagttgacctgtttgggggttgaaggcagaccttgtgatggacttggtgaagctgcgcccaggcagtggtggcccgaggacatccccaggaaagccccgcgcagctgccttgcagggcgctctgggatgatgcaggcctcatcctcccttcctgctgaccgccaggcacactgaaatcacctcccacttcccccacacctctgcacacaccttgccctcaaactcgtccaccagcttgttcaggatgggcttcaccgtccggcagggcgcgcaggagggtgcagagtagagcaccatgaccaggccctgcgactcgtggtacagcttgcgcagcgcgtactgcccccggtgcttggtgctggcggggtcgaagtcgccgcgcgggaccgaggcgtgccgctgcggcgcggcggccgcatcccccgccgcggcgccggcgtcggcgccggc

SEQ ID NO: 41364 - DNA, 77 bp, Chlorella protothecoides
agggcgcggcccaggagccgtgtgtggggcccagccgggggggcgggggcgacggcctgggtggcgacggcctgggt

SEQ ID NO: 41365 - DNA, 61 bp, Chlorella protothecoides
cttagagccatgctcgcgggcatccatgaagctcatggcgccacgctatgcagcgagacca

SEQ ID NO: 41366 - DNA, 2336 bp, Chlorella protothecoides
  modified_base (113)..(167): a, c, t, g, unknown or other
  modified_base (532)..(541): a, c, t, g, unknown or other
  modified_base (1136)..(1145): a, c, t, g, unknown or other
cccgcctcccccaagccctccccgaaggcctcccccgccgccgcgcccaaggccgcccccgccgccgagagcaccctggcggccgcctccatccagccctccccggcaatctnnnnnnnnnnnnnnnnnnnnnnnnnnnnnnnnnnnnnnnnnnnnnnnnnnnnnnncccctgctccgcccccacccgccctccccgccaccgtcatcggcagcaacgccacctacgacaccatcaccgtcttcttcagcggcgagagcaagggcgtgcgcagctacaacctgctgtgcctgcccgagggcaccgaggccaccgccttcaacaaccaggccccaggtgagctcccccgcgtgtggtgtgacctgctcttggactcgggggttttaccggctgctgttccagcccctggcagtctgccgtgcgctaccagtgccaccaagcatcgcaagtatctcaaatcttcctcccctccccactaaaacacataggctccgtggtcgttcccgccgactccaccgaggccaccgtgaagnnnnnnnnnnactcctctccccactacaacacataggctccgtggtcgtccccgccgactccaccgaggccaccgtgaagaaggtcgaggctggcaagtacacctgcaccctcaccactatctccactgccaacgacattgcccagaccagcctgaacgtcgaggtccccgccgcccccatcgagctcgtgccggcgaccatcatcggcaccaacgcctcctacgactccatcaccgtcttcttcaacggccagcccgagggagtgcgcagcttcaacctgctgtgcctgcccaagggcaccgagacacccgccttcaacaaccaggctgacggtaagtttttgtgacgggtgctgatgttggcaggggactgattgcgagacttgctgtggatggcctcctgggctgcatggacggccacacctgcaccttttgccagaggcttgccacccgggcctgggaccacacgcttctccacccttcccttgccctgaccagcaaccagtactctccactcacccccctccctctccctccccccacccacataggctccgtggtcgtgcccgccggatccagcgaggccaccgtgaaggacctggagnnnnnnnnnntcctgaccagcaaccagtactctccactcaaccccctccctctctctccccccactcacacaggctccgtggtcgtccccgccgggtccagcgaggccaccgtgaaggacctggaggccggcgtctacacctgcaccgtcaccgtcatctccaccgacagccagatcgcgcagcagagcaccgacgtgacggtcccgcgccgccccgtggccgtggccgcgcccgagatcaccgccgtggatgccacctccgactccgtcaccgtgcgcttctccggcgccaaggccgacgtggccaaccacaacctggcctgcgcgtccgtggaggcggtggccgccttctccgcctcgcccttcaacaacctggcccccggctccgtagtggtccccgctgacgccaccgaggccaccgtcaccggcctggcccctggcacctacaactgcaccctcacctccatctccaccgacgacctcatctcccagtccagcaccgaggcggtggtcaagcccgcgccccccacccccgccagcatcaccggcagcgaggccacctacgacgccgccacgatcttcctggcctccgcgggcgagggcgtgaaggagaaccgcgtgtcctgcaccaccaaggccggcccgccctccgccaccgtcactgtggagcccagcgtgggcagcgtggagatcaaggacctggccgcgggcgactacaactgcaccgtcaccaccgtgggcgtcaatgggctcacctccgcctcctccaccaccctgaccatcagccccaggcccgagccgcctgcggcgccctccatcattggcgccgcagccacgcccgagggcgagatcaccgtctacttcaccggccccgccaagggcgcctctggcttctccctggactgcagccccgaggaggccgcggacaaagaccccctggccgtcaagctgagcgccagcgcaggcaacggcacgctcaccggcgccacccccggcccctacaactgctctgtcaccacgctcggcgccgtcagcggcggcggctcagcctccgtccgcgtcaccgtgcccgaggccgagcccgaggcggcgctcacccccgccggcaagaaggccaacccagtcaaggacggcgcaaaggccgccgcggcacccgccgccgaggtgcccgcggccgccaagcccgtggcctcccccaagg

SEQ ID NO: 41367 - DNA, 97 bp, Chlorella protothecoides
gggtcagggcgggaggaattacacgaccacacgatagaatcaaaattcacaatggatcgcacagtggaaggccagcgaggacgcatgctggtgtcgc

SEQ ID NO: 41368 - DNA, 77 bp, Chlorella protothecoides
tgccagcgctggcctgcagagcacacgacagcagtgtcgaagactccgtctccgagtcgcagacctgcaccttccac

SEQ ID NO: 41369 - DNA, 79 bp, Chlorella protothecoides
ccagggcatggagagaaccataactatgtccccctgtctcccgggcagcgtccacctattggaccatgcagactggaac

SEQ ID NO: 41370 - DNA, 70 bp, Chlorella protothecoides
gggggggaggcggtcgtagcggggcttgagggtaagagtgccctgcacccaggcctcaccggtgcacact

SEQ ID NO: 41371 - DNA, 113 bp, Chlorella protothecoides
ggatctgctgacttgatgactcgattgggctgcgtcgacatcgcggcggccagaccaggttccagagttgcagcacccagggaaccctcaccctgaaggcctggggacgtctt

SEQ ID NO: 41372 - DNA, 161 bp, Chlorella protothecoides
ctgctgtgctgccggcgagtgcagagtgtgaggcgagtggcctgggacccctttggtgagcacgcgaggccggcccgtcactcacgttctcagtacgtcacgcgcgtgcctgcccaggcatcagcaaggccgcagctgagcgcaggggggtcatggtacag

SEQ ID NO: 41373 - DNA, 61 bp, Chlorella protothecoides
caggacggccagcatggcgggctaggcagggacctcttttgccgcatgggcggcatggtgc

SEQ ID NO: 41374 - DNA, 105 bp, Chlorella protothecoides
gccggggggaggggtggtggtggggtgggttagggttagggttaggtttaggtttttgggttaggtttagttttagtggggttagggttagggttagggttaggg

SEQ ID NO: 41375 - DNA, 61 bp, Chlorella protothecoides
aagatgaggcggagcggatgcgggagtcagtgtgcatgggaatgcgtctggcagagcggtg

SEQ ID NO: 41376 - DNA, 89 bp, Chlorella protothecoides
tgcaaaagttgagctgccttgcatattgttaaactttatctgatactggagcgtagcccctcacagacccccattatctcaaatctgca

SEQ ID NO: 41377 - DNA, 61 bp, Chlorella protothecoides
ctgcatggccggcttcaactcctccatctttgcctacggccagacgggggcgggcaagacc

SEQ ID NO: 41378 - DNA, 66 bp, Chlorella protothecoides
aactgacctgttgagatggaatcccaactctgcccccaagcaatgcggctgcatcagggtctggga

SEQ ID NO: 41379 - DNA, 130 bp, Chlorella protothecoides
gccctccatggggccggtgccctggcgcagtgggggtgtttggcttattttggtggggggggtgctcatctgctgcggcccccgagtgcctcgtgtactccacagagacagcagcgcggccctctgtcac

SEQ ID NO: 41380 - DNA, 71 bp, Chlorella protothecoides
ccaggaggacagtggactgggcgatgcatgcttgagtacattctttgcagggcagtccagctctttcccac

SEQ ID NO: 41381 - DNA, 76 bp, Chlorella protothecoides
caaacacctggcagaaccgcggcccgaccgcccgcacacccatccacccacccacccagtgcgtcacggctgtgga

SEQ ID NO: 41382 - DNA, 74 bp, Chlorella protothecoides
caggctgcggggctgcggcggggtgcaggacccccaggcagaaacacgcccgcatcagggcagccggccctcca

SEQ ID NO: 41383 - DNA, 71 bp, Chlorella protothecoides
cagcgccgtactccccgccactcgctgcattgcaccgcgcatgttgagtgggttgcagggtcggcctccag

SEQ ID NO: 41384 - DNA, 61 bp, Chlorella protothecoides
agagttgggtactgggtggaggggggggggggaggctgcaccaccaaggcgggagtgaaag

SEQ ID NO: 41385 - DNA, 69 bp, Chlorella protothecoides
caagtttgcagacgaacacccgcacctccgccccccccctcctacatccaagtccatgttgcgggtgtg

SEQ ID NO: 41386 - DNA, 5413 bp, Chlorella protothecoides
  modified_base (470)..(479): a, c, t, g, unknown or other
  modified_base (1803)..(1812): a, c, t, g, unknown or other
  modified_base (2197)..(2206): a, c, t, g, unknown or other
  modified_base (2784)..(2793): a, c, t, g, unknown or other
  modified_base (3258)..(3267): a, c, t, g, unknown or other
ccgggcggcggccgcggcgcgacggcccgcgtcgccgccgccctggcccggctggagggcaacggcctggcgcggtatgtggcgcaggacgggtcgcccgccgcgctggcggagggcgtggccgcgcgggcaggaggcatggtcctccccgtcaccagcatcggcagcgcagaggtgaggggggagcggggcgattgggtggggtgggggctccctgctgatagtggtggctgcgcgcgcaagtgtgagttcggggccgagggggcctgggcggaggtggatgggccagacgcagtgcctggcaggagccaagaaatccgggctgacgccatcagccaggcgccatcaccatcctcactcctttacacaccacccccctgcaaaccaacacaggatgtcgatgcgagcttgaacgaggcggtggcggggaagggcatcatcctgtatggcagctgggacctgcccgtctnnnnnnnnnngtcggggctgacgccatcagccaggcgccatccccatcctccctccctcccccccccccctttctgcaagcacaggacgtcgatgcgagcttgaacgaggcagtggcggggaagggcatcgtcctgtatggcagctgggacctgcccgtctcctcggtgcacgtgggcgtggacgacgtgctgcgcttcctgcccccgcccccggttattgaaggcgtcgaggaggtgggcgcgggggggccaggcccggacccaccctcggacgccatgccctgacgccgccggcatgctgtacgatggagagtaaagcccgggtcgtggagggattgcggtgcagttgttgccgcatggtctgagggagaggggggccgcacctggccgccaggacacctcagcttcccgggcgagtttgggtgctgccaggcacccacaccgacgtgaagggcgacacgtttcatggcgctcttcatcccgctcgcacagtgaggtccccgtgggttctcaaacccagatgtcatatttcccctactgaaaagcccaacgaggcccgatcagtccgcagatcgtcgtgcgacacgctgcgagactggccttctgaaagtgtgaacccctcgccgaggaagggaggagcgtgaccatggtatatataagcaaaggtatgccatggtattgcggagtcggtcgatgggctgtccgccgatgtctgtctgccggagcccagcccgtcacaccgcccagacacctccagacacccactcccgcccgtgcacaccgctgcagggaaggtcggcagcaggcggagcagcacacatgccctcctaggattcttcatcgggatatggaacctcctgtccctcttgtgagcgcaggggagagtgggatccccgattggtgccccgaacaggcctgcaaaggccactgcctgatgctgatccccacttcccctccctctccacagctttcgcacgctcatcaaccctgcagcggtactagaacagcgacaacgagacagtgatggaggagggggacacggcaggactggggccggcaacagcggaaggagcaggccaaaccgcgtgactgggctcagcgacctgggcagtggaggaagtgagtgagggcctcgctgtggctgcgacggacagtgtccgagaccggcgggtacagcagctcctgttgggagatcgagctcctggattgcaccctcagcgcccatctgcaccccagatttccccacaccggtgccttcctccggcccgcaggtatcccctttggcggagggtgctgtggataacgaggaggtaagggggctgcatcccctccnnnnnnnnnnaatgccttcctccggcctgcaggtatcccttttggcggggggtgctgtggatgacgaggaggtaagggggctgcatcccctcccctcccctccccatggaccctacatccctgcatacgtaccatgcccccctctcgtctgggcgtgaggaactcccagaccgtgctgctccctgggtgaacgaggctcacggctttgaccctgaaacccaccctacacagaccaaacccatgccccaagccttgcgcctctgtaccacttgtaacactagacttggctgcaggcgcctccctggggcacgcccagggggctcagggggcgggggtgacctccacggtcgcgtgcatggaagccgagaagcagccagcgcccgtctaggccggcnnnnnnnnnnttggggcacgcccagggggctctgggggcgggggtgacctccacgatcgcgtgcatggaagctgagaagcagccagcgcccgtctaggccggccccgcggccgccttcctgttctcaatcagcctcaccgcccctgcgccggccatgtacagccccaccaggggcacggcgagtagcgtctgggtgaaggggtccgtggagggcgtgagcacggccgcggccacggtggcgcccaccacgacgtacttccactgcgccagcatggcgcgggaggagacgatgcccagctgccccaacaggacctgcagcacggggacctgtggtggcggtggtaagaaaggggggaggatggaggggggtgggagggacgcgcttgggagctggcagatgttgccacatgccggccgatgggcaggccagggcagggccggccttcagcacggcaagtggttggttgggggctggctacgagccacaaaaaaccctggacaggggcgcatcaggccctggagcctcacgcaccgcgcgccgcacctggaaggcgaggcccgtgctgagcatgagcacgaggacgaagnnnnnnnnnntcggccgtcagcacggcaagtggttggttgggggcaggccatgagccacagaaaaccctggacagggtcgcatcaggccctggagcctcacgcactgcgcgccgcacctggaaggcgagccccgtgctgagcatgagcacgaggacgaaggagaagtactggtcgatggaccagagggactccaccgcgccgtcggcgtaggacacgaagaaggatagggcggcgggggccaggacctcgtaggagaagaagaggcccaggtagaagagggcagaggagccgaagacgacgggggccaggaaggagcgctcggagcgggtgaggccggggattacataagcgatgatctcgtacagcaccgtgggcatggccagcagaatcccggtgtagcccccgacctttgaggtggggaatcggggagggaacatggtttggatggggagaggagggtatgacagtcgcggnnnnnnnnnngatcccggtgtagcccccgacctgggaattcggggaggggacatggttgcgatggggagaggagggtatgacagtcgcggacgggagtccctgctgggctttctcaaaggtggggaatccagggatgcacaaggagacacctgaggcctgcattgccgggcggcctcgctccatgtagaaacaataaacaggggggccttgccggcgttgcttcaggctgtgaattccactccgctcaggcacgcatgatcccctgcactctgcctccctgcccggggctggtcgtgaatgagagaccactctgcaggacggcggtgcacaccccagccaccccatgcacgcacccccagggtcagcccaccttgagcgtggtgaagaagaactcgcccggggagagctggaggaagcggactccctgctgggccactggtgcctccaggaagagcaccaggtccttggagaaggcgaagcaggtcagcaccgccacggcggcggcgatgccacccaccagcacccgctcccgcagctcgtcgaggtggtcccagatgggcatctcaaacccctgagtcagctcctcctcgtccgggttcagccatctggccaccgccgtgcgcgtgtcctcggcatccaggatgggcgggaaggagtctgtttgggggaagacacatgggggggagggctgggagatgaaggtagaaacggcggccctgggacgtgggcatcgagcggtccgccaggagagtgcaccacagcacatctcccaagaaacaaagctgcactgcaggattgcagaccacatgacgtttgtggcatgcgtagagcaccaagtgctgcttcccattcccattgccagtgagctctggtcgcatgctgtaattatgggaccacctcccatctgggtcatgaatgccgacaccgtcttcccacgcaccaagctccgaagcacgatcattgcgcgctgcatcatcttctgaagcctttggccttatcctctgccgggcgctccatgtacgtgtgacacgcttgccggcaatatgcctgtgagcaggcctgcatggctgacacccggcctcgaatggcctgacacggcagccaatcgtggatgcgagcatcatttttgaagcctgttggaatactccacgcatcagattgcagactttccgggcttcccctgtatgtcgcatgcagtccgtgtcgttgttccccgtcatgagttaggacatggaccttggtctgggggtaccacgggtgtaccgctgctgaggagggacgctcggatggtgagcgaggcccgcctcatctcccggtcagtgcctcgcctggacccatccatttcaccaatttctgcattgcgttgggatgcactaggtttgcacacccacacatccctcctttctccggccccagagcgattcccacactgagcaaatcctagctgcaggccttcactattccgacacacgcaggcccacgatagcgcgcatccctgcctctccaactcgatccagcaacaccctgagagtctgtgcacaccaagatgtcagcccttgcgcctgcaccccccgcccagcatcaacccggcaacgatggtgaatggaaggcgtccctggccctcccccccaaagacaatcgcatcaagactgtggtacgtcatgagcaccaggagggaatactcctccacgcccgggcgtggcttatgaggtaccgaaccacctgtaccttgccaagctgatgactctgagtgcccggcgtaacggtgctgtgccctcctcccatctcgccaggatgtcacggcgacgaagggcaacagcttcgaggattacttcctgaaaaggtgggtccctgagggtgtccgggcctttgccccgctggttccggcaagtatatctcccggccagcggggtggtgggtggagtgttctttgggagggccaaacaatttccctcctcccctggcttgtcatcttcaccccgcttgcgtctcgttcgctcttcatcatgtgaggggcaggtgcgcccgcctcgtacccttccatgcctcgagcccagggagctcggttgtgatccctggatgctccatctcctgcgcctgctgaaaggctcgagcaagctcactctcgatcatcccttgactgtctccccccccc

SEQ ID NO: 41387 - DNA, 63 bp, Chlorella protothecoides
cgcaatcggcgtgcgcagcgcgcggccgaggcggcgctggccccgcccgcctcctgacctgcc

SEQ ID NO: 41388 - DNA, 61 bp, Chlorella protothecoides
ctggcagggtcccacacacagacagccatgccgcccaatccacagcccacacctgggcatc

SEQ ID NO: 41389 - DNA, 62 bp, Chlorella protothecoides
atatcctgccaagggctcgacatcaatcgagaatgccttcctcacatcggggagacagcaat

SEQ ID NO: 41390 - DNA, 61 bp, Chlorella protothecoides
cgttgtgcagaggctcaaagtcctcggcggggatgctagcctcactcctcctgagcttgga

SEQ ID NO: 41391 - DNA, 80 bp, Chlorella protothecoides
gcgaaggcctctcgggctgatgtgcggaggagaggaacactcatcccggacctgaccttgcaaggacccattccgtaccg

SEQ ID NO: 41392 - DNA, 125 bp, Chlorella protothecoides
cgccatcctccgcctcctccacagggtgagtggggtgggcgggggtgcctggtcgccatgcccctttgaatcccaccgaaaggcctggcggggtttggcagcaccaagccgaggatgcacagcag

SEQ ID NO: 41393 - DNA, 1256 bp, Chlorella protothecoides
  modified_base (439)..(633): a, c, t, g, unknown or other
  modified_base (741)..(825): a, c, t, g, unknown or other
ggcggaggggaggggggcggaggggagggggaagaggagggggaaggagggcttgcaggcgaggttaatggagagctgggtggcggtgggcgatgaggtggagacggcggcgggggtgttggtgggggtggtggtggaggactcggagggctggggctttgtaagcacacagcgttgaaataggtctcctggtttgcgtattcagtgcagatgagcagcaatggaaaactgaaactcccgcatgtaccactgtccgggaataaaaaaactgccggacatgccgagacacctgttggaactgttgcgatgcagacggcggtgggggcgccgtctctcatgcatatcttagggtaaaggctttcgccacaatttagcatggtcatcacgggtgcagtcgagcaatcaccaggtggggatggtggagggctgggaggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtggagggctggaaggtgggggtgttggtgggggggatggtggagggctggaaggtggagacggcggtggggatgttggtggggggaaaggtggagggctgggnnnnnnnnnnnnnnnnnnnnnnnnnnnnnnnnnnnnnnnnnnnnnnnnnnnnnnnnnnnnnnnnnnnnnnnnnnnnnnnnnnnnnaaatggtggtatctgaggggacaccggcggtgaagatgggggaggaaatggcagagacgtgaaggggggaagggttgggggcgaggtgggggggtggggtttgggaggtgtctttgaaggtgagaaatttttgcctggacgtggggaggaggttcccttgggaggagggggtgatgcattttgggagggcagcagggactgcttctctgggaccggagggggtgacgccttctctgagggcggagggagtgacgacttcttgggggccggtaaggacgtctctgttcggacagaaggctgtgattgattgttgtcctggaccacagactggtcgacttccttgaggctgcgcatcttcagagttctctcaacactgaccgcctttttacactgaaggctaactttctcgttgttgtacacacagtttgcgt

SEQ ID NO: 41394 - DNA, 73 bp, Chlorella protothecoides
tactcctcaaccccgacccccttcccagtcaatacatgccacgcccagcaggtgcccgagctgtgggcggcgc

SEQ ID NO: 41395 - DNA, 71 bp, Chlorella protothecoides
atttccattttccattttcgataaccctgcgccagtgatcgaccacgtggacgaatgggcgcatgaccgtc

SEQ ID NO: 41396 - DNA, 61 bp, Chlorella protothecoides
ctgacaggcctctgccagaggcaggttggggcctcaaaggaatggcactccagcgggcaaa

SEQ ID NO: 41397 - DNA, 72 bp, Chlorella protothecoides
tgccgccccgttgagcgccataacggcggggcatcacaaaggcggccaccaatcagtgcacaaatatcggga

SEQ ID NO: 41398 - DNA, 70 bp, Chlorella protothecoides
tgcccccgactcgggctcggtgtagccgctacccagagagcctgccactcccactgccgttgtcgtttcc

SEQ ID NO: 41399 - DNA, 77 bp, Chlorella protothecoides
ctgcttccacaggtgtgtgtgtgtgttgtgggtgggtgggggggggaaggccccgtgatgatgggcgggcatgcagg

SEQ ID NO: 41400 - DNA, 61 bp, Chlorella protothecoides
acatcaccgctcctcatggggattggatggggcgggcccttgtctgcaccacagcagcaag

SEQ ID NO: 41401 - DNA, 61 bp, Chlorella protothecoides
ccaggttcaaagagtatgagattggctgggggaatgcattggattaggaaggcttttagcg

SEQ ID NO: 41402 - DNA, 61 bp, Chlorella protothecoides
actcaaagaaataaaaaaaaaaaaaataaaggaacctatgattccagaatcaacctccgaa

SEQ ID NO: 41403 - DNA, 89 bp, Chlorella protothecoides
accagggtgccagcgcagcaggtgcaggggtttcagtctctgctacaatgcccggcccgccgtcctcctcggagtcgctgtccagggat

SEQ ID NO: 41404 - DNA, 61 bp, Chlorella protothecoides
gcaggacgacaacagcgagccactggcagggggggttggttgggtcggtgctgtggtggct

SEQ ID NO: 41405 - DNA, 71 bp, Chlorella protothecoides
gaccttgcatgcacggcgcactgccgagcaagcttggcaactgcaggatggggtgaccccagggggggggg

SEQ ID NO: 41406 - DNA, 78 bp, Chlorella protothecoides
ggcgtcttgaaagtgcaaagtagcacttgcggtgacacctctcgtcaggctgccggtgaccacgcatggcgagacatc

SEQ ID NO: 41407 - DNA, 33435 bp, Chlorella protothecoides
  modified_base (404)..(413): a, c, t, g, unknown or other
  modified_base (1729)..(1738): a, c, t, g, unknown or other
  modified_base (4619)..(4628): a, c, t, g, unknown or other
  modified_base (5150)..(5159): a, c, t, g, unknown or other
  modified_base (5960)..(5969): a, c, t, g, unknown or other
  modified_base (7718)..(7727): a, c, t, g, unknown or other
  modified_base (7835)..(7844): a, c, t, g, unknown or other
  modified_base (7908)..(7917): a, c, t, g, unknown or other
  modified_base (8157)..(8194): a, c, t, g, unknown or other
  modified_base (8656)..(8665): a, c, t, g, unknown or other
  modified_base (9167)..(9176): a, c, t, g, unknown or other
  modified_base (10062)..(10071): a, c, t, g, unknown or other
  modified_base (10163)..(10172): a, c, t, g, unknown or other
  modified_base (10247)..(10256): a, c, t, g, unknown or other
  modified_base (10458)..(10467): a, c, t, g, unknown or other
  modified_base (10897)..(10906): a, c, t, g, unknown or other
  modified_base (11274)..(11283): a, c, t, g, unknown or other
  modified_base (11814)..(11823): a, c, t, g, unknown or other
  modified_base (11920)..(11929): a, c, t, g, unknown or other
  modified_base (12411)..(12420): a, c, t, g, unknown or other
  modified_base (12845)..(12854): a, c, t, g, unknown or other
  modified_base (13026)..(13035): a, c, t, g, unknown or other
  modified_base (13285)..(13294): a, c, t, g, unknown or other
  modified_base (14631)..(14640): a, c, t, g, unknown or other
  modified_base (15308)..(15317): a, c, t, g, unknown or other
  modified_base (15756)..(15765): a, c, t, g, unknown or other
  modified_base (18467)..(18476): a, c, t, g, unknown or other
  modified_base (18701)..(18710): a, c, t, g, unknown or other
  modified_base (19753)..(19762): a, c, t, g, unknown or other
  modified_base (23300)..(23309): a, c, t, g, unknown or other
  modified_base (24418)..(24471): a, c, t, g, unknown or other
  modified_base (24609)..(24618): a, c, t, g, unknown or other
  modified_base (24687)..(24696): a, c, t, g, unknown or other
  modified_base (24759)..(24890): a, c, t, g, unknown or other
  modified_base (25592)..(25601): a, c, t, g, unknown or other
  modified_base (26327)..(26336): a, c, t, g, unknown or other
  modified_base (27060)..(27069): a, c, t, g, unknown or other
  modified_base (27349)..(27358): a, c, t, g, unknown or other
  modified_base (27423)..(27432): a, c, t, g, unknown or other
  modified_base (28357)..(28366): a, c, t, g, unknown or other
  modified_base (28883)..(28892): a, c, t, g, unknown or other
  modified_base (29565)..(29574): a, c, t, g, unknown or other
  modified_base (29833)..(29842): a, c, t, g, unknown or other
  modified_base (31288)..(31297): a, c, t, g, unknown or other
ctgcgccgcgcccgcgcggcctcgcccgcatggaggcccggcccagcgctgggcgacgtgccggcacgcgcccgggcgccatcctctgtcggcgcggggtgggacccatgctcgcgaccctgggcatctgagccacgcccgcccacctggtcccccgccggcccgccgaggacggagttgagcaccgcaaacaggccgacggaacccgtctccatctccacctggtgccgagctgccgccgcatcctcgtggcgcgcggcggccgcagcctccgccttggctcgcctggcctgccgcccgctccgtcgcttccttgccggagctggtggagggagggaggagttggcagggggctccgtgtgcgagcttggcctcagtgtgcatgcctaggattgcatgccatnnnnnnnnnntttccttgccggagctggtcgagggagggaggagtgggcaaggggctccgtgtgcgagcttggcttcagtgtgcatgcctaggattgcatgccatgcccccccttcctctcagtgcagctccgcctcgaccgctaccggatgctccaagctccccacattcggcccgcctctggccccacacccacctgccacgcccaggccggcaccctgcgttagaaccacggtctgaaggggctgggtctgcccctgcccctgcttgcccagccccgcgccaccataccccatggccaccatgagcctgcctgccaccccccgcgtgtgcgcttcccagctcgcgagtccgagagggttggtcacgggcactgggccctccccggtcccttcctccttgctgtcatcagaggtgacgtcggatgaggacgctgcctcgtattgatcacaggaagtccagctcgggtcggcgccgagctcgtcttccccatgcccagccggcgcaggtgcgagatgggcggcggggacggtcatcagggtgcctggtgctccttggacggaccccctcacccggacgagcacggcgccggggccagacgccgaagcccctgcctcgatcctgccacgggaccagagcctgcagccgggctgaggggccaccagcaccgaggcaccggccgccgtcggtggggcgagggcagccggggcgacggccgtcaggcaggtcgctgccagtcgcaggggctgcagctggcagggcctgcacagggcgatgtggtctccgggagtggcgctggcgtacagtcgagcacagttggtcatgatcgcaaacagtgcgtcaggccgccgcaaagggtgtcatgaccgatcctccagagaaacctgtggggatgcccgagcagcccatcctcacatgcatgggtggcagaaggatacctcgacgagaccgtcagccccagccccgctctctaccaggccaagatggatccgtccatctgtgtgtctaaaaagtgcccggttcccaggtctgagcgtggcatcagtctttgcggcggccgcatccagccgtctcaacaggatatcctttgcgagctggagcagggcggcctctacatcctcagcaacggcctccagctccctccgtagctggcaaccgggcaggtggaggagggagggtgtgtcgggcactcatgacaggcacaccttgagatcgcccctgggcggcattcccatcctctcgctcgatgcaaacgattcccagcctccccccttgcggaaactcacgtggatgatttcagggctggcgtcctggtcggccagctcnnnnnnnnnnccccccctgggcggcattcccatcctcgcgctcgatgccaactattcccagcctcccctcttgcggaaactcacgtggatgagttcagggctggcgtcctggtcggccagctcggccagggccgctcgcgtctcctcgagctgctgtcggagctccgcctccaaagcctcggaggccatgccgatgggttgccggatgccgtcccatgcacatggtgcagagccccggtcacccggtacatgttcctcccgcggatcgcggtggggtgcatcgctgccgtgccttcctctatgctctgcgtccccacgcatgtgtcgcttgcgtcacagcggcgccgtacaggcaggccgccaccggcctgaggccgtcgcaccccggctttcatccgcctcgctgaggttttacaattgagtcaacatcgggaggtggcgatggcaagagcgtttcgcagtactcatcaagcgcggccttcatggccagggcatgcagcggcggctggtgcaagttgaatacaagtgttcgacagtaagcagactgaaaactgagcactacagttgtgagagaacgccgagatgggtcttgatggggggccacggcgagggcggggggggaggaggaggcaatgtcctgaggaccgggggctcggactgagggccctgctcaggcacaactccagggctcttcaggcggcccactcctctcctcttcatccccccaccctccctcctttcctcactcccgctccacgccctccaccttctgctggatcaggcgctgcgccagtgccacgctctccggcggcccgctgatctcgcagctgcggtcgttggttcccggcaggcactccccccgccggctgatgcggatgcgcacccccagcaccgccttgatctggttgatcactgcgccgccgcgcccgatcaccacccccacccggtcctccggcacggccatgaccaggctggtggtccccactcccgccgccgccgccgcggcagcgtggggcaggaaggcccccgccccgccgcccggtggcggcgcggcgccgccccaggtctccgccggcgccgcagcgggcggaccgaagccgaggctgacgtcggtgagcagcgggtagtccgggttctgggacagcttggtcagcaccagggccaccgcgcgcagcagctggtcgggcgtgcccgtcagccgcaccacgcgctccgggggatcacctggccccgggggcggcgagatgttgaacaccgcgcccgacgcgtccttgaaggagcggatggtggcgccgccgcgcccgatcagcgtgccgcagagccgggcgtgcaccagcatgcgcagggccatggcgccgtcctcgcgcgcggccacggccgccagcgccgccagctccgaccggaaggtggccagcactgcgtgcagcgcggtcagcagcgcgtccagcgtccccgtgatcagcagcaggcggtcgtgggcagggggggtgccgaactcgcccagcgtgccgggccagggctccccaatcttgctcagctggggtggggaggggtgggaggggggaatgggcggatgggcggggaggaaatgagcggcagggtggccgttgaaggggggggggctcctggcgagctgcaccaagggacacatgcgtcgcctgcaggccgccgccctgcccctgggggccaggcccggcgcaatgcaggcagttcgtctgctccctttggaccaccgggcgcggaccaggccggcctggccagcacgccccacctggatcctggcctgggactgggcctggatgtccgacacgttcacgccccccttgccgatgatgctgccagctgccacgtttgggaccagaaactttacctgcgcggggaatggaagggttcggagcgtcacgcgcggtacgcgcgagatacgggcggggggttgcgtcccggatactgccccggcaccctcaccgcgaggcgaggcgcatcctcctgggcggcgtggggggcgtcgcccggctcgtccaggtacagctgtgcatccaaaacgtccgagtcgtcggcctggggcggggggctggccccctccatgctcccggacatggcgtgcagggcaccggtccagtggggtgggtgggtggtgcaggcccttgtcgagcgcgcctcaacgcggtgttttgacagactccttatatctccatgactaattatagaacagcatgatacaaccagggcgtttctaagctgtctttgcacgcccgagggttgtgattcacgttttcacccgacacacctgatcaagaccgcggcgcccgtacacacaagatcaggcagtgcacccgatcctgttagggaatctcacatacgatcccgctttcctgctcgtaggcccagcatacatgtcccccgatcactcgcacgaaggccatctacgctcagggcctgccacacatccctgggaccagagtgcctagcctcctcagcccgtggcctgtacgagcgcgcaccggcaaggcgagggccaacagttgtcccgaccttggttgcagagggcgttcaatgcatgtcgccgacgccaccgagctgggcgtgaacatccgcaccacccacgcccaggacaggcggcgtgggcgtgcggggaagcagcccaccctgctcgacacggcggtcaactgcatgcagtgcggcaaggtgcgcggtaaactggtagatgctacaccagccggacaccccagcacaccattccatcaggtttggggggggccttaggtgtgcagctgcacgaatggctgcgcaactcccgatggccccgctctgcctgcggccacaggtgtatgatcttcgcccggcaagccccgagtcggacgcgctgatcaaggcacagggcgcgtgctccnnnnnnnnnncccttaggcatgcagctgcatgaatggccgcgcaactcccgatggccccgccctacctgcggccccaggtgtatgatcttcgcctggcaagccccgagtcggaggcgctgatcaaggcacagggcgcgtgctccttctgcggcggctctgtgcgcctgcgctggagcgacggcacgtccttggcggcccccgccgaggagccccagcacgccgagctgcgtgccgggctgcaggagtacctgaggcgctcgcctgtccaggcatgcacagcgccccagccagggcaggaggcggagggcgctgcgaggcaggggtgcagcggcgccaccccgggggcttccccgcttggaccccgggaggagacgcccggcaggcagcgcgtgcgcccaaacccggggacatcccagcacacctacgtcccggggccagactgggacccagaccaggccgtctctggccgatgcaccggggtcaaagcacgggaacctgacaccaggggctcacgagcacgggcgcctgtannnnnnnnnnaacatcccagcacacctacgttccggggccagattgggacccagaccaggccgcctctggccgacgcaccggggtcaaagcacgggaacctgataccaggggctcacgagcacgggcgcctgtacccagcgggccccgcaggactataccgggcctggcaccatgagatcctggctcatcaaacgaggtaccggcctgtgctgagataggagcagatctgttgaggaacgccctccagagagtacatatggcatccagaggatggcgattgtgcgtccaggggtaatagctttgaggcctggcgtgttccaggctcacttgtgccagggagcagaacgtagttcattcgaatgcttcacccggggtgcctacttgcatggaaaaccacaggggtgactgacccatgagccgtgaaatggcggttggaccttcacatgttacacgcagcccttcaatgctttgtatctggagctgacaacatggacacatgttctcttgttggcgagatcaggcgtttgaagaccttgcagggcaaggggggctggtgggggcccttggagatcatcggcaccaccactttgcccaccctggaacctgtgagagggcttgctacctgatacccgcaagctctcaaacagccgcatgagaaccacgaggagaacagcatgccacgggctttggggtattctgttaggcgtgatgatggggggatgcaggatggctgtgtgcagaacagagccgtgtcagacagtcctcagcgagtattgcccccggggtctcatgcgtaagccaacatacggnnnnnnnnnnacctctttgcccaccctggaacctgtgaaagggcttgccacctgatccccgcaagctcttaaacagccgcatgagaaccacgaggaaaacagcatgccacgggctttggggtattccattacgtgtgatgatggggggatgcaggatggcagtgtgcagaacagagtcatgtcagacagtcctcagtgattattgccgccggggtctcatgcgtaagccaacatacgggtcttttccgtccgaaaaaacatgccgagtctacgctgagttttactatgacgatcgagcggtcacccagcacatctccccgagcggagttgatccttcccatgaggatcatctacgttccattcgggggtatcatcttgcattcggatctcgaccatcccaggacgattctgctgtcattcgacccgagccatcttcagacctcacaatatatgatacatcaacactcagtatgggtctaaggcttccatcgcagtctggactccttgttccgcgtagccttgcccagcccctcccccccgaccagcttcgaatataccccacggagatccggctatccgcagctggcggaccgcttgacaattgtcgcccgcacatcctcagcctgaagctgcgccactatttaaagcaaacccaagtctacacactcttccatctgttcattgtatctgtgtgtcgcgatgagcatattcgcgtggctcctagtcgtggcattggccgcatgtgcggccccagatgcggtgggcgccctcgcctccacggctcctcgcaagtctgcccccttccagacacgcaacctgatcgaaaaccaccagaaaggcttgaagcttagggtttccaccacctctatcgacacctcgggccagtatgttacggtctcatggtccggcgtcgaggtgcgctgcggggtgaggcggggctgcgacggccagcaccagctccatcaccctaccaacccatggcatcccttcccacaggacccagctgacacggatatggttgccatgtacctggcagacagggatccatccgaaacctggcccatgaagtacatctggacctctacggtgcccaatgcccagaggaggggtgctggacagtacttgtgagtcgttgagctgtgcgattatctgctgaaggtgcatgggggcagaggctactggatgagccatgccttgttccataccctttttgtctggaatgaagttgctgggcctccctcatggccaaatgcccaaccctgcaccctacacatttgtgcctcctgcagcttccaggtctacaactactatgagcccatcaagtttgtcttcctgaggggcgcatttggcgacaagttcatcgcggccacctcagagaacatcacctccaccaacccccagcagcccacgcaagtgaagctggccttcactgaggatccgaggtgggcggggatgactgccggttgaggtactggccatggtactggccatgggcgtgtggcccgccggcctcagcctcctctgtgcgggtgctcagtgtgaccctggcccgtcatagggtgcgctctccggcctgacattcccttcctcccatcccccggtgcagcgagatgcgggtcacctggctcacccagtatgagggcaaccccatcatcaggtacagtgggcaggtcgtgctgcttgttcagagcaatgaagagtcagcggggaccccgcccaccaccccttccccctgctcttccccctcctctccactcannnnnnnnnngtcaggtacagtgggcaggtcgtgctgcttggtcagagcaatgaggagtcagcggggaccccgcccaccacccctccccccctgctcttccccctcctctccactcannnnnnnnnncggggacgaggtgcgggggctgcgggctgacgtggcccagtagggtcgcatgggccagggcagnnnnnnnnnnggtacggcctgagcaagaaggacctgtccctctccgtcacggccaacgtctcgacctacacccctgctgacctgtgcgacgccccggccaactccactggctggaaggagccggggacaattaacagcggcgtgatgactggcttggagcccaacacccgctactactatgtcgtaggggacgaggtgcgggggcctgttggctgacgcggcccagtagggtcgcatgggccagggcagnnnnnnnnnnnnnnnnnnnnnnnnnnnnnnnnnnnnnntatcaccacctcgcacacacacacacacgaacgtgcaccgcgcagggcgagggcccctcctccaaggtcaccagcttcatcagcgcgcccacccccgaggacaccgttcacctgctggcactggccgacctggggcagtacaacgaggacggcagccgcaactttgcctactggtaccagtactacgagcccgccgacgagttctatgccatcgacaccatgcagtacacggtggggccgctgcctgagggtggccgcgggggtgaagagtgcctagggtgggttaggaccaaccgggcggccccagttgcagagtgcccttgtcatgcagcccttgacctcttaccggtccagctgtgctccagccacacgccgcccacacagcccctctccaaaccctgcctcagatgatgcacatgatcctggcggcagtcaacaacgaggcggagcaggacggcacannnnnnnnnnagggggtgaagagtgcctagggtgggttagaccaactgggcggcccccgttgcggaatgcccttgtcatgcagcccctgacctcttaccggtccagctgtgctccagccgcacgccgcccacacagtccctctccaacccctgcctcaggtgatgcacatgatcctggcggcggtcaacaacgaggcggagcaggacggcacagtggtgacataccctgccctgcacgcggaggcccggaccgggaagtaccactccgcctggcacaacggtgacgtgtcctacgcgcgcggcgccgagtggcaggtgaggatggggggggtgatggacgggttggggcgggggaagtcgatccagcgaagcccgcccctgtgcaggggcattttgtaccttgtaccacgaccggcgcctgcaggcgggaggacgccaggcccctgcgcgctcggcggctgggcaggtgcctgcccagccatgccgcaagcgtgcactcacactgtgtacannnnnnnnnncgccctgcacatggaggcccggaccgggaagtaccattccgcctggcacaacggtgacgtgtcctacgcgcgcggcgccgagtggcaggtgaggaatggggggtttggtggacgggttggggcgggggaagtccatccagcaaagcccgcccctgtgcaggggcattctgcaccttgtaccacgacctgcgcctgcaggcggcagggcgccaggcccctgcgtgctcggcggctgggcaggcgcctgcccagccattgccgcaagcgtgcactcacactgtgtacacaacccccacccggtcctcccacaccttcccctccctcaaccactgcagtgggacacctacgggcaccagatcgagcccctcacgagccgcatccccaccatgtacacgatgggaaaccacgaatacgacgatcccaacgcctacgacagcaggttcagcacctccgtggacagcggtgagcggctctggcacatgttttgttcaggcaattctctgcacgcacaaacacagcaatgtggggcatggaatcgctaggctttgtccaaaggccggtgtcgtggcagcccagacatccacaggcaatatccgattgtacccaaaccttcctctgctccctcaccaacttatgaatccccaatgcacacggtaccacaccaggtggcgaatgcggtgtggtgcagcagaagagggcgcccatgcccactgtcaccgagcgggacatgttctactccatcaaccacggccccatccacttcctgcagctcagtgagccggtggtgatggagggatgggggacagcgtgcccctgaggcttgcataccgcaggaaaaaattggaatgagagggagagggcagccacatgcgcttgccctgtgccnnnnnnnnnngcggtgtcgtggcagccgagacatccacaggcaatatccgattgtccccaaaccttcctccgctccctcaccaacttatgaatccccaatgnnnnnnnnnnaagcaaatgcgtccttcccccacacctatcccaccccacctcatcctgcgctcacagacaccgaggccaactttnnnnnnnnnngagcagatgcgtgcttcccccaaacctatcccaccccacctccacctgcgctcacagacaccgaggccaactttgagcctggttctgcacagcacgagtgagtcaggggggtcagaatcgggccgatctcgcagtgcctgtcctgctcactcccacggagctctttgaggacaggtctcggtcagtagggccgcaccgcccnnnnnnnnnntcagcacgagtgagtcaggggggtcagaattgggccgatcgcgcagtgcctgtcgtgctcactcccacggagctcttgaggccaggtctcggtcagtagggccgcaccgcccaggattcagtgagcaagccctcctccacccttccctcccgccctcacagctttgcggtcgccgacttggccgccgtcaaccgcagcgtgaccccctgggtggtggtcggcttccaccgcatgatgtacacggattcgtactacggcttcacccccacctccagccaggtcgtggcgaccgacatgcgcgccgcctttgaggacctcttctttgagtacggcgtcgacatgacctggcaggtgagtgggggcgtgctctcccgtatcaaggggatggggtgtgctgggcggggtagcaggaactgtcagcggtggggtnnnnnnnnnncgagtacggcgtcgacatgacctggcaggtgtgtgggggcgtgctctcaagtatcaagggatggggtgtgttggccggggtagcaggaactgtcagcggtggggtcgctgcaggaccattcagttcttcccatgcaacccctggacgcttcctcttcgaagcatccgctcgagggcaagccgctgccttgcatttgcccaagaccatgcccgtccctgacaaggaccgccaccctccaaccaccgagtctgatgctggctccctactccccgctgctgatcacagtcgccactccctcgctcccctccacatcaccaccctctgtccgtcccccagtatactcaccccccttggccccatggaccccnnnnnnnnnntcgctgctgatcacagtcgcccctccctcggtccctccacatcaccaccctctatccggcccccggcatactcaccccccttggccccatggacccccccccagggacacctgcacaactaccagcgcacctgccccgtctacaacaacacctgcgtcgactacgatgacgagggcgtggctcgggggcccatccacgtgaccatggggcacaacggcttcatgctgacccccttctaccagcccgaggcccccaacgcctttgacgggcagcccacctttgcgtcctttggctactgccgcgcggaggtcaatcgcacccacttcaacctccaggtgacagtgcttccctatggggttcaggatcggtcctctgcaaacgccctgcagccacgccacggggcatgacagggcacatccaggcccccttgccaccccttgggtcctcggggatggtctttccccccaaaacattggcttgttggcgctgacagtcctcccaccttcagccaactcaatctgcactctcatnnnnnnnnnngcaccctcctattcccatttccctcccactcagatgctcgactccctgcacatggagctgcgtgatgagtttgtgctgtacaagcccgagggctggnnnnnnnnnnacaccctcccattcccactttcctcccactcagatgctcgactccctgcgcatggagctgcgtgacgagtttgtgctgtacaagcccgagggctggcagctggaccgggaggccaacctgcaagtcatggccagcgtcacccccgtgcccttccccatgctgatcccgatctccggttggggcgcggtggtcgagaagatcttccccctgctggcgatgcaggacctggcaggggctctggaagcctttggaccatgtaagggggtcccatgatgaggctcgagggggaagcaagggtgatggtggggtgaacatgcagccccagccctcacccccggccccaatcacggtccaaacctctgcctcgctcccacagccaccaacatctggaaggtcctcaatggcaagttcagggatttggagggacccttcatgctcaagaccgtcaacaccatcatcgacttcgtggacgcgcgcctgannnnnnnnnnaagggggaagcaagggtgatggcggggtgaacatgcacccccagccctcatccccggcgccaatcacggtacaaacctctgcctcgcccccacagccaccaacatctggaaggtcctcaacggcaagttcagggctttggaggggaccttcatgctcgagaccgtcaccgccatcatcgacttcgtggacgcgcgcctgaatgccaccatcctggaggtacaaactgatgcatgcttgcagccaagggggtggtgatgtgtcgctagcacatgtcaggggctgtgggcgcacgttccctgtgcattctctgctggacggataagacgggagaagcctacccttctcgcggcatatgtcatcgtcctgaacctcaatatccatgcgcagatccttgcaaacggcgccctccccgcccccgctgagnnnnnnnnnnaaatgtgtcgcaagcatatgtcaggggctgtgcgcgcacattccctgtgcattctcagctggacggataagacgggagaagtccacccttgtcgcggcatatgtcatcgtcctggacctcactatccatgcgcaggccatggcaaacggcgccctccccgcccccgctgagnnnnnnnnnnccatggacgccgaagaatatctacggggtgaggttaccatccttgcagagagcggcggctccagccgctggagccctaatttccacccttgaagcattaggatgcttttgaatggcattccgtgttctacattgcgatttctagtattgctgtactccatcatgggaacatcaaaggatgggcggtcttcagtccgacgacggtattgaaggaaatgccgatgccctccacaaagcaaagcccctgcgcnnnnnnnnnngcattgacgccgaagaatgtccacggggtgaggtcaacatccttgcagagtgcggcggctccagccgctggatccctaatatccacccttgaagcagcaggatgcttttgaatggcattccttgttctacattgcgatttctaatattgctgtactccatcatgggaacatcaaagcatgggcggtcttcagtcccacaacggtattgaaggaaatgcagatgccctccacaaagcaaagcccctgcgctatggcgctgagagcgaccttcagtcgctgagatcggcatggtgggggcgggtgtcccgcccccaatcgggtccccccccctgctccagctcgctatcagcgccgtagcacgcacggtgcgagaaggcagcccggcctgcgacgcggcgcggtttcccggtccagagattgctgctgccgtgctcctcgagtgcatccgggcaggccacggtcatgacgcggtcatccatccccgccagtgccccgcgttcctggagctcctgggccccaggtgcctcgcgctccgaggcgacccgggccccggccgggccggggtcggcgcccctgcgcccaccctggtgcacctggaggcccacgccgtaccgcgcccgctgcagccggccccctgcgccctgcccggcctgcgctgcctgcacctcacggcgtgtccggccggcgtggcccagctgctccctgcgctgcgcgcgctgccgggcctgcgctgcctgcgtctggacgccgccaacgacgccctggtctgcgccgctgtgcgggcctgccccggccttgcctccctgcacctggccggcagcggctcggtcactggccgcagcgtgcaggcgctgtgtcacggcgctgcactggcggccgcaggccgaggggacgaggcctggccgccgctgcagctgaccacgctgtcgctcgcccgcacgggcgtcgcggcgggggagctcaagatgctgtgcgcgctgcgcacgctgcgcacgctggacgccaggggtatccggggttctgccgccgcgctggtcccgcttggcgcgctgctgggcctgacgcaggtccagacgggggttctggcttcctccgctgcaggggcgcagctggtgatgggcgggcgcctggactgctcgtgcagcagagaagcaggtggggcatggggttgaggggggccacctaggtagcaatcacccgcctgtttttgcaaagctatcctcacagtatgaggtcctgccgggctgcgggtgacacggcgccggtgctccctgccgcacagagccgaggtcggccgcggtccgcgaggcggcctgcgtgctggcatgggcccttgnnnnnnnnnngcggcgccggtgctccctgccgcacagagccaaggtcggccgcggttcgcaaggcggcctgcgtgctggcatgggcccttgtgggcatcccctgggccctgcgggagcaggcgccgccaggctttgtcctcgctgtcgacgacgaccttgggtcaagcggccacgagcgggagacaaagcgacgaaggcgcctggccccgtgatcgaggatcgcccctgttccttgctccccacctccagccccttgtctcttccctcactattcttcaccagcactgatacctacttcccagggatatcacactctgcacccctacggaatggcccacctgctttcacgtccagtgccctgcaagcatcatgcatttggctcagtttctcagtgcatgatgccggcagcgcccaacacccacgaccgcagcagcgcgggtcagctggttggctgcccggcagcggcttcccggccgctgacagactgccgtctttcccgtgacttgacgctgaggtaagggtgcgccgctgccgccgccacgtccagccggtcctcttgcttgtatgccaggcagctgtgcaatggtgtgggacaagggtggtggggattcgaaggtacagaggaaggagggtcaatgactcagcagtgcaaggaaatggcctgacgctgtgtgtgnnnnnnnnnnaggattcgaaggcacagaggaaggagggtcaatggctcagttgtgcaaggaaatggcctgacgctgtgtgtggcacggtccccaaccagaatccacctgcggatgaagtccttgcattcttgggagatggctggcttggtggggaacttcacctctcgcgcgttgagcatcacctgtgggatgtcaagtggcgtggcgggggctcagggagtatttcatgcatgctggagcagatttgggcacccaccagcacaaaggagccctgtggcttggggctccttttatcacaattagaagcacctcctggaagggcccctttggagcgtccagcttgagtggacaggttgcgtaccccaggggaaaacattcacaccgcacagggcccccaccttctcagaatgccaatcattagataccatccagactccctatccccccnnnnnnnnnncttttatcacaatcgaagcacctcctggaagggcccctgtggagcgcccagcttgagtggacaggttgcataccccaggggacaacattcacaccgcacagggccccaccttctcagaatgccaatcgttagataccatccagactccctatccccccaaggcatctgatcgcacctccccaagtaccctttcccccctccccccccctcctcagcgcacctcattcctgaggatctgttcctgggactggtcgtggccgaaggggcgcctgccaagcagcatctggtacagaatgacgcccacgctccacacgtccaccttgttgctgatgagcggcgtgcgccgtacctcaaagcactcgggtggcaggtaccagtaggtgccggcgccctgggaggtcagctccatgcccatcgtctggccgtcatcgaccaccttgctcagcccaaagtcggtgagcttgacctcccccacgccgtcaaacaggatgttggcaggcttgaggtcgtagtgaatgacggagtggggcttggtgttgaggtactgcaggccggacagcacctgggtcacaatggttcgtgcctccttctccggcagcacctggggtcagcggagaaggggtcggggagggggtgggtggatgggagcgtagaggtcggcgaggggttccggggccatgagcgtggcaatcattgaagggagaccccatcaccaccctgggagtaggacatttccaagacgccgatctgcaaggggccccggcgagcccgggtcccgcctccgcctctccgccttctctcccccgccattccaaatccagcgcccgccccacctcatgcagtttgcagtaggagtcgaggtcgccgccctcacacagctccagcacggtggcaaaggtgttgttgtcgatctcaaaaatgtccaccagcgacacgatcctggagcagcaggcgtgggaggaatgtgagcctcgatataccgcggtcccctgcgctgcaaccgtccaggcacgtcttcatcctccccctcctgctgtctgaaaccgaatgcaggccccggaggagggcacaccgacctctcccagcatctcaaccaccccatcctagcctcggcactccactcgcacctggggtggtgcagcttcttgtggatgtggtactcccgcaccgagtgcttgacataggacgccttcttcagctcgctccactgcccgttcagctggtggatcttgcaggccacgtcacgctgactggacaggtcaaaggcacggtacacctccgagaagccgccccgacccaggaggtccagcaggacgtagcggtcgttcagcacggggaagttggagaagcgggacgcgtcctcgtcccgcacccgcttcaggtccctgtgggaagcaggaggcacagggggttccatgagactcagtgtggggcgcatcacaggtggtgtagatccttggggttgcatggacaaaaagctctttccaggatggctggctgatgaagcaaggaaggggggtttccatacatcgagtcctcaccgaatgagcaaccacccgtgtgcggggtccaaaacacgaccagagacggcatggatgcattcagccttcctgccactcctgcccgctgcccccaaagcgtggctggattgctgtcagggagccatgtacccagcactccaacaatcattggcctgccgttcgttccacccacctgatgtacagcatcttctcggtctccaggcgggccaggtcgaccttgaccatctcctcctcccgcttggtggctgccagccgtgccttgtagatctcctcctgccgtggcatgggtatggaggcggagactatgtagcttcagtacagaatgtctgaagaagagctggagctctgtatcggtctggggccacatcccctcctgggtgcctgtccgttttggtctgcacagtgtttccaggcactcccacctggacgacccagtcctctgggtggagggtggacgtcgacgtccctgcagcgtccgtgccctcattcctctcctctggcagcggctgccccggcagcggcagccgccgtttggccgcctgtcaggttggaatggttgttgctgttggggtttgtggggtctcaggtttcctgtcagtcatcctgccactgctcatgcgctgtgtccccccttcggcatctgaataccacccagtcacccagcccggtattaacatcttctccccaaccccctaccccaccacccgtccgcaccttcctggcggcctcaatggcatcgcgctgctcggccagcgcggtgagcttggctcgcaaatccctgaaggcctggccctcctcccacacctcctgcacctcaatgccgcgccggcgcacgcccagcgaccccagccgcggcgccagcgcgcgcagcgactgtgccgtgctttcccgctccagcgccgcgcaggtgcgggccaggcgtagcagcgtggcgcgcacgtgggcgatctgcgcggcgcccgagcgccgcgcctcgcccagctctgcctgcatggcggcgaggcggtcctccgcgtcctcgcgcgccgcccgcgccgcctgcaggtcccgccttgcctcctccgcctccatcctggattgagtaagtggggggagggggaggcggggagtactggtcgggacttgagaggtttggcttcccgagcggtccgagtttccacnnnnnnnnnntgcctccatcctggattgagtaaggggggggaggatgagggggggaggactggtcgggacttgagagctttggcttcccgagcggtccgaatttccactctgactcctgcacagaggtcgcatcaggacaggggggctccgttcctctcctcatcattgaccaaagcagctgcataccatgcctccacaacacccacaacacccacttgagctgggctgcatgcnnnnnnnnnnctgatcattgaccaaagccgctgcataccatgcctccacaacttaggcacaacacccacttgagctgggctgcatgcagctcggcggcggcaagtgcggcggtctgggccttgaccgcagcctccaccgccgccatgccgtcgctgctgttggcattgctgctggtggaaaagtagcggctgatggtgttgcgctggcgacgggagctgggggggctgctggcagctccgcggctggcctcgcggtcccgctcctgagggtgggcggtggggcggaaaggggagaagccggggagggaggtctggggtggtgatacaccacccctgccaccagcggcgccgggaccgagggaggttcgccggcgtttcttggtggcgttgatgtccgtgctgagctctagaccgtctaggctgtgccacggcgcctccgtgcggtgggactcgggtgcgtcgttctctgggccgggggtgctgtcgcgggcgccggggcaactcagttgcgaattggcctcgcggctcgtggcgggggagggagggatggcgaaccgtttttccagcagtgccaggcgagcctcattgctcccgttcaggttccccagcaccgccatgacgtcggagggcactcctgacgccatccctgttcgatggctgaggccagaccccgggacgctcgtcagacaaccaggggctatgattatgaaaaatcaatcgatcattgctgggcgatcattgtgcatgcgacgatgttgggcaccctctgtgcaccgcaagatcatgaagcctgctgctttaaaaattgaactcgacacccctctcccgcgcttgagactctggtgagcatccgcttaattgcagggaaatagcgccttgagccgctgattgcctcaactacaaaatttagggatgtgatcatgaggtatggcatgctctgttgtcgatgggtccacctcatagtgtgggtgctcttacgtggtcttcagcccacattctgatgaacagccaaatttgcgtatatgcagtcctaacttcacaattctactcgannnnnnnnnnttagtgtgggtgctcttacatggtctccagcctacattctgatgaacagccaaatttgcgtgaatgcagtcctaacttcacaattctactcgacctacgtaataatacgtgttactgaccaacaattattcctcttgcatacctgagcgtgccctgttggcaaccggtgctcaagaatatcagtgggtacaaagcatgaagcatttaacctcgacttcctctggctccgcccgagagtccccaagaaataaaacgatgattccgaggaatcgaccggcgaccctcaaagagagggaactacttggtaatttacatatttatttcatccaacacttgttcttgcaccccaccagtgtagtcggggagcgacaggaggaaatccccttccctgacctacacgggttccatgccggaggccaagcacaaaaagacagagggctctccccccaccgcggagcatgcatgtcgcaaaatggtggatcgcggctgggccgggccctacctgcgctacatcaacatcctccccgaggagggtgtctggctgggatcggttctgctcctcgtgcgcagtgagcgcctgggcgcctctcgcacgcccgcccagcccccggccgagtctgccgacggccccaccaggccaggggacacccagtcccatgacatcaccgctgagatggtgatgtgggaggctgatggcaaggaacagggccagagcacctcccagggggtgctgctgaccgaggtggaggggtggcaggcctggcgcttcggcatcagcctgtcgctgcaccgctcccagcgccccattgcctaccaagtcgccgtggggcctgtgcagacggagcagtgcgtgttctggattccagggggcggccagcccatgcactgggggtacgtgtgttgggcaagggctcagggatgaggttggtagggcgccgcacatgcctgtattcttcgtgtacaggacttgaggagggagactactttgcttattgttcgtgcaataacctgtagagcatcttgttgtagcgagactgacaacccctgacccatttcaccaagcatgtcctccatcttcacgcagctacacctcctgcaacggcctcagctcggtgagttttgtaggtgggagggctaaggagccctgttacaccctgacaaggcatgcaatggacctcctgggatggaagtgagagtgtaattcgcaaggggacaagcacatgcctcccttccctgctccccaggatgttcccgaggatgcgcccgagaggcaggatgcgacatacctctggcgggaccttctacagctgcacgacgcctaccccatgcactgcctctttggcggaggtgagacgtgggaatggtgtttgcagtaggaggtctctttggagggagatatcatgagactcttcccaacaggttgtgacacgcctcaagcgcgcggcatgcatggtcagtccccaaggcaggccgctgcggttcagttgacaaaggcacaccctgggccccatccatccctcccaaccctcctgctctaggtgaccaggtttacaatgacttggtgtggtctgagccttcgctcaaagaatggggaaatctggaggacaggtgagcaagctcgaaacgcagcaagatcaatggcgctgaggcctccttgcaagcatcagccacctgactctgtactcactgggcggtggggagagtacgtttgcacactgctgacctgccccagctcagccggcttgcatgttctgttcacgacttgaacccacgtgcctgtccctgtccttcctccagggaggcaaaactgtcggcgaactggacgcctgagatggagggtgaggccaccgagttctactgccggaactacatcgacaccttctccaccacccacattgccacggccatggcatgcatcccacagctcatgcagtgggtgagcctcggtggatgatgggggagggagggagatttttcatggccttgtactgtgcatgctcctcgcgattctgcctgcctgcttggtgcgggagcatcaaactgagatgctcccaccttccccacactctcaggatgaccatgacatctggtgcggggactgtacgcggggggcatgatgtgtcttggaggtgaagtcgactgatcctgcacagggatgtccatcggcacatctgattgagcgtgctcgccctaggttcccacagtcatcagcttgcacatgcaagtgctgtcctgctgatctgcctggccctcaaccgactgctttgcagggatggctggggttcgtaccgcgaggacgtccagtcctgctttgtgttcaaggtgtgcacgcgaagcccatcgtgctggaatgggcgtccttggtgcagacgtggcctgcctctcagttctgctcaactcaaccttgtcatgtcggcctgtgcatacaagacatacagctccgcgcctcatctctgccctcctcctgacgcagggcctgttccaagtggcgaggcgctttttcctcctgttccagaagcacaccaccgtggagcgggtcgacaaggagggcgagttcctcaataaagggtgggcctctggcctgaggggtgttgggtcggaggtctttggggttaggcaaaagtaggtgccttgctatcctcttctagccaagccaccagccctacacattgcaagcaggagactctcccagcatcctggctctttcacccacagatgacaccactcatgggttgttgttcagtgcagcctttcattccctccctcctccaacccccttgcaggagctaccacagcgtgcattacctgggtcccactgttgcacttttctctgtggacatgaggacccagcggacccgctccgtctgtgtgccagaggtgggaattgagtttttaggccggggaccggagctgccaagcagccaggcacatgctgttgggagtgcactcctgactcgatctgtgctccagtgggggtgcttgcctggctcaccgggcgtggcgtgcccttaatttgccattcgctgaagcgagcggccccgacccatccctatcgatactttgcaggctgattatcccctgctgctgcaagcggctcaggcactcccagtcacagtagagcatctggtcatggcctcgggtgtgccagtcgtctggcccaacgtgagtgggagccactgctgctttctgtctatgcaaatggcagcctcgggggatggccgcctcacctgccctgctctctggggtgtcccctgcctcagcgtgcttcctgatacctgctgggcccgacatgcatcttgtgatattcatcaaaccctaccgcagatcccctccatggagctcctgctgcgtggactcgagcacgccatcaaccgcttcaactgcctcctggacctgacaaagaagactggtgggtgtgcctgccgtcacatgcactgctggctggggttgcacgctgccagcaccgggtctcagcaggctggtgtgaacacgagacaaacgtcccttttcctgctcccctccatccaggcctggtggnnnnnnnnnncgcgagcacgagacaaacgtccctcttcctgctcccctccatccaggcctggtggaccaatttgatcagcccgagatcctggacgacctgcatgacggatggatcgcagacctgcacagtggtgagtggtgggtgagggtgccaggacacctgccatgctacctctgacatcgggatcttgagtcattgtgtcgagccccattccacctgcgtgctggaatcagcacatgcattcaccccgctcacaccctctgcagaggagcgcatccgcttcatccacctgatgcaagacatggcgacctctcgccagctcagggtcagcatcctctctggcgacgcgcatgtggcgggcataggacgactgtacagccacccaaagtacaagaacctcgagtgagctggaatgttttgttgggtgggggctggggctggtgtggatgcagctgcgtgtcgtactccaaaccctgcgctgcttcaggcatctcacagagtcgcgcttgccagattgcatcaccgccaaagtccgcctcccaacctgctgatactcttcttccaaaccaagaaccctccatgccacccccccaacctccaccaggaatgacccgctcttcatgcctcagataacctccagcgccatcgtgaacgcgcctccccccaacccggtggtccgcaccctcacccgcctcaacttctcaagtaggttgcgaggtgctgggctgggggtccgatgcaatgcggaggacagcagtgacgcaggggtcgctggctcgagggtttctgagatacaccccaggtcgcacttccctaccggaaggcccatcgctgtgagagatcttgctgccattgccatggcgagtgctgcagctcacccctccactgccctctaaaacccacctcatgcagagaagatcgatgggaagaccaagcagaagatggtgcgcgccttctggccacgccacccgcgcgtggacaagctgcttgcataccggaactggtgcgacgtgtcgctggtggcgccacccttcagcgcacccatggtccccggggaggcagaccacggcgcgttgcgctttgtcctgcgggtggagaggcccaagcagaggtgggannnnnnnnnnnnnnnnnnnnnnnnnnnnnnnnnnnnnnnnnnnnnnnnnnnnnngccttgaaatgcatgaattcggcgctgtatgatcatggggagtgggctgcgattgtgacatcagttccaggagcagcgtgccagtccaccactgcacacgctgaggtagtgtcctcttccctctcctcatcaggctgnnnnnnnnnncgtatgtagtaggaaattctgtgatgctgttccctgcgtcacaccttccctgagtgtgccccgcgttgnnnnnnnnnngagccgatgatgggacttggcggaggtagtgaatatgtcgaagggggagggggaatctcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatcacagcacatgctgagggagtgtcctcttccctctcctcatcaggctgggctttgcagaggagacgtacaccatcgccgtgccacgcttcgtgccggacaagcggtccgagaggctgacgggcgacaccgaggcgacgcggcagcgtgcgctgcgagcgctggcggccgctggggtggccttgccggccgtgttcttctccctcaacccttccaaacagggtagcccccaggcggagcccgtggaggaggagacggaggtgaacctggaacccagtggcggactgaatggcaggcgagccggcccccagtatgcatgaagaagcatgtatgtagtcggaaatcctgtgatgctgttccctgcctcacaccttccctgagtgtgccccgcgttgcctactacaaagcagctaccaattttgtacttccttctgaccacatggcagtaccggtttagctttggcggggtagaacagttcgccatacacataagctggcactcaactctggctggcatggaaccaatccgacctcgttgccaggaactcctcatgccttccaggggggtcaccgagaactagctccggcaccaaattaatctcagtcctgatactccaatctgaatatcgtacagattgaaaatggtgtgagaggattattgcaatggaagcggcatcgagaacagctgagagctgtcannnnnnnnnnttcagtcctgatactccaatcggaatctcgtacagattgaaaatgatgtgagagcattattgcaatggtagcggcatcgagaacagctgagagctgtcattcatcaagaaagcagggaacaacgggcgccccctcggaagacccccatgcttgatcccgccaggaaggtggccgaagatcggcacgcgagaacccgccagccccgcatcagggcagggatgctgtaaaagcgcagatttaccgtcccctcgtacgtggaaaagcccctttgacgccagcctttcctgtgagttccggggaggaatgctgggatgggtacgtgcatccctgtcgtcactccttgaagacctctaccccggctgccaccttataatggcaatccacgcttgtttccacccccgacagagcgcttgagactcaccgctgcagccaggcgaccaggctcaaaccatgggttccccgaccatcggaggtgcgtttggcctgcaacccttccccaccctccgactttgcacatggacacaccctttgaatgttttgtatccacaggcaaggcccattgggcctccatctggcttccctggatcctctttaccctgggctggatcatcctcctgtgtgagttttaggggtcagttgggagccgatgtgtctgattctgggccctcttctcagctgctagggtcttgcaagcctctactgacaccctcttcccacccttgctgnnnnnnnnnngggggtcagttggaagctgatgtgtctgattctgggctctcttctcagctgctagggtcttgcaagcttctactgacaccctcttcccacccttgctgcagctggagtggctgtcatgcagagcgtatgtcggtgcagtggttgggtggatgagattgccggtcacttggagctcgccacatgtagtgcatccccagcttgcttgcagaccggctgagtgcaaccttcacactcatgcagtcctgcaatgagtcgtatgacctgacatcgctggcacgcggcggctccgtcggttacctgtgagtgactagaaggttgtggttggcaccgatggcagacatgctcggtaatcttacagttcgtcctggctattttgagccctgtagtcctgcagccctccttcataactaggtgaagacccttcctctgaccatactgactctatcctgtgtggttttctccctgcttgcagtgctcccgtggactgcagcaagttcttccgatgtgagttcctgcttgcttgggaagcccatggcacttgcctggggtgttttgtcttctgtgttgcaactagttgcggtggtgttcaaatatgggtgatatttcctgcgtttctcccatcaccagccctccatcgtgcatcaacaacccccccttctacataaaccagacgcttggtgggccactttctattccctggctgtctgggccaccctgctggtgnnnnnnnnnntaaaatccagacgcttggtgggccactttctactccctggctgtctgggccaccctcctggtgacgctgatcaccaccaccatccacaagttcaggtgggaggggtcgagagtggggagcatgggctagttgcggcgcatggctggattcaaggaccagtaggcgcctgctgacgcctgtggtctgtgcggggtcattgctgccaactgtctagaatctgatccagcctcccgctcaatcccatcgtccctgtcgccctcctgctctgcaggccagggcnnnnnnnnnnctgggtgatatttcctgctttgctcccatcaccagccctccattgtgcatcaacccccccccccnnnnnnnnnntcgtggccctgctttccatcaccatcatgctgctgatgggcactgccaacaccttcctgtgagctgggagggaagcatgagtggtggagcggaggctcggcctgtagcggaccagtgccgaaaaccctcactttgtgcgctggtcctgtcgattgacctcgctgggcactcatccctcctcctccccttgccgactcccaccatccacaggttcttcaacgacgtgcagaccgggaactcgagcttcaaggccggcacccgcacgacggtggcaggggccatcatcgtcaccatggcctccttcgtcctggtcttcctcattggtctgcacgatgaggacgccacgtgggacgagagccacaagggtgaggggtgccagggaggacagggcgtgggagaggggtgttgtgttgcgtgcgccagagctcatcctgcaggcggctttttgtcgtgggcctgggccgaggtggttactaatgcacagccacagcagcagtgatgcttttctgatctgccacaaccttgctcgtgagagtgttttcctagcctcaattgttgagtcaacaccacatcccttcctttcctctacagcttcccgggcggtgatcaagtccccggcctcccccacgcccagcaaggccacttccacctccaccttcgaggccaggggtctgcccccgaccaccgcgtcgccctccgcgagcgccggcggccgttagaccggaatcagtgcgagcaccctggcggcacggcaccatgctgtcgtgccgacccccctggcgctcgccacccccgacttgttgctcgacactttccccgttggctgacgaggggcacctcgctttcccacccccattcccctctccaggcaccagcccctgatgtgatgcacggttacatgtcaccaaaggtggaagggtgtccnnnnnnnnnnactttcccacccccattcccctctccatgcaccaccccctgatgtgatgcacgtttacatgtcaccaaaggtggaagggtgtccgggagagggtagagagtgcgccaactgtcaacagcgaggggcagtggtaagggtggcgatcgagccagacacttccacgcgtgcattgcaggccacccccactactcctcggcaatggggttgttgtaggccaccacgttggccttgtcgttgccgggatcgacaaagcgtccgccccgcgtctccccgctccccgcgcccacgcgcttggagtgcagctccgggtcccgctcgtcctgcagccccagcccgatcagcacggcgaagaggccgatggcggcgatgatggcgccggccagcaccacgcggccacgtgccagcagggcccctggggtgaggtgattggcatgaggggaatgttcttgtgatctagaagagggaagtgcgagccataacataggagagggagtcacatgttcgaaagacagccccnnnnnnnnnngcgtgccagcagggcccctggggtgaggggattggcatgaggggaatgttcttgtggtatagaagtgggaactgcgagccataacatgggggagggagtcacatgttcgaaagacagcccctgcaatctttagcacccctcaccgctgacggtggggatggtgttgaagtagaggaaggagttgatgaggtccatgagcagcatgagctccaccgccaccagaccgatgaggcccgctctgaagcgccggatgccgttgatggtcatcaggatggggaggaggagggacaggatgaacactgcagggagagggggggggagggatctgttgacgtgaggctcaatgtgggaggatgctactgggcaatacatgtagtcatggacgctatacttgaggcatcatacaggccaggccgcccctttatcaagcttggggtccagcctgtggtcaatcaaacaacagtgacacagctctcgaggaaatccactcacggtagacggtgatccaccaggtgaagccatagaagctgcaggagggggaggggagggacagtcaggcatgcccagggccagggagtggatgcaggtccatcgggggctccctaccagccaagcaacaccagactggcgacatcaagggaacccttgccacctccccacaccataaacgcannnnnnnnnnatccatcgggggctccctgccagccaagcaacaccagactggcaacatcaagggaccccttgccacctccccacaccataaacgcactggctgcacgggacaggggagaagtaccccgcagcgccggcacgcacgatggcattggcaccgctagagctgcagtcctggggacatggtgggggatggaatggggttggtagcgggcatgaacaggcttggtggccaaaatggctgcccctcagccttcccctctcaccgnnnnnnnnnngacggtgggggatggaatggggttggtagcgggtatgaccaggcttggtggccaaactggctgcccctcagccttcccctctcaccgactgcagagctgccactccgcaaagcaggaggaaccatccaaagagggagatgacccctgcggtgagcgtgaagagcgatgggcatgaggctcggctttgaccccacgccgacatgggcatctgctccccgagcagtgaccccgcactcacaaggcaggaagactaccgcattcgcttgcgtcagacccgacatcccgatggcctgctgagatatgtaatgatgggatgagttcatctgggttgaaggagcctgggcgcagggggcagggaatgcaggctggaaggtgcccgttggtcctcacctgtcagactctcctggggctcgggggtaggcggatggcgcggggttgcagatctatgagatttatcttgtatttaccttgtgaaggtcggctcccggcttgagggggggcccgttcgggtctggatgtgtttctcggatggagccgcggcgggaaggagtaggatgggtcgaggaacctgggctgacgccaggacggagagggagacagcggcagcctgctgcctccaaacttgtcttcagtacgtcaactacagcattacagggcgtccggagctctgcgatacccgatcgcagcctttgaccaccaccactcgaccaccctttctctcgtaagcggaggagagtgctatggctgtcaaagctcctcccctcgtcctcgcctggggcagcgtgttcttcctctccgttgcatggttcctcctcctgggaggcgttgggtccctgcagagcgtgagttcggcgaggggtcggatgcccatgcacggagcctctgcagccgttggtccccattcccatcgtctccccatcggccagcaaactcccccccccgcaggcatgcggcgactctggtgccaccagtctcctgcgtgcaggatcggcgggatacctgtgagtgtacgggtcgtgagggtgctgcctctgggtggggttaaggggctggatgaatgatgacagcattcttgcctgctcttcaaagtgccaggggtcccagcctgcaagcactcaaaatctctgacctccaatccctctctgcagtgctcccgtcacctgcaaccgcttttacaggtatgtaactgaacgtcgagggtgagggagaccctcttctcctcagggtttcattgttgcttgagataaacaccagcccatacccctgaccattcccctcccgtcccccctgcagctatgtgtggtggactgtgtggtaagccgagtgggtttgcccagcgcaggggctccagagttttatgctttcaaatgtgttaaaattgctgaaaggaaatggagcagggcttctcccgtcacgctcagtataggcagcatcctgtgccgagtnnnnnnnnnngatgcttttcaaatgtgttaaaatagctgaaagacaatggagcggggcttctcccgtcatgctcagtataggcagcatcctgtgccgagtgccccatgcgccgtgccagcggccgctgacccctccgcgctccccatgcgtgcaggtacgacttcttcgccatcatcctcgtcgcctacctgctggccacctcacgcattcacacgctgcgctacggcgtcatcggcttcctcatccccgtcacctacctgctgatgagcacgtcggacgtcgcccaggccctgtggcacatcggcgtgtccccctcccgggccaaggtgctgctggccggcggcatcatctcctccatcttccaggtggtcctcatcgtcctcctgggtatccacgtgagtttggtggctgggggtttggggagggtgggagggtgggggagggatttgaagagtcttgtcagcaacgcgagggaggctgaagtagaaagatatctggtgggcccgacgtcaggaaacagcttttgaggcaggccctggtccgcacatgcgaagacaagtgtcatcctgatccataatactgcaggatgagctggctgtgaagtgattgcaagcatggcactgcggcaagcccagagttgagcattgttgggaaacgggagcaccagcatgaggcatgaacctggggctgatgagacaggtgcctccatgacctcgccgcccattacacctgacagacttgcacttgacgccccccagctgatctgtaagccattgtgagaccgcggaaggggttgacccaggggctgcatggtcgggatgtgaagaccctgctggccggtgcacagcacgccccgcatcattgagtcaacctgtcgacgtcgttgtaattgcgcacaagccagatgggtggaagagcgaagtagatatataatacttacaatagcatgtagagtacatgcacatgcgtcgccgtacgatgacatgatgcgtgcgatactgccccggcgagggacagccttgttggcggaatggaccctggcgcgggcctgtacgccgggcctacagctcgacgccactcatggccttctacatccagaatgtagaagctttaccagcgacagccttgtccgcctgaccccctcaggcgagcacctgcatctctggcgagcgcgccctgcatgcgcgctgaccattgttggggtttgtgtgtcgcccaagaaacaccatcttacagccctccgacccttgccaatcaccaccaattccccccccacgcgccgtacaggggctgagttgcagaagcggggcacccacttcgccgccctggcgcccggcgccgcccccgggctggcgctgtggtcgcggctggtgcgccaggtgcacgccaccttcatgcccgccggctaccccgtgaccgtggcccccggctaccgcacctacgtcgcgtggcaggggctgcaccacgccgcgggctccgccaacggcgtgctggcctccacgttcctgctctatgcgctggggctgggcgcggaggccatccccaccgccggcgccatcaactgggtgctcaaggacgggctgggccaggctggcacgctgctgttcggccgcgccatcgcacacaactttgacgtcaacgcgcgctggtggtacgtggcctcctccgccaagctcaacctggccatgggtctggagatcggcacggcgttggcgcccgccgccttcctcccggccgccgcgctggccaacgcgctcaagggcctggcctggatggccggcggctcggcgcgcgcggtgttcaacggcgcgtttgccgccaacgtgaacatcgccgacctgacggccaaggccaccagccagaccatcgccgcctcgctggcggggactgccgccggcgtcgcgctggcggcgggggtggggcagagtctggcccccgccgccgccgcctacgccgcgctggcggccctgcacatgctgtcgggcgtgcgcagcgtgcgcagcgtgcccctggccacgctgaacccctccagggtgcacgcgctggggcgcgcattcctagacgggggcggcgcggccgccgcggccgccgacgaggtcgacggcgggctggccgcgctcggcgacggggcggtggtgcccgcggat

SEQ ID NO: 41408 - DNA, 11508 bp, Chlorella protothecoides
  modified_base (165)..(214): a, c, t, g, unknown or other
  modified_base (403)..(412): a, c, t, g, unknown or other
  modified_base (697)..(706): a, c, t, g, unknown or other
  modified_base (1877)..(1886): a, c, t, g, unknown or other
  modified_base (2063)..(2072): a, c, t, g, unknown or other
  modified_base (3288)..(3297): a, c, t, g, unknown or other
  modified_base (3457)..(3617): a, c, t, g, unknown or other
  modified_base (4614)..(4623): a, c, t, g, unknown or other
  modified_base (5247)..(5256): a, c, t, g, unknown or other
  modified_base (6228)..(6237): a, c, t, g, unknown or other
  modified_base (7067)..(7076): a, c, t, g, unknown or other
  modified_base (7484)..(7493): a, c, t, g, unknown or other
  modified_base (8744)..(8753): a, c, t, g, unknown or other
  modified_base (9212)..(9221): a, c, t, g, unknown or other
  modified_base (9877)..(9886): a, c, t, g, unknown or other
  modified_base (10206)..(10215): a, c, t, g, unknown or other
  modified_base (10735)..(10744): a, c, t, g, unknown or other
cctggcgcgcctccgcggcacgcccggcattcgtgaggagcgcgtggcggaggctgagcgcgacctggcccacgcccagcgcaaggccgacgccgccaaggaggtctacaatgtgggttgggcgtgtgtgtgtgtgtgcgcccgggggggggggggggggggggnnnnnnnnnnnnnnnnnnnnnnnnnnnnnnnnnnnnnnnnnnnnnnnnnncggtatgtcgggctctctgcatgccggggtgcgcaaggaaacacgggcaaccgcctgagagaaaggtccaggcgggcgccagcctgctcccattggttcccgtgaaacccttcaacgccgcatcgccgcccgcggcacctttgcaggccatcgcgacgcggatgtccagcgagctggtcgccttccagnnnnnnnnnnatgaaacccttcaacgccgcatcgccgcctgcgtcacctttgcaggccatcgcgacccggatgtccagcgagctggtcgccttccagcggcagcgcgcagaggagctcagtgcggtgctgcgccgcttcgccacactggtggccgcgggggagggcgcggctgccaagacctgggcgcccctggcgcggggggcagacgcataggcggggggccgggaatgcggctataggcagatggctccctgggtcagggacctgcttgcccctcgaatcgcccgagtgtgnnnnnnnnnncgacacataggcgggggggcgggaatgcggccataggcagatggctcccggggtcagggtcctgcttgcccctcgaatcgcccgagtgtggaacaccacatcccatcaaagcatgcactccacccacccatcaccccctgcctgccgccgatgctgctctggtcaggggagtgacctttgccctctcgcttgtaaccgccaagaggaaccctctgcctcaatcccatcaagtgcgagccctcctcatgaatctctgatgacgaaccctggtgaatctcggattcgcacagcatgggtttctacagtacagaagcgcagcagagtagagaccgaagcccgcagtcaagaggggcagcacaccgagcgcacaagcatgcgccggcgggccgccccctgagccaaaatggagtgtcggaagaattatgggtacgagtacggagggggggttggaccttgcagtgtatctgctcggtgggaagaggacactgcgcgtgcggcagggggaaacagccccatgcgctcacagcttggtacaatggtacacggggtgggggcagaaaggggggatgccacagcccgcgaggtgcggagagtgggttgccaacaagggttggggccacaggagggccagcatggagcagcagtcatctcagtgcttaatgggaaggagggggtgaggaggcgatcagagcacggtggggctgggcgaggcagagtgctgcaccgcccagggcccatcaggggagtttgatgagtgggtgtgtatgttacgccagctggacatgccgcagggcaggtcgatgagctggaaatcgggacaagccccccacttcacgtcatggatgagggggttggaagctccggaacgcacggggggagaagtccccaaaaatgttgtggtctctggtgagtcacggaggcagcttgcctggagaggggggtgagggaggaggctattcgagtcatctgctacaacgcacaggaaatggccccacacatctgcagcaatgcagcagcgcaagaccgttcccataccacaaatggtggggcaacagacggcaggggtctgcatgtgtctctccgacacctgtccatggccccgtcccctctccctcgtcagtcccgacccgtgggccatccagaaacctgcgccctcgcacctccatcaacnnnnnnnnnntctgtccatggctccgtcccctctccctagtcaatcccgacccgtgggccatctagaaacctgcgccctcgcacctccatcaactgtcggagttcgtccaggccgtcgtcaacgtcgcaacaatggatatcgagagcacgactgcagaaaagggggtggggggcgagagtgttaaannnnnnnnnnaccccacgtggacctgttgcgaagcggaggccgcgatcccgcaagggctacctggaggagtggatcggggtgcaggcgttttcattcctcagggacgaggcgggagtgcgtgggcgagacgagggcgtgctgcggggctgcgggcttgcctggggtgcctgcgaggagggagggaaggtccagacagtgagacttccggggcgagaccctcgcactcctctatgctgggccgtcacaccccttcaagttcatcttccaccctgcagtatcccactcccgagtcccacctccatgcctgcccaacggctccgcatatccgcaaccgcccgggaaagaccaccgggtttgagtctcgcatactcctttccgttcataacagcgttcagcatgccatttgaggtagcacgagagtagaagcggaggaaaagatgtctgtcggtgagttccagaagcgccagaatttggcgtctcgagagaattgaacgaacgagactcgatcgtgtttgaccctggaaaggcacgtgattgggcaaccctagtgagcaccccattgccaccaactcccgtctcggttgtgccctatggactcattattgcttggttcctgcggttttgataccagccacatcatgccgcgccattctgccgccgcgccgtccctgcaaccgctgccagagtttcggaagcagctcgcacagcgcccacggcactgaccaccgacagccctgtgcgagcgttccgactggccaccgtcagctgcgccacgctggcacgcagtgcctccagggtgcttggcagctccgcccgctcgctcagtgccgcttgcacagtgtctgcgcttggggtgtggggagcggccgggctcggaggcagcgccagtgaaggagggcgaggggcaccgagatcgaagtggccggccacgtgcagctccctccacaagagtaaggggcaagtctgggccgtgggaacccttgcttgcactccgacgaccccgctcaccctggacagccggggcggctcgccgcacggctggcagcaccacgtcggtgagggccgaggtcgcgctttccaccccctgacggactccatgctctgcggcagtcaccgcccgtgcagaggcgcgcagcccgtcccccaggtcctggctgcattgcacgagcagggggcagggggtggattgagacacatgccggggtagtgagcggacatcaacccnnnnnnnnnntggaggcagcgccagtgaaggagggcgagggcaccgagatcgaagtggccagccacgtgcggctccctccacaagagttaggggcaagtctgggccgtgcgaacccttgcttgcactccaaggaccccactcaccctggacagccggggcggctcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggcggggggggattgagacgcatgccggggtagtgagcggacatcaacccatagctgcctaccagaactgcaccccccacatcacctgctgccacccaaatcaagccctcccaaccccagctgttgtgaggcttgaggctgctagcttgatgactagttcatgcgagtgcgtatggcacccctctgggcatgccacagcggccgccagcaacacacacacctgagccccgtcatctcctgcaagcagtcggccacctccaggccggcaagccgcatggcaccagctgtctccgggagctccgtccgcatcgtcacgaggagagcggtggctgctcgagcagtttgtgacagtgcctggcagcgtgaagcaggacagggggagggtagcgctcggtgactttggagggctgtgcgctcggacccttgctcgggcccccaggcctgtcacccatccgaaggctcactaggatggcggggatggcagcgatcagggcggcagacaccgcgatgccgaccagggaggcagcgatggacagcagcagccggcaggggtccgccctccagctggccaacagtgcgggtacggctgtggtagtgatggcgctactgatccctgctgctgctgctgctcctgttgagcatgagcgtcgctgcctcaagcatgctgcaagggtgacccccacacaggcgtgctctgcttgagcaccatgtaattgccttggcactgattgcgtcactatcaccacaccacgacttgaaggctgacggcagcaaatcgaaaggccagtgggtgttcgtcggagtgctcgaaagtgatctccctgggttcctggggacctcagggaggcccctgacgcggccatcgggctgtggatgcctatcgccagatcccagtgcacaattcaatagactgtgtcatgaggggatagcggggtgacgcaggttgccctgtgtcgtgccggtgtccattgaaggacatcgagggggtggtgnnnnnnnnnntgcaggttgccctctgtcgtgccaatgtccattgaaggacatcgagggggtggtgcagtacccccctgacgaggcgcttgggagaggggagcgcgcaactcccggtgggactcacaccgcggttgtacaacgcatgcctcttctgaacagaatagtggacttggttgaacgccatcctatttctccagtgcattcgagcctcttttgctccctgccagcccggttctatctgctggcttgggccatcaccgtaaccagggcgctgtcccccagttgaggcgtccatcagcatggcccgtaatgaggagaaagcgcagagtatgctcaatcgcctgctggcggccaagcaggctgatgcgaggcccgagcgccagaagcggccctacctggcaacggagtgcactgacttgaacgaggcggacaagtggaggcagcagatcctgcgggaaatcgggaagaaggtcatggagatccagaatgctggactgggagagcacaggtgcggccggaaggaggggttcgctgagggggtgtggagtcttgcaatgcgcttggtgcccggccctgggtgccccgcccttggcctaggcctcgcggccatggagagcagcctttgccccagtnnnnnnnnnnggagcacaggtgctgccggaaggaggggtttgctgagggggtgtggagtcggcaatgcgcttggtgcccagccatgggtgcccagcccgatgcctaggccttgcggccatggagagcagcctttgccccagtgcatccccattcgaccacactctctcacacacaccgcatgcttgcaggatacgagacctgaatgacgagatcaataagctcatgagagagaaggtgcactgggagcgccggatcgtggagctcggtggcccagattactctaagacgggaccaagggtgacggactctgaggggcgtgtgatggccgagaccagcggtcgaggggccgggtaccgttactttggcgctgccaagaacctgcctggcgtcaaggagctgtttgagaaggaggcaccgcgccaggtggggagatgggttgttgcaagggggagggctatgggtgcactgcagctgggtatgcaggagatagggctggagctcgtgcaagtaaaacaagtctctttcatgcaggcacgcgcagagcggtgctgctgccgcgcatcctgcatcggtcgcattcaagtatactcccttctccccgccgatgcctcatgactgaattgaacttccagccgcattcgcctccgcacaggtgcggcgaacgcgcgcagagatgtaccgactcatcaacggcgactactatgggttccgagatgaggatgatggcgtgctgctgaaggtggaggcagaggcggaggcccagctgcgagcccaggcaagcctgagggtgggatgcagtgatgcaggaccctgtgcagattggagcaacggggagaggtcatgcattgcgcgttgccccactcccatgcagtgccgcaagtggtcctagcgcgaacgctctctgcttgatgtcatcacctttcctgacctaccccccactttcccgcttgccacaggccatccaggagtgggagcagcagnnnnnnnnnncctctgcttgatgccatcaccttttctgacctaccccccccactgtcccgtttaccacaggccatccaggagtgggagcagcaggaggcgcagcggcagtccagcgccgctgccgctcgggggacctccgccacagtgcaggtggaccctgctgagtcagcgccccagtttgtggcctacgtacccctgcccgacgcccaggagatcgaggcacgtgtgctggaggggaagaaggcggcactgctgagcaagtatgcctccgaggccctgcaggcagaacaggcccaggcccggcagctgttgaaccggggatgagtgttgggatggcagagtcgctgtaagaaggaacacagcgcgcgcagggtctgggggagagtagggcagagtgcctcatttagggggtatcccttgggggtgccctcatcatgtggggcgcgatgcaagtattgatcgcgacatgcacggtgtccacagcaacaacaaagaggactgcagccacatctcatgtccaaacatcattcggtcgctgttcctgcagagcatctcatcgtatcatcggcacaccggcgttcgaaccagctccgtcatggcggacgcctccaaacgcccgctttcagacggggaggaggccggacccagtggtgcgctggtggagatcaagaggcaacgattggacgagggcgccgtcgttcccgctggacccgcctcatccctggcgaccaagccgcaggtgagcaggggtccagtgctcctgtgttgtcgcctgcaggcccggactccctttcaccgcacacctcctttggcaatacacagggtccatcccgcacgtnnnnnnnnnnatgttgtcgcctgcaggcccggtccccctttcaccgcacacctccgttggcaatacacagggtccatcccgcacgtctgcgcttctggcgcccaccatgctgctcacaggccacgcggatcaggtgttcaccctgaagttcaacccggacggtgatgtcctggccagtgggagctacgacaagaccatcctcctgtaccgcacctacggggagtgcgagaacttcctgcaaataaaaggtggggtgccgggctgcagctgggaacgtaggtgggggagggggaaaggctcgggcaggtggtgggagcgcctgatcggcgctgcagccccctcgcccacagctcatgccccttctcgaacaacccacattgaataggccacaagaacgggatcctggagctgcactggnnnnnnnnnngcccctcgcccacgggtcatgccccttctcgaacaccccacattgaatagggcacaagaacgggatcctggagctgcactggacgccagacggcctgaacctggtctcctgctctccagaccgcactgtgcgggcctgggacgccagcaccgggcagcaggtgaagaagatgagcgagcacggcgacatcgtcaactcctgctgccccctgaagcgcggcagcccgctgcttgtgtcgggctccgacgacggcaccgccaaggtgagcctgtcgtgggagtggtgcttgttatgggggaaagggaaggttgggggcgtggagggttgactgggtgggtgcatgttggggggttcatgtggggggtggttggcgccatgcacccgcgtgcatcagtcgctcgggagccccgcaactgcttgatgcggtgattgccggatgcagcgtgggcaccacactcgctagattgctgaaatgccctggaagtcccaccacagtccctccccctcccgcaatccgccaggtctgggacctgcgcagcaaacggtcggtggccaccttcacggaaaagtaccaggtcctggcagtggcctggtcggaggccggggacgcggtgtacacgggcggcatcgagaacgtggtgcgcgcgtgggacctgcgccggggcgccccctccctgaccctggcggggcacgccgacacggtcacgggcctggcgacgtcgcccgacggcgcgcacctgctcagtaactccatggacggcacgctgcgggtgtgggatgtgcggccctacgcggcgcaggaccgctgccaacgggtggtgacggggcatgtgcacaacttcgagcgcaacctgctgcgctgcgcctggagccccgatggggagcgcgtgaccgccgggtcggcggaccgcatggtctacgtctggcggtctgccgacggcgcggtccagtacgcgctgccggggcacggcggcagcgtgaatgaggtggtgttccaccccaccgagcccatcgtcgccagcgccagcagcgacaagaccgtgtacatgggggagctggcagcgtgaggcagggattggagccggcgagctgccaggggacccggggatcggtgcacaaagcagtggatggagcgaggggcatgtgtgcgatcgacacagctcagtcactggcaatgactggtgctcagagcaggtctctcctcgcccgagccttcggggggcagtgcgctggccgtgggagggagtggcnnnnnnnnnngtggtgctcagagcaggtctctcctcgtccgagcctacgggaggcagtgcgctggccgtgggagggagtggcaaggcacaggcaagcttgacagcccgcagcgatgtcctccagtggcaactctctggtgcctgccatcgctttgctgcctcctccttgatgcctggcggctcttgagccccctcatgcactcccctcccctcctccagacatcctccagtcccccccaagcgcacacagcatgtaatgacctgacctcacaccactgtttgcaagctcgagctccttcaaaaggtgtcaagcatggagctgcacgggacaacgcaatgcgcgggggtggaggtgctcggacggcgaatctcagggcgcggtgcagcaacccgattcccaccacctccggaatgcgtcagtcggccgcgccaccccccgccgctcccccaagagaactgctgggcatcnnnnnnnnnngacatggcgctgcacggacaacgcaatgcgcggggtccgaggtgctcggacggcgattcccagggcgcgtcgcagcaacccgattcccaccacctccagaacgcgtcagtcggccgcgccgcccccagccgctcccccaagagaactgctgggcatctcatgcaggtccaggtccaggaactggtgccgcagcacaggacccagcaggtctggaggccagtccagagggttggggttggcgtgcaagaaggtggcggccgctgccctcgcctgctctaagagagcggcatcgcgcggcagcgagcacgcctggaagtttgggggtggggattcaaaggaaggggggaatatggcggcagggctggtgttgacatcgccggcaaaggggagcttgcatcaggacaggacaccccccacccctctcgagcggtgcagaccccagcctctccaatgtccattggcgacatgggggtccctctcgatgcacctccgctcccttcctctccctccctgagccggccttccatgagaatcctgtctcggacccgccgaggcccttttctgagttcccagcccatcatttccccactcccaccaccccaccttgaggctggagcccagcatgcggctctgcccgctctggcgccgccccagtnnnnnnnnnncaagagagcggcgtcgcgcggcagcgagcatgcctggaagtttgggggtggggagtcgaaggaaggggggaatatggcggcagggttggtgttggcatcgccggcaaaggggagcctacatcaggacagggcacccaccacccccctcgagcggtgcagaccccagcctctccaacgtccactggcgacatgggggtccctctcgatgcacctccgctcccttgctctccctccctgagccggccttccatgaggatcctgtctcggacccgccgtggcccttttctgggttcccagcccatcatttccccactcccacnnnnnnnnnnaggtctccggcgccccgcgcctgaaagtccagctccgcgacctcgaagccgtcgcgcgcggaggccagcaccgccagcttgtcgcgcgccgccgcagtggaggccaggaggtagcaggtggcggggcgcgcaccgcgacccacccggcccctcagctggtgcagctgggccaggccgaagcgctccgcggcctccaccaccatgaccgaggcggcggggacgtccacgcccacctccaccaccgtggtagaaagcaggaccgggacacggccggaggagaaggcggagagcgccgcctccttctcctcgcctgcaggcggaaggtgatgagaggaggggggacaggggcagtttgggtggccaggggaggggcaacagaggcagtggacccggtgtgcttgcgccataggtcccagtcatggcgctgctgctttgttttccctcccccaggatgtccccacgatcttcccccggtgagagacattcccaatcccactcaccggtcattcggccgtgcagnnnnnnnnnnccatggcactgctgctctgttttccctcccccaggatgtccctacgatcttcctccggtgagagacatcccccatcccactcaccggtcattcggccgtgcaggaggccgcacaggtgccccggcagcaccccctcccgcgtcagcctcgcgtgctcctccgtcacggccctgagatcgtcgaagcccggcgccgcgctttcctccaccagggggcagatgatgtacgcctggccccccgcctccacctcctccaggatgtgctggtagacctgtaacgtgtccgtgagtattttattgttcaaggaggggttgacgtgtgtgtgtggggtcggaggctatgcaccagggtcccttgatcctcctcccctcctccttgcacgcatgcgtgcacaatctcacccccgacacccacacacacacctgccgccgtgcggcctcgtcacgcgagtccagcacccgcgtcgccaccggcccccggcccggcggctgctcgcggatgaccacgtggctcaggtcgccgtgcatgagcagggccagggagcgcgggatgggcgtggcgctcatggacaggacgtggggcggcggccgtgccttaccggccagccgcccgcgctgcgcgacgccgaagcggtgctgctcgtcgattaccaccaggcccaggcgcgcaaaggcggtgccctcggagagcagcgcgtgggtacccaccgccagcgccacgctgccgtcggcgaggcccgcggcggcgcgcgcgcggtcgccgcg

SEQ ID NO: 41409 - DNA, 61 bp, Chlorella protothecoides
cgccccatcttctgcgcctctcgcttcttcgacgcccaggtgctggacctggcatggacgt

SEQ ID NO: 41410 - DNA, 61 bp, Chlorella protothecoides
caacgatgcctcaccctccttcctcgactcctctccggacacccaggccgccatggaggcg

SEQ ID NO: 41411 - DNA, 79 bp, Chlorella protothecoides
gggagcgggggaagagggcatgcattccggggccccgcttcacacctcatgcacgtactgcttgctggccgcgtagtag

SEQ ID NO: 41412 - DNA, 77 bp, Chlorella protothecoides
tcctgcaggtgcggcagggctggctcggggcgtgcccggtccacagcccctgcctccctcatgcaggctggaagcat

SEQ ID NO: 41413 - DNA, 121 bp, Chlorella protothecoides
actccgctgccatgtggatcctggcactcccaggccttgctgccccacccctcgcgtcaaccccctcaccccaaacccctcaccccaacctcacaaacacacctggactcgcgccggcggc

SEQ ID NO: 41414 - DNA, 74 bp, Chlorella protothecoides
tggtgcatcactcagactgtgcctgggtgcgtttacaaagtgccatgccatgcgattcatccgcgccgcaccca

SEQ ID NO: 41415 - DNA, 116 bp, Chlorella protothecoides
gggtggggggcgagaagaggcgtcgagggggggctgtggatggagtggaggggtttggcatcacccatgggaactgctgaagagtgggcagctggcgggcgggcgggaggtgcacc

SEQ ID NO: 41416 - DNA, 102 bp, Chlorella protothecoides
cgcgctgtggaaacctgccctccagtccattgccaaagtggtgcgctgccttggggggggggtgcttggtgggggctctcgtgttgctcttcaagccgcagc

SEQ ID NO: 41417 - DNA, 821 bp, Chlorella protothecoides
  modified_base (156)..(374): a, c, t, g, unknown or other
  modified_base (431)..(682): a, c, t, g, unknown or other
gaagaaagcgtggagggtcgggggagaaggaagggatcgagggcagcccggatgggaaagggagttggcgcggagggcgggcatggccgtcatcgccccacccccccaccccagtacatgcacctaccgtagccggtgtagctgtcattcaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatcactgcgcggggtgggcaagtgggggtggggggtggggaggcagggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccatgtcatttcccgcccctgtccctctacgggtgcaggacgacagagtgcagggcacacacacagaagtagagtggcagggggtggtcgcggcgggcaggggggggttcctatcggggctacgtggccgtggactt

SEQ ID NO: 41418 - DNA, 123 bp, Chlorella protothecoides
ctggtgctcagttggggcgaggcgggggtgctggcgccacgaagggtaggaggcgtcaccagcttgttgtgttgcgtgccgcccaggcggccattgggggtggcaggggccaggtcagcctgg

SEQ ID NO: 41419 - DNA, 69 bp, Chlorella protothecoides
aacccccctggacatgccccttggccgccgggacagactccatcgccattccatttagggcgaatagag

SEQ ID NO: 41420 - DNA, 2163 bp, Chlorella protothecoides
  modified_base (196)..(205): a, c, t, g, unknown or other
  modified_base (698)..(707): a, c, t, g, unknown or other
  modified_base (826)..(835): a, c, t, g, unknown or other
  modified_base (922)..(931): a, c, t, g, unknown or other
  modified_base (1345)..(1354): a, c, t, g, unknown or other
gggcgcgcgcggccgcgtcgccgccgagtatgcgcgcgcgcgcgggatgctggaccaggcggggcgggaggaggagggggcgggggcctggggcctgctcagcgctgaggtggacaaggtgagggaggagaggagggtcggggagagtgggggattcgatggtcggggaggagagcacccggcatgaggcaggtgnnnnnnnnnncgagaggagtctcgggaagagtggggagttcgatggtctgggaggagagcacccggcatgaggcaggtggttcccgagtgtcgcggagtggcctgccgctgatgcaacgcccccccccccaacacacacacacaaactaagaagagttccatgctgcactccgctacaggccgcgggcgaggcagccgcccagctgctggtcaccgtggagtgcggcggggtggaccccgaggaggtgctggatgccatgcgctcgctgctggccctggaggcggcgggggtgcccgccgcgcagggctgcgacccgggcgggtgaggctgaggctggcactgttcggtctgttgcagggcggctgcatgcgtatgaggagccgggtccggggtccgaggcacaggggcaggacactgggcacgggccgggccagacaatgccagggagccctgccagcggtacgagactcgactctggtgccgaggcctcgcagctgccagnnnnnnnnnnagtccggggtccgaggcacaggggcagaacactgggcacgggccgggccagacagcgccagggagccctgccatcggtacaacactcaactctggtgccgaggcctcgcagctgccagnnnnnnnnnnggggcgctgcttcacccaattgtgtatgaatgctgaccctggagggggcctccaccccccactcaagccccacccatctgcctttcnnnnnnnnnnagggcgctgcctcaccccattgtgtatgaacgttgaccctggagggggcctccgcaccccactcaagccccacccatctgcctttccgcaggctgtttgtcaagtcgcaggagggccaggttggcgccatgctggaggcccaacgcacacagcgtgacgccatgctgcacgccgccgagcagcaggcggccctgcagcgcgagcttgaggtgaggagggggcttggctttggtggtgattttcgggggaaagggggggctgggtgagggggggtgggctcagaggcaccacagtgacgccgtctttcggcaatgacatcgggcaagatgagggagcagggaacctcctgccttcccagtgtctctaagtcgggaggggcagacacctgcctcatgagggcacatgccgccgccnnnnnnnnnnaaaccgcctgccttcccggtgtctctaagtcggggggagcagatacctgcctcatgagggcacatgccgccgcctcacccacccgccccacctcccaccatcacgcaggaggaggcgactgcgttcgccagcctgggcatcccccgcaaagcccacgcccgccgcctgagcatgtcggtggcagacgacaccgcgccgccggggccgggcgcggcggccgcagaccccgggcccgggcaagatgcccggcccgctgccgtcgcgcacgtcgtggagctgacgcgcgccctcctctcctggctccccggctttgtcgccgtggccggcccagggctgagcgggctggcggacgagctggcggagggggccgccccggcgcgcgcccggctggcggccgcggccgacgcaggcgcggcgctggtggcctccaccgtctccacgtacaggtgggctcgtggagtttcatgggttttggggatgaccgatcttggcaaacactgcaaggttgcaggggatggtgaggggttgcgtcctgcgccacgctccctggcctcattcctcccttccaccattcgcccatggcaccgcagcgaggcggtgcacgcggtgctggacccggacccttcgctgggcgcggcggtgctggacgagctggccgaggcctgcgaggcgctggagggcgtggccggcaccgcgggcctgcccacgctgcgcgcgctggcctcgcacgccgcgctgagcacgctgcgctgcctggcgcgggacctgcacgccgagggcgaggcgctggcggcggcgctgctggcgcc

SEQ ID NO: 41421 - DNA, 61 bp, Chlorella protothecoides
agcgtcgcgccgctgggcctgctggaggggttgcgcaccggggcgcaggcgcggacgtgga

SEQ ID NO: 41422 - DNA, 133 bp, Chlorella protothecoides
acatcccaccccccttagaattttaccccccaccccaccccccccacacacacttacacacttacacgcaaggaaagttcaggacaaacgaccagacccaccacatttcccaaccacaacacacactacacaa

SEQ ID NO: 41423 - DNA, 66 bp, Chlorella protothecoides
ggagggcgcctgtggccgacacaggcctctgccgagcttgcctgcttccttgccggcgtggagagg

SEQ ID NO: 41424 - DNA, 61 bp, Chlorella protothecoides
gcaagccaggcttccgctgggcccactgggggcaaggccagccaatgcaacaggggcacca

SEQ ID NO: 41425 - DNA, 10582 bp, Chlorella protothecoides
  modified_base (333)..(342): a, c, t, g, unknown or other
  modified_base (1166)..(1175): a, c, t, g, unknown or other
  modified_base (1367)..(1376): a, c, t, g, unknown or other
  modified_base (1773)..(1782): a, c, t, g, unknown or other
  modified_base (1862)..(1871): a, c, t, g, unknown or other
  modified_base (2350)..(2359): a, c, t, g, unknown or other
  modified_base (3691)..(3700): a, c, t, g, unknown or other
  modified_base (4046)..(4055): a, c, t, g, unknown or other
  modified_base (4613)..(4622): a, c, t, g, unknown or other
  modified_base (5723)..(5732): a, c, t, g, unknown or other
  modified_base (6884)..(6935): a, c, t, g, unknown or other
  modified_base (8469)..(8478): a, c, t, g, unknown or other
  modified_base (8597)..(8606): a, c, t, g, unknown or other
  modified_base (9589)..(9598): a, c, t, g, unknown or other
  modified_base (9655)..(9664): a, c, t, g, unknown or other
  modified_base (10139)..(10148): a, c, t, g, unknown or other
cccggcccctccgcctgcacggcaatcgcgcgcggcctgcgggaggcagacggtatggccccgccgcgggcggcccaggcgtccacgctgacgctctggtgggccggtccggccttcgctgacgaggcacgggcggcgcagggcacggtgcggcgcgccctgcgcacgcccctggcctcggacgccgtggccgacgacgcggagggcatcttggggcggctggaggagctgcgcctggccttcagctccgccgaggactgaccctcgggagatgcgggggctgtgcgagtcgttgagcttgttggccacagggtctctcccgagggtctgagnnnnnnnnnngcgggagatgcaggggctgtgcgagtcgtcgagcttggtggccacagggtctctcccgagggtctgaggcacgacacggttggcggccgcccagagcccccgcaaccctcatctggctgtgggccctgggtccctggccattgccctggcggtctacgccagtgcaccgaacgatgccgcgcgtcctgccgacgtcatcccctcaccgcgcccaccatcacatgaccacctgtcacatccccgacgcgctgacgagtctcacagggaatggacgacgcccggcctggcagggaggacagtgaaaacaccccctcaccgccccgtctccaccccccgggcaaacacgcgcagcccccccctgatcacgtgggcccgcagcaaagcggcgggcgtcgcctcgccgtccaggttccagtccaggttcgcgccgcggccgccctccaccctcaccgcccgcacgtccagcacctccacgcccggcaggtcccccgccgccaggccgcgcgccgccatgtgcgccagtacgcgcagcatgcccagcgcgcccaggttgggcaccagcaccaccttgacccgcccgtcggctaggtgcccggcgcgcgccatgccgcacggcgtcttgtcgctgcggcacggcgtcacgatcagcttcacgctgcgccagcgcccttcccgcgactcccatttcgtcggcggggtgcctggctgggggcccatagggtctagagcgagggcactgggtgagccttgctggtggagatcgtcggttccgcccggcgacgcgtcgctgggtaccctccgcgcgtcggtgtccagcggcgggnnnnnnnnnnagggcccacagggtccagagcgagggcactgggcgagccttgccggtggagagcgtcgggtccgcccgcagacgcgtcgctgggcaccctccgcgcgtcggtgtccagcggcgggtcggtctccgaccatacgtccccatccgaactcgcactcgcaccagccccctccccggccagctcgcagacggggcnnnnnnnnnnctctccgaccacacgtccccatccgaactggcactcgcaccacccccctccccggccagctcgcagacggggcagccggcgcggcaggcggcgccctccgccccggggcccagccgctcggccgccatcccggtcagaggcgagggcagggtgctgacgcgggcgcgcacgcctcgccctgtcagcagcgccgccgcgcccagcaggtcgtagcgcaacggacccagcgcgcgccaggcctccgcgcgcgcgcagacctcgcccatgaacccggccgctgcgatgcagcaggcgtggacgggggcgcggccggggccgaggtcaacgcgcagcacatccaagaggccgtcgtcgccgagcgcgactcgcgccgccgcgccaaacgcgctgcggcagnnnnnnnnnncgcgcgcagcgaagcacggtgctccgagaacagcgaattgaccagctcatggaaggcgccgtcgccgcccaccgccacannnnnnnnnncggcgcgcggccggggccggggtcgacgcgcagcacatccaagaggccgtcgtagccgagcgcgacgcgcgccgccgcgccaaacgcgctgcggcagccgtgcagcgagcaggccacggcgtcggtggagccggcggggacatgcgccaggcgcagagcgcgcagcgcagcgcggtgctccgagaacagcgcattgaccagctcgtggaaggcgccgtcgccgcccaccgccacaatgcctggagtgtttggtgggtgggtggatgtcggcaggagggagcagagggaggtttttattgctggagcggaaaggttggggggtcgggggtaattagggcgggcatggcgccgggcgcaacagtctgtgtgcattcttgggaattccacagggatttcagcatccaaagccatttccgccgtccccgcttctcccccccacccacatatccacacgcgcgcaccgtcgtaggcggccagcnnnnnnnnnncaggtatttattgctggagcggaaaggttcgggggtttagggtaattaggacgggcatggcgccgggcgcaacagtctatgtgcattcttgggaattctacagggattccagcatccaaggccatttccgccgtccccccttcccccccccacacacacatatacacacgcgcgcaccgtcgtaggcggccagctgtgccggggacagcgcgcgcagcaaggccaccgtgtggttgcggcaccgcgtagctcgcacggtgcaggcgacgccggccgcccgcagtacgggcagcagtacagcgtgcgccagcgccggcgccctgcccgcaccgctcacggggttgacaatgatgagcagcgagcggggacgggacgtcgagacggctgcaacgcctggttggcagagcaaaagcacgatttgcagtgagaagaacatgcgctgccgctccacatccaccatgtctaccgccgacgactctcctcatcaccttgttgcaggctgtggcaccaggcatccaaggccctgctgtcgtcaaagtgggagacggggatgacacgggggtgccattcccacggccgcccgggggcccggcggaaggtgtggatgtgggcggtgggggggcagggagctgcctgcccgccccaccaagtggcctttggcactcgggcggcttcaggcaccggcctgacaccaatgatctcacacagggggagggagtgccagcctgggcgcccgcccggaaacatccattccaggtgcgtgggagtgagcctgagctgcgctggctcgccctccaggcgcagcccctcccattggccgtcgactgaggagctgaaggcaggtgtctgggactcgagactgtggggttgaagggtgacgggagggcgagtctcaatgcgcagacctgccaggggccggtggagcacagtccaggcagggagccgtacgcaccccaggtcaccggcagtgctcgccaatgggcgcctaatggacagaagtcacatgcagaaaagccctggaccatgcgattccctctcactcaaaactcttgccgcgctgacgacgagcagatacgcccgctgacatcaggcgagaggggatggaaaggccatgcaaggcccagtgcctagtcaagcgagctgagattgggtgccaccatcatctcgcttcgaaagtgtggcagcgacctgttcagcgggcgtaataaacccaaacgtatggatgaaagttggttcacttgctcgattgggcctcctatgtcgtcacggttgaaagaagggtcacgtcctgattgtcgtaaccctcgatcaaaattgctccggccggagcgnnnnnnnnnncggcagcgacctgttcagcgggcgtgataaacccaaacgtatggatgaaagttggttcacttgctcgatcgggcctcctatgtcgtcacggttgaatgaagggtcacgtcctgattgtcgtagccctcgatcaaaattgctccggccggagcgcagcatgcacgacgcagcatcagagtgatctgggacctgaaggtcccacgcgtggcagtccctccacgatcaggatacattatatgtatgtaattcatcttattttcctggcaagggtgtccttgcgaccttcgtagatgtttgggacgtgccggagggccacaccacacctcaactcgtgacgcctcgggtnnnnnnnnnnagatgtaattcatcttattgtcctggcaagggtgtccttgcgaccttcgcagatgtttgggacgtgccggaaggccgcaccacacctcaactcgtgacgcctcgggtccaatgcacgacatggcaccaatagccagtgcgtgacaacagcaatgccttggtatgattatgcctgtgatatgaatgcacatgccagccatgcaggcttccaaggacactgctctcatgagcgcgaatgatgccagcctggcacaggccagccatggcagtttgtcggcagcactgcagcgcaggaccaggaagacggtgcggcgtggtgctctggcgggatgacttcagtgataatctcctccgcctgcccccgcatgcgcttttgttacacagattcacccatgatgtgatgtctccaagcacccctgtcgtgccaccccccagggacgcaccacctccgccagactcctgcccactaacgcggcatgcggagcggcagcggtggtggatcgcgatgcagcgaaccttccccccccggccgaacttgaagagaacacagagccagcannnnnnnnnncgacaatctcctccgcctgtccccgcgtgcgttttggttcacacagatacacccatgatgtggtgtctcaagcaccccagtcgcgcaaccccccagggacgcaccacctccgccagactcctgcccactactgcggcatgcggagcggcagcggtcgtggatcgcgatgcagcgatcctggccacccccgccgaacttgaagagaacacagagccagcatggctggactgggaggaggtgggccatgaatcgccggccagtggcggcgaaggagccggcccggctccgattgaggccccagccagccagggcctgggtctctccatcagcctgattggcgagggcgcgcccaagccgcccgcgaagcggcggggcgtcagccaggccgaccgcgaggcctcgcagcgcctgcacaggagccatgcgctgtgcctgctggggcgcgccctcctctacgacgccgcctccagcgacgccagccttcaggcgagggtgtaagggccttgtttgcaggggcaattgcagcttgctaaagacgtctgggcctgtggcttcggtgatgcccgcagacaggcccgcccatcatcctgacccccccccaaaaaaaaacatccaatgctctctgcaggccgtcgtcctctccctgctcccgcccgaactggccggctccagcccaatccctggtgccgacccttcccagcgagccgaccctgctcaaatgggggagctgctggcctggttcaggggcgacttccgacccctgcggcggagcgccgtccaggtgacacccgccgacggcgaggatgcgctgggcgccacgctgcgtgcggcccgcgggatccccgcggtcgtggagcagctgcagcgcgtcgctgcacagcgcactggcagcgtggaggagctggtggctgtgttcgtggccgcgctccgagctctgggcatcgccgcccgcacggtgcgcgcgctctgcccctgccccctgagaccgtcaggtgggagaggagctgggccggccgggaagatggtttagggtatgggggagggcgaagaagctgcatccctgctatttctgagggcatcgggcctcagctgcgcgcatgnnnnnnnnnngtggactagggtatgggggagggcgaaaaagctgcacccctgctgtctatgagggcatcgggcctcagctgcgcgcatgttcaccctcgcatttcctggcaatttccaacagcagtgatgcgggaggaggcgggagaggttggcgctcggagattggccgggaggccgcgcaaagcagcagctgctgctgctgacgcggactcccgaaaggagtctgctcaggctggcaagtcccagaagccgcggaggaggaagggccgccccaaccccggcgtagatgtcagtctggatgccgggccctcgtcagccacgcctgcggcctatgggaagcgcaggaggggggatgaggagctggagcagcagctggccatggccatggcagccaccgcgttccagcagccagtgaaagaggacggctccactgaaggcgcccctcgagagcccagcaccggattcctgtctcgcaacagtgctcgcccagagccccagacaggtcgggtgcagggcaatcctgtggtgcggggagtcaaggacgtgactcctgcacattgaggaattcatgctctgtcctgtgctccgtggcctgcagactgcacacttcgaccccagtgaacacacaaacaccacccccaggcgtgctcagcgtgtccaccccgggcatcggccgcttctgggtggaggtgctggtgcaaggcacggcggccccccgctgggtccaggccgaccccatcaccgggtggtgggaccgggcggtcgacgtggagcgcctgcaccccagcgggcgcagcctggcctacgtcgtgggctgccgggcgggcggagccaaggacctaacccgtcggtgagccggaggatatggtgtgggcgtgagggtgatggtgggaataccatgccccgctgtgctgtccttgtactgttcaggtgctctgtatgaaagtcgctgaggggtctcatcactgctcacatgctttgccaccacacctcacccaaccccccctcaggtacgccgcaaactgggtggcagccgagaggctgcgggacgggcggtggtgggacgccaccctggaccccctgcgccggctggagtcccgagctgcgcacctggctgcggaggtgaaggaggagccggcggtcggtgcctgccactcgacnnnnnnnnnnnnnnnnnnnnnnnnnnnnnnnnnnnnnnnnnnnnnnnnnnnntttccctggcggcacgcgaggacgacgagctggcgcaccgggcgttgcagcacgagcgcagcgtaccccgcacgcaggagggcttccgggcgcacggcgtctacgtgctggagcgccacatccccaagcaccaggcgctgcgccccggggtcaaagcgcacggcatgcacaggtacgtggctgtgttcacggggctcgagagggggacatgtgacggccagctggagagggatggcatgccgggcacgaaaccggcgcctgcctgccccaagaacaggcgcggcgtcgacgctcacgccgggcccacaccctgcttcccacaggggcgaggcgtactatgtgcgcagggacctggccgacgtccacacccaagaccggtggcggcgcctgggacgagacgtgctggaggaggagctcgcacgccccgccaaggccctggcccggcggcgggcgccgggcctgagccccggccccgcgggtggagtttccaagaccatctccggccgcgtcgcagggagggacccccctccagacccagcaggggtcccccccgaggctacagagccagccgcgccgatggtgcactactacggcgagtggcagacgagggtggcggtgccgctggcggccaggaacggcaaggtgccgcgcaacgccatgggcaacgtggaggtgccgccgctggcgcatgcgctccccctgggcaccgtgcacttggacctgccctccgtcttcgccgtctgccaggcgctgcgcgtggacgccgcccccgccctggccggctttgagcaccgcggcggccgggccacgccctgcctgcgtggcgtggtcgtcgccgccgaacacgagggcgctgtgctggagctgtactggcgccaggccagggagcgggaggccagggccgaggcgcggcggcgccaggcggcggaggcggcatggcggagcctgctccgggcgctgctggcccgggtcaggctgcaggcgcggtacggagaggagggcgcggggcagggcggcagcatgcaggacgccgcggcgacgctgctggagcccgaggctcggggggggtccgtggcggcgggacggcgggtcgatgccgagcgggggcttcagcacaccagcgcgccggaggaggaggcggaggagatatgaggggatgggtcaggcacatgagctgtacattatctacctcctgtaaagaaagctaccctgccgagggcacgggcaggggatggtatggccgagtgccaaactgggtcagctgggctccatgccagcgggtcccgcgccttggcgcgacgaaacgagcggggttccggacgatctgcgcaggagcatgtctcagtcactaccgtccttcgggtcttgccgttttatactacccatgagtatctgcacatctaatcagtgagcatgctcaatccctaatcccctgtactcgtggagcgccgtgttcccaagtttacaagcagtggaacgcgtttggaccctccctccctaagggctcatcaagggacacacgatggggtcatgnnnnnnnnnngggccgtgctcttgggaaaggagacctggcaatgaagtcccttcctccttgtcagcccaagaccccgacacgacctctgatcgcacgcccccctcccaggaccacgggaactgacggcnnnnnnnnnnatactcgtggagcaccgtgttcccaagtatacaagcagcggaacgcgtttggagcctacctccctaagagctcatcaagggacacacgatggggtcatgcttgagctgctgcggcggaagcagtgatgctgatatctacgcccagggcgccaggtgggtaggccgtgctcttgggaaaggagacctgggaacgaagtcccttcctccttgtcagcccgagaccccgacacgacctctgatcgcacggccccctcccaggaccacgggaactgacggcgcctacgcgcctcccagaccgcaaaaaccagacacccctgaggacagggccgctcgcttggccgctgcagaggcggtgagtaccagggtgcagtgtcaacaatgttcacctcgtgaggaaattcctcagcactcgtcaagatccaatgccaacaagctctccccttcccacacatgcacaggcccaatcgcgacaagccaagttcgagcacagcgccgttgggcgagcgaccctgaagtcggtcaaggcggtgcaggcagagcggcaggcggggcggccgcctgcggggaaggacactgcaggcgactggctgtcatgagaactcgcgacggtcatcttccgtgctctgatgtgaaaggagagcattccctgtgtactctgcccccctgcttctaccttggtcaggcgctcttgtaagatttggtcattgtcatgctcaaggggacgctgtcctcccttactcagtcccttcgtcgcaggggtctctgcagggtcgggaggcagggcagggtgccggcacgagacagcagcgttcaggcccccgccaaagcctccgcccccccggtctcccccgccttgacacgtgggcgcaggaacctgggccgcagcacggcggcggcggcttcgtcggccatcgtgccggggggaacgcaggcgcacaggcgccgcgtctctggggcctgacccctgcactgcggcatctgcnnnnnnnnnntgaggggatgctttcctcaattagttagtcccttcgtcgcaggggtctctgcagggnnnnnnnnnnctgacacgtgggcgcaggaacctgggccgccgcacggcggcggcggcttcgtcggctaccgtgccagggggcacgcaggcgcacaggcgccgcgtctccggggcctgacccctgcactgcggcatctgctgcgtgacatagcaggtgccggggctgctgtggttcctcgcgccctccgccaccatgtttggcaggtcctgcccccactccagcgagcagcctcgggggcaggggaaggcgcgcatcagcgctgcgagggaaacaaggagggaggagggggaaagggtgtgtcgcggttgtgagggatgttgaagtgggatgtggggggtgcgggcgtgttagatgtggtttactgagcgaagggagggctctattcgcagtgagtgccacgcatcgtggcccgacccagagctgccgatgggggtcttcgctcaccggaatgttcttgtctggatcaccctcactcgtggcaaannnnnnnnnnagggggtgcgggcgtattagatatgggttactgagcgaagggagggctccattcgcagtgagtgccacgaatcgtggcccgacccagagctgcctatgggggtcttcgctcaccggaatgtacttgtctggatcaccctcactcgtggcaaagaagccaaggtcctcatcattccacagccaggacttccggaaccctacctctccacccccctccacctagatgtctgcccacccgcgcaggtgttgaggaagtggaggtcggccttgctgcagaccgcgccacgggcacggcaggccgcgctgcagctgacgccgggctcggcggccacgccgcgcatgccgggcgtgggcaacgtgcgcagcacgccgggcagcaggtcgcagcgccgggcgtcggccagcagcaggcgcccgccccgccacggcacgctg

SEQ ID NO: 41426 - DNA, 68 bp, Chlorella protothecoides
ggggctggccgccggggatggggaggatgcaggactgacagctggggatggggaggacgcagggctgg

SEQ ID NO: 41427 - DNA, 73 bp, Chlorella protothecoides
tttgtactgcacaggtatctagcgagtggtatcctacctgcattgcgccttccttcatcccagtggctccctc

SEQ ID NO: 41428 - DNA, 137 bp, Chlorella protothecoides
gagcgtgctgtcccgggtgtgggcccatcccaccctggcactggcagggcgcactgcctcgcgctcctcgtgacgcatgcaccctccaccctcgcccaggcgagagcgggggccgcgcggatgtgcgctggatggtg

SEQ ID NO: 41429 - DNA, 136 bp, Chlorella protothecoides
atactgcacggcaggcgtgcaccccactcgttgcggggagattgaggctgcccctgagggtgccgccgcctactgggaggcactgcgcggcgtgctggaggaggggaagagggaggggaagaccgtggcggtgggg

SEQ ID NO: 41430 - DNA, 69 bp, Chlorella protothecoides
tgagcacaggagtggggggtggtgacagggtcaagtttaccccgtggtggcatctgaggtactccgtgg

SEQ ID NO: 41431 - DNA, 77 bp, Chlorella protothecoides
cggatgggtatgctgtcgcgaaccctctgctgggagacaaggcagtgggccgcaggcatggggagtgggcctgccgc

SEQ ID NO: 41432 - DNA, 68 bp, Chlorella protothecoides
ggagtggggtggaaaaggggaagtatgcatcatggcatggcggttgcatgcattgccagcgtcagagc

SEQ ID NO: 41433 - DNA, 84 bp, Chlorella protothecoides
tgactaccatcgtcggcgtgggcaactggttggcccaagacctgggggggggcatcatgcggggggcccgccggggccctggat

SEQ ID NO: 41434 - DNA, 77 bp, Chlorella protothecoides
gagctcgccgaccgagttcaagagcagagcacacaagccttttggggccggggaagttgtagaggctttcccagtgt

SEQ ID NO: 41435 - DNA, 89 bp, Chlorella protothecoides
gttgtagggtctaacccgcccccacaacatccacccaccccatccgccccacccacccaaccccccttccttgaagtgtgacagtgacg

SEQ ID NO: 41436 - DNA, 73 bp, Chlorella protothecoides
agaggggaggatcgtcgtcctgcgccccgggcgcacgcccagtgccctgtcctccccagtggtgttgcttgcc

SEQ ID NO: 41437 - DNA, 61 bp, Chlorella protothecoides
cgtgcgcccccccgggcaccacgcggagagtggcaccgcccagggcttctgcttcctgaac

SEQ ID NO: 41438 - DNA, 67 bp, Chlorella protothecoides
tcgtcaccctcctcccctttatcgtcacccccccccctttccccccgcaatccctcactgcaacaac

SEQ ID NO: 41439 - DNA, 80 bp, Chlorella protothecoides
tgacctcgtgagagacaggcacagcttgcatgactcacaggcagcgcctcgttgacgcggatgctgtccttccttttttg

SEQ ID NO: 41440 - DNA, 61 bp, Chlorella protothecoides
ggccgtggaggtgcgattattcgtggctgggggtgaaggggccgcagggcaccttgagaag

SEQ ID NO: 41441 - DNA, 91 bp, Chlorella protothecoides
gtagtacagcgcatcggcggcggccaccagcagcgcggagtgcaggtcctcgtcggcgtccccacgcgccaggcgacgcaggatcaggccc

SEQ ID NO: 41442 - DNA, 69 bp, Chlorella protothecoides
ccaggctctcactcgtgcacatgcacttcgagggtgctgaggtttggcaggctcgatagctcctgcatc

SEQ ID NO: 41443 - DNA, 93 bp, Chlorella protothecoides
gggagttgccagtctcgcatacccgcaaaaaacacctccccatccccacaaccacagaccactacccctcctcccctccccttcaggtggaaa

SEQ ID NO: 41444 - DNA, 9138 bp, Chlorella protothecoides
  modified_base (146)..(155): a, c, t, g, unknown or other
  modified_base (399)..(408): a, c, t, g, unknown or other
  modified_base (836)..(845): a, c, t, g, unknown or other
  modified_base (1450)..(1459): a, c, t, g, unknown or other
  modified_base (2043)..(2127): a, c, t, g, unknown or other
  modified_base (2669)..(2678): a, c, t, g, unknown or other
  modified_base (3523)..(3532): a, c, t, g, unknown or other
  modified_base (3988)..(3997): a, c, t, g, unknown or other
  modified_base (4212)..(4221): a, c, t, g, unknown or other
  modified_base (4352)..(4361): a, c, t, g, unknown or other
  modified_base (4865)..(4874): a, c, t, g, unknown or other
  modified_base (5268)..(5277): a, c, t, g, unknown or other
  modified_base (5592)..(5632): a, c, t, g, unknown or other
  modified_base (6119)..(6230): a, c, t, g, unknown or other
  modified_base (6314)..(6323): a, c, t, g, unknown or other
  modified_base (7177)..(7248): a, c, t, g, unknown or other
  modified_base (7470)..(7479): a, c, t, g, unknown or other
  modified_base (7750)..(7759): a, c, t, g, unknown or other
  modified_base (8817)..(8826): a, c, t, g, unknown or other
gcgggcctcgaaggcaggggagccccgggccgcggtgccgccccccgcgagcagggccgtcagggcgggggcaccgggccgcgcctccccctgcgcgccgcacaggcgcgcgagaaggtcgccggcccgcggcacgccggcgatgnnnnnnnnnncgcggctccccctgcgcgccgcacaggcgcgcgaggaggtcgccggcccgcggcacgccggcgatggcctccagctgcccagccgcgatcgggggcaggcacaccaggcgctgcagggacgccgtacgctgggctaggtcctcggcgagcgtcgcctgggggagttgtcggggggcggggaggcgtttcggggtgtgccaccctggctggcaaccggccgggatggagtggtggcctggaaccnnnnnnnnnnagagaggcgtctcggggtgtgccaccctggctggcagccggccgggatggagtggtggcctggaaccgcactgcccctgcgcgcgtctgcactcacctggggcaggggcgggaagcgcaggagggagaccgggcatgcagccgagcgccaggggcagctggcggcgtgcttgctgaccagctgctccgagtatcgagaggcaagggccgccacgtcctcagcttcggcgccgtcggggataggacacaccagccgtgcgccgcagaactgcaggattgtggactcgtggggcccgtgttgcatgggtgcgagggacgccccacccttcctgcttcccttccaccctcctcaatgtaaagccccctaccatatgggagcgtcgcgcacttgcatgcactgcacggcgacggagcaccaccccatactcnnnnnnnnnnctgggagcgtcgcccatgtgcatgcaatgcacggcgacggagcaccaccccatactccacgagcttctggcataacatatgcacaaatcagaaagacatgcagggcgtgcatcctgcgctgtcccagacgctccccacttgcatgctcacctcgcaggccagagtgtccacgcccgtgttctcccacccatgccgagcgcagtcagccggagtgatgccggcaggcttcgcaaaccatgtggcagatctgaaagtctgaaggcgagtgaatagatccttgcgatcccaggtctgtcccttggccgctggagcgggttttgaagggacctctgtcgagtcgggggtggggaggtacaccaaagagtccagagccttcttcagacgctttcggctttcctccgacatttctggggcttgagtttggtagaaccagccacttcacaccgtcaaattcccgtgatcataccttctcgtatcggaatctctcccctgaccagtgctcattgcgcgccctgagggcgcccttcttcgtcccgggacgggcggctttacagagtttcgccactagcaggccacacgacaacggcctcgccctcttctcagcnnnnnnnnnnctgagtttggtagaatcatccacttcacaccgtcgaattcccgtgatcataccttctcgtatcggaatctcttccctgaccaatgctcactgcgcgccctgagggcgcccttgttcgtcccggggcgggcggctttatagagtttcgccactagcaggcaacacgacaacggcctcgccctcttctcagctcggttcccagctctgtcaggccggaggatcgacccaacaccatgggggtgcgtggaggctgtggctgggtggaggactggctcgggggatggcggggggtggcgccacgtcgggagggccagctgagatgctgcgggcgcttgggcactcaccagcgcgatttgcacacaccctccgcagtcattgctggcgaccgaggacttcacgcacatcctgcgtgtgctgaacaccaacgtcgacggcaagcagaaaatccagtatgccctgaccgccatccgcggaatcggccgccgctactccaacatctgctgcaagaaggccgaggtcgacctgacccgccggtgcgtgaggcgctgggaggggagctgggggtggctgtgcgagcgaggggannnnnnnnnnnnnnnnnnnnnnnnnnnnnnnnnnnnnnnnnnnnnnnnnnnnnnnnnnnnnnnnnnnnnnnnnnnnnnnnnnnnnggggccgcctccctctgttctcctgagctcagagacccgaagcccagaaggcttgccgggtttcctgttcgaaagggatcgccagcgggcctcgccccacccgcctgtcctcctcacatcccacgcagcgccggcgagctctcgcccgaggagctggagtccatcatgaccatcgtggccaacccccgcgcctacaagatccccgactggttcctgaacaggcagaaggacgtcaaggacggcaagtacttccagatgacctcctccatgctggacaccaagctgcgtgacgatctggagcgcctgaagaagatcaggaaccaccgtgggctgcgcgcctactggggcttgacggtgcgcgggcagcacaccaagaccaccggtcgccgcggcaagaccgtgggcgtggccaagaagcgctgagtgccgtgtaggccgtggtgtaacctggtcaggagagccggggcaggcggggattgggagggcgcggagcaggtgtgccgcagctggaaacgaagcccagggaatgcagggagcctagnnnnnnnnnncaggccgtggtgtaacctggtcgggagagccggggcaggcggggaatgggagggcgcagggcaggtgtgccgcagctgggaacgaagcccagggaatgcagggagcctagaagacagtacatggacggagggggtgtggcattgaggcagcatcacagggacggaaggttgctagccggcgccatctcagatgtactctcggaaatgtggagtggcagtcacacaagagggcgcgaaagtgctacgagcgcgctgccccgaagccggactccatgcgatcgaagggcatgtatgggtgcacgggtcccgtcacatgcgttccaaaacaacctcacacctttgtgtgtgcctggatacttggccggcaagtttgatgcccatccgccccgagctcttctttcagtccacggcggctctgactgcctacgccatcacctttacagccctgggcctggatctcctcgagcagcatggccacacccgaacccacatccagcaacccatccagcagcaacaacccatcgtcgggaaatgataatgtcgcacgccaaaaaagtgctgccgaagcaggggtgagatcctctggctgccaagggaagggtggctcattgttttcatgaacttcatgaaatggcctttcgtcggataccctcagcagcatgccctcccagactcattcggtctcttgcacttcctctccagaccgagagcctgaagacaagcacggctgacgaacccaggaaagattgtaaggagcagtcaccactgcgctcagatccagaggaaggtgtgatcagactgagggaatgtggtggtgatacactcaacctgggggtgtcctcctnnnnnnnnnnagaaggtgtggtcagactgaggggatatgggagtgatacactcaacctgggggtgtcctccttttaagtctgcttcctctgctgcaccttgaagctgtgccaccaatatgcatggcgtgacactctccgctgcaggtcaggagacactgggggagtttgcgggcttcatcatggaccgaagtcgccagtagagatcccagtgatctggatttttttctcaaatgccacacaggctcgattgtcatgatatgagcaccttcgctgccacaacatctcaaggtatcaaagatcttgcgtaccatacttattctcaaacctggcagggtgcgagctttgtaaactcgtgaaagcttgaggaagattcaagtgccaggccgagcagggaatgaattgcttctgtcctcagctatgggaagatttagtcttcgtggaatccaggatgcaaatcgcgcaaannnnnnnnnntcgagcagggaatgaagtgcttctgtcctcagctatggggagatttagacctcgtggaatccaggatgcaaatcgcgcaaagaagttgcagagaaaaccccaatcctccctgtacctcaccctcgcacgcttccacctatctatcagaacctggttaattagccttaaactatggttgcatacaccttgtgataatctcgcggcccattcaccannnnnnnnnntccagtgatctgattgtcttctcaaatgccacacaggcgcgattgtcgtgatatgagcacccttgctgccacgacttctcaaggtatgaaagaccttgcataccatacttattctcaaacctggcagggtnnnnnnnnnnttggttgattagctttaaactatggttgcatacgccttgtgataatctcgcggcccattcaccaggagccccctttcggcgatgagtcacgacctgacaccgctcggcgtggtgctcttcagtattgcttccgccatctcgggagagcttatcaactggatcctggtgtaccggacgagttcgtaccgtgccctcaaagagaatctctcgcgccacgcaaagaagctcgaggaggccaagtccagtgggagcgggagcaagaacatcaagaagctggaggcccgcctcgatacatggaagacggaggcctccgcccgtgtggcgggcatcaacatgcgcaccggcctcatcgtgcgtgggttggaggggggcagggcggcgagcctggcagagcagaggggccaccagggctgcggggggtttggacgggcttggacgggcggactagggcgtgtccagcatatgatacatttggacgtgtattgctgcgtcaaagcgatcaannnnnnnnnntgggggcttggacgggcttggacgggcggaccagggcgtgtccagcatgtgatacattcggacgtgtattgctgcgtcaaagcgatcaatccctcttccctgccatcccctcctgcagaccgtggctgtggtcatgctcagtttccgcctggtatcgcagctgtttggcgacgcgccggcggccaccctgcccttccacccgccgcccttcctccaaaagctgacccaccgcggcctcaccgacgccgacccacggcagtgctctgcggtgagtgggactggcgcccattggttggcatccctggcgacgcgctcccgtcaggacgcctgcaaatcactgtaacctttgggcaggcgcagcttcggtcatcccacctgacacccgccctcaccnnnnnnnnnnatcaggacgcctgcgaattactgtaacctttggcaggcgcagctccggtcatcccacctgacacccgccctcaccaccacccatgcagatgttcatcttcatcctgtgccagggatccatcaaggtgctggtcaccaagctcctggccctgggccctgggcgcgagtgggtgatcatcaagcccaacaccctaatgggcctgagcgacaagaagtgactgtgccgtggtaacattatccttgcgcacttacaacagacgcaggggctgtagggacgttcaacgaacccgattggggggggggggggggggggggnnnnnnnnnnnnnnnnnnnnnnnnnnnnnnnnnnnnnnnnnaggcctgccgtccagcgagtgagatgcatttcgttccaaaaacatgtgggagggggagtagaccaaaattcaaggatacacgggtgggatggagtgtgagttgcgaggcccagccggtaccagagcaggcgaggccgcggacaaaaacggggggcgggcctgcctgtgaacagcaggccgccagggaaaggcaagggaggagggggcgccgtggtccaccgaaggaggggagaggggcggcgacccgcggacgaccaggccgcacacttttcaatgcggcgcgggtcgtccagcgcacttgcaaggcgccggcgcctagtcgctcgcggccaggcgctcgtcctcggcagccacgacctcgaatccctcgatgggctggcggcagaaggggcaggccggcaccaggtgctcgcgcgcggagcacagctggcgggcgcagccgaagcacaactcgtggccgcagccggccacggccacagacacgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggagaagctgtcagcgcggcaaacaggaaaggttaggtgcccacagaagctgcagtcagaatcacactcaacacggcgatnnnnnnnnnnaggctgtccaacagcgtgtcaacctggcgctcgcacgccggctcactcgactccgcacgacctgctgtggagtgggggggggcaggggagaagctgtcagcgcggcaagcaggaaaggttaggtgcccacagaaggtgcagtcagaatcacactcaacacggcgatgcagatcttgctcctttgactgatcccaccaatcactcaccgctctggcgcatcagctcctgcagctgctgcacggtctggctcaggatggcctccgtctcggcatcagcctcgaaatctgccaggctaccacagccatgcggtccatgcgccagtcccttgtccttgggcgcagcagctgtctgggcctccgcagcaaggcgagacgagggtcctacgacatcgtggcagtgggacggggtgaggaatgctgcaagagagagaagagccaacagcaatccagcaaatgtagcctctagcaacaagcacatggtacaaaccgaggtcacgcccaaacgcggctctgccccaggccgactgttgatcgggaagcaccaaagcaacccccctttcaacacaccccacacaccagcctgacccgacatcccatccacgcaactcaccaaggccataccgctccgcgcggcgctccatctcatcaatggcctggaggaggcgtgccttccaggcagccaccccgggccgtgagatcaggccaatgctcgctagtcgggagggcgcgggtccctccctctctccctcctcagcggccgccaggagctgccggctgcggtactcgatggccgcatcgagcacggcagccagcatgcctgtggcggtggtcttcaccaggagcatggccagcgcnnnnnnnnnnnnnnnnnnnnnnnnnnnnnnnnnnnnnnnnnnnnnnnnnnnnnnnnnnnnnnnnnnnnnnnngtgacccatcgttggaggccctccagcaccagctgctggcccgtgtacagtgtcacggagaagaagggatgcatgccgggtcgaaggcccggacgcggagggcagggccaagcagctgtggacgggcggggaggggcgcttcccgtgagtaaatttcctaaaaggctgagctgacgtccaagcatgcgtattcgggccgaccggggaagcccgggcgagcannnnnnnnnngtcctaaaaggcggagctgacgttcaagcatgcgtaatcgggccgaccggggaagcccgggcgagcaaaccaccgcaccaccacgaactctcaagacagttcagcgcggccccaatggaaacggcatgcgcttccaacgcactgaaaatgaagtaattccatgtccgcggcctgaggcaggccacagaggctagcccgccgggtcgggaaggaccttcccgggcattcacacaacacccgaaacagcccctcttgacgaccgtgccgcctnnnnnnnnnntgccagtccagtgcggccccagcggaaacggcaggcgctttcaacgcactgaaaccgaagtaattacatgtccgcggcctgaggtaggccacagaggctagcccgccgggtcggggaggaccttcccgggcattcacacaacacccaaaacagcccctcttgacgaccgtgccgcctcaccttgaatttatagccgtttgcggagaagagtaggctatagggagtccgctcgcggcccgtgcgccactttccaagcagcacccgaactccacgcgctggtcggtgggagcaggcaggaagggtgatgggtgtcgatcgttcgcgtcacttgtctcaaggcttaatcaacacatttaccaggtcagagctcgagttggcgagggctggtatgcctatttcggcattctgtccctcacgatcagattttgctattgacttcggtggatattcacaccccgggtcgaatcttctgcgcccatccaattcgcatccataccgtttaaatgcttccctgccgtcggtggagggctctgggggcgtgggatgagggaccgcatcatcagtgctttcaattgagtgtacaacgttcggtgccagcaatcgactcacttctggtgtccatcaccccagtgcctcctccagcctcgccacgatgcctgggacatgggcagatcccacgatggccaccacattattgccgccctgctcgtgcgctgtcccactctggacgccgtccctgtagctccagcgcaccccctcggcaccccgctccctggtgtagcccggggcgtccagcccctcccccctcagcgctgccaggatcagcgccgccatgtgagcgtcccgctcctcaatcagcggcccccgagccccaggccagtccagcaacgcgtcctcaccccacagcttaaagccggggccctggtcctgcgagggaaagggtggcgtgagatggatgtgagcaacgtaagggcagggagccgtctccggtgagggttcacgacacacgatataccgcacgaggatgggccccccttcgtgccggcgagcgctcgtcnnnnnnnnnncggcgtgaggtggatgtgagcaacgtaagggcagggaaccgtctctggtgagggtccacgacacacgacataccgcacgaggatcggccccccttcgtgccggcgagcgctcgtcgcccacagccccacacacccctgcgcgcctggatggacgtgtgcaggcgcaccgcctcctcgatcccctccgcgctcctgttccccagcagcgtgatctcggccaggggtcctaccagcggccaggccgcgaccgccagcggcactgtcacggcgagcaggacggccgcaacccccgcgccgccctccggcgcggcc

SEQ ID NO: 41445 - DNA, 74 bp, Chlorella protothecoides
ggcctgcgatgagtaagtccgatcgagtcgatccccccaccccctgtccacctcccctccaccccaggaagccg

SEQ ID NO: 41446 - DNA, 76 bp, Chlorella protothecoides
gggccctccgtggatgcctggcggccagcgtcccagcgcatcagcggcgcctgtccaccaccacaacaggcagccg

SEQ ID NO: 41447 - DNA, 108 bp, Chlorella protothecoides
accatgcacacgcccgggtcggggtacaccgcgcatgtcactccgggatacgccggctccaccagctggctgaccgaggagctggtggagccggtgtactggttcgtg

SEQ ID NO: 41448 - DNA, 153 bp, Chlorella protothecoides
gggagtaggggtgagaagagcacaccactaggatgatgccagggtcaaggtgtgaggtcacaccgccggaggattaatgtcagtgcacttccacaggcaaaccgtcccgcaaccgcaaccagcgccactcacccagccccaccaggagtcatg

SEQ ID NO: 41449 - DNA, 79 bp, Chlorella protothecoides
cacgccggcggagctgtcgcgcctgatgcgtaagatgcggttccgccctggcgaggcgctgtcggcggaggcgctgtgc

SEQ ID NO: 41450 - DNA, 126 bp, Chlorella protothecoides
gggggcaggggctggtctccctgggcgccgaccgacgcggctgggcatcgtcgcgggcgtccaggccgctcgactccgccgggatgtgctgacggtgcgccgccggggaggccagcgtctggctgg

SEQ ID NO: 41451 - DNA, 61 bp, Chlorella protothecoides
ttcctccgcccgccgccccttcaagcccctgcccctcacctccacagcgggttccagtcgc

SEQ ID NO: 41452 - DNA, 75 bp, Chlorella protothecoides
tagggctataaggcgcccgtccacactgcggtccacaaacagctctttgataacttgggctcacagctggggcgg

SEQ ID NO: 41453 - DNA, 61 bp, Chlorella protothecoides
agcgtttgatgaatgcaatgcgacaggctcctgctgatggttggcttatcgtttttgacac

SEQ ID NO: 41454 - DNA, 61 bp, Chlorella protothecoides
ccccacccccaccccgtccgccagcctctctcccgacgcacccctcgcgccatccagcgat

SEQ ID NO: 41455 - DNA, 61 bp, Chlorella protothecoides
ttacgtaattgaggcacggcatatgatcggccgaatgccgtatgcggtccctcgtacgccg

SEQ ID NO: 41456 - DNA, 61 bp, Chlorella protothecoides
cacatacaccatcacgtgcggctggtcggggctccacacacaggaatgaggttatagccac

SEQ ID NO: 41457 - DNA, 61 bp, Chlorella protothecoides
tcctggaagcagactcctgcagaagggggggaatggatgaggggtgtcaatttgcatgcgg

SEQ ID NO: 41458 - DNA, 104 bp, Chlorella protothecoides
tccgcggctggcctcgcggtcccgctcctgggggtgggcagtgggccggaaaggggagaagccggggagggagttctggggtggtgatacaccacccctgccac

SEQ ID NO: 41459 - DNA, 71 bp, Chlorella protothecoides
gttgggcttgatgggtctggggttaccagggtgattttttttttttttggggggggggggttgtgggtttg

SEQ ID NO: 41460 - DNA, 61 bp, Chlorella protothecoides
gaaaccccgcacccatagttccacaaaccagcccgcagggtgtcactgtcgaggccatggt

SEQ ID NO: 41461 - DNA, 97 bp, Chlorella protothecoides
cccgtcggctgtcctcccacatgccccgccacgccgaggtcggcaagtgtgctgtgcgacgtataggccccggcagcggcaacgctgtcagccggca

SEQ ID NO: 41462 - DNA, 79 bp, Chlorella protothecoides
gctggcctcgcggctcgcggcggaggccggtgcaccctttccacccactgaatcagacttcctctgggcccacgccgtg

SEQ ID NO: 41463 - DNA, 73 bp, Chlorella protothecoides
cgagctgttccgcttcttcaagaggcacgccgtgggggtttttatccttggctcgaggcggaggttggggtgg

SEQ ID NO: 41464 - DNA, 83 bp, Chlorella protothecoides
tttcctccaatctggcagtgttacagctcgcgctagcgctcgcccacgcgagaaagtatcgttatcgagctaacattcatata

SEQ ID NO: 41465 - DNA, 66 bp, Chlorella protothecoides
agcccagacgtccaacgccaccgatgtggacgtgcggtgcggctgcgacatctgccccggcgccct

SEQ ID NO: 41466 - DNA, 80 bp, Chlorella protothecoides
gggcgcactgcgacggcctccagcggctcgggactggttctgaatgctccctcaacgaagggtcaaatctgttgtcacgt

SEQ ID NO: 41467 - DNA, 61 bp, Chlorella protothecoides
ccaggagatcgcggcggaggtgctgtctgcactgaagcccctctcccccgacgagttcacc

SEQ ID NO: 41468 - DNA, 76 bp, Chlorella protothecoides
ttgggtgaggggacagagatctgaaccaacgatgaaaacctggatgaggttgccactgcgatgctggggtacgggg

SEQ ID NO: 41469 - DNA, 61 bp, Chlorella protothecoides
ccggagtcctggcctctggtaggcagccttgggtttggggtcagcaccctttgtgaagcta

SEQ ID NO: 41470 - DNA, 73 bp, Chlorella protothecoides
aggaggcggtggcaacatgaatggagggggtggggattctgtgggcggagggctgagagacttcttgggtgga

SEQ ID NO: 41471 - DNA, 81 bp, Chlorella protothecoides
gatagtgcggcaggcgctggggcagcaggggcagcctgctccttgcaatccactcatacagcaccaagctctcattgagca

SEQ ID NO: 41472 - DNA, 64 bp, Chlorella protothecoides
gtagtgcccgaacttggccgcgtagtcgtcaccatcctgggccacggagctgcggaagaaggtg

SEQ ID NO: 41473 - DNA, 372 bp, Chlorella protothecoides
  modified_base (95)..(267): a, c, t, g, unknown or other
ggggggttggttgaagggcagtgccacgctgatccccgggaactggtgcccggtgttgtccgtgtaccacacccaggcgtcggtgatgccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccaccagattgccggacaccaccatgctgcaggccgcgtagtcccctgggtcggtggaggaggaatcgggcctgcagtatgccgccaggatggcgacgtcgtg

SEQ ID NO: 41474 - DNA, 3417 bp, Chlorella protothecoides
  modified_base (99)..(269): a, c, t, g, unknown or other
  modified_base (699)..(708): a, c, t, g, unknown or other
  modified_base (1159)..(1168): a, c, t, g, unknown or other
  modified_base (2435)..(2444): a, c, t, g, unknown or other
  modified_base (2618)..(2627): a, c, t, g, unknown or other
gggggggggtaagtagacagttttcccccctcctttgtcgcctggccggctagcacatgaccccggtcaccgccctgcacgccgacaggctcggcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcccgccgcggcccgcgaggccgcccgcaatgccacccgcgaaggccccgcgacggccgagcgcttcctctccctggtgctgccgcgccacaccggcttcggcctcacgcgcgccgagctggccgaggcgctgggcccccgccacgccgccgccgatctggaggccctgctggactggggtgcgctcacccgccaccccaccgcccagaccgcctcctacatattcggcctgccggatgcggggcggtacctgcgcagcgtgctggagggccgcctggtgagtcagcgtgtatttttgggtggggatgatgggatgacaatgccccagagccctgcagtggggccaccggaccatggaaggcctgccacccccagaatcacccctcgagctggagcgagtccgctcccaccggcgcaggagctgctnnnnnnnnnnatgtattttggggtggggatgatgagatgacagtgccccagagccctgcagtggggccacaggatcatggaaggcctgccgcccgcagaaacacacccctcaagctggagtgagtccgctcccaccggcgcaggagctgctgaccatgctgcagcggcggtggcacggcgagacactggaggcggagctgctgaggaaagggcggctgcggcgcagcacgctgggcgtgctgtggcatctgcgtgatgtgctgggggcggggctggtggtcaggcgcgagaccgcggtggggcccatgctgcgcctcgcgactcggacgtaagggaggcctgggtgtctgaaggtgacctcctgtttgcgaatgaatcttgcacacgatccagcacatctctattttctccctgtgcatggatgtatgcctgccatccacgcccgcgaccatgacccggcnnnnnnnnnncatgaatcttgcgcgcgatccagcacatctatgtttttctccctgtgcgcggatgtatgcatgccatccacgcccgcgaccatgacccggcggcacgaaaaatgcctcgtcattcagcagtgaagtactttcatgtcaacccaagactaccaggcatgctgtgtcttcacatgagtgccccaggcaatgagcacggcgcataagggcatgcaggaccagcaagggggccccctcagctgccctggccgaagaagcgggtgatgctgtgctgggagtcggccttgcgcttgcctgacttccccaccgcaccccggctggagtcacacggcgcgttgcgcagcgtgcgcagcatggccgcttcgcgcaggagcgccgcctgctgcctgacgtccacgcccgccagcaagggatcctcctcgctccccacggggccctctgacgagtgggcccctgctgtcgacggggccctggcctctgccccaccaccagagcctccagggctgcgactgtttgcggcaagtattgcgcgaggggcagcggcctcgtgcggggtggcgtccggtgcgtcattgccgagcgtgctcctcgcttccgctctgatcgcatggccttgctgccgctgtgccggcgcagacaggaagcgggtgatggcgctggtgccagcggcggggacgggggtgaagtcggtggccgacagtgccagacggctgcaggggagagcatcctggggtatttgttggcatgggtcgtgagtggtctgaggttgctcgatgaaccgagttaccatgctggctcgatggacgtttgacagaataggtaggcaggaacacggattgggcctgctccgaagaaaggccgattcttggcggggagccagccagcgcaagttgccacccaaggcagctcctcgtacccttcgtcagcaccccttgtgctcagcccctgccctgggcccccaatgcctggccccaccgctcacccactcaccgccatgcagccggtgaggaaatatgagtaggcagcctcagccagtacctggggcgaggggccctggccgggtggaaagcggggcatgaggaacacccggctgtgttcgccatcggtctcggttctacagcagcaaaagggtacacggggttggacgccagcggaaacaaggatttgaagggagcatggcagggtcttaagtgcccctgcccgggtcacacactgtcctgctcacccccctgtcctcacccccctgtcctcctcaccccctgtcctcctnnnnnnnnnntctcaagcgcccctgcccgggtcacacactgtcctcctccccccctgtcctcctccccccggtcctccttcccccggtcctccttcccccccacgtcaccctcaccacagcacctgtagtgtatcgtcaggttcttgggccgacgcaggttctcctcggcgtcgatgcccaggnnnnnnnnnnccctcactccagcacctgtagtatatcgtcaagttcttgggccggcgcaggttctcctcggcgtcgatgcccaggcgcggcgcgagttcgttggccaacacgacaaaccacgacttgatcacatccagatctgcgggagggggtggggtaggaggttggccgccgcagaggtcggcaggttgggcagggccagtgtcccaggtgaactggtccaccaggaccagccatcgctgtgcagatgccgcacgagcccttgctgaactctgcgccacaggcatgcgggcggcatgagcccaccttctagcaccccagtgacaggtgcagggcctggcaactgctcggccggaagaataccccccaaacatccaaacccacccctggtgttgtaaaacgtctttgccgccagcatggactttgtgacctccctggccttgacgggctccatggatatgccctgcacctgcgcgaggcaggggcatgaggggttccagggtgacctggcatgcagcgtgcaccccagcaaacgactcggtgtctcccagagcctaccctgcccaaatgccagcctgccgcaggccccattccacaccccccactggcccaccgccgcggagatgaaggccgcgcgctcaggtccaaagcggcgctcgagcacctcgggcgccagcgccaggacgtcgccggcggtggcacagcccagcgccgccagcgagtcccccagcttcccaccgaagttgcgcagcttggggaggggaaggttctggggtggcggggagtggtgttggggggg

SEQ ID NO: 41475 - DNA, 1702 bp, Chlorella protothecoides
  modified_base (140)..(261): a, c, t, g, unknown or other
  modified_base (787)..(796): a, c, t, g, unknown or other
  modified_base (1282)..(1291): a, c, t, g, unknown or other
  modified_base (1473)..(1482): a, c, t, g, unknown or other
ccatcgcactcaccccctccccctcccccaaaccaaaaccccaaatcccaccagtgggcatcttcccctacgtgctcaagctgctgcagaccacggccgccgacctgcgcgccaccctggtcttcatctgggccaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgacctggtgaaggacggcgggcacgtgtactttgtcaagcagctggacgcgcgcgggtctgggcccggcggccccggcgcggcgccgcccgccgccgccgagtcacgcgcgcaggccgcctttgtgctggccgcgctctgcgacggccacccgcgcggccagctgctctgcgccaaggccggcctgctgggcgcggtgctgggccagatgccagcggcgctggcggcgctggccgccggccccggcgccggcggcgacggtcagagccggcgctccagcgcgctgctggtcaagtggctggccctggtgctgggcaaggcggtggagggccagcccgccctctgcgccgccgccatggcagagcaggtctgccgcaggtctttgtgtggtgtgaggaggaggggggcggtgagagggatgtctttgacggcggacgggcgctccccgccgacgctgcgccgggccgtccgcctgcgtgcgccagcctcctcgccgtgccacatgtcgccacaggatccccgcnnnnnnnnnncgccccgggccgttcgcctgcgtgcgccagcctcctcaccgtgccacatgtcgccacaggatccccgctccttcctttcctgcaggcgcacgacatcgtggccaggctgctggccagcgccgacccggaggtgcgcggggcggcctgcttcgcgctgggcgcgctcatccaggtggacccgggcgaggaggaggcggagggcgagggcgaggccgccggcgcccagcccccggcctcggagcgctggaagcaggagcgcgccatcgcctgcagcctcatggagatggtctacgacgccagccccgtcgtcaggtgggtgccggggcctgttttgtggagggacatctctgtgtactcttggaggggccatgtttttgttttcaaagtaggtatgtggaggggtgggtgcaggggagcgagggggatcatggggcgacagagcacgggacccctctcccccgagggctcgcagccggccagcgacgnnnnnnnnnncggtaggtgcaggggatcgagggggatcatggagctaaagagcacgggacccctcccccccgagggctcgcagccggccagcgacgccgaggccgtctgatgcccctcaaacagtcgcactgcaatccttacccctccatgctcgacacggcaccaaaaattcgcgcaggggcgaggtggcnnnnnnnnnncgatgcccctcaaacagccgcactgcaatccttacccctccatgctcggcacgacaccaaaaattcgcgcaggggcgaggtggcgtgcgcgctggggcgcctggcctcgggccacggcctgctcttccaggcggcggtggccgccttcaagcgcgccacccctgccgcggcctgcatccccacgcgcgccggcggcgcgggcgcggccgcctcggcgccc

SEQ ID NO: 41476 - DNA, 66 bp, Chlorella protothecoides
gtcgtgggggcgggcgcgggagcggccggggcgtgcgtcgtgggggcgggcgcgggagcggccggg

SEQ ID NO: 41477 - DNA, 72 bp, Chlorella protothecoides
tttcgaggaattggagcgcgggagggcgcggcgatgccttggatggtatgcagggtgcccatgaccttgtca

SEQ ID NO: 41478 - DNA, 445 bp, Chlorella protothecoides
gccgaactgcagcgtgcgccgcgtgccgcgccggcgcctggcggcggtcggcggccccacgccggccccgcggaccaggcgccagtcgcggctcctctggcgcacgctggtcgccgctcggcggcgcagctgccggtgggcggaggagtcgtcgtcggacaggtcctcaggccgcatgcccggccaggtgttgcgcagcggggtctgctcctccctctccacctctccgtagatggggaactcggccacgcggggccagggcggggtgaagccggggatggggccgggccccggcgccggcctgcgccacggccagctcatcgctccgccgggcggcggggcggggtcggagtaggcggggcggcgcgggctgacgcccttcaccggccacgacagggggggcggggcctcgaaggcggggacggggcgggagtccggtgccgcg

SEQ ID NO: 41479 - DNA, 98 bp, Chlorella protothecoides
gcaagctcaagtttggaggtgtggaaacataggtttggggaatgggggggaaggggtggggcgcgcgaccttcccacctgcagctgagcagtcctgga

SEQ ID NO: 41480 - DNA, 67 bp, Chlorella protothecoides
gccctccgcctggctggccgcccgcctcgccttcacccgcaccgccgctgtctggtccatggtgggg

SEQ ID NO: 41481 - DNA, 20848 bp, Chlorella protothecoides
  modified_base (218)..(247): a, c, t, g, unknown or other
  modified_base (340)..(372): a, c, t, g, unknown or other
  modified_base (8769)..(8811): a, c, t, g, unknown or other
  modified_base (20506)..(20549): a, c, t, g, unknown or other
ccccagccacctttcccccccccaagagtccccccgcgcaccgcccacccacccgcatgtcgtagggcgcgacgtggtccacaggcggcggccgcgccgaggaggcacccagcagctcgaagccccatgcgacgcaggcccagccccagccgaagcaccaggagcgggcgcgggcgcggcgcgccagggccgccgccgagtgcgtcagcgacaccgcnnnnnnnnnnnnnnnnnnnnnnnnnnnnnngcgggtagacagcagtgcgtgggccacaaccaggccgccgtaccctgccgcagcccaccaccagatgtggtacttgccgaacacccaccagcnnnnnnnnnnnnnnnnnnnnnnnnnnnnnnnnngatcacctgggcggccatgagcagggccatgacgcacaggatggccagccactggagcacgcccagggcggcacgcccagagatggccccgcccgccacgcgggggcccccaactgggcgcagggaaggaggagcgggggggcgggggggctggtgccatgtcatcggccagggcggaggggcatttcccgatcgcgctgggcggcacggcaggcgcaccccctcacacacacacacacaaagcggcctcccggccaggcctggcccacctgaggcgcgctgcgtccagaaggcggcgacctgctccaggaagctcagcagggcgtggctcatggccagggaggagatcgcgtagctgcgggagggcatgggcggcggcatgacgtgcatggcgcgcccctcatgaacggacgtcgacagcccaacccccaccgctgccttaaccccagcgccgcctgcgttcccccacccctcgcccccacaaaagactcactagttgtcgcggccccaggtgaggacggccatgaggtggaactccaggaggatgaaggcccagacgcggtagaatgttctgcgcaggcggggaggatcaacccttgtgcatcgagttggcgtgggatggcggcatgactcgcacccacacccacctccctgctctcccaccccaaaaaacagaaagacctcgaacctgtacatggtgaagatgctgcgccgctctacaaacgtcttcctaaacacaaacgcgccccaccagtcgcgcgcgacctccacgttccagcccacgccccccgtgccctccgtgtccagccgccccgccgccagcttggcgatgggctgcccctccacgctgatctggaccctgccgatgcccagcagggcatcgtaggggtcgcgggacatggcgatgctcccgcccggcccaaccctgacgcccaggcgcagcagggcctgatggggttagagggaggagagtgggggttggggggtgtagggagctggtgagtgggctgggcatgacgagatgaagatgggcttgtgcagggcagccactccacaggaggaatgtacatgcctctgccacgccgcattgccctacactcttcggccacccatagaccagtcagcactgcgcacagccccccctcccccccatcctgaacaccctcacctgggcgacgatgtccctgcggcacagactctcgttcacgtcatcgtaggcgatgcggtgggcgatttccaccccgtccgtccccatcctgtccacatgaacggccaggaaggcaaagatgggcgagaccacccggtccaggaagtagcccgcgtcgccgtgcgccgccatctccgccagggccgcgccgtcgggtgagtctggctggatggacccggtgtggaccagggctgtcagggccatggactcgcgctgcgtgttgccacataggggggggaaggtaaggtgggaggagaatgggaagcagctgtggcggggctcgtggatttcacggtcgatcactggcttggggatggaaatgatgggcgcaggtacgatccttcttggggggcaccaggggaatgggaatagcttgacgtcccagcccttccaaccgtgcatggagacgggaggaggtgacggcggtccttgcaccctcagacactgcaccaagatgacacgacgacatacatacttaccgtttcgtccacgaggtcaggcgtggtgcccagagcagccatagcggccatcagctcagcatggtgccggttgcggagactgatgtttcgttggatgacatcagcatgcttcaggtgttcgtctgtcaaaggcacggcgggggattggtgctcatcaggatgggaaagggtgtggctcaaccttgtctgggggagcactcggagagcccgaagcagagatggggtggtggagcataacagcacagcacagcctgtgaaatccagaagtgcatgccatggactacaaacgccactcacatgcaaagatgggcgaggaggggtgcatcgggtttgggcaggaggcaccattccacctgtggaaggagttgcggcatatccagtagacaaaccaaaggcactccggggtgtgccgcaggttggctgcctccgagtacaccaggaagtacatggccagctcctccagcccatactcccactcctgtgccaaggacgacagttgtagtcgcaatggtaaaggggatcggtgctttgatcagtgccaaaatcgaggttgaccatggttgccctaccgagaaggcaatcgagaacacgtgtgccggggctcacactgatcaccgtcaccctgtgcaaaatcttccaccttgcctgtatagtgtgcggcctgtggatcttggccagcttgagctccggtatgcggaggggcagtcccacatgtgagcaccagtcgcggtagccctggaaaatggcggcgtgcaggcgatgcacggcgcgtgcaaatcgatccatgtcgtcacctacggaggagtatggcggcgtgcggccaggatgaattctgcacagaggcaggcgaacaccacgccccccactccatgaacattgatgtagccaccagcgatggacgtgcctgtgtccttgtccctccgcatataattctttacgagaaggtgatacaagtgatctgtggccaggaagatggtagcaggcgtccaggatggcttttcggtgccctgtggggagattggttgtgcatctcattgcccaacttggcttaagcgcaatgccctccatggcagcagacagccgacccgcgattgctggcatcattcgaactcacctccgtgcggggatcaatattgaaggcctgaaatccgaatcgacggccgaggcgtttgaccacctgcgagtgcgattgtgcagcctgtcgatgatcggggcctggcaccgtaaccaatcccatttgccgcccggccaagggctgcgggaacgacctgccaacgccgcaaggccaccaccgcgtaccgtgaagatggccacctgccatcccgtatcattggaactggatccaaaaaggctgatccgattggctgccgacatcgcagcgcttcctcccggaagcgaaagtgaggcaggtggttgagcgtgcttcacgctgtctcgcaggaagtctccatcgctcgtccggagagagtgcagctgaccttcagcgccttgatacacgtatggaaggggctgtaagcaaggagtcgaatatcaagtccccagcactcggcggtgttaatctcgccagccctgttccatgggtcgctcagcgcgtcctgctttccaactttcagttgtccaaatggagggggcttgggtgcgccatcctgccatctgcccacttgatcagctagctaagtatatatttatcttcatgctgaagctagatagctgataatgggtctttatcaagccttggtagtcgcatgctgagggtccatgtctccagcaagtatgccatgcgagtgtgtcaacaccatacattcctgaggcttcttctcattcaacctgagggaatgtgtgacactcagagtaagcaatcagtaattcttctttggcaagcacccaggtgggcctaatgctcgaattcagtgcgcgtgctgacagaccatacaaacgggcgcgccctcgaaaaccgggggggcgaaggtcctttgaggatacatctgcaggccggatgcgcctctgtcgcccatacgcaaaagacacacaatggtgaccctggtgtcatggggaccagactacggctctggcagagccctcgctgtgcagtggatgcaggcttagccccttcccgaccccagaccgtcccaccactgagggccaccccacctcctcagcgggtccccctgacccagaagggtcagcccatagaccagccacggagtcatgctccattcggtggcccaccaaagtgagtcaatgcgtgtcttgtggaaggcttgggggagcggggatgccagctccctcgcaagattgggtcgctggctcaggctcaggctcttgctcctgcccccctccctgcagacgggcccacctcccgacgaccatgttcacgcccatggaggatcttccaccagacggagaggcacgttgtgatgtgtcatcaggcctcagttgccgagcctgtggtgctttctgaggtgatctggttgtcacgctcgccaaacgcagggcatgccaccgagtctcccgccccacccaccacaggtgttgaccttcaaagaacagacgtgcaacgctgagacgcaggagtgccccacccccatgtttgtgtgggaggtcaagtgcaagtgctgcttcgggacgggcttctcccgcagccgaacgcacgccagcacgtccaggcaccgccgagggcgcgggggcgcacggcgagccgccctcatcacctgcacctcctgtgctggacttgggtacgtgcgccacgcctccgccactccggacgacacgctggaggaggcgtttgtgacgctggggcgggacaggcccgggccggaggacaaggcccggccctggcggccgccctcgctggccaaagccatctccgccgtcaacgtcgtcgccaagctctacaactcgctgaagcagcccacgcctccaatgtgacggcgaggggcgtgctgctgggctggaggcgtcgtgagttgcccggcacgactcccacacatggcctgctggagagtgtgagtggcggcgtaggagcgtgaacccaccccaccccacccccctctctgggcgcatttccaccctggaccgccttccaataatgcaatgcttcatgcccgacaatgcgccagggaccgagcgaaagtctgcttcaaatccctcacccccttgcacagcaatgccttgtcctatggcttgttgcagtccccatgctcttccaagcccttcttctccgtccgctccactactgtttctcatggctgcctctgcccctgcagcaagcctgctcccgactcttgctgcaaacaatctcctctcaacaacaagcggtgctacccttattggtcgggaggggccaaggcctcgcggacgaggtcctcgatatccatacatgggggttgcaccttgaagcccggcgcatcgcgagatgagcgacgccgtgcgcggggcaaaatccgccggccaacaggcacaatgccatcggatctgggggaaggcatactcacccttgtgctcggccccggcctcaaccccccccctcgccggcgggctgggccatggccgtggtaaatagcacccgcaccagctccccccggccgtcgtgctccctctccatgcccactaccacgccctcgtcggcgcgccacagcgtgcgcagcatgatccctccctcccccgacgcctccagctgaaccagcagcgcgggggccagcagcagggccacgccaccctcgtgtgggcctgcccgatggccgtcgggggcggcggccacctcctgttccacggcctcaaacaccttgagcatctccacttcccccgtggaggggctgatgccctccaccaggctggccaacacgccacagcgccgccagcgcccggcgaacgccgcggccggcagggcgcccggcgcgcagcccggcggcaggagggaggcggggtcggcggcgcgccccgggacggacgcctccacccacacgcccggcacgcccagccagcgctccgccgccacgcccaggcgcaggggggccaggtcgaggcgcccccgcccgtcccgcgccgtctcgcagaggagcgagacgcgcaggcggtggtcgctgccccacgccaggcagtgctccagcaggtgcacgccgggggccgctgccgggggcggggcctcggcgtcggcagcatcctcatccccgcctgggggcatgtcgggcaggggggttgtcaccgtgcttgtaagaacaggtctctgggtgggtgcaggcgacgccccccattgctgctgcaagggacacgccctgaacaggctgacacagccaggctgcccccccaagcccacgctccgcggctcacccagcagggaggatggccccaggctgtggctgccgccgtcgaagaagaacaggcccggatcctcgctgtcgtgccagtgcgcctcccaaccctccgccccgtccaggtccgcgtccctccccgcccccgccacctgctccagcacgcgcagtgtgtcccctggccccaacccatgcgcctccgtgctgcggcacggtggggatcggcgggcctaggtgcactgtgattggagaggagggctgcccgcaagggctccaggccctcactccacgcgccccagcagtctcatccccacgcctccacgcacgtcaccaggcagtcgcttgcgtcgtcggccacacggcgctgcaggaccacccgggccagggagaagacggtgcctccttcctcgtccaaccccacgccctccgccgcgcctgtgaggagcgggcagggtgtgccgggttgcatgcagaatgcacaccggccagtccccagcgagggcaggtcggggtgtgggtttgatccaatggcatgcaagcatgcggtgactatggtggtggtggtacgcacacgctcagaattgaggggctcctcaccagaggcaggattgcaggcgcgggcggaccccagccagacgccctcgttcacgccacagtaggtcgaccagaggggactgggcaggatggaaggccccactccaggcacaggccggatggccatggagaggggggccatcgcctcgccctgcggaattcccgtcaggatctcgctgcccgggccagcatggcttcgaggtaacccatgccatccatgcatgagcctcaggccaccggggccatgcattctgcacgcccctgggcgccgcgcgtgtattgcgttcagattggggccacacatcccgaaatcacatgccgtagctccggaacccatgtcctggatccggagagggactctccacgctcggcggtggagatgccctcaagggggttccattcaatatgctaagaatggcccacacgatcttgcctctgaaattacgttcattacatttgcaacccgatgatatgatcgatgctgtgggcgcactgtgaacgaggtgtcacctgtggtcagatccgtgcatgtgggcacatttccccggagcagaggcatggttctttagtgggcgtacgccttcgagacgcagtgccgagtgcgttcagctgtgcactatgtgacaccacatgatggtgttttaaaaagtgcaccgtgtgcatggctgctaccccggaagcacagcattgcaccttgacatgcacgacttttgtctcaccctcccctacgcactgctcgtcgcggtgcgggagctcattcggtggctggcgtcccctagcactgctcacataggtttgtgcgagatggttgtctgatgggatggtccagaaccccctgacatcggcagggggtagccacgacagaagagagcacacaccttatgcaggccagggattgggcagtgccgccgcactgggcttcctgggttacaccagcctaaaagcgtacaaacagggcaggagagcgcatgtgactgcagtcctctcccttggtcagtcaggggcatgtggtgcgtggactgtgatgagcagaggacgttgaattcctcgcatggggcctgctggtctcgggttcccataccaaccctgtaatccccctgggcactgcagtgctggcagcggcattgctctcccgcaccctcacagcaagcgggctaggttccttggctggagcgctaagtattctttcggatggaggaatggccgccttctatgtgtggaaccttactctgttccatcccaagctaccactcccgaaagagtaactccagctatgatgtgctcctgattgcatccacaacaatttcctgtgtgaagtgtacaccactgagacctcttcaccgacaattatagattgaattgaagcatcctggaggcctgtatctttcggtgccatggcccgccagagcacgcgcccacatcgtggatggcaaagcactgcatggcgtctatctggtcatctacttcttgccaggatttttccgcagggtcacccctagggcacgcgacagctttcctaaaatctgtggaggaagggagagaggggtggttggaagtggacgctgtaggaattgctgtgtccaggcaagagacgctgccagcatgcaggctgacaaccaggaccggagcagtgcggcaacagcttggacccgactcaagccaggtacagagccccatgcacagccatctgtgtcctcccacctggggattgggaatggccttccctgcctcatactcgttgatcacctggggcttttcattgatcatttgagctagctgcaaggtgtgtgggggggggggggggggnnnnnnnnnnnnnnnnnnnnnnnnnnnnnnnnnnnnnnnnnnntcggtgtcagtcaagttgggagcacaccacatgctatgccactcagtgctctcctacacagtccacaaaccaaccaacccgccaagacaaccaaatgacccactctaatcaccctgccagttctgtgccgcccacctgtgcttggctgagcttcttggccaggcgggcctgctggatctgcttcttgagctccgagctcacttgctcgtgatggaaatcctcggtttctgcgtccagcttcacagcattggggttgcctgctctcgccttgttggaccccgcatcgtgcttcttgacggtgctcacggcagcgcctgcgggatagtgccggaggggaggagtgaggactccaacctctgactgcacccaggccaagttcaggcacgttcagtataaaatagcctacctgattgcagtgcagcattgacaaccgcggcagactgtgcggtggacgctgtgggagccttcttccggaggaccacctgggaggagcgacgaggagaacgttggccttcccatatccgtattgctttcgaagagttaatgcgaggcgttcccgggtaccctactcacgctgttccagtcctgtccctggaggttcatagcgcgagtcctaagtggtgatgggcgacgtgaagtccaaaagggagatgcactattctcttctatctacaatttgtggaaaacgtggcgaagcgcaagctttcacgcgcgcatgggtgggggcgaggtgagctcgcgcatggaagaaactagatggggaagggggggggacgggttacttccccgagagcaacaaacatgcgactgacgcacacgcttttctgaattattcattcctacagataagtataaagaattcattaaacaatgtcaaatacttcgttggagatggccacgaccaccacccaatttcagatcacatactccggcaagagcctgcaggtgacgctaccccaccaagcctctgtgttggacctggtacacatcattttgagaaattttgatctctcccaggacactattaagctgattctccctcccaaacgtgggggcctgattcggctgggagaccacatcgatgctcgcattgtggacattggtgaggcagggcaggcatgcgccggctgggcagtgcagggcaccaatgtcgttgggtgtactcacagagatctcacatccgtccgaaatcgtccacaggtgtgacatcgggggccacatatcgagtgctggggagcagcgctgcagcagttggcgccgtcatgtcagccaagggtcagtaggggatggctgacttggtagctgcccgtgaaagcggccccgcagctgtaaccaagcactgatgcgggtatgcttacagcaacaccactctcaacccaccagatgagccgcgcatcgcggggtttgatcacgagctgcgtagggaggccgccaggcgtgcgggagtcgcccacccccgtgcccccccggcaggaccgtataccttcaagaacttcagggcctggcagacccctggactgacaccatccccagcagaggccctcgccttcctccataggtgccgctgggagggtcacagtgcagtttgcacacgtattggaggtggggccaagcttgcaacacgcgcctcaacctgaaagttcttttcatgacaacaaactgacccagccacattctctacaacagacttgcggcggacccgggggtccagggagtgatgtcaaggcatcggtggcgagtgggcacgctcagcgagatgccgcctgagggcaaggtgggtgtctctcccgcctgcatcctcggcgtcaacatcaatgcaggccaggagatatcccttcggctgcgcacagacgatctgagaggtgggcgcaatgatgtgaaagtgggcctgtgatctttgctgaggagaactgtatcgtttgactaatgttgaggacgatggtcgcagattggctcgagggagggtgagaagtgaagtggaagcgttcttttgcaccgctctcaagtgttcagcccatgctgatatgatcaagatcgctcctttgtgttcacaactctttgtccgtgcattgctgtgccctgcaggcttccggaggtacgacaggatctgtgagaccctcatgcatgagcttgcccacatggtgcactcagagcacgacaatgctttcaagaccctcaactccgaggtgagtggacgcatgagaagagcaaagtgcagtccttggatacctgtgtctgggctatcctgagagttgctcctggggattgggttgtaatctcagatcaagctcatttatattgccagatcacaaatgcgggcataggagtgaggttttcatttttatgtgcccacctcaatgtctgggtttctcctcctacatccagttgcgatccgaatgtgagcgactgcagcgacacgcaagcacctctggagaatggaccagtgaagccgcgagtctggactttgcgaaatcatctctgcccagcggggcacatcctgtcaagggagaaaggctaggaggcacatctgagaggagcaggcttcatcagttcacgggaagtggagatgctgccagaaatgctatcgctgcggtgaccagcagtgccggagccagagaggatgggtctggcgcaaggacacctgacccaaacggcgtgggagctgcagcaaggcagttcaggaagaacgatgcagtactctatactcagagagatggcagtcaagtgccagccaaggtgaggcaggccagggctgggtcggaacatgctctcatgctgactggagaggtgaggggcaatctgcattcgtatgacgctacaatgcagtgctgcatcacagatatgagatcttgaagcacttcccgtctgggcactcatgcaaaataggtcattgcagtggacctgtcacttgatcctccagcgtacagcattgaactatcaactggagtccgtgagacagaagggcatcgcttggaaccggcccgacctgaggagtacacctccgctgaccctcttacagccgacaaggaagccgcagcccgtgcgctcggagaatgaccatcatgagtacacatttgatatgttcatgtatcaagacgggttctcaaggctcttcatgatcgatatgggcctgtagaccacaccaatgcttgtaatgcagctttcacctaggcacaagaagttgtgcatggcatgtggagccaagggcatatggcccggcactacgacgtgcttatggatgcgaacgcccatgccggaccctcatgtcgttttcttcgcctgctgccgttggtgctcccggctcacttcgtccgccaagtcctcagtgctcggctggccaatgtgccggatgacgagcacccacaccaccagcgctaccagggcaatgtgctggttgatgtagccctgcttggcgcccaggaagatgcccagaccgctgcagaatgtgctggcgagcagcagtcccttgcccatgctcgcagcaagattgcctactccacccggagcaggccgggtctcgacggggcccctctactcaggagacttgcatgctgcgggatgctataccgagtctgtcacgaaatcaatctttgaacattttcgagagcacccgtcgctgctcgacgatgatggctcgcagtggcacacccacacggtgtttagctggcactctacacactcaaatgagcagtacagtccaccgatcatgcctgccacaaatgaacagacgtgaccatagaatcaacgaaattcaccctctcaagctctttagaggacggtgaggatgcatggccagcctctgggtcaagagagcagcaggaacctgtgacgcaatgcctctccaggggacagcctcccacgatatacggcattgcgcttgcacaccaacttgcatgccagatcccagcctgcgatagccatgtatgggtctgcttgccactgcgcatgccacaacacgaaggcgctcccgacagcccacatccatctcaggagcacaccgatgcatgcatgccagtcgtcctctcacctgcttggttatttgcgtccagcacctcaaagtcacatgcctgtactcgcatggaccgcctcctccacaaatcaaggtcgtaatcggcggctgcgagttccttgttgaaggccttgagggagcctgcggagcgcagctgagggatcgacatctgcacatgggttgtggggagtgaggggggccatggcggagttgaaggcttcaccgcagttccgcatgcgtcccaagccagcatgaagacagagtgccactcgccatgatcagcttcccggccggtcgtgtggcctctattcttctccagtcccttgcccacctggaggaggatgatgccggcagcgtacgagtcaaagaggtctggccttcccagcctccacaggaatggggccaggagcaccgcaataaagggtgctggcacccttgggacggcctttggcagaaccagctgctcaggtgctgcgcagcgagcggagttgggacgcataggtcgttccttgcaggggtcaaaaatgttgatggctactccactacaccctgcagtctcagtaggtacttcctcccaaccaaggtgcacggtgaacgtgccagccatggcattgcatgacaggctgggcccctgagcaccaggtccccagctcaccggcgtatcgagggtccagcatgccgtagagggggttgaagttcactccagtgctcaggtcgcacgccgccccaaaatcgatgatcttgatctgtgcgcagggagcaagactttggggccctttgagtgagcggtgtacctcaattcccccatacccctccagaaaacagggacgaccaaagtcccgcaggcccccccacatcgcagcaagcgggcacgtttcccagtctatgtaaaatcatcgccgtacgtctcccttgctggtcacaaggacgttgtccggcttcacgtctcgatgcacgatacccagagagtgcagccgttgcagtgctggggccgttggggaaagatggaagtcggacacaggatgaaggacatgctctgggcagccacagagtgccatgaacgaccaggccagggccgtggcagtgccggcgtcaggccgccatgctcctgcccaacgccaacaacaagagccatggggctaacctttcagcagcttccgcatgacggccttggtcagtgccagatggcgcttctggtccggcatggagtctgagcgtggccccagcatgatgcggcccagactggtctgcagttggagtggatgcaggtgcggaggggtgctgagtgggacgacagaaggcgctccgtcaacgtaatatgcgggggtgtggtgcaccgcgcgtccccaccaccaccaccaccccaggggcccccctcagcctcccgccctctcgcgccacacctccatcccgccatccaggaggccggccatggcatctgccagggtggcgtccgactcaaagcgccacaccagccactgcgtcccccgggtgaatgcgccgctggccccggccacctcgaattggcccaggtagcgcgcgacgcggcgcgccacctggccgcgcgagcaagcatggggaagggggggtgaggcgctcggcggggagcgtgcgcagggagggtctcggcactcgcacacaccacgccggcacgcaccgttgggtggcgcgagatgcggaggttcatgtagctctccacctgcccagtctcgcctgccccccgggccatggtgcctgcgagggtttgggggggagcgcgcaccgtgcagaccagcactggcgggccagaggacaaagtgggaagccctgcggcgggtcaccccgccggccacctgctttcaggaagttggtgcggatgcccgagttgtcgaggttggccttcttcagcaccacccgccgcttctcctgctccgggctgagcgcggaggagtacaggtccgggaccttgttggcagagagcagcccctcgtacactgcgcaggaggcgggggtggcaggggcgcggcatatacggtttggagcagaccccttgtcatcagatcgttgaggccagggtgcccctggcagaccagcacctgtcccaccacccccctccccaccaccccactccaccttgcccatagttgccaccacccagccgatctcgaagtgtgaagtcatcttctgtgaagcgctgttgcgtcagtcttgccaggggggtggagacataaaagtccagcagacctggaggagggaagcgtgtgcgtgtgatgacaagggcgctgattgccacaaccctcgagccggcatctcgctgttcaatgcctccagcacctgccgattctttgcattccagggcagggacgatgagaagcggcccattctcaaatccaccacaccagacttcctgctcaccgagcaagggactcggctgggccagtagaatgtaataggtgaatgagagacgcagtaccccaaacagagagggctggagggaggcaaaggcgacagcatcccctccaatctgtggaggggacgatgggggtcggaaccacatgcggcacagcgcagggcaacatgcaggcctgatcgaccaggctttcattcctcttgcaagttctggtgggtcctagaaaaccgccacccacacatgcagcgttaacagtgtcacctggtttgcaatgctggcaaggggactcgggagccaggcagtcacctggctcagaccttgttgcaaggtgccagctagttcaccaggatcaatgggtagggcccagaccctcccatcacgtgcaggctgcctggatctgctccctctgtgtcctgatactgacagcctggaatcatgtggacatacattccgggagctagcataggtccaaatagaggtcctcgccagggttgagcagttcatgtggggggatgtagagcccaagcaaccttcacagagagattgcaggaagtgtggagttcgaattgagggcagcatgcatggtgtcgtatccttcatgggccgaggccaccccgagatcgaaattgctccatgcgtcacagcaggctcgctccattgccatgcctcgcattgctcacctgcacgatggcatgaattcttccgcctgacgaccgcaggttggagtactcctagacaggcgcttgaatgatcttggggcatgcgggtatggtgacctgcatcgcatgcccagcatgccatgatcttccgggtccctgcacaaacccacccggaatgtatcgtagacgccagcaagcgctcctcaggggaaagatcacaaactggagacagctcatcattcctgtacactggcccggtgtttgcataccaccatgacagggtggtagagtgtgacagcatccaccacccgcaagggtgccagccacagaccttcacttacagggcatcaggaacgatcaagcgtttgatctggttattgtgacaatttcactggctgcacggtccccgaactcttgccaacgaccaaaggcagcacatctggaccagaatccatcataaaatcagcggggcaaacccagccattgaggattgccgtccgaccaggcaacatgatcacactcgtgcagtttcaccctggaatccctactttgcgccggtccgtttccgccaagcctcgatccactccttggcgggaaccacctcagctttgctggcgggggcatcggcagtgctcttcccgttcacggcacctgcagcatggacatgtgctgcaccagctgagagacggacagcaagatttaggacaactccaggccaggagagcttctggtctaccctgtacctcacagcccaatgcatgcagcccttgtgctagatactcactgggaggggagggcgcagccttggtggcaacagggctatctgtgctgtctcccttgggcttgaacgcagccgcggcgacacccaacacccccacactgccaatgacaatggcggagagtgggaagccccctgcaagcgatcgtacgtggggcaatggtgtactgcaggagccaggagaatcgaggtccaattcctggccacctgtcgatgacagtcaccatcccacacacatcgcaggtgcaccacttcacattgcagccttccggcacccaccaggcccccacccagtgcttgcacaccccagctcctcacctggcgcactggcaatagagccagtggcaggcgtaggggctgcgctgggggttgaaggggcctggctcgaggggggcgagtccagggcctggctgacagggctggccgcggtggtgcgctgcccgctgcccggagtctccgatgacgtgatgagggactgcggggggctggggcccccggcctgctcctgagcgggctcaggcgagggcttgggcgcggccgtcggcttggcgggggtgtcggggggggtgatgcgctgctcgccggccgcaggggcattgttgctcggcgtcgacgacggcatgggcggcttctgtgtttcctcgggggggacaatgatggcaggggagcccgcaggagccggcgcggcgggggccgcaggtgcaggggctgccggcgcaagggctgccggcgcaggagccggcgccttggctaccgcagcgacagggagcgtgggatgagggggcgaggggggggaccccacccccagcagacccccggaccggggcttctccgtcttaggggcatccttctctgggacagatcccagcagggaggggctggacaccgggtcaggctccggcacgtcgccagcctgcttctggtcgaagaggcgagagcggatgttcttcaggctgaagggtgacgtggactttgtcacctccttgaccgcctgcttggtgtccgacacggccgagctagcggcctccttggccgccttactgccggccttggaggcagatttggccctggacaccgccttcttgaccgccgaggcagccacctgcacgggtcccgcgatgcatgagtgagcacgatggagtcaggaccactgcaggctgggagcgccaagtctgtggagacttcagctcgcacttcggacagccagcaggcatggccagggggtatattcatggcagtgcgtctggggactctgcgtacctttggcgcagacttcagcgcctccaccgacccgcccctctcagcgatcgcagcctggaaggtgggcagtgcagagggagcaaaaggtcactactctgctgtcaaaagtatatctctctgcgggctgctgcaataaggtgagtcccaggcatcacactcctccaccactcagacgtcagaccctgcccctgccacacctgcaattcggcagcgtacgactgactctgcgcatacgaggaaagttctttgcttgcagcctgggctggtgctgcattctgcagatataggaaagatcgtgcatgagatgtttgaggatagtactctgccatgtgcctcccggcactgtctgctgttacctcctcattggaggtggctgcttgatgggccacacatctggatacccacgtgaccatgcctcaccaggatcagggctgcggcgatcgccgaaaggcctgtcatcagaccattgcttctgtggtcagagctcggggggagggcagcaaggcacgcctggcgccttggccggcaaggggcccccgaggccttgctccgaggcagtcccttgggatgtactccgcccagctgtacattcgccatcatagttacccaaggcgaccaaattctacacggaatatcgatgagatcgctgcactcgtcgctggtacagttatatcccgcggagctgaccgggcaatcttcctggataaattcacgtgctcccggcaggacggggtgggggtgtgtggggggggtcacaaagaaactatgcggtacgaggcgtagcgtattacgagtactacggttcgttttaccttttcaacgtgtataattgaatttgattttaccaggaagctcgggcggacttgtaccaaggtctcgccatgactctccaccggatacggccgcgacgcgtcgcgctcatctgctgtatgttcacgcttcgggtatgcacatgaggtgtctgattgagtcgttcatatgaggagagtgcttaaatgtctcccgggtaccacctcacctcaccccaccttcacccttgcacccacctagctggccttgggaggtgtgagctacgaccagtctccatacaatcttacaccggaaagaggtaccgttggctgctgagcgtactgggtttcctgacacgttgcaattcagtgccctctgtcggcagggatgtacctgctgcccaccccgtccactcgcccatccccaagtagccctcactctgcgcacatcccagtgtcatgctttggcgtgcccatactgcccatactcatccagtgagactgaaaaatatttccctgtgcagaggatgagctcattgtctccacaatcttctccatggacacctgcgccatcgatgcagcctgcgatccccaggtcgacttcatgcagcgatctgtggtgcagctgacccagttccagcagaataacttctgcacaggtttgacagtatacttttgtgcggaaaagattgattgatgcagctgttgcgcggctgttgggggtgtgcccaggaaatgcggacctggaagagcaaaggctctcctgtgtaaccgggcaatccgactggagcggcacctttgttgcccctccaaccagacgctgctcccagccaccaggggctgatgtcagcgcgcctcacactcgaatctgttgtatgatccctgtctgtgccatgccacaaaccaagactctgtaccttcaacccccgcaggcaccctgataaagggaccaggggacaaaatctacatcctgtcggcccgccactgcctctccatgcgcggcctgcgattcgtatacccatggagcagctacagcgtcatcttcgactacgcgctgccctgcaatgcctccagggtcagcgacatcccatccaccttcggccggtacctgacggtgaggcatgggttagggagaatggcctggtcggggaggcaatcctttgcggcgttgtggcctgcaacacaaacgcttgggctgaacaggggtgcagctcaggcaaggactcacacttgcgtccctgtacacgtactcttctccttttcttcatttgaacacctatcccccccccttcttcccatgcacagggcctggccatcgtgtttgaggacgagcttagcgacatcgcggtgttcgagctcctccaggacatccccccggagtggggccccatcctggcaggtgagcctccaggtgctgcgggcggaaccccacctcgtcgtccagctgcaggtccaggcaacctgccacgggccggggtctgctctcacacgcgcctgcggcctcggtctcctgaaccttctcccccgtcccaacatcctccaacaggctgggatgccacggagctggacggcaacttcaccttcacggccgtgtcaaacccgcagggggacacccagaaggtcaccaccggcatgtgagcgggggagacaggggcccaagcaaggggcacggcttgccaggctgcttcagaggccaccgctccgtcctggagtgggtgtcgctcgaccgtgccgggggtgctgcccatggtgggacccgcgcccgatccttcccctccctcgacgacacttcccccccccccccccccccannnnnnnnnnnnnnnnnnnnnnnnnnnnnnnnnnnnnnnnnnnntgtcggtccctttctacagggtggtggtgaacgacgaccactccgtgtccctggtgaccaacgtgagctgtgaaacgcacacctgcggcttctacctctccgccctgacctccggcgcgctcaccgtgggcagcagcgggtgcgggctgtaccacgacggcctgggcaagatcgtgggcgccctgtccagcggcctcggcagctgcgccctgccatccgacccctggggggaggacgcgcccaggaagttcttcggcgccctcgcggcggtgtgtggcgggggtagcagcggggggggg

SEQ ID NO: 41482 - DNA, 146 bp, Chlorella protothecoides
ctctctgccacgccgccctcctgcgctgcgacggcaaggtcgacgagtgcgaggacggcgacgtggctggcgtcgaagtggccgacgtgggccgcgcccgcgcaaaggccgggggctcggcggccggcccccgcggcacgagggat

SEQ ID NO: 41483 - DNA, 84 bp, Chlorella protothecoides
tggcaggcccaccaggtcgcccacgccttcttgcacggagcgcacaagacccgtggggttgagcagcagggccaaggagcccag

SEQ ID NO: 41484 - DNA, 226 bp, Chlorella protothecoides
gggggggcgagagagtgtgtgtaaggatatgagcaaggagagatggagcaaatcatgcgaggaacgatcctgcactgtcgcccggcatggagtcgagactgacaacagagggcaacgcctggcccccctcctggaacacacgcgcacactcacaagcacacaacgtacctgggtggtcatggaggcggtgagccccgcgttcacaatctccttgaactcgtccatg

SEQ ID NO: 41485 - DNA, 74 bp, Chlorella protothecoides
acagcccatgcatgcagcatcagcgcgcagtctcccagaatgtaacagactctcagccaactcacggcggcctt

SEQ ID NO: 41486 - DNA, 61 bp, Chlorella protothecoides
cccgcagggcaaccagtggaaccggctgcgggccgccaacgggcagcccaacttcacttga

SEQ ID NO: 41487 - DNA, 61 bp, Chlorella protothecoides
cggcgcattctgcatggcctctgccgcctccttgttcagtggatcgtccggatttggtgcc

SEQ ID NO: 41488 - DNA, 66 bp, Chlorella protothecoides
agtgtggggtagcacaggagagggggggggtggggtgcccactatgggcagggctcccggtggtaa

SEQ ID NO: 41489 - DNA, 61 bp, Chlorella protothecoides
gtcagggccgcctgcaggaatcaagaatgataaggctgtcattgcattgaaagatgcatgc

SEQ ID NO: 41490 - DNA, 75 bp, Chlorella protothecoides
tcctgcacacaggtgctggggtccaaggggacggcgtcgattcggtgcatgggcatggcatgcgcgctggcggct

SEQ ID NO: 41491 - DNA, 61 bp, Chlorella protothecoides
cattgcaagtggttgctcccccccccccttacctgccactggattcaacgtgaatgccagg

SEQ ID NO: 41492 - DNA, 61 bp, Chlorella protothecoides
agggcttgcagtgggacgaatgcccctggcaccgccaattccagcgccactcctcatggct

SEQ ID NO: 41493 - DNA, 144 bp, Chlorella protothecoides
ggcggccacgctgggcgcgctgcgccgccatgcacgcctcgccctggccgccgacttcgccttcccgctttcctacggcccgccggtgatcggactgggtgtggtggtggcgggcgggcctggcactgcggcagggggccgccc

SEQ ID NO: 41494 - DNA, 61 bp, Chlorella protothecoides
ctgaagcagcgcggggttgctgtacgccgcacccagctgcgcctgctgcgcctgctgggcc

SEQ ID NO: 41495 - DNA, 61 bp, Chlorella protothecoides
atgctcctgcgctcccgcgcgcgcgaggtggtcaagtccgtgctgggctttgtcaaggtgg

SEQ ID NO: 41496 - DNA, 61 bp, Chlorella protothecoides
tgctccagctgacgttgggagcggcagggggggattaagtggccttgctgacgtttggagt

SEQ ID NO: 41497 - DNA, 131 bp, Chlorella protothecoides
gcggcccacagcccaaggtgggtttgacccaagggtgaaggttgggttcggacttcttgttgaggagggaggagtgcaggtggggttggtatcagggatccgagatgagcacacttgccgtggcctggccc

SEQ ID NO: 41498 - DNA, 70 bp, Chlorella protothecoides
caggcctgggtggaggctttgggagtgttttttgggatgtggggggggggggggggggttgggggggggg

SEQ ID NO: 41499 - DNA, 61 bp, Chlorella protothecoides
gctgggaaacgcttcatgcgccaatctaacccgtctttccgctttccaaatgcaatcaccc

SEQ ID NO: 41500 - DNA, 61 bp, Chlorella protothecoides
cgatgggttcgtcacccgcagtagcggctttcgtcatatcgccgagtttctgtatctatgg

SEQ ID NO: 41501 - DNA, 125 bp, Chlorella protothecoides
cggagggcctgggcggggcggggggttgcgcgttcgagggccctggaggggggccggccgccttcccctggcgggcggcccgggaggccgcgccgggtgccaacgacgacgccggcgaggggtcg

SEQ ID NO: 41502 - DNA, 67 bp, Chlorella protothecoides
tggggcaggccgggcaggaccagctgcgcaacctctacctgccatcattgtcccgcctgctggatgg

SEQ ID NO: 41503 - DNA, 68 bp, Chlorella protothecoides
tggtaccttgaaagtgcgggtgaggtaaaaaggagcatgactgacgcatgcagggaaggtggggactc

SEQ ID NO: 41504 - DNA, 66 bp, Chlorella protothecoides
gctcatgcttgcctcccacccccagtacacaccacacacacacacacctgccacttgcgcgtgaac

SEQ ID NO: 41505 - DNA, 61 bp, Chlorella protothecoides
gcgtggtttgtcccttcccactgcggcagggggaccatgtctacactccatggggtgattt

SEQ ID NO: 41506 - DNA, 37326 bp, Chlorella protothecoides
  modified_base (109)..(211): a, c, t, g, unknown or other
  modified_base (282)..(291): a, c, t, g, unknown or other
  modified_base (1073)..(1082): a, c, t, g, unknown or other
  modified_base (1252)..(1261): a, c, t, g, unknown or other
  modified_base (1876)..(1885): a, c, t, g, unknown or other
  modified_base (3673)..(3773): a, c, t, g, unknown or other
  modified_base (3841)..(3850): a, c, t, g, unknown or other
  modified_base (3918)..(3927): a, c, t, g, unknown or other
  modified_base (4080)..(4147): a, c, t, g, unknown or other
  modified_base (5365)..(5374): a, c, t, g, unknown or other
  modified_base (7749)..(7758): a, c, t, g, unknown or other
  modified_base (8111)..(8120): a, c, t, g, unknown or other
  modified_base (8563)..(8572): a, c, t, g, unknown or other
  modified_base (8661)..(8670): a, c, t, g, unknown or other
  modified_base (9788)..(9797): a, c, t, g, unknown or other
  modified_base (10272)..(10281): a, c, t, g, unknown or other
  modified_base (10964)..(10973): a, c, t, g, unknown or other
  modified_base (11301)..(11310): a, c, t, g, unknown or other
  modified_base (11610)..(11619): a, c, t, g, unknown or other
  modified_base (13202)..(13211): a, c, t, g, unknown or other
  modified_base (13267)..(13276): a, c, t, g, unknown or other
  modified_base (13405)..(13414): a, c, t, g, unknown or other
  modified_base (13763)..(13772): a, c, t, g, unknown or other
  modified_base (14349)..(14358): a, c, t, g, unknown or other
  modified_base (15009)..(15018): a, c, t, g, unknown or other
  modified_base (15261)..(15270): a, c, t, g, unknown or other
  modified_base (15437)..(15446): a, c, t, g, unknown or other
  modified_base (16257)..(16266): a, c, t, g, unknown or other
  modified_base (17082)..(17091): a, c, t, g, unknown or other
  modified_base (17603)..(17612): a, c, t, g, unknown or other
  modified_base (18655)..(18664): a, c, t, g, unknown or other
  modified_base (18829)..(18919): a, c, t, g, unknown or other
  modified_base (19052)..(19061): a, c, t, g, unknown or other
  modified_base (19144)..(19153): a, c, t, g, unknown or other
  modified_base (19236)..(19245): a, c, t, g, unknown or other
  modified_base (19664)..(19714): a, c, t, g, unknown or other
  modified_base (19871)..(19880): a, c, t, g, unknown or other
  modified_base (19952)..(19961): a, c, t, g, unknown or other
  modified_base (20033)..(20088): a, c, t, g, unknown or other
  modified_base (20467)..(20476): a, c, t, g, unknown or other
  modified_base (23030)..(23039): a, c, t, g, unknown or other
  modified_base (23322)..(23331): a, c, t, g, unknown or other
  modified_base (23956)..(23965): a, c, t, g, unknown or other
  modified_base (24402)..(24411): a, c, t, g, unknown or other
  modified_base (24587)..(24596): a, c, t, g, unknown or other
  modified_base (25324)..(25333): a, c, t, g, unknown or other
  modified_base (25468)..(25477): a, c, t, g, unknown or other
  modified_base (25548)..(25557): a, c, t, g, unknown or other
  modified_base (26073)..(26082): a, c, t, g, unknown or other
  modified_base (26585)..(26786): a, c, t, g, unknown or other
  modified_base (26882)..(26891): a, c, t, g, unknown or other
  modified_base (28094)..(28103): a, c, t, g, unknown or other
  modified_base (28529)..(28538): a, c, t, g, unknown or other
  modified_base (28633)..(28642): a, c, t, g, unknown or other
  modified_base (28749)..(28758): a, c, t, g, unknown or other
  modified_base (29512)..(29521): a, c, t, g, unknown or other
  modified_base (29880)..(29889): a, c, t, g, unknown or other
  modified_base (29948)..(29957): a, c, t, g, unknown or other
  modified_base (30015)..(30148): a, c, t, g, unknown or other
  modified_base (30312)..(30321): a, c, t, g, unknown or other
  modified_base (30674)..(30683): a, c, t, g, unknown or other
  modified_base (31301)..(31310): a, c, t, g, unknown or other
  modified_base (31514)..(31523): a, c, t, g, unknown or other
  modified_base (32036)..(32055): a, c, t, g, unknown or other
  modified_base (32290)..(32299): a, c, t, g, unknown or other
  modified_base (33283)..(33292): a, c, t, g, unknown or other
  modified_base (33685)..(33694): a, c, t, g, unknown or other
  modified_base (35025)..(35034): a, c, t, g, unknown or other
  modified_base (36099)..(36108): a, c, t, g, unknown or other
  modified_base (36872)..(36881): a, c, t, g, unknown or other
ggtggcctccaggaggtaggtgacacgggctcctcctagtccagggtttctgccactggcatatgcaagtatggacatgcccccccccctcgccagctcacaccctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccatgccggccctgatctgctgcagctggaactgaagaccccgcttgtgcgccatctgcagcgccgtcnnnnnnnnnnggccatcccggccctgacctgctgcagctggaactgaaggccccgcttgtgcgccatctgcagcgccgtctggcccccctcgtccatgacccccaggctcagcttctcgggcacgctcggcggcttgaggtccatggacaggaggcgcggctcggtgtagtactccggcgcatcctcccacagcatggcctcccgcagacggtgccgcttgcccaccagtccgtcagactggtggctggcgtgcaccgccacctggcagtgagaatgaaaggaagggcaacagaaggggtcacggtgggggctcgggagattctttctgcctggaccccgaccaggcccttgcagtgcggggactctcctcgcggtagcactggaccaggctggtccatcgcattgttacccagtggttggtctgatgagtccctaacagaccgcgcctgttctcttcccaccctccattcctccactcccccgcaatcccccccactgcacccgggcatcccctcccaccaccatccctcccgatacaatccacgccacacgcccacgacccctgcagcgcacctgggtcacgtgcatcaggcccgccaggccctggaccgaggccgtgtgcgagccgaagcgggccacgggcagcacgcccagcaccaggcgcccgccccatgcgtaggacagccggtcctggcccggccagagggcgggcgtggcgcccaccccctcgcacagcgccgactccagggcggcctgagcgttgcggcccggcagcgcgcgcgcccatgccnnnnnnnnnnccgcattgttactcactggttggtctgatgggtccctaccagaccgcgcctgtcctcttcccaccctccactcctccactcccctgcacctgccccccccggcacccgcaccccccctcccaccaccatccctccagacacaatccacgccacacgcccacgacccctgnnnnnnnnnnagcgcccgccccatgcgtaggccagccggtcctggcccggccagagggcaggtgtggcgcccacaccctcgcgcagcgccgactccagggcggcctgaccattgcggcccggcagcgcgcgcgcccatgcctggaggaaggagagcatggcgggcgcggcgcggagcaggagcaggccgtcgtcggtgccggccgccaggctggcggccagctccagcccgccgtcgccgtcggcggtggagttgaccagcgccgcgccggcggccagcaggtcggcgtggggctggcgggagaagaaggggcgtgggtcctcggcaaacgcccagtcggcgtcggacagcgtcacgtccaggccgtaggagaggaaggcgcgggccagcccgatccgttggcaggcggtgctgttgtggaagtcctgttcgcacgccttgcttccccctgggcaggggaatatgggggatgtgtttttgggtgggggggaatggtcagtcagtggagcctgaggacggggggggggcacaaagcagtcttgaggcagggcggggcatgccagggcgagccctggctgctggacgacagcatcgtgatcgaattgcagagcttgaggatgtgtgnnnnnnnnnnggcacaaaacagtcttgaggcagggcggggcaggccagggtgagccctggctgctagacgacagcatgctgatcgaattgcagagcttgaggatgtgtgaagatggtggtcgggggaggaagcagcgttgaaagggtggacctgccgcccactcggcttgacaacagccctgcccctttacctgcagccatgactgagccattcatgtccaggttgtacatggaaaacacaggcagctttgcatccaggagggcctgcgagggaggtgggagagggggtgtggtggctccactgggagcacaaggcggtgctgggaagcgccaggggctgtgcagaggggctgttcgctggcccctggggtggcctcacgccaggacgcatttgaaaaaggcaggtgcccgacttgcagtgttgcacacactgccgcggcgccggcagggacgaggttcaaaccccttgaaagctccttcccacccctctcccagtgatgactgggccccagagggccccggcatgatcatcgccgtctttgccgccccacatccccttcccaccctcgcactcagcctcctccctcacctgggctgccttctcgtccagcgctcccacgaggaaatttgttgcgttcaccctttgcagactcctggcccagttgaccgcaaagtccgcatagacctggctggcccaggtcacaaagatttcgccgccctgagctgctgcgtgggccagctcccggttaagctgcggcaccagctgtggtccgcatgccggctcatacgctatcttaggtgacttccagcccaggtactgcgtggggcggaggggaatccgggtccggatggtgatgggtgctagaaggggggggtcctagcccggttacacggcccgtgaggagctggcccatgcacaccttgtccgatatgagcaccccattcccgtataaaacggcgctggtgacgagaacgatgatcaggtggttgcgccgcatggctttgatgtgcgccagcaacccttgcacggacatcggccgggtcggccctcaccccgatgacgccccgtacccacacatgcgaggaagaggcaggacgagatacgaccacggtcttttggtgtcgtcacaagctggctcggagacgaggcctagcatgacccagcctagcttcccccttggaggcttgatttagatacccggtccgattcctttgaacgcgcccgcgcgcgcgccctccccgtcccctatcccaatgtattgatggggccctccccgcctctccttcccaatggttgcggtttacacgtgcgtgcacatcacgtagcggtggaagctgctcagagccgctggaagcgctgcagggccttctgggtgtttaggaggaggtcggcgtagcccatcccgccgtcctgcccatgcggcaccttacggcagcaccagaaccccagagagcgcaggaagcggctggccatcctcgcgttggccccctgctcctcccagcccccccacaaggccagcgggtccgtcacgtggatgcggtgcgtggcctcgtgcgccgccagcgccgcctgcagccccaggtttgtggagttggcaggcagacgaagggtggcccggctcctggcgagtggggaactgccttccggggagttcaccgcagcactcgctaattccaggaccacgacatcatcctgggagggggatagtggatttggggggaaggattggcatgggaggaggtctcgagcaagttcacttgcgcggtgggagagccagcgagcggtgttgggaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccagcaggaagtggcaagtcatccagctggtgccttgcgggatgtgccgtggccatcccatgctannnnnnnnnnagccagcaggaagtggcaaaccatccagctggtgccgtgcgggatgtgccgtggccatcccatgctannnnnnnnnngtaatggaatggggggggaaggaaggatggagatgggaggaggtttcgagcaagttcacttgcgcggggggagagccagcgagcggtgttgggaccccgcagcgatgccgctttcggtagctgtgggcccaattcgtgatccaccaggcagcnnnnnnnnnnnnnnnnnnnnnnnnnnnnnnnnnnnnnnnnnnnnnnnnnnnnnnnnnnnnnnnnnnnngaggttcacatgttcaaacaggccatgttcgtaactcagcaccccacttggcaacacactacacccaggcagtgaaagtatgctgggccccgcagaccccttcctcttcccatgtgcgccagctgcaaccctgccaaccccgggcccagggggccccaccttgacgacggcgggcgtgcgggggttgcccaggaaggagtactcgcggaaggcgaccgggggctcaccgccctccatgcgttgctccaggttccccggctcgaacacgtggtccatgggacaggtgaagggcagggggacggcctctgcccctgggatgcggcacctgtccaggggcgcccagtaccgatcgcacaggcacatcagctgcatgagtgccgataggggggtcgcgtagggagaggtcaggggacactacaggtactgggctgtgaaccctctaggggtgctggcattgcatgcatgcactgtcagcagaacagggggcctggaggtcacgctttgcgacctccagccctggtatgcgggtgacagggcatgagggttgctgcagggcaggaagacagcaggccctcccctgtgcacccttccgccacgcgccttgcttctcggccccatctcattgctgaaacccctcacccctcccccgccgccttcctacccttccccatcccattctccctcgcacgagtacagcgcaaacatcaccaccgtcgcacacgcaccttgggcatgatgaaggtgcggttgagcaccacagccatggccataccggccctgatctgcagcatctgctgcagcatgccctgcaggtgggcgagctgcacggcatgcatgccctcctcgcccatggtctggatgccgggcgggatcgctgggtactgcatgtcgatggagaggaagcgggggccggcgtagtaggcgggtgggtcgtaccacagcatgccctcccgcaggcggttgcgcttgccgggcgtgccgccgtactggaaggtggtgtgcaccatcacctgacacagggcgtcaagtgagtgagtgggtgtgggtgcgggtgtgggtatgcacgcgcttgtgcgcatgtgagtgtcttggtgtggttgtgggcgtgcagttgtgctgatgtgacccagatggcgacaaggcacagcggggtagcaggggccatgaacggtgtccagcagcgatgaaaggaaatgcaggggaggctccatggcaggnnnnnnnnnnacaggggccatggtcggtgtccagcgttgaaaggaaatgcaggggaggctccatggtaggtggccgccgccccggcgcgcccctcgctgccaatcgcgttcccgcccccctgccaccgctccttcctttccacaccagcatccactcacctgggtcagctttttctgtgccgccagccccgagacataggccacatggcccgaggagtagctggcggtgggcaggatgcccaccagcagcgcgtcgtcccaggcacgggtgaggcgggagggcgccggctcgggcgtcatgcgcccaacgtgcagcagctggttgaacagggtctggtcccaggccttggggtcctggttcaggcccttgcgccaggcggccacgaaggccagcgtctgcggtcgtgcacggaagaccagcaggccgatgttggccacggcatggatggcgccggcctcctccagccccgcgtcgccgacgggcagcccggagttgagcttgtcggtgtgcgccagcacgtcggcgcgggggtggctcgcgaagaaggcgcaagggtccgccacgaacaccgcgtccgagtcggccagggtgatgttcaggccgtaggacaggaaggtgtgcgccaggtccaccttctgcctgcccatcttggtgaaggagggggagccccagccaaagtcgcctgcggttgcgatggaggagaggtgaagagggtgtcggtgtgtgtgactgtatggagggctacgcttttgggaaagggggggtgaaggggagggggagcgatcagcagtgaagtggaacacgcccaaagatgcacggccagaaactggatagccagaacgccaagtcccacacacctttggtcaggccagtgctgttggcattcctctcgtacatggcaaacactgggatgtcgtgtgacatcagggtctgcaggggttggaagggggggtgggcagctccaagcttgggagtggggtgggacagcatcgacagcatgggaagtccagaggggtggccatgcagcatgtgttgctccaggtacttgcatgcatgctcggatggactgtgagtgcagggagtggtcaaccaggtcaaggcagcaagctactcccattccactgtcacccacaaaacagagggggctgcgcaagctctgggcccccacccccgccgcctccagtgctgcttgccttggctgcgcccacgtccatggcaccgacgaggatgttgtgcaccccaacatctttcaggtgcaaggcccagttcaccgcaaagtctgaaaaatgctcgttggcccaggtcacgaatatctcgccgccgtcggcagcagcccaggccaactccttgctcagctgaggcacctcatctgttggtaccctcaagatggtcacactggtggccagaatcccccatggcaggacctggaggggcacaggagggcacactgggtcgcactcactccgggcagggggatgtaaaggggctgtggtgccgcgccagtgtcgtgcacccatcacctggaagctcctgtaggctatgaagcaggaagatatgatgatgaaggagcaggcaatgatgagcccgagccacctcatggtgaggtttggcaacgttcctcaggcacgccccatctacttcgagtccacctccggtgaggtagaccggaatcgaggcccaccagctatggttattaattcagatctggcgtgagggcatctttgatagggcaggtagctgccaagcgaaaccacctgattcgcttgtgatattttccgggcgcgagaacctggttgctcgcgtcattccatttcttggcgacgtctcccctcacgcttccaaatgcgccgcgccctctcaggcttcccctaatctaccgactcaacaggtgccaactcctggacatacagccacagcttggaccccgataagacacctgggagacatgagccgcttcttcagggactcgtccaccgagaatggtgagaaacagaaacgcctgtgccccgggggacgcctgcatgggaaagccggctgaattcgtttccctattgccctcgcagcggacatccaagaaaactgtgtgaagcatgcagtcgccgtgggggccaagtctgcagccatggctctggcggtgtccacaacagtgatcttggggagctgcaaggcgttccctcgattcggccgggccctgggcgtcagtgcacgtacagccttgatcgtgagttggggcgatcaccgtgtcccaatggaggttgacatctacctatggcatagcaaaggcctatgacgtgcttgggatggggttgaggcatcataagggtgttcagaacttcaagggagagggtagaagggtgtagggtgtccctttgccgggacccttnnnnnnnnnntactgtgtcccgatggaggttgacacctaactatggcatagcataggcctatgacgtgtttgggatggggttgaggcatcacaagggtgtccagaacttcaagggagagggtagaaggtgtagggtgtccctttgccgggaccctttgaactcagcgtcaatacttgtcatctatccctcccatctcctcaggcttcccctgcctttggattcttcttcctggacacggagcttgagttgaacgcatgtgcacagaggcatcgccacatgcagcgttccttcaagaacccatccgtgactggacagtgagaaatgtctgtgaggtgctcatcgcgctagttttcagtactcannnnnnnnnntttcaagaacccatccacaactggacagtgagaaatgtctgtgcggtgctcatcgcgctagttttcagtactcatctcagccgtcccagacttgttaccatcttgtatcatgtgccctgttgtgtaaattttcgttctggcgcatgacaacagtgcttggcatgggaactggtttgtccgatggggagcaaccctgtagcgttgctgaagctggcctgacacgcagggacgcatagttacgtaaacggcaagcaaggtcggggtacacgaggccctcattacccagcagttgatatgctgtagttacgtcaaagatagacccaccgttgcgaccttttggagtcgatatcgcacggtgtcgggactattgtctgtcctttacgccagccaactgtcctttgtcgcgagtctcagcacttccgcttcactcaatccacgtcccnnnnnnnnnnacaaggtcggggtacacgaggccctcatttcccagcagttgatatgctgtagtaacgccaaagatagacccaccgttgcgaccttttgnnnnnnnnnncgagcttcaagcgccatggttgagcagccgacttccattgacgagtgggctaccgctagccttgccacagcaaggccggtacagaccccggaggtgcggagctggcctggcggggcctggcaaatctggccaggagtgcttggtagtcatcatcgagcctgtgcgctcacgcccatgtacccccatcccatggaacagatgtacgcctggtccgagtcggacagcgaggaggggctgctcggagtcgatgcggggtgcacctttgagggcgcagtgagccccgggtttaccactgaggatgaggaggaggaactggcccgccaggccgcgcgccggtaggcagaggggcggagtatgagtcgcagactgctggttttagggccgatttgttgctcaccgagaacctcctgtctgtctcccatccctccaacaacccagttcacccctgctgcagtggaccccctgccatgcccagcatctgcatggacgcagactggctctacgatctgggccgtaccgtgcacgtccctgacgatgtggatgcaaatgaggagctgcagcagggccccgaggaggacgagcccgtctcatgggagagggtcgaggccgggcctcgtgaggcgcggcgtgcggcgcccttcaagaatgtgctgccccccatccagcacttggggcacgaggagttttgagggaccgggcgtacgcagaaacgttataccgagcactgactgctggacgagagaccgccgacatgaatccaggagcaatcttgcaaccctgtgcttgtatgaatggatttgttgccccagttttgaggggtcatcttcctcaagacactcatgtaccatttcatcatcgattttctggcccgttcttggtatcactgtgcgtcttcttatccatttttgcactcatatctttcattaaaagatgtaagctgcccggcgcgaatgtagctgtggggaagaggcattggcttgggagggcacatgggacattttgaggcgcaatgatcactcatcgcgcatattctgcaccccgacaaagcatgcgcattggtgctgcaaacgatttttgccgtctgttatgtcgacacgctctgatctggtccagcatgnnnnnnnnnnctgggagggcacatgggactcttgaggcgcgatgatcacccatcgcgcatattctgcaccccgacaaagcctgcgcattgttgctgcaaacaatttttgccgtctgttgtgtcgacacgctctgatctggtccagcatggttccagagagtttatgagtgcctatggccaaccctgctgtcgagttcgcggaggcagaaggtagggggtgcacggaagttttgcatggacatctagctcctcggcatctgattgcgctcagccgcgcttggtcgtccccgatcgcagtgagacgagcgctcgtcaccatccagcacactgccactgaggtggcaaacacccccacgctgggcctctactacgtcagggtgcgcgggggagcatgaagaatgcgttcctggcaagcttgtgatcattggtcagatcgcgaacccgtgatcgcggatccacctccggaatggggcaggaagggcaannnnnnnnnnagcgggggagcatgaagagtgcgttcctggcaagcttgtgttcattggtcagatcgcaaacccgtgatcgcgggtccacctccggaatggggcaggaagggcaagcatattcatgcctgacctccatgatcgtcaggaacacatccgggcgtccctcccgctggtggtggccagccggcagcagctggccgaggcccagcagggcttgcaggacggcctgtatgcggcaagaggcgccgaggagtttgcgagcaccctgtcggcggtcctgcccggagccctggagcgcctgcaggccgccctgacccaggccatcggcaccgccgcggctgctgcgcctgccaggagcactgacgcatccaccctggcccgctccctggaccgcctaggtctgaggagcggggcccctttgtccccagctagcaagggggagggcctggtctgaggtgggagggatgaagtatacctgcaactgctagatcgctccgccttgcaggaactacagtctcacagcctgtcccatgacatctgtgcactcttttcgctgcaggagtgattacgtattttgcgccatgctgaaaccttctcatgggggcatggcttgtaattgtcttgtaatcacccatgagaagagtcgatgccatcaaagccaccatccccgccggtggacgggggagggagcnnnnnnnnnnacttgtaattgtcttgtaatcacccataggaagagtcgatgccatcaaaaccgccatccccgccggtggacgggggagggagcacatgcgctgccggctcatatgcgtcagtgcacgattgccagagcacaatcggcgaggggcgtcgtactttctaaagcctaagcctgcctggcctcccgctgcgcccagttgaggtatgcggccatgaagccgtccaggtctccccctagcacgtcatccaccgcgctgctttcttttcccgtgcgcacatccttgaccaggcggtatgggtgcagcacgtagttccggatctgctggccccacnnnnnnnnnncgccagagcacaatcggcgaggggtgtcgtacttcccaaagcctaagcctgcctggcctcccgctgcgcccagttgaggtatgcggccatgaagccgtccaggtctccccctagtatgtcgtccaccgcactgctttcttttcccgtgcgcacgtccttgaccaggcggtatgggtgtagcacgtagttccggatctgctggccccactctgtgggtgccagggggtgccggatgagtggcaagagggatccctgcccaggacttcaagtgcagagtcagtcgagcccctgtccgccgcnnnnnnnnnngtgcgtgcccaggacttcaaatgcagagtcagtcgagcccctgtccgccgcatggctggccaaccgtcccaccagccctgtgagtgtccccacccctgtccccaccctgcctgcctccgacgcccacctgctttgacgtgatcgccacggatgccagccgccgcctccctctgcttctcctgggccagcaccagcagcttggccttgagccacttgaaggccagcgccttattcagcgcctgcacagggcgcgggggaggaggagtttgggtacggtgcagttcgtgggaatgaggttgccttcagcattcagggctgccggcgtgccaacatgggttgcggcgaagtgcatggttggaatcatcaggaccgaggtgggacccatttgggagaaccgtgtgtttgccggctcccccacactgctcctctccatgcacacgctgctccactccacatattcaatgctgaacggccagtgtctcctcttcccccctgcggagctccttgcacacctgcgttcgctccacctggcatcgcaccgcgatgccggtgggcaggtgcacgatccgcaccgcggtttccaccttgttcacattctgcccccccgccccgccagcacgcatggtagacacctccacctccgtctccggcacctccacgctggccgccaggtcctccagcaccggcatcacctccacggcggcaaaggaggtctgccgcgcggccttggcgttgaagggcgactgccggaccaagcggtgggtccccttctccccggccagccagccaaaggcccaaggccccgtgacctgtttggatgcaaggaggggatacctatgaatggaaggatcactgggaagaggcaaggagcggtgataatcaacctgccagcatggggggcgcccgggaagcattgggaacctcatgcacttgcccaccccacccaccccaaaaatgccgttagccaccgcccatcgcacctccagctcgacgcacttgatgccggcctcttcgcccagcgagcggtagagggcgcgccaggtcattccacgccgctccgcccaacgggtgtacatccgttccaacatggacgcccagtcctgtgcgtccgtgccccccgctcccgcttggatggagagaatggctgcctgatgagaggggggggggatgatggggagtggctgcgccggctagggaggtcagtgactgcagccctgagtgacggtggaggcctgcagccatgcgctcgcccccctaattgtgtgctcaaactcttgttgagcactggcagggacacgaggcatcgcgcacagatctaggccactctgcatgatccattgccgcccggacagaaagactgtacgcacacatgagcgcatacccggtcatcgtacggcccgttcagcatctggcgcagctccagtgctgccagccgggcctccagatccgaagccagggtctgggcctcttccaaaccctcgtgctgcagtgagcttccagtctgccaatgccagggatggtggagcaaaggtggcaaggtttcttacgcaatgccagtgcttgagcaggttggagaacatggnnnnnnnnnncccgcccggacagaacgactgttcacacacatgagcgcatacccggtcatcgtacnnnnnnnnnnaaggtgcgacaactcatcaacccaccacacaggggctgcatgcccacaccaacaaaatcaacaacgcattccaacaccaggcccaccttctcgaggttggccaggtccaccgtcaagtcaacgtcgtcnnnnnnnnnngaggtgggacatcgcatcaacccagcacataggggctgcatgcccacaccaacaaaatcaataccacattccaacaccaggcccaccttctcgagagcggccaggtccaccgtcaagtcaacgtcgtcacagatgccggacagctcctgaagggatgccactgtctccttggcctccgacagccgctgcagcagggtctgtgcgctggaggtgtcctcccagagcgccggatccccggcctgtttctctaggtctgcaatcctgccttggagcgccgccatgtcggcacgctgtggggaaggtgcggggagaactttttatagaccaggttgtaggaggcatgtcctcnnnnnnnnnnacaatcctgccttggagcgccaccatgtcggcacgctgtggggaaggtgcagggagaactttctatagaccaggttgtaggaggcatgtcctctggctccttgtgccccacacagcggctcaatgccggccacacacctcacctctgctgcatcctggcaccgcttcctcagctcctcggccttctctctcaggccattaaagctcagttcatactccctctcgctatactttcctggtgtggccttgaccgctgtgccagggtggcacgtgtcatgcgcatttcgccacgagggtacagggctccttctgctcgtctcagccccgatggcggatgggaggcgataaacatgccccgatactatagcatggagttcgcgaatgacccttctcaacccggaatgccgtgcattggtcgaaaatcgtaggaccaggcgaggtaagcgggacgctgtaatcatacgctagaggtcgaaggtcgagttgcagcatttacaacgtgaaccttcttgctttttacctagaatatgcatgagatgggcatgtaatggattagcgcccatggaacactgcagatnnnnnnnnnnacatacgctataggtccaaggtcgagttgcagcatttacgacgtgaaccttcttgctttttacctaaaatatgcatgagattggcatgtgatggattagcgcccatggaacactgcagatcggtatcattggatacatttcgtgaaatgctgcacagcatgcaagttaggtatgcttctacgacagatacccggagattcaccgggcctgggaaaatccgtccatagtcctgatagccccatacagctccggccgcctgtctctgaacatgccccacctgccccattggaagagggggcccaaggtcataatgcatgacgagagtcgggcagacccacaaccctgggctgtccatcaaccacaggctgcacctgcccagaacccatcccagtccccgcacgacatcccctcacccagcccgagccgtgcgaatctcgtctaggtcaaaggtcgcggtcacaaagccttcctccttggccggtgaggcgtcagggccgccattggggggcagggagccacttccaacctggggagcaagcgggggggtgttgtgatgggttgctgttatgcctgctggcagctttgttgaaaacaggcaaactgaggcagcaggagtcccgcagatcccgcagcacacctcaactcctgctnnnnnnnnnntgtgttgtgatgggttgctattatgcctgctggcaactttgttgaaatcaggcaaagtgaggcagcaggagtccctcagatcccgcagcacacctcaactcctgctcagttccgagcatggtgtttgttgctgagtggtaacatcctcctgcactgactcacagccaatccctagggcccctgttccccagaacccttccaagggaaccctgcctgcctctccacggtttcacctgagccacnnnnnnnnnnagccccggagtgccccgccatcacccgctgccagtgaaggtagctgctgaccgggggggcggggggcggctcgctcccaatcgcagtggggtagaagaggagctcggcgccctggagcgccaggcagcgggcggcctccgggaaccactggtcccagcagatgaggnnnnnnnnnnagaccatggtgtctgtagctgactggtaaaatcctcctgcactgactcacagccaactcctaggggccctgtcccccagaacccttccaagggaaccctccctgcctctccacggtgtcacctgagccacgacccgccccgtctcgtcagtgatgaaggacccaccgtagaacatgatctcactggcgtcaaacacctccctgcccatgcggttggcggcgatgacggggaccatgctcgccccggagtgccccgccatcacacgctgccagtgcaggtagctgctgacggggggggcggggggcggctcgctgccaatcgctgtggggtagaagaggagctccgcgccctggagcgccaggcagcgggcggcttccgggaaccactggtcccagcagatgaggacgccgattctgccaaaggaggtgtcaaatggcttgaaccccgtgtcccccggtgaaaagtagaacttctcctggtacctacaggcagggatgagaacaggggaggggggtgcgaggagggtgcaaggaagggactgctcggggcctgagcatggcctgggcggtggcagaaggtaagaatcgcttggtctgaactcgagactgccgattcccagacacagtggcagccagagcgagtgtagcgctgcggggccgcagcgtccaccagccacagaagggaggtgactgtgtgcaggagcgtccagcagcccacagacctgatcaccccccgcaccctgggccgtcaggtatatgggacttgcggtagaggcccaccgtcatcccatccgcatctatgaccaccagcnnnnnnnnnnctcctgatcaccccccgcaccctgggccgtcgggaatatgggacttgcggtagaggcccactgtcatcccatccgcatctatgaccaccagcgagttgaagtaggcattcccggccctctcaaagaagctgactgcagggcatgcagtggtggtgccggtgtgtgtccttgcttgggagtgccacatccagtggcgagcgaggaaagctggagtgcatccccgccgccgagcacaggggctcaatacttgcaagacgctggacggcgcacagatccacatgcgacgctgtgccattccggggcatgtgtgtgacaggctgcacatcactgcgagggtgggtgtgcacagaccgcgcagtccattcccacaaacattggcatcccagccacccctgaaggactcacttggcaggaccacacccagctcctttgcgagtcccgcaaacctctcaatcaaggggttgccctcgacggggttggccagggcatagtgcttggcaagctgctcctgacaaaagtatggggcctcgaacagctcctggggtgttgcaggagagttgggtttggcatccagtggattgcatggaacagggcggcggatgaccctgtcgggaaccgcattccgaaacaaggtccaagccggacctgcaggaggataatgttcgcgcccgcagccgcggcggcacgcacgttctgttctgcctttgcctgggagtgcaaggtcgggcgaggtcgcggtgagctggtcagccatttggaagcttacgacggggggccaaggcaaaacccgggcagcccgatcaccatttccaaacnnnnnnnnnntttctgcctttgcctgggagtgtaaggtcgggcgaggacgcggtgagctggtcagccatttagaagcttacgacgggcgcccaaggcaacacccgggcagcccgatcaccatttccaaacgtattatgacttgtcaaagcgtaccaagttctcctcgatatcccacgagcacgtcatctgggtggtcgccaccgtcacggtgcgacccatggcagaggttgtggctcacaaatcgcgtttcggccgcctttagtcgagatcaacgctatatatccgatgacaatctcagtggcgagtagggaagatcgccgtgacgctgggtctcaggtgcccttccctgcaaacccttgatcctgaccgccctggaaccctaactccaaccacggagtgctcggcggggccgcgtccagaaggtcttccctgcgcttcgctgcctcccgaccgatccagcctataattaagttgtacagaatatatgttatactcgactgaaactgtgataccagtggatnnnnnnnnnnacactgcctcccgaccgatccagcctacatttaagttgtacagaatgtatgttttactcgactgaaactgtgataccagtggatattgcttccctttcctgtcctggtccgcgtactagaatgccccttgaccccagccccaccgctcagggctggcgcttcccaggggaatgggagccgcatgctcgcacatggatgggctggccgagtcggcccgataattggcgtgatggtgcaaggtgagcgggcgcccccgaccggggcccaaccgggttcactgttggacagactctccctgatcagcagcctcccaccccgattcccgcccttgtgcattcagaccgggccagcaagcatttgtggatgtggcgaaggccatatcccgcttcgagccggttactgtcggcgcggatccggagctggtctctcaggcccgtgacgccctgcacccagaggtggaggtggtcggcatcccacaggacgattcgtggttccgagacaccggcccactggtgagtgtggagaatatggcccatggcattgaccgctgcgcgcatgtatcagagcagcagagaaacaaggactcgttgactgtgatatgctgatggaaacctcattgtgcccaaagcacccaacccccacctcttccaaggcactccagtttgcggcccacactccatcgaatgagtgatggctgcatacaaaccctgccacgccatctcccattccacgcagttcctggtgcgggagggtgctgatggccgtgaggtggcgggggtcgactgggagttcaacgcctgggggggtctgtatggcgactactccaaggatgtgaagatcgcgtcggccattctggaggtgaccaggcgtttggatgggagggtgtcgtagcctgggtttcggctcccttgcagagggcacagtgctcgtgttggcgtgcacatcgccagcccagtccacgtgccgtgctcgagttcctgatgcatctccatgcagagggagggcatcccctgcatccccgggcccatgatcctggagggggnnnnnnnnnnggcccagtccacttgccgtgctcgagttcctgatgtatctccatgcagagggagggcatcccccgcatccccgggcccatgatcctggaggggggcagcgtgcacatggatggcgaagggtgagtcatcggatgactgtacctggtttggcgaccctgcatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcccattctcgggggtgggcaagcctcgcccgggtggtttcttccctcatcattcccgcctggatcccttctcaccccggcccgccccccctctcttatgccagcaccctgctgacgacggcggagtgccnnnnnnnnnncggagtcgtgcacccctggcattgtacatgctgcagccgcctacgacagggatgctgagggcgaggtgcacgtccctccgtgnnnnnnnnnntggaatcgtgcatccctcgcatcgtccatgctgcagccgcctgcgacagggctgctgagggcgaggtgcacgtccctccgtgnnnnnnnnnnacctggatcccttctcacctcggcctgccccccctctcttattccagcaccctgctgacgacggcggagtgcctgctccaccccaaccgtaaccccggcctgtcccaggccgagatcgaggcccggctgatggcgttcctgggggtcacccgcgtcatctggctcccgcgcggcctggtcgccgacaccgacaccaacggccacgtggacaacatcgcctgcttcgcgcggccaggcgtggtggtgctggcctggtcagatgatgccgaggacccgcaatacgaacggtcccgcgaggccctggcggtcctggaggccgcggtcgacgcgaggggcaggcggctggaggtcgtgaagctgccccaggggcccgcgatgcattaccgcgaggaggaaacggcgtcgatagaggtgtggannnnnnnnnnnnnnnnnnnnnnnnnnnnnnnnnnnnnnnnnnnnnnnnnnnggcgaggcatgcaccctgcacccagactccagcccccagagcctggtggcagcgggaggcggtgtcagtccaattgagccaggcagggcatcgcccctcatgctcatccccctgcaatgctcagaaagcgggggcgggggagatggatcgagtggcnnnnnnnnnncagtgcctggcgggctccaggggtactgccaaagctgcgatgcaaggggggcaggggggtgtggggtgggtnnnnnnnnnntagtgccgtgcgtgctccaggggtactgccaaagctgcgacgcaaggggggcaggggggtgtggggtgggtnnnnnnnnnnnnnnnnnnnnnnnnnnnnnnnnnnnnnnnnnnnnnnnnnnnnnnnntttgagccaggcagggcgtcgcccctcatgctcatcccccctgcaatgctcagagagcgggggcgggggagatggatcgagtggcgggcactcggctggcaggggcctacatcaacttttacatctgcaacggcggcgtggtcatgccggggtggggcatcccagatgccgacgcaaggtgagctgctttctgggatcgtgacgctctcttgagggtgggggagctgtgttccttgagtgcatggggtgtgaggaagagcattgccgctgggatggcaagggtggggggaccgccgccccagcatgtgagaccccttcccgaacaaaccatcgttgcagggccaaggcggtgctccaggaggtgttcccagacagggannnnnnnnnnaccccagcatgtgggaccccctcccaaacaaaccatcgttgtagggccaaggtggtgctccaggaggtgttcccagacagggaggtggtgcaggtgtacacgcgcgagatactgctggggggcgggaatgtgcactgcatcacgcagcagcaacccctgggcaaacctgccgccatgggcggccttgccatcagtgcactgtgagaaatgtaaaacctatagaaagccggaacaccccgactcgcacgtcaccaactcccttgacaactctggcccgtccccgagcgacacatcgttgaacccggagcagttacacgcgctgcacacacctcgagcacgtcatggctcccggacatgccttccgctgggtgaagcccgaagtgtgagtgcctagcggagccgggacaaggtccccctgccgatgctgcccgacgccgcgatatgcaccaacgtgccatcacctgacacttgcaggtaccccatcatctttcccgttgcgctggccctcggggcgatgacctactccatggggcgccacctttggaccaaccccgaagtcttgtgagcacacgggttgggacgggagcccgcgttaacctcgtgatccagcaatgtaatatcggaggacttcagtgattgtggttctccaaatgtgtcacccctcgcagccccagcaagaagctgcgcacggagggcatccctgaggaggagaccaaccggtttcgtgcagaggggtactccaagtccatcttccggtctctacaggaggtgtgggcatgtgcagagcgtcagaacggttggggtgggtgggtcgacgtgcgtcgctgctgaagaggctgcgacacttggcgctgtgcgaagcccgctgcagggaggacgagaccgtcgctcggctgagtgaggtgccctcgcctgcgacgaaagccttgacacctcggtctggtgtcacataccaagaatttcccctttgtgcggcgcagggacgaggaatgaagggcatctttggcacctccagccaggatcactaggtggtctagggcaaatgaagcgctgtcatggagagtggtctcctttcccccacccccactgcttgcattagtcaacatgcgccgtgctgcatcagcaccaccacagccatcaagcaatgtctgtcccctttcaaactccccctcttccccctgtcctgcacacggcttgttcgctctgtcacggcagtgccatgcgagcccgtgcctgcatgctgtatgtacatgggcatgcctaggaaatcactatcaagagaaaagctgtgcatagcgcggggtcatggggaggaaggagaggtgatgcaggctagcgctggtggagagggcccccgaaccgcggttgcatggttccctcgtcaaactccttccaccacctgctcgagtcaggaggtgcatgggagctcgatcctgagcgtatgtgggaatgcagggccacagcatgccctggtgcacaaaattctattgcatggtcaacccaaactctctctgtggcagttgttgttgggaaaggcgcagcataggagttcccagcctcactagggttggagagctcaccctccaccccttccccctgcttgaaatgtcctggcaggctcccccttctcaccgattcacgcgcattcccagaggtccggaggaggccttggcaggggaggggtggcccggctgcggcaccttcttgcctgtccctgaagggacagcggcgctgccgtgcgcagatccccgctcgtcccacgtggaccctgccctgccggggacggaaggctgggccccatgtgccacatccagctggaacgcggcgcccagcgccgtggatcgcccagtctgcgccagtgagccgggcagggggctcggaggcgcttcgaggtcccctggcagccgggcgatgtgagcaggttcatgcagcagcacctctgaaagaggaaaggggggaaggtgatcaggatttggtccctttgttcctgccgtgaggaggtgaaggggcacgcagcacgcttgaaggttgggcagccgcctcaagcacacacccggtcggaagggagcaccccacccaccccgccacctgactctggactatgttccggcgggccccaggtcaggttcccccatgcggcggggagggcactccctgcatcgctcgtctggctgccagacttccgtagggattggtcctccccctctggcctgtaggtgcgactgggctccgcagcctcccccaccgggggctccgccacaggctcgcctgcgggatgggagtgtaccggcatgatgtcgagagggagactcgggcgggatagccccacaaatccaggcctgtgcttgggtgtggacctgcaggcaagggcaagccacacaccctccttccccttccacccttgaccacccccagctgtagcaccatggtctcgagggctcaccacgggatccccagcgcaggagggcagaggactcgggaggtgcgccgccacccttggacccggcggcgcctgccatttcgacggccaggccagaggtcagggggctgctgnnnnnnnnnnttgccccccttggacccggcggcgcctgccatttcaacggccaggccagaggtcagggggctgctcggctgctccacatggtctggaccaggggtagcaccatgtgcggcaggattattgatgggggccgtcggtaagcagtgagtctgtggcttgcctgaggttcgggcccctcatgtgtccgacccactttccaccagccatgtcctccccagcaggccatcgacccttggcctctcctccccgtgctcccccttccaggccttccctcgagcatctcccnnnnnnnnnntggccatcgacccttggtctctcctccctgtgctctcccttccaggccttccctcgagcatctccctgcacatcgccgcttggcatccgcagaaacaacccaccgccgcactcccacacctctcatgaggaaggccagaaggggcttggtggccgcgccaaaccccaggatgctgatgatgaccaccactagggtggtggtgatgagcgtggcatcgccctcccttcctccgccccccaacagtgtgtacaccagggccacgctgacggcgccgcgcatgaggcccgcccaccaaatgacgacgcactcgcgcagggagaggcggacggcggagaaggcgttgtgcagggcggcaacggggcccacgaatgcggcgcgcgaggccatgagcaggaggatgacgatccagaacatccacagcaggtgccttacgttggtggcctgagtgaaaacaaggttgaggaggggggggggggttggggcaaaagcaagtggggaccttgctgaggagtggagggcaagggtggggtggttccaccagcaagaagaaaatccgtgcctgaaccccggtaagctgagcggtgcaggacacgagagaacgaggccttcacaaaagtaacagagnnnnnnnnnncacgttggtggcctgagtgaaaaaacgttaaggagggaggggggtttggggcaaaagcaaatggggactttgccaaggagtggagggcaggggtggtgtggttccaccagcaagaagagaatccgtgcctgcaccccggtaagctgagcggtgcaggacacgggagaacgaggccttcacaaaagtaacagagctgcaagtggaagcccagcgctccgagagccccccccacaccctccacttgacggggtccacggcgtccatgccgcagatgatgaagatgatgccctccgacacgtagctcagcgtcgcaaaggcatgcacagtggtgatcctgggagaaaggatgaaaaagggggtaatgaaagccctggacataatgtgtctcgcgcagtgggagagggttgcagagccacctcacgagtggccctgtggannnnnnnnnncaagccctggacatggtgtgtctcgagcagtgagagagggtggcagagccacctcacgagtggccctgtggaacacttgacagagcgggggggagccatgcactccacgagggcacatgctagcactgtagtcgctgccccaggatcctctggtgcgcacctcgactgcttggagnnnnnnnnnnggagcaggggggagccatggactccacgagggcacatgctagcgctgtagtcgctgccccggggtcctctggtgcgcacctcgactgcttggagatgttgtgcagggcgtagtgggagatgatgatggcggacacgaagagggccacgatgccgctgaggcccgccacctcccctaccaggtaggaaaggtatgccatcaggccgatgtacgccacctcctgccatgtgacatcccacgtgtgtgaatgatggccgctgacacacacgcattcacgtagggccttcttaggcgctcggcaggcacacctgcgcgatgagagtgagtcccttccccccccccccaaaaaaaactatctggacagcggcgccacctgggaggtctcgtggaaggtgaccctgcgcaggcagagggctgtgacgaggcccaggacgatacccagggctgccgaggccagcagaaggtacaaaaaggtgccaaaaatggtgaaagccatggagacggtgaggtcctccgtgccctggagctccagatcctgagagggggaaagggggttggagggctagtggtttctcacgcctgcatgtatgggacggagtatggatgtccagagccgaggcaaggttcatgcaccgtgttgcgtcatcagcacaccctcccttgcaaatttgcatggcagacagacaatctgagtgggccaggcaggcatgagtgcgagcaagttctctnnnnnnnnnnagagtatggatgtccagagccgaggcgaggttcatgcaccgtgtggcggcatcagcacaccctccctttcaaatctgcatggcagacggacaatctgagtgtgtcaggcaggcatgagtgcgagcaaggtctctnnnnnnnnnnagggataggattgagggcgaagagcccggccattgtctcgagagcatgagattcctccagacccactgcannnnnnnnnncagcatctccgtgtggcttgccaattgcctcactgtcggcttgccttgatggtggaaagcaggacaatggaggtcgcatcattcaggacgccctcaccaaaaaccaccgagtacagcagcggataccgctccttatcaagaacctgcgtgatgggagaggattgagggcggagagctcggccattgtctcaagagcatgagattcctccagacccactgcactgtgacctctaagagtcctccttccattgcaacagtttgaaccaactcccacatggaatcacacctggagggtcgctacagaatctgtagctgccatgatggcagccaggcccaggcactcctgaaatcccgacagcaattgtacgtggtggacacaagggagtgcagattcccatcccgcaatatgacatgggtcaagctagagtgtcacggcatgcatggggagcaggcgtaacctcttctgcgccaacaagctgggctaaggacatcgccaaagcacagcatactgggacnnnnnnnnnngtgacatgggtcaagctagagtgtcacggcgggcatggggagcaggcgtaatctcttctgcgccagcaagctgggctatggacatcgccaaagcacagcatactgggactcaccctgaatgtgaggagtccatggaagcagagccagagtcccagggagagcagggcaaaacaggcataggtgccggcaatgccaaagccactgatggtcaggaactccttgaagaagtggcgcttgcgcacagacagtccggcatagaatatgatgggagggaggaggaacctgacggaggagagaggacctgtgatgttgctgagcaaggtgtgggaagaattcctccgtaatccagttgcaaacacgggcccaatttgaccaagcacttgccagcgtcatgtggcaggcattggctgttgagtccaggcccaagtaggtgatgcagggcccgatacaatttgcatcccatgtccctgtgcctgagcccatacccgccccttacgtgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagcgcaatttggaggtgtgccaccactatgtccatgctgttgggtaagaaatagcagtgcatcatcgcctacagaagggtcccacgcacctttnnnnnnnnnncggctgttgagtccaggcccaagcaggtaatgcagggcgcgatacaatttgcatcccatgtccctgttcctgagcccatacccgccccttacgtgaagaagctggatgaattgaaagaaagaatggactccagcacgccatctgcaaaccaggtctgcgcagccaggagggtgccccccaggacgagaccaaggatgcatgcagcgctgccctctcccaccaccagccatctgttccaggtcgagtcccgaggcggcagagtggtgtgaaggggttgtagcgcaatttggaggcgtgccaccactgtgtccatgccgtggggttagaaatagcagtgcatgatcgcctacagaagggtcccacgcacctttgcgcaacataggatcctatagttatccataagaccaggagcacaacaaggaaggctggatggggaggagggggaggagtctcaggggaggtgccgtgcctgcacatgttccgatggcacggtggttgacccccaacgcacccgcctcgaggctgttcgcatgactgctttctggtgtttcggaactacttgatgctgttatcaaggctccgatcggcatcgcgctatcagcgatggcaactctggtgaccagcgacttcccgggcaccacctccgcgtggaccccccttcacttcgacctgccggcatgcagggaccggacgcagcagcacattaatttatgcgcgatcggattacttgatggctgatgtgcggagtgcgcgctcaggagtgttcatcacacgagtcctcccgggggagggagttagggggccaaaccaagctttcttgcatccagaccatcgacaggacttcaccctcccaacaagcagcaacaagtcgtagacttcttctcatgttcgtcttccaaaatgtttcaaccaagaaatcagggctacacgtgctctcaagaatcagtacaaccagtcatgcatccacaggtgctttgggcgcctgcagattcgagagtccatctagtaccttgatgcgctcgatcttgtcccccccctgccatggcgtgtgtgtgtgtgtgtgtgcagggttgtcatgagcaagccatgccatggtgaccgattgccaccctgtatgcaagccagtgcagcgctcacagtcccgctgtccttgttgcagcctgccaacagctgtggcaccacccacctggagctctttcaggnnnnnnnnnntgtgtgtgcagggttggcatgagcaagccatggcatggtgaccgattgccaccctgtatgcaagccagtgcagcgctgagagtcccgccgtccatgttgcagcctgccaacagcggtggcaccacccacctggagctctttcaggagtggtgctccctctgtcacatatccaaacacagcataccgcccatccagcagattggatccagtgggtgtcagctccgattcctttcacacgaagggttgcagatggaaacgggttgatcctcttgctgacaatgtacttattcgtgactgacgccacatgtcacgatgccagcccctggtgtgacacagcccaccttcagcaggaagaagaattgagatgaggcggagtttgtgtcaaactcggcgcgcgccagcgccaaagttccaaaggcgttgaannnnnnnnnnaatcctcttgctgacaatgtacttgttcgtgactgacgctacatgtcacgacgccagcccctgctgtgacacagcccaccttcagcaggaagaannnnnnnnnntgggagcactggctgctcgttgaacctgcagggaaagagggcagagggcaggtgggccctcctgtcgtatttgggcacaaggtgaagccctgtggcacacccaaaannnnnnnnnncgggagcactggctgctcgttgaacctgcagtgaaagagggcagagggcaagtgggccttcctgtcgtagttgggaacaaggtgaagccctgtggcacacccaaaacgcgtccatgcaaacaagtcctaggagctagatcctcaatagcacgcaccgtccattgtcctcgagggtctcttcgtagacagggatcttgtcaccctgcaccatgacctcaaagggcaccgttctcagctgcccattctcaacatatccctcctgttgtgagactccgggggtggggggtggggtggggtggggtgggggagcaagtcagcgtcgaccaatcagaggcaatgaccgatccaatagcttcatgagccgaaggggactgggaaaggagacgcagctttcttgcgacaccccaatcagctgtgccttgtcagtgacatcctgatactctggaccactggggcgattcccatagaagcaggataacgtgccgactcctctgagatcaccacacagcagaggcacagcgccccgtgttgtctccagtgactcacccctgactccggcttcccgctctgcacaacaaagccatctgaccgctggatgagcatgccatcatagaagcccttatgggccaggtccacaaaggttcccgcactggggagggggatgggatggttggcatgggagctgccggcacactcaggctgtggtagccaagtttgttccacgctagagagccaggcaattacgatgaggaannnnnnnnnngggttggcgtgggagctgccggcacactcaggccgtgggagctgccggcacactcaggccgcgggagccaagtttgttccatgctagagagccaggcaattacgatgaggaaatctcatgctgacatggcaatcgtcagcaactcctcagcacataacaatactccgtgtgtgtcctggggacacctaacccctctcccccctgtcaccaatgtctcatacctgagtggggcattgaagccatccacgacaatgaccatcctgcctccagtcgagttgtcctcgcggggactggagaacttcacatccatttgcagcgtggcacgaccctgagcaagtcgagtggccgttgaggcaggnnnnnnnnnntggcacagcgacccgtgttgttcccagagactcacccctgactccggcttcccgctctnnnnnnnnnnccaataatactccgtgtgtgtcctggagacacctaacccctctcccccctgtcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcagggtacaggggtcgcattgtccgacagcgtgccgggaggcaccgggcaccgggtgtctccacaagcagcaagccctcagtgtccccacgtattcacggttgtaacgctgcaggtctcgacctcgccccaatcccccacgaccctgtgacgcttgcctnnnnnnnnnngagccctcagtgtccccacgtgttcatggttgtaacgctgcaggtctcgacctcgccgcaatcccccacgaccctgtgacgcttgccttgagttgcgggaggttggcatactccttgggtacttcaaaggggtagcccgagaccatagactcctctatgtcccctaccaagttcaggcactcctgctgcagcaccggaatgtcattcttgtccttgtttccaaggacggcttgcagctcagagagtttctggtggaggaaggacagggagaaggcaggggtggatgttccttattgtaggccaccatgtagggacgctggcacgccgttcaaaagggggtgaatacctgggtnnnnnnnnnncggcaggggtggatgttccttggtgtagcccaccatgaagggacgccggcgcgccgttcaaaagggggtgaatacctgggttcgcaacatggctgtggtgtactgccgccagaattcccttcacagcttccctttgatccaatgcggacacatgctcagtcctgcacacatgtcccatgtctctaatgctgaattctggcccctctcccctcatcacacctgcttgagcagcaccagatcgtcctggccctgcttctggcgctccttgacgagggccttggtgatggtgcctgtctccctgtccagtatggacgctgcattccggaccgcccgtccaattggcccaaaggccttgcccccaggaatcctcagcgcctctgagatgctctccagcgactcctgcacctgcctgatgggggtgttgtggatgggcagcgcatagcgcaacagtgctttggcgtccttcaccgggtctgtggagatgaggccggcggtggcggggggcggggcgaggacgaggcgggaagagtccgccgccagcaccgccagcgctgctgctgcaagggcggagaccatcttctgagcgactccattgctctggggtacctgctcaggggnnnnnnnnnnggagtccgccgccagcatcgccagcgctgcagctgcaagggcggagaccatcttctgagcggctccattgctctggggtacctgctcaggggaagggtaagcgcgtgtcgaactgccactggagtgctgggaagacagtaggcggccatctcaagccctgatctgtatggaccgagcagagttcgacccacagtgccatcggtnnnnnnnnnngggcggccacctcaagtcctgatctgaatggacggagcagagttcgacccacagtgccatcggtcctgcatacattctgcgtttgcttggatgcgccacactggacgtgggtcctcagggcgtgcacggtccgaggacgaatgctccctgtgtgagtgggtgttgcctggccggggccccgcaaggattgcggctgcattagaggactatatacacacactgaatttgcactgatctgtggtactccttccaatcctacttggaatgcgcttcatattcgcagccaaacaatgtatggcgcttgcaacaccacgtttcggggaatcggaaataatcttgaagaggcttcttcctttccacatcattccccggggcagggcgcgctgtattctgcgagaggctcctaacattttgcccaagggccccgcgattgagtgatcaatcctgtggtccaacgatgcctgactcggcctcgaccgatcctgatccggtctgcaccatagcggctgctgnnnnnnnnnnnnnnnnnnnnattgcgtagctagtcgcgaccacgacacgacaaagtgcgaggcgcagctcaaggccttgcgtgcgtgcaccaggaagcaagtgagtgtgcttgcttcacaatggcaaattctattgttgaatgtgcatgcaccgtgcccaagtttgatgaagctgattgggaatatgagagggaactctgtgtgctttctcctcatgggtggaagggttgagaactctgcagacgacgatcaagnnnnnnnnnngttccgtgtgctttctccttaggggtggaggggttgagaactctgcagacgacgatcaagctcgcataccgatcgacgtctccacctcaggctcttgactcggccccaactccttctcgaatatccaccagaacgttgtcgacttcaaactcagtcctgtgcccgcaaagagcaactgagcaggttgggctctgctgcccaaggatctgttgtgcagctttgcacgacccacactggacacccagcgctcgaatcccaccccacctccgctcccttggactccaaaacccagtggtcgctgcttcatggtgctgcgcagcagcagagcctggcaccgcttagtgagggccacccgcgagtcgactcccaccctggtcttgtttgtgggggcgtgcctctcggtcccctacttccttgccaaagcggtacagaactcgaccaacaaccccgtccaagatggcgagctggagaagaaactgcgtgctggagccgggctggacagccaggtgcgagaaagagggatgatgaggagctgggagtggcggagctggtgcagacatagatcctgtagtgtacccatgcattgcgggctgttgtggatccatgcatctctgtcctccagacatacctgctgaactcaccgctggtttacttggcacctccagcgcgctcgctagaaatgaggtaggacatgctgcatgtcggccatctccatgaaagaacccaaatggctgagtgtactccctgccaccctccatgcagatgctggcccgagcccagaagcagcggctgcaggtcctcttcgatgaacttcagtctccaggccagggcgaggaccgatacaaggctgcactggagtgagcgagaagggtttggatgccctgcggggaggatggctggcgcggaaatgtcaagttgtattcttctcagttccttagttggggctgagacatacgatcctgacgcagtccacccttgcatgcnnnnnnnnnntgttgtattcttctcaattccttagtcggggctgagacacacgatcctgacgcagtccacccttgcatgccatcctgcgcagcgggcagtctctgggaacctccagttctggcagcagcgtcgacgcagtggccatccgaatgaaggaaagtcggggctgaccagcgcattggtggtccgacagaatctcccggcagggcagttccacagtcccttctatgatcacttcaccatctgaaggtcccttgctgcaatacatgcctaacaattacagtgttgacactcgagcattcttctcgtcgcaactgcgcaagcgtcttggaaggcactggttgggatggaaagcgtcaggcaaggcaccagaatctcgtgcaagtctctgaatggaggccnnnnnnnnnnttcttggaaggcactggttgggataaaaagcgtcaggcaatgcaacagaatcttgtgcaagcctctgaatggaggccactcctgcctctgcctgcacaactccaggccatgcgatccttaacgcaacagctggcacacggtgtgatggccggctccgggcccaagcctcagccgtcctcctcctgcaggcccttcaccacgaacccggtgatgaaaaggaccgcggcgacgcccaggctcagcgaggagatgaggtagctgatgatgctagtcagcgccgtgtcgtgggggatgagcgcggcggccaggatggacagcaccagggccgggatggatgcgctggtgatgaggccggggtccgacaccagcagccgctccgccaggctcaggaggcccaggttctccgccgcgcccagcaggcccagctgctcgatcttggtcagggtcaggcccgccttctccgccttgctgcgggggtggatcgagagaggcccatgtggggggaggcggtgggtgtcggaaggcggcgaaaaagggtgagagggacgacacatgggccagaggcatcagcatgaaatgggacaccgtcggcgtcgatatatcccctctgtttcggccccttccgtctccgcaagatccatcagggttttctgccctggacccaggcctacctgagcagccctagcctctcgacaccggacaggaccttcttcttctcgatcttccggtacatggagctggggctcacatccttctcctctgcgaagtagcctgcgccaaaccaccgcttctgccagctgtcatcaaacgtattcagcttcttgggtccagcgcccagtctggtggagggcctcccgccgcgagggctggacggcaggccctggaacggagccggtcggcccgggcacacgacacccgatctgccggcgaagctgccaacgtgcgccattttgaaacgtaatgaaggttttgttgaggtatccagaggttcgatctatgccatgcttgcgcctcgagtccggtccccatggggatgagagattgtggagaggatagcacgcacagcatggtgttcttggacgttgtaagtctgcgattagcggaaaacttgtaaaccctcagcagacgcttcgcgaataatgatcattgtcttgtttgagatgcggtgacctcaacctggtggcgtacaggcctgtgcatgtctggagcttgcgggagaggcatcatcttgtggcagaccgactaaaacctaaccccgtgtccattccggcatattaaacggtgaaagcgaaataagactaaccaaactatagaagtcatcgccgctgcannnnnnnnnnctggcagaccgactaaaacatcaccccatgtccattttagcatattgaacggtgaaagcgaaataagaccaaccaaactatagaagtcatcgccgctgcatgcccctgtctaagtcagctatcatcgatgctagatctgacgtggcaaaaccaacaacctcggggcgccatgggtccgggactccggcggttgattagatctgtacagccgagcatccacggcatttcagaagtttccatacctcacagcttgaagttatcacgcatcgaaagggctggatcgttggagtcagaaactcggccctgcctggtgacagaaccctcccgcacttgaattaggtcagggcggggatggccctcctggcgcgtcaggaccaagcgccgttcgatggctcctctcaagctaaatccaagacaagacgagcgaagtccaagaagattgtaaggctgcggctggaggaggtgtactggcagggcctgctagcggaccagaccgcggcacgagccttcttctcggatgctacccggtacgcaacggcgggggcaggttcgtcatattcggagcaaagaagcttggccagctgagcctataatgcgactagagggggatctcgtgccgtgcacccggcgggcattgtcgttgccaaggtgcagtacagatttgccctccgtcccctcaatcaccttgcaggcgggaggacgtgctgcgcttcctgacgggcggccctagctgtgcctatggcctactgtgcacgtcatccatgcagctcaggtgcagaactgggcattggtatgggccaggctaggcggaggggcagcagcctggtgtgggcctcctcgctgtatgccgcttgcgccctgctgctctgtggtgcgggtcatggcggtgatgtccagggcctgtttggttgctcacttgcgctcgaggctcatcaaagcaccgccaccgtctggccccgcgttgtggtgtgggcggcggacatcgtctggccctgctgctgccagcacacagccccctccactgaggccccctgcaccccccctcacgccctcaggctggtcatnnnnnnnnnnctcctcacttgcgctcgaggctcatcaaagcacagccaccgtctggccccgcgtggtggtgtgggcggcggacatcgtccggccctgctgctgccagcacacaaccccctccactgaggccccctccaccccccctcacgccctcaggctggtcatcctgtccctgatagagcgcgactcccgcctgatgctggtgggcgccagcagcgacaccgtgcgcgctttctacgaagccgtccgcgacgcttcctggcgccacctcagcctgcccccctccctggcacccgccggccagctcagcgcggcggacgtggcgggcctgcgccgcgccacgctgggcgcgctgggcgccatgctggtcgtgggggacgccgtcaccatcgacacccgcctcttccgcacccacgtccagttcctgctcaacctgctcacggccgtgacgtccgacggctgggaggtggccgcggcggccgaggccctcgggtgagagccggtggggtgcgggcggggctggcggcgcgaggcgccgaaccctgccgcccgcctcacccccatcacagcctcccactcctcccttcccatgccccactgcagggcgctggagagcacctaccccggcctgctgatggaggcggggtggtacctggcggagcgcgtcgagagtgccgccgccgccgaggggccgctcacgccggcgcagaacggcgaggtgtcgcttgcggccctggtgctgagccacgccgcgggtgaggcgcggggtgggnnnnnnnnnncgcggggctggcggcgcgaggcgccgaaacctgccgcccgcctcaccccccatcgcagcctcccactcctcccctcccatgccccactgcagtgcgctggagagcacctaccccggcctgctgatggaggtggggtggtacctggcggagcgcgtcgagagcgccgccgccgccgaggggccgctcactccggcgcagaacggcgaggtgtcgctggcggccctggtgctcagccacgccgcgggtgaggcgcggggtgggagaggggaatgcctgtcggttggagtggggttttgaaaagaaggggggggggttccacactgctggacccgttgcgcgcggtgtgcggggagtgcacacgcggcttcggcggtctgaccgttctcggtccagcagaccctcgacctttttcgcgccccaccccgtccgccccccacccactcac

SEQ ID NO: 41507 - DNA, 65 bp, Chlorella protothecoides
ccccccccccccccccccccccccccaaggtggcgggcctgattggggccgaccccaaggagatc

SEQ ID NO: 41508 - DNA, 77 bp, Chlorella protothecoides
tacttgaagcagtgcaaacgactgcacccctaaaggcctgctccccacacaccacgtcggtgacgagggaccgctcg

SEQ ID NO: 41509 - DNA, 61 bp, Chlorella protothecoides
gagcgcggcgacaaaggtgttcatgcaggcgcccttcacgtcgcggtcggcgacctccagc

SEQ ID NO: 41510 - DNA, 61 bp, Chlorella protothecoides
agagttccgagatatcgttctggaggggggggccagtaagcaggaggcggtggtcacactt

SEQ ID NO: 41511 - DNA, 63 bp, Chlorella protothecoides
tgtagcgctgaggggagcaatgctggggtgcactgtgtcccccacacgacgctccagccccgg

SEQ ID NO: 41512 - DNA, 65 bp, Chlorella protothecoides
cccccccccctgctcaccaatgttatcactcccggtgtttttggtgccaaagttgttcttgccct

SEQ ID NO: 41513 - DNA, 61 bp, Chlorella protothecoides
catgaagaagggtggggcaacccaggcaggtaggagctccgcacactgggcctctgggctc

SEQ ID NO: 41514 - DNA, 61 bp, Chlorella protothecoides
gcttacagcttcctctacggcctgtggagggatcagtgggacgccgactgcgagctcttcc

SEQ ID NO: 41515 - DNA, 80 bp, Chlorella protothecoides
atccccagcggccagccccgcgtcctccccttctccagcagccggccccacatcctccccatccccggcatctagcccca

SEQ ID NO: 41516 - DNA, 78 bp, Chlorella protothecoides
ccccagctcaggggccgtcagctccttggccagcagcgcgtagaactccagcgtcggccccaggcctgccacggggga

SEQ ID NO: 41517 - DNA, 61 bp, Chlorella protothecoides
agtgtatcaggaaccgccctttcacggcggggccggcacgccccacccaccggcatgcctc

SEQ ID NO: 41518 - DNA, 11425 bp, Chlorella protothecoides
  modified_base (356)..(365): a, c, t, g, unknown or other
  modified_base (1155)..(1164): a, c, t, g, unknown or other
  modified_base (1601)..(1610): a, c, t, g, unknown or other
  modified_base (2118)..(2127): a, c, t, g, unknown or other
  modified_base (2469)..(2478): a, c, t, g, unknown or other
  modified_base (2663)..(2672): a, c, t, g, unknown or other
  modified_base (3045)..(3054): a, c, t, g, unknown or other
  modified_base (3950)..(3959): a, c, t, g, unknown or other
  modified_base (4507)..(4516): a, c, t, g, unknown or other
  modified_base (4646)..(4655): a, c, t, g, unknown or other
  modified_base (5412)..(5421): a, c, t, g, unknown or other
  modified_base (5948)..(5957): a, c, t, g, unknown or other
  modified_base (6148)..(6157): a, c, t, g, unknown or other
  modified_base (8950)..(8959): a, c, t, g, unknown or other
  modified_base (9459)..(9468): a, c, t, g, unknown or other
  modified_base (10938)..(11033): a, c, t, g, unknown or other
ccgcggcactctcgccgccgcccggcgcgccggcgggcgctgccgccggcccggcgcgcccgccgagctgggggaagaggagggagtcggggctgcggcccgcgctgagagacagctggcgcgtcagcaggctcgccagtacatggggcggggaggggctcgaggcggcggcgccgccgccgcgggggctgatgggcaggggcgtggacggggcggccgcccaagcactgccttcaccttgagaagcgacgcccgcggcgaagccctccaccttgacgaaggaggccgcgcgcgggatggaagagggcagcggggcccggggcaacacactgcgcaccgtcccgctgctggtgctnnnnnnnnnncgccttcaccttgagaagcgacgcccgcggtgaagccctccaccttgacaaaggaggccgcgcgcgggatggaggagggcagcggggcccggggcagcacactgcgcaccgtcccgctgctggtgcttggcggtgcctgggactccagggatgggcgccggtaggagccggagcgtgcgtcgcagctgccgcggcggtagctgctgccgcctttcaggccctcatccatggggctgatcttccagctgcccgagtgcaggggacgagacttgacctggccacccgcggagggggggcgaggctgctgctgcgccatgctgctgcccgatggagggggcgcggccgagaggagagggggggtcatcccgccgggccacccgtgctgacctgaggagagggtcgggcgagggattggagcgggatacggtgacatgcaaacaaaacaggtcgagcaagtgtggcgatcgacgcaagcagctcaacaaggaccagtcgcaagaccctcgcgcgcgggctgggtaaagggaactcaaaacgcggaccgcaagggctccctgttccgtcaaaactcaaggcaccacagttgcgcgtacacatgtctgacctcttcgagtggtggaatctgggcttccgggaggggcaaggatgtcggagaataccctccgcgcgagcgtcaggtgattctccgagaggtgcccacagagcgtcgaaggcagccgatagcgtggcctttgctcacggatcgagtaggagtatcccacagactgaagcagcggagctcctgtctacnnnnnnnnnnggatagcgtggtctttgctcacagatcgagtaagagtatcctacagactgaagcagcggagctcctgtctacttggaaggtcacgttgcaaggatggagctccacaagtgcgccttccccgtggaagtatgaccggggacaatcaggggccagaaagatttcgggagattcggagaacggcagacctgttcaagtagaagctgacgtagaatggaatttccaaggacgatgattgccgtctcctcttcaggatcgagaatttcatgtctttgacgacagcactcaacgttgctgatcctgacagcgcacgggatcggcctatcaccctgcttttctgtgcggtgcatgtattgacatgcagaggctgcgactcaacccaagcgcatactcctatatccagtgtcgtaagaatccatcgaccattcagaatgtgcggnnnnnnnnnnaacctgttcaaggagaaactgctgtgaaatggattttccaaggacgatgatagccatctcctcttcaggatcgagaattccatgtctttgatgacagcactcaacgttgccgatcctgacagcggacgggatcggcctgtcaccctgcttttctgtatggtgcatgtattgacatgcagaggctgcgactcaacacaagcgcatacgcctaaatgcagtgtcgcaagaatccatcgaccattcagaatgtgcggtgtcactgcagcttgctctggctagctgctgcacaggctggaggtctgggacaaggctgaatgatagtctgatgggcagaagcttccaggtgggcgcacgtcagggaccgttcacactccatgcaggagcgttacgcacccagcaggttgggggcttagaaggtggtggttaggcagctccttcaatatcgagtcagtcgagtcacacgatgccaggcgggggactaaattacctacagcatgttgcaaactgnnnnnnnnnnttcgctctggctagctgctgcgcaggttggaggtctaggacaaggctgtataatagtctgatgggcagaagctttcaggagggcgcacgtcagggaccgttcgcactccatgcaggagcattacgcacccagcaggctgggggcttagaaggtggtggttaggcaactccttcaatatcgagtctgtcgagttccactatgccaagcgaggaactaaattacctacagcatgttgcaaactgtatctcgaaggacacggcggggggggtgcatttgagcaatcagacggatgtggaactcccctggtcttgatagagaagctcaagcctgcacccacctccnnnnnnnnnnctgcatttgagcaaccagccggatgtggaactcccctggtcttaatagagaagctcaagcctgcacccacctccactgtagcgaattccaatagggtgtcgtgcacaagggtcgctcagcacatatcccagactccccagcctgttgcggatgtagctgtgtactttcacaatcccgctctcaannnnnnnnnnaaattcctataggatgtcttgcacaagggtcgctcagcacgtatcccagactccccagcctgttgcggatgcagctgtgtactttcacaatcccgctctcaagatggtagaacatgtcattcctgcatgtcttggttgcttcatgcgtgatacaccacgaaacctaacaattcctgtagggcccacagctgccagggaccttccctcaagaaagggaccgggcgcaaacatgggacatgtcgtgcaagcgcatctacaggggccaattatggacattgaaggagtaattgccccgcagttctgatgaatagcgtcgttatgctgagtagcacgatgaacactgcggccgcggtgcattcacgatgtggagccnnnnnnnnnnagaatagcgtcgccatgctgagtggcacgatgaacaccgcggccgcggtgcattcacgatgtggagcctgcggggggtcgcaggccctggcgctcgtcaggtgggttgggacactgattacgtctgcataacatgcctcacccccaacgagaagctcacggataacctcggcctccacctcgcagaggcgacagccgaaggagtcgtgcattctcatgtcaagggaccccacccaacctgacacaccaaaccatgtgtggcggtggtcttacgagcgccagcaccaccgcccatggccgagtctcatgggtgagtggagctgcaagcccccagcagacaaccctgtacactgccgggagctcgacatcgtcgacgagcagcacaagcagcagcggctccagctctgacagcgaggagcccacgacatcacgagccgctcggcggactgcagtcaaggccatgcagcctacggtgtccgtgtgccaggacaagtcgtgcggtcgcaagggctctgccgcgctgctggctgcgtttgaggaggcagcccagggcgcctgcgtccaggcgtccaaatgccagggctactgcaaggtcggcccgtctgttcggctccacaaccgacaaggcggatacgtgcagtacgccgctgtgaatacagaggacgtggaggagctgctggacaaactcaagcaatgaggatgagctggcccaaataccatttcctacgtatcctctttctcccattgggggcccattgtttagtttttgagaacacaagttttcaggcctggcttctccataccgtagtgaaatcatgggggtgggagcggattgaatgttgagatttcgtgatgactgggcctgacgccttacatgtacaaactagtctaaaccgnnnnnnnnnnagttgagtttttgagaacacgaggttttaggcctggcttctccataccgtagtaaaatcatggtggtgggagcggattgaatgtcgagatttcgtgatgactgggcctggcgccttacatgtacaaactagtctaaaccgaaggagcaagcgaatgcagcagggtggaaggaagaggacagcaggtcacttcagtgcttcttgttctgtgcggggtgcggataggatattgtcggcccccattcttgaggagcagggtgtcgcctgcagcacatcgccctccccatctgcctccctctcatcctgcgtcgtccagagctaggcacgcgtcccccgcttcccttctctcgcgctcaatccttgggctcacccaccttgttcttcttcgccgaacgaggagttccattctgggccttcctgcccgagcgcttgcccttgccggccccaagcagggacaggaccagcgccacctgcgagggatggcgagttcatcaagcacggcaggaagatgccagggcccatcccccccccggtccccccccgcccccnnnnnnnnnntggaatggatattgtcggcccccactcttgaggagcagggtgtcgcctgttgcacatcgccctccccatctgccaccctctcatcctgcgtcgtccaaggctaggcacgcgtcccccgcttcccttctcnnnnnnnnnnggttgatcaagcaaggcagggaagatgccagggcccatgcccccctcgggcccccccgcccccaccctgccacaccagagggagccagagcagacccttgacgatgacggcggggtatggcttcaccgctaggggggccgtgctggggtaacgccgcagctgggcggcgagcagtgtctccagctccgtcgctgctcgcgctgcgtgcgccgccgcctgggcgtatagctcctgggccttggccccggcgatgctgacgtggcggtgcagggtgccgtagtgcgcgcccagggtctcgtgggaggccaggcgggtgtgcaggtctgacgccagggcgcgccccctgtgcagcgcctcgttccaggctggaaaggcccgggtcgccgcccaggtgcgggcctgggcggtgtacagcctggccctgtcgacggccagcgaggcatgcggctggaccctgtcggcccagaccgcctgggcctgctgctggaaggggtgcagcttggcaaagaagagcacgacggaggcggggacgggggaggactcctgctccaggcgcagcgcagccagcacgttgtttgtctgtggggaacagcgtggggcaacatcgctcggaatcttgcgccaaggcagaaggggagaggcatgcgtggggtggcctggacgatcggcctaggcaccatcacagccggtacctgctgcagatcctgaaacagggcgtcacgctcagactcggtcgtcttgacgctctgcttgaggnnnnnnnnnnggatcggcctgggcaccatcacagccgatacctgctgcagatcctgagacagggcgtcacgctcggactcggtcgtcttgacgctctgcttgagggccgcgatctcggagttaagacctgagatctgcttcttgagctggatgtgggtagcctggttggggagggggaacaacaggggaatactatggcttgcatagcgacgtacaacacgtgtatggccagaagtggtgacatcataccctggcacacccctctacctctgctttggctgtcagagcctccacccggcccttgaggactgccacttcctcgctggcagacgcaaggtccgcggtgcaggctgcatcgccagctacagggacatcatgctgcacctatatgcaccagaaagtgatatacgtgaaaatgtatcactcaagggcatggcaggcgcaagcgtcgacctcgacgtacctccactccctctacatcttcgtgggctgcgacaaagcttgggccagcagccacgagcaggcacacggctgccnnnnnnnnnngcctctccatcttcgtgggctgtgacaaagcttggaccagcagccacgagcaggcacacggctgccagcaggagcagtcggcgagtcatattgttaagagttccgtgagaagcttttgcggtcatccaggaagaggaggaggcgtggccctgtcgagtcattgctaggtctctgcgtccaacactccggcnnnnnnnnnnggtcggcgagtcatgatgtcaagagttccgtgagaagctcttgcggtcatccaggaagaggagcaggcgtggccctgtcgagtccttgctaggtctctgcgtccaacactccggctccctttcttgcgctcgcgcgccagaagaattcaatacctcgcgccctgacacacgcagatgatcctcggcgatgatgggtgtcctgtacgccgctgaaggaccatcctagcaccgagggagaggaatctggtggctcgcctcagcgatgtcgccgtcgcgaggcttgtttgcagggcatcgcgtcctttgcacagccgtgactgtcgcggagagggaccgactggtgcagcatctgagggaggagggcgccaccctcatcaccgttttttcggtggaatcgccccctgatgtggtggtgacgcgatccgccctggctacaggaagcagactgtgccgcctctctcgccccgacatccctgccgtgacccccgactgggtgacagcctgcgtcagcgcgggacgcctcctggcacatcatcctcaccgcctgccatgcttctcaggcatgacgatctgcctgtcgggccttggctcatcggagaagcaggacctggtccagctggtggaggcacacaatgggcggcactctgcagccctggaccggcgctgcacccacctggtcacctgcaccacccagagcgacaagtacaggtgtgcgcgtagtctttccagcgtgccgtgacgcggtgcctgggaggcactttgcccgcctgggcattcgaacctcgaatgcagtcgcagagtcatgacccttcccaccccaggtttgccctgacccatgacatcgtatgtgtctcgccagcctgggtacagtccagtgtttcgcatggcttctgccccccagaactggacttcccatgttcggatgagaacgcagacccaaacccctcggccaggtgtgtctgggataccctctccgagaaaaggtcggggggtgggaagtggtccatgcaatgcactcgaggagagcgcacaccatgctcaacccctccagcaggcttttattctactgctgtgctagcaaagggattgtctgggtgtaggcatgcttttgccccggacaagttgcatgaatccactctgggcctctgtcattcaatactttgctcagtgcagcaaagcaatgactgctaggcaccctatcgtcatgcagttgactccttgcttccatccccacacagcatgctggagcagacccgcgatgggagcggtgctgcagccccaagatcaggctcttccctgctgccgacgtgtgtcctccagcccagcagtcgcccccccgccctctcagatccctccgccggcccgatgagcctgtgcatggatgcctgctacctctggctggtggggtgtgggcctcaggagcagctgcaggcgctgcaggcaatacgccgcgtggctgccaagaggtttgcggtcccacacccgctgctgacccatgtcatcgtcggcggggcactgggtgacacggacgcgcggcgtgtggctgccgtggcctcggggaacgcctcgttgcaggtggtgtgcctagactggctgctggactgcgtgaagaagggctgcatcctggcatgcgggccctaccacttccgagcccctcctggagcaagagggggagcaggggcgatcgccatggtgggccagggctggctggggtgtgggagggatcccgccagcgggtggagagggtgccttgcgccctggaatcagagccaagctcgctcgtcgctccattctgtaggccggtatgtcgtccggcacggcggagcagtcggcgtcggaggcaagcaagggccatgccggcatccttgtgggtcgctactttacactgtcagcgctgtgcaacccagaggagcttgcgcgggcccgccaagtgattaaatctcaagggggaaaggtgagggtccagggcgtgccggagccggcccgcgaagacatccctggccggggagataccaacaccgagtattcttcgccttgatctgcatcgggatgcatggtcaggacagggaccagccacaaccccacccccgaccatgccggtcccttgcagatattccacgagagcacggtccacacggtgccttcccgcgaggtggcgtatgcactctgccccgccagcctcacgcatgcgcaggtcaaggcgctctgctctgcctccagtgactttacctacggtgagcgggaagcagaggggtatcgggtggccagggtggccgggcttgatgagtgcagctgcgctcaccactccgccgtgggatgcaggcatggcatgccctttgggatgccggatccaggagtctggctgccatctgcatgccggcggggattggagacaggggaaggggaagacgacagttcctgtgaagtcctgggagacccagtgtgctggccaagcgacaccttggtaaccgggacgctgaccctctcccttgctgcgctggtggtggccagtgccggaggaccatcgtgtgacgtcgtactggatggagtgcagcctgctggcaggcaagctcgtgccgcacagcagaggagctccctgctaccggcccctaccctacccctttcccctgcctggggtggagaagctcaggtactggtgcatgcgcattgtgccattgcgaggagggggaaggggcagcgagggaagcaatgagcgcagtgccctgcaggcaggcggatgtaggcctctactgcgttctgatttgccagccgcatggctctgaccctcagcannnnnnnnnnaaggggcagcaagggaagcaatgagcgccgtgtcctgcaggcaggcggatgtaggccgctactgcgtcctgagttgccagccgcatggctctgaccctcagcagcccacctcccggcgtctggtcatggtctgcgaccacaccttgcgtgtgtatccgccgcacaactccaagggcacgaccgtcacagccctcctgcccaggcccttatctcctgctcttggatttccccatccccatcgccgtccttttggccccgcagaatctgcatctccggttacgacgtgcatgtgcgctccgccatcaacttttcagtccagctggtgggtggcacgcacagctcggaagccatgacgcgcgccaacacacacctggtcctaccagaggccgtgggtgaggggggttggagggcgtgccaggtgcagatgtctcaaactggtggcctgtggccctgtgcttgccgtttgcctggtgcagctggcgagcagtggtttgacgccnnnnnnnnnntggcctgtggccctgtgcttgccgttttccaggtgcagctggcgagcagtggtttgacgccgcacggaggcagagccgcctcatcgaaagtgcctgagcagatgcatgccccgagcacgggccctcttgatgcggcagggccgccaggacccctgactccacacgacccctcgctgccatgtccaggggagaagtacaagcactgcgcggcatttggagtgacgccggtgaccgcagactggctggtggacagcatcaccgccggcctgctgcagcccgaaaaagagtaccaccccgggagacgcgctgcagcccaggccccgctcgctcaccagagccaggcggggggccggccgcgccagggtcaatcgcaggagcagtgcggggccggggaggggagagcaagccaggcgtccaggaagcgggccggggagggcgcgcccgctgacctggggcccctcaacttggagagtctgctggagatgaccgagagcggcgctgggcatcgtgagaaggcaggcccgccccccaaacggtgcgtgctgggcgggcacggccgatcgaggctgccgagggccggaagcggggaatgagctgcacggctacagatgatctggggcatcctgggcccctgggcttctgatcagcctctcgtgtgtgcctcccagactccccatcacgtctccagacaacctattgctcgacatcctgcctcgcaggtgttggtccagggcgggtgactgcggcgccgcctcccagcctctgcagcccatctcgggcaccgcgcctggcggcactccggggcccgggccggggctggacgacgtggtggacaccatctcctgcatcctggaggacctgtccaactccctgccaggcgacaggccctcccagcacccacgctcgcaggggcacagcacacgcagggccgggcctgctgggatgagtggcggacagggcgggcgtgggagcgcagcaccgtccatgcaggtgcggggggcgctggtggtgggaattccctcgtgcatggcaacggggactacgtcgaggaacaggacgcctgtgtcgcaggtgcacatgctcctgccccatcctttgtgtcgatgtcacccccactttcaggactgcatggtgtcccagagtattgagtatggatgctaggacttgcaggctccgaagaggtcctgagctcgcctcgtgctccaggatggggcactggcatctgaggcgctgagcagcaggtcgggcgcagcattgccagaggcatggggtgctgtgaacggcatgtgcccctctcatgctggacgcccctcgcccctccgtcagtgctttctcccaggcacccatagcagacatgtcgctcgagcagaaggtaatacacagatgtgacgacagaccagacgctggaccaggctagattgggcttgggcaagggtgcgtgcagcacaggggcaccatcgctggatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgccatgggatgtgacctgatgtgttacagaattcgccaggaaagcatgcttgttaaaaggtatcgtcacggggtgcagagatcggtgtcatcacggagcagggaagccctgtacataggcaaacgggttggagaggtgaatgactccactcggggcagggatttcttgcaggtggtgcatcataggggtggtcgcggccatggctcgagctagagtatagagcttggtggccataatggtggtgttgcctgtggaggtggaaatgggtgctcacgcaccaagcaccatcacctaagacgccggggggggaggttaagggtcttggggcgggggaggggactcaggtggtggtggtgactgaggcgggggagatgaaagaggaggggag

SEQ ID NO: 41519 - DNA, 79 bp, Chlorella protothecoides
gggtcggcaggctgctcatgtacggtgagtcgggtgtggataagatgaggcactgccttggggtgccaaggtgctgccg

SEQ ID NO: 41520 - DNA, 127 bp, Chlorella protothecoides
ggggggagggtgacgataaagggggggaggtgaccatgcaggggcggctcaggaggggccacgtccatggtacaaggctgggggccatgggaagccaagtccgtctccctggcatgaccctccccgc

SEQ ID NO: 41521 - DNA, 70 bp, Chlorella protothecoides
gagcagcccggtccgtcctccacaggtgctccccccctccggtcgtcctccagctgctctggcatcttgc

SEQ ID NO: 41522 - DNA, 78 bp, Chlorella protothecoides
tgagtcgtaccccccacacccaaccccacaaaccaccacacacccctcccccagttttgacgagcacgatgcgattcg

SEQ ID NO: 41523 - DNA, 2649 bp, Chlorella protothecoides
  modified_base (102)..(111): a, c, t, g, unknown or other
  modified_base (916)..(925): a, c, t, g, unknown or other
  modified_base (1072)..(1081): a, c, t, g, unknown or other
  modified_base (1205)..(1214): a, c, t, g, unknown or other
  modified_base (1349)..(1358): a, c, t, g, unknown or other
  modified_base (1741)..(1766): a, c, t, g, unknown or other
gcgcgaggctgcactggtgcgtcgggagggtgggggtagcacggaggagggtggggtgggaggctccgagcatttgtggtgtgcgcgcagggcgcgcgggannnnnnnnnnttccagcgcgaggcgggcgccgccgacgcctacgtggccgctcgcgcagcggagctgggcggcgctcccggcgcgaggctgcactggtgcgtcgggatggtggggatagcatggaggagggtggggtgggaggctccgaggatttgtggtgtgcgcgcagggcgcgcgggagccggcagggtgtggaatgtggcctgtgaggggccgagctgatcccctccctcgagtcccagcagcacccaggggtgctgccccccccagccgcgcctctgaactggcgtcgtcgcacgtccctgacccctccgctcagtcaccttccacgccccaaaaactcaaacatcaacaggctgcaccggccacggacgctggcggtgtgggccgagctggagcggcgccgcgtgaagctgacctgggacctgcccatgctgcgcggcaagctgctgcccctgctgctggactgggacctggcgcatagcggtgaggaaaacggggccggggagaggggggcgggcgaaacgcggcccgagttctgggcgcgcgaggtgcagaaggtccagggcggcgcggcggcgggacccaggaaggcggccggcgccgcggcggcgccgccccgcggctggcgctatgtcgtgcgctgggagcgcgtgcccagcgtcgcggcggaggcctacccgccgctcctggccgtgcggccccgggagcggaggggccggggcgccggcggcgaggaggggcctgaaccggccagccagagccgggggagccagggggcggcgagccaggcggagggcgccgacgctgcctnnnnnnnnnnggccggccagccagagccgggggagccaggaggcgccgagccaggcggagggcgccgacgctgcctccatccccatgacggtgcgcggtggcgcggggcagcgagtgggcgtctcaacgcccgctgcatggctgcgcgcaatgcatnnnnnnnnnntgcggtggcgcgggcagcgagtgggcggctcgacgcccgctgcatggctgcgcgcaatgcatgcagcgccaggattgtgcacggacgcatgcgcgctcccgacacacactcacacacacacacnnnnnnnnnncgtgctgatgtttgaagagcgtgtggcgagaggcggtaggggtgggggtggttggggtgggaatgttgcccccctttcctttgccagccgtggacgctgcgccagtggcttggccgggcaccaggctcggcgctnnnnnnnnnnatactcacaagcactcacacacacactcacacacacactcacacacacatcctcgcagctggaggcgttcgaccggcactggctggacggcagcaccgccgaggcgaggtcggtcaggatcagcgccgtccggcaacatgcagcgcagctggagcagcgccacctgtccgggtatgtggggtgtgctgatgtttgaagagcgtgtggcgagacgcggtaggggtgggggtggtcggggtgggaatgttgccccgctttcctttgtcagccgtgggcgctgcgccggtggcttggccgggcaccaggctcggcgctcctgccctcgcgatgctcgaccaggagaggccgagtgggggtgcggcatcggcgccgccctgctggcnnnnnnnnnnnnnnnnnnnnnnnnnnccagatcgggggggcggggaggcgccaggccggcgccggcctcaccggagacgcagggcctgctggcgcggctgctggtgcagcagcgcgcccgagccctgctggggcccaagccctccgccgggcccgctgtggccaggggcccggactcggccgtcctggcggcggcgcgggggtcatcggtggtgggcgacgcacgaggcggggcggccaccgcgcgggctccggcgcggcgtgggcgcggcctggcggagggctgggccggggccaggcccgaggagggcgggggggaggcacaggtttctcccaccccgcgtgctgctgtcggaacagcctcgccgaggaagcgagggctgcgggaggccggcggcggtgtcggcccggcatcgcctgcaggcgctgccctcctgcagggtgcagggacccagcgctcccccgccaagtctgccgacatccggcggtacgtggagcagggcagcccagggcgcctgggtccaactgcctgcgagggcggcgagctggacctcacaaccccagagggctgctgccggagccccgccattgacctcacccagacttgaggggcgcaagggagcaggaaaagtcctgtcaaaccagatgcatgcacacgtttgctccctcttcaagtctcgcaacgattattaccttggcagtacctcgcacgaatctttttgcccagctgactgcccctggcccggcacaatcttgacctgacgagatggcttatcctcacgatctggagaaggaggtaggtacttcccctctgcctcctggttgtaagacacaccagagtggtatcccgggtgatctttccaatgtgctccaggaatagacagacagcatccttgcaaacccccccccc

SEQ ID NO: 41524 - DNA, 83 bp, Chlorella protothecoides
gccacccctcttgggcccgacatcccccctcccaccctcaagcaagagacacgacaaaccttggggcagcgggcggcggcgat

SEQ ID NO: 41525 - DNA, 61 bp, Chlorella protothecoides
gcaccttcgccaatcggaggttctacaatacatacaatccaatggcatgcataaactggcg

SEQ ID NO: 41526 - DNA, 145 bp, Chlorella protothecoides
gaagggctccacccgccagctgcagatgtttatggagtgtgtgggtgtgtggcgtgggatcacagatggtcgaaggctcatctgtagaaccccccccggtgcagaagcaagcgatcccaggggctcctggtctggaaatctcccc

SEQ ID NO: 41527 - DNA, 65 bp, Chlorella protothecoides
gagaatgaaaagatggtatccaacccccccaaaaaaaatctgagaacagtgggcgttcccagcct

SEQ ID NO: 41528 - DNA, 79 bp, Chlorella protothecoides
ccaccctggacggcgacatccgcatcaggcaagctaatactttaagatttgtggtcggatgtggcaaccaggccaggga

SEQ ID NO: 41529 - DNA, 89 bp, Chlorella protothecoides
ctccaacctccaaatcgtgcttgcccacccactcctgcctgaacgctcggcagtgctggctaacccaccagcacctccctcccaaactc

SEQ ID NO: 41530 - DNA, 61 bp, Chlorella protothecoides
ccctgtcgcagccaccaacaagatgcagatcggggagacgctgacccgggggctgggtgcg

SEQ ID NO: 41531 - DNA, 76 bp, Chlorella protothecoides
tacctcgcctccctggaaggtatggtttggagggaggtaggtggctaggcactcactggtaggtgcctacattccg

SEQ ID NO: 41532 - DNA, 63 bp, Chlorella protothecoides
gcagccgcgcaggccagagcgggcatgagctttgctgccgggcccctgcaggccgcccacgcg

SEQ ID NO: 41533 - DNA, 613 bp, Chlorella protothecoides
  modified_base (122)..(131): a, c, t, g, unknown or other
tttctcggggtgggcgtggtggggggcgatgggggggggcgttgaggccctggcagcccgtggaaagggtgtgggtggatgcaggtgcacggccagggaacatgggacggcacagcatgccnnnnnnnnnntgcgcccgcggtctgggccatcgtgcttgccatgctggccttgctcatttttggcgtcacgggggtgaggtttctcggggtgggcgtggtgtggggcgatagggggggccattcgggccctggcagcccgtggcaaagggtgtgggtggatgcaggtgcacagccagggaacatgggacggcacagcatgcctggaagtcctgggcagagcacgatgtggggcggtgcatgccatgatactcccccctttcctcgcccctcagcaggtgcacgacggcccgccccctgccctgggcacgctggcgggcacctgggccagcttcctgctggccacctgcggcctgtactacctcttccgcaccaccaccgccgacccgggcatgctgccctgcgcggcgggccggcacgcgggctccacgccgcgcgccggccagcccggcaagtcgcacggcagggcggcgggggaggcgcgcgggaccggc

SEQ ID NO: 41534 - DNA, 174 bp, Chlorella protothecoides
aggggcggggttggtcgggggtgccccgagaggggggttagtggggccttcgagggggccgacgcagccatgcgcctgggaaggagtgtgatgccggagagggccgtgcaccgaggcgctcccctgtgcaagaatcctgcgttgtatcacacacacacacaaagacaggcgcac

SEQ ID NO: 41535 - DNA, 97 bp, Chlorella protothecoides
ccctgcgccgcctccaccatcgacttgtctgtgttgtgtgtggggaggggcaaggggtggtagggacggaagggcgtgagaggttggagcttgctta

SEQ ID NO: 41536 - DNA, 78 bp, Chlorella protothecoides
tggggggaggcgggcggggccatccatgcagcacaaggtggcaggctcgcagtaaaggggtccctggcaggtgacacc

SEQ ID NO: 41537 - DNA, 61 bp, Chlorella protothecoides
tgtaggatcgtcccgcgatgctccgtggatgcagggtctgggggtcgtgtggtgcagcaga

SEQ ID NO: 41538 - DNA, 71 bp, Chlorella protothecoides
cagcgactgctggggggattcagctcacattcgaccatcggcatggttaccatggccacagccaggcgccc

SEQ ID NO: 41539 - DNA, 145 bp, Chlorella protothecoides
atacgggtctggcagggaagggggccctggggtgagaagcactgggccctagggggcccgggacacggcatgctgcaccccaaccatgtaaatgcacagcgtgcttggaagggacgcacatgcccgtatgtgggcaagtatgcaa

SEQ ID NO: 41540 - DNA, 338 bp, Chlorella protothecoides
cgccctccccccccagcccatcgccgccgcacgggccacccatcgtgctggccgccgccagctgctccctggctgcgcggggagtggtatgcgtgaccgtggtgaccaccgcccggcacgtcaaccccatctacctcacctttgagctggggtcgggggtgttccgcaactcctactcgcccaccagcctgacccagagcgcgcagtccgtgtttgtcgacgccacccagcccatcggcacctgctctgcctcagcctacgactatgacggcgagttcatccagacccccgacgtggacctgaccccggtggggccgccgccgccccccagccccccg

SEQ ID NO: 41541 - DNA, 91 bp, Chlorella protothecoides
cggggggtgccctcggtgtgctcgccactccgaaaacatctgcagcgccgcccacccccgcccccagtccctggccaaccccgcaggctgc

SEQ ID NO: 41542 - DNA, 483 bp, Chlorella protothecoides
  modified_base (252)..(387): a, c, t, g, unknown or other
gccttgcgcaccagcttcttcttgatcaccttgaggcctgcggcatgctttggtggggggtggcttctcaggggaagggtgtggagtaggggaacggggtccagggctggcgcggaacaggggcccggctggattggatcgagattggcgcgcaaggggcaagcgccctccacgccacacatcctctctccacacccacggggaccgactggaggcagcctgctcaccctcgtgcagctgcagcatctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctcatcggggacggactgcgacacggcacgcggccgcctacggcacccggtcggggaaccaggacctgcacccagcttgattccgcgcacacaa

SEQ ID NO: 41543 - DNA, 79 bp, Chlorella protothecoides
ggcagagatgtccgagatgccccgaaccggtctaactatccaaagctatccccctcgtgcagctcaacattgcgtaccc

SEQ ID NO: 41544 - DNA, 4576 bp, Chlorella protothecoides
  modified_base (457)..(466): a, c, t, g, unknown or other
  modified_base (966)..(1033): a, c, t, g, unknown or other
  modified_base (1506)..(1515): a, c, t, g, unknown or other
  modified_base (2046)..(2160): a, c, t, g, unknown or other
  modified_base (2880)..(2889): a, c, t, g, unknown or other
  modified_base (3439)..(3448): a, c, t, g, unknown or other
  modified_base (3566)..(3575): a, c, t, g, unknown or other
  modified_base (3947)..(3956): a, c, t, g, unknown or other
gccgcggtacgtgggcaaggccgcgcccccggactcgctgctgggcaggttctccctggcggcgctgcacctgcgcggcgcgcgccgcgtcgccacggcctggaacgcgctgctgcgcacgctgcgtttcgagtaccttgagcacggcgcgggggggcccggcggggggggtgcctcgcgcgaggggggcccggtggacctcggcgccgcgctgccgcaccagcacctgcagctcttccagctcagcgtggcgatgctgcgcgacgctgaggacggccccgcatgcctggccaggcgcgcctcggacggctcggagacctcggcctcctccctcttcatgtctgccggggaggagggcgtcgcggatggcgatttgggaggggtgggcccgctggacgctggcatggcggacacggaggtggcggaaggcggcggggcgagcggtggggatgagggnnnnnnnnnncgggcgtggtgggcctgctggacgctggcatggcgggcacggaggtggcgggaggcggcggggcgagcggtggggatgagggggccggctcccttgatcgcggctgggaggacgatggtctcgaggatggcagcccagcgaagagcgggtcggcggagcgcgacgatcctcccgtcttgcagacacgagcgcatggctcgggttccgccgccggccgggccctcgagcgtcctggcagtgatgaggcgagccataccctcgctgccgtgcctcagggcgtggcttccattctccccggcgcgtacctgctgcaccacccagacgtcccactggccgtgcccgagacccaggcggcgccgccctgcaccgaggaggcgctgctcggagcgggtcccagcagcggccaaggagaggatggcgggggagtgcgcgcctcgcacgccgcgctcctggcgtcggacatggcggccttcaaggccgccaacccggcgggcgcctgnnnnnnnnnnnnnnnnnnnnnnnnnnnnnnnnnnnnnnnnnnnnnnnnnnnnnnnnnnnnnnnnnnnncagccccaaggactggcgcccggggggctcgctgagtgccaggatggccgccccgggcaacgcgtgggcggcggcctggcagggcgcgcgcgcctgccccgccgcgcggcagcgcccgctgcaccagccccgccgcgaggcggagcgcgctctgcacgcgctggagacggtcctgcccgagcacttctggcgcgcgctgctggcggtggcgcgcagcaccgcgctggcggtgttgcaagccagtgaagtcgccggcatggcgcccgtggccgggcagctggagaggtatgcagtgaaaggggtagggggcggacactggacggcacgtcgaaccgcagaggggtggccgagtgcagggcccagcgcgcggctgtgggaggaccccggggacgatgcgcttcgattctcgagatgagcgtgacgtgggcgggcctctgggtctctggcctgatgatcctgggaccccatgcctnnnnnnnnnnccagaggggtggccgagcgcagggcccagcgcgcggctgtgggcggaccccggggacgatgcgctgcgattctcgagatgagcgtgacgtgcgcgggccactgggtccctggcctgatgatcctgggaccccatgcctgaccgcctcgacgcctgcccacccccccacctcaccgccactcgaacccaacccccatctcctcgccaggctgcgccgccaaatggaggccgccgaccccgacgacttccccgccgaggacttccggcgcgtggagacgctcatcgccacggcctcctccatgctgtgcacgctgggctccctgccccagggcctgggtgccgaggccggccccgccggccggcgcggcgcgggccgggtcgcctgggacctgaccgcccgggcgctggagcgcgcgctgggcgacggggctgggcgcgcatctgaccccggcgccgcccgccacgccgcggcggtgccggtgcagcccggggagcgggagttcctggccgcgtgcatgagcggcggggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcagcaccgcctgcacgtggaaagcctggcggcggagctgcgggtgtcctccgtcctgctggccagggggtccaggcggggctcagagcagcagcgcggtgtggagcactgaatgtggcacgccgagaacaccatggaggcgctgtgcgtgagtgtgtgctgggccatgcggagctggcgacccatgtgcgtgcaaggcacacaaggagtccgagaccaggaccctggcgtcagatcctccatcgctgggcgcgaagtcccgcgcacgacacagtccccttctccggaaaggaagcatgcagacctgatcatgcattgtacatacgtggcctgcttatgatgcgctctgaatagtaaatcaattattggaaagaatgcgcgccggcgtgcgctgggcatcgctcccgctgtgggcgacgtccgtggcagcggcgtaccgcattctgcccccggagcctgcccactgctcggcatctccacagaaccacagcgtcgatcccggttgttccaaactcgatgagcatgttggggcattcaaggcctggctgcagcaggctggcggggaggtgtcgggagtagagttcaggccagcgcaccaggtgtgaccatgttggggcgttgtgctatttcggcactcggccttgagacaggcagcatcagttcgacgcgggaatcaccatttggaaccccaatttcatcccacaaacaatgctcaggnnnnnnnnnngggggcgttgtgctattttggccctcggcctttagacaggcagcatcagttcgacgcgggaactaccatctagaatcccaatttcatcccacaaacaatgctcaggaggccagcggcatggcagtgtatgcgaatgcgtctctcggggctcggcagggctggggccagtgggcagcgcagaagctgcgcctcccattcgccccccagcctgtcagcctggccgccttcccgctgtccctggccctgaccggccagtccgtggccgccaggtccccctgtctgggggctggaatggattcgggggccgtcgacgagcgcgacgccgttatcctatacctggcggcgcagcgccggctcggtccggcctcgcagttgcatccctggctgcgcctgctgcccaaaaccttcacgaccacgctcttctggaaggacgaggaggtggagtggctggcggggacgacgctgcatcgggccacgctgtgagtggagtgggtttatcaaggtatcggtgccttgggccatagggtcgatgagttggggaggggagttnnnnnnnnnngatgattgaaggaactcaaatgtgggacccggttctgcgagctccctgagatgaacgcagtggagcgacgtcaagagccctgcacatcctctcttttcgtcaccctcaccagaggccnnnnnnnnnntgttccaatgtgtcggtgccttggggcatagggtcgatgagttggggaggggagttgggctgaaagtgcctcaaattgctcatagttcccattgctgaggatcaaagaaatatgatttaagagaactccaatgtgggacccggctctgcaagctccctgagatgaacccagtggagcgtcgtcaagaccctgcacaacctctcttttcgtcaccctcaccagaggccaggtcgcctccctggtttcccctctcgtgcctggcatgccagtgcgccattccatcatcctaggcaccacccccatctcccctcaccatgcagcctgcggcgcatgcggctgcaagaatcctggaaggcgctgaccgggctggcnnnnnnnnnnccccatctcgtgcctggcataccagtgcgccattccatcatcctaggcactaccaccatctcccctcaccgtgcagcctgcggcgcatgcagctacgagaatcctggaaggcgctgaccgggctggcctcgcggctcgcggcggaggccggcgcaccctccccacccaccgaatcagacttcctctgggcccacgccgtgttctggtcccgggccatcgccttcccctgcccgcccgaggcgctgcctggtggaaggtcaacaaccgccggccccagcccgcaggagggcgtcgtgccgggcctggacttctgcaaccacgccatgcgcccagtcgcccgctggaccgtgtatggcgcggagctcgacggcgcgggcggcggccgtcgccacgtgcacctggtccccagcgtcgcgccgcccgctccgggggccgagctttgcatcagctacggcgacgacaagtccaatgaggagctcctcttcctctacggcttcgcgctgccggaggccagcgggctcgcccgcctgatgctgcccctcccgctgccggccgcggcagaggactggacgccgcgcctgcacgcgcgcgtggcgctgctggcggcgcgcgtcctgccg

SEQ ID NO: 41545 - DNA, 72 bp, Chlorella protothecoides
atgtgtacaggatcagagtatgtatgccgcggcccagcgcgccacggtcaggagacccgatggatacatcac

SEQ ID NO: 41546 - DNA, 95 bp, Chlorella protothecoides
gtcgcgctcggcctccagctcggccccctgtcgcttgtaggccgccgcagcgccggccgcggcccgtgcggcctcctccagccggccgcgcaggt

SEQ ID NO: 41547 - DNA, 27111 bp, Chlorella protothecoides
  modified_base (711)..(720): a, c, t, g, unknown or other
  modified_base (1092)..(1167): a, c, t, g, unknown or other
  modified_base (1378)..(1387): a, c, t, g, unknown or other
  modified_base (2267)..(2276): a, c, t, g, unknown or other
  modified_base (2737)..(2746): a, c, t, g, unknown or other
  modified_base (3923)..(3932): a, c, t, g, unknown or other
  modified_base (4146)..(4155): a, c, t, g, unknown or other
  modified_base (4649)..(4658): a, c, t, g, unknown or other
  modified_base (5046)..(5055): a, c, t, g, unknown or other
  modified_base (5316)..(5325): a, c, t, g, unknown or other
  modified_base (5888)..(5897): a, c, t, g, unknown or other
  modified_base (6425)..(6434): a, c, t, g, unknown or other
  modified_base (6853)..(6862): a, c, t, g, unknown or other
  modified_base (7198)..(7207): a, c, t, g, unknown or other
  modified_base (7438)..(7447): a, c, t, g, unknown or other
  modified_base (7858)..(7867): a, c, t, g, unknown or other
  modified_base (8123)..(8132): a, c, t, g, unknown or other
  modified_base (8300)..(8309): a, c, t, g, unknown or other
  modified_base (8581)..(8590): a, c, t, g, unknown or other
  modified_base (8664)..(8673): a, c, t, g, unknown or other
  modified_base (9952)..(9961): a, c, t, g, unknown or other
  modified_base (10248)..(10291): a, c, t, g, unknown or other
  modified_base (12411)..(12420): a, c, t, g, unknown or other
  modified_base (12596)..(12605): a, c, t, g, unknown or other
  modified_base (12692)..(12701): a, c, t, g, unknown or other
  modified_base (12772)..(12781): a, c, t, g, unknown or other
  modified_base (14000)..(14009): a, c, t, g, unknown or other
  modified_base (17111)..(17120): a, c, t, g, unknown or other
  modified_base (17636)..(17645): a, c, t, g, unknown or other
  modified_base (18154)..(18163): a, c, t, g, unknown or other
  modified_base (18655)..(18664): a, c, t, g, unknown or other
  modified_base (18750)..(18759): a, c, t, g, unknown or other
  modified_base (19380)..(19389): a, c, t, g, unknown or other
  modified_base (19491)..(19500): a, c, t, g, unknown or other
  modified_base (20525)..(20534): a, c, t, g, unknown or other
  modified_base (21199)..(21208): a, c, t, g, unknown or other
  modified_base (24187)..(24196): a, c, t, g, unknown or other
  modified_base (24667)..(24676): a, c, t, g, unknown or other
  modified_base (26240)..(26249): a, c, t, g, unknown or other
ctctgtgctcgctgtcttataggtcgggcaactgtgggaagggaggggtttagaaggggggggtggaacatgcggccctcgccgtgcgggaagtcatccgcgcgctccgtaggaatggttgcctgcgccacaggcttattgtagtaggtaccgtggactgtggtctgaacggcaaccaatatgtcggccctggtgaaggggcgctccgagggttcgaagagctggggcacgccgcgcattgtttccaactgatggaagattttcagatgtgaataatcagcttgggggggggcgggggggcggcgatctgtcgtcggggtttcactagtttacatcccgcacgatctgggaagcgtaactccccggatgtgccttcccccgcctccgcacaacccaagacgacaaaaaagcatgaccccatgcccgaaggccatgccatcgccataacttgtatctatatcaatccataatgcatgtaacgaatatgaatcggcggggatcatgtttctgctccctcaccctgattctggcagcgtcactgggaggcgaggccgcgcgcctggacccgggacgcgcagactcctttccactcgactggcccccccagcctgtcaagatggatggtaatgtagggatctgcccgccaggatcagttcgacatgggttgccgatcgatgaggtgccggggttccgaatcaattcatcatgatnnnnnnnnnngatcccgcacgaactgggactcctagactccccggatgtgccttcccccgcctccgcacaacccaagacgacaaaaaagcatgacccccatgcccgaaggccatgccatgaccataacttgtatctacatcagtccataatgcatgtaacgaatatgaattggcggggatcatgtctctgctccctcaccctgattctggcagcgtcactgggaggcgaggccgcgcgcctggatccgggctcctttccactcgactggcccccccagcctgtcaagatggatggtaatgtaggggtctgcccgctaggatccgttcgacatgggttgccgatcgatgagttgccggggttccgaatcaattcatcatgatnnnnnnnnnnnnnnnnnnnnnnnnnnnnnnnnnnnnnnnnnnnnnnnnnnnnnnnnnnnnnnnnnnnnnnnnnnnngttatctgcttgagaagcacttcgccacgacctccgacgggtatatcctgagcctttatcgaatcccctttggtcgcgccggccgcggcgggtgcgcggtgggggatcaagatgaacattcacagcagccggcgggcatcccacgtgttagccagccatcccttccccaccccgtgtagtccaccacgcgccccgctgattctgcaacatnnnnnnnnnncttatctgcttgagaagcacttcgtgacgacctccgacggctatatcctgagcctttatcgaatcccctttggtcgcgccggccgtggcgggtgcgcggtgggggctacacgggtgatagcgatgaacattcacagagagccggcgggcatcacacgtgttagccagccagcccttccccaccccgtgtagaccaccacgcgccccgctgattctgcaacatggtatattcgacacgagtgctacctgggtactgaatgaccccgatcagagcttggcgttcctggcagcggaggccggctgggacgtctggctgcccaactcgcgggggaatgacttcagcctcgagcacaccacgctggacatttcccagcgcgagtactggaatttcacctttggcaccatggctggtgaggtcatatggagcgggggtggtcaaggggatgaaggcgtcagcgtggggagggacttgacgtgtaagcgctatcttgcggttctctttcaacttgtatgttatgcagggccccattgtgcaatccaatgcatcgcttacctgcctagcttggcaccaagctaacacaaaaatgttctgcacagaggaggacttgccagcaattatggagtatgtcttggagaagaccaggcaccccaaggtcgcatacgtcgggcactcccaggtgtggaggtgtggtaaaaggggagctcaccaggttggcggcgcctcctcaatgctcaagacaaggcgctccccctgactatccactggtaggggtatgcgcagtgcacctgcgcgacagcagagggtcccaggagagacttgaatccgtcatgccagtgtgtgagcttgttcttcccctccccactgtcagggggcaacccannnnnnnnnntcaggagagacttgaatcaggcatggcagtgtgtgagcttgttctttcccctccccactgtcagggggcaacccagatggtagccgcctccagtcgccaccccgagctggcggagagggtcagcctggcggtgctgctggcccctgtcctgagcatgcagcgggttgacagcctgctctggaacttcctggccaagttgaatgtggataggcttctggcgttgtccgggctggcattccgcattgggcaggtgagtaatccctcttcttgatgcattggcttctcaaacgagaagcaggctccttccagctcatgcctgtctcctgagcagctgccaggtgtattgcgatgctacagaatggcgcgtgtatcccgtccttccatgtcctttctggtccccacatccactctgcctgaccgcagttcctgtccctcgtccacagtccaacctgctgtccagnnnnnnnnnncattgcgatgctacagaatggcgcctgtatctgtcctttcatgccctttctggtctccatatccactctgcctgaccgcaatccctgcccctcgtccacagtccaacctgctgtccaggaccgtgatccagctggcctgtccctctggcgggggcctggagcccatcctctgctcctccatcctcacgctggcctgcggcttcaatgaaaaccagctgaacatgacgcgattcaaggattacgtcaagtacctccctggcggcaccagcatctacaacgcccagcactggctgcagctcctgcgcggagctcgccgcctgggccgcccggtcttccagtcgtacagctggggcgatgactgcccccggcgcccacccttcttctggtgggagccgggaacctgcaacgcctggtgcgtgtctgggagggtggcggctgggatgtggagaaaggaggggctggagtgggggaccctgatggggctgttggaagacagggttttaaagacacggagcctggaactccaggtgcctgaggaatcgcattggcgtaaccagaggaggagtgcagtaaggccgagcgcagtgctggccccttcctggagcatcacatccatctctgctggctgtccgtagggcgtacagggacggcgtcgtgccgagctacgacctctctaaagtcaacattccccttgtggtgtatgccggtgagagggctctgtgggcggtcctacggttcctgtgcggcaggggaagaaggggtagataagaacgctctccacggaacaatggctctgcagagacctgttcagggggggtgcctcctcttctcatcagtgccatcctcggtaccaagatgcagtaggggctgtaaccattggcaccagctgccattgatacaatcatgccccctcctccgcaggggaaggagataagcttggagttgctcaggacactgcagatgcactggcggccatgccatcccagaccgtcctgaacttcaccactgtccatgattatgagcacctcgactttgtgagcgagcacagtggtgggggtgaagctgtcggtatctgtcgttactgcagagctgctgtgcccgtgggaatcaaccagattcaacaagtgcaaaatccctcctcctgatacgtgccagacatggagtgtcgtggcaaagnnnnnnnnnnccgttattgcagagctgccgtgcccgtggaaatcatccggattcaatgactgcacaatccctccacctgacacgtgccagacatggagtgtcgtggcaaagtacgatctctaccccgagatactggagtggctcaagaagggctcctcctcagctccagatgccttgatgcatgttgtcgcaccggtgagtgagctctggatgggcagaagacnnnnnnnnnntaagaagggctcctcctcagctccaaatgccttgatgcatgctgtcgcagcggtgagtgagctctggatgggcagaagacttgctgctgcggtggagaagggtggtgcagctgctcacttggaatgctttgcctggacagtgtatcgcagacctcatgcttacaggctcgcatgccgtgaggttgcaaagctgggcgtgtgacgttgctgtcaactcatggacatcctctcttgctgtacaaataggattgaggggaatatatgtgcatcaacccttacccgatacacagcctttgctgtccatgtccccatgtatcaaaacctgccatatcctttccctctgattacaactccgaagccatggggcgggttaacataccgccctgtgccctggcctgcatactgtgtagcaagtagccatactatagcttgttcgtattggatggattccattactacactgttgagtatgcctcttgtaagatactgtgcannnnnnnnnnatattggatggattccatcactatactcttgagtatgcctcttgtaagatactgtgcacccaagacatgtgcactggtgatggttcccggaagtaccatagatgtggcagaaatcttccaaggtgttttggcttgccaaggactatcgggcacctaatgcaccgtcagccaggctgcggcgccaagactgccacgatgtaggccgaccatccgcgctgcagccgctgccgtgcctcagggtctatatcctcatgtggctgaaagtcagcctcgccctctgactcctcggagtcgctggccgaggcctcctggctgccagaggtatcagacgcgcgcccaccgtccccggcagacgcgtcctgtgatggtgggggatgaggatgagatnnnnnnnnnncccgaggcctcctggctgcccgaggtatcagacgtgcgcccaccgtccccggcagacgcatcctgtgatggtgggggatgaggatgagattgtggtgccggtgagcatcggcggcgccctgtaccctttgctgccctgccgctctcctgctcatcaagttctgctctgcatcttccccaaggactctgctagaattcaacaccttaagggcccctccctctcaccccacaccccaacatacactctccaccttgatggggnnnnnnnnnnttgctagaattcaacaccttaaggggccccccctctcaaccccgcccccccaacatacactctccaccttgatggggcgtatccagacgtaggtggtgctgaaccccgcctggcgcaggagctcgcggacgtccggcaccgtccacatgcgccagtcgtagtggaagttgtaccgccgcgcctcccgcccgtccatctcccgcagacggatggtgcccgtcatgcgccgagtcacggggtcaaacccgctctgcacccaggtgtaccccagacccgtggtggagttgtgtcggggcagcgtcaggtcccgctccgcggccggccctcccaacaggtcggccacgaagatgccgccacgcgcctggtccagggccgctgccacgtggcgcaggtagcgcaggaggcgggtcctttgcgtaattttggtgggcgggggggagtgtccagtggtctgtcgcatccaggcaggcctctgggaaggcatgcggtgtgggaccggcatgggaggcaacaccccccgacatccaccacgtgctgtcatcccacccccgcatacctcgtannnnnnnnnntgggtcctttgcgtatttttggtggggcgggggagagtgtccagtggtctgtcgcatccaggcaggcctctgggaaggcatgcggtgtggtactggcatgggaggcaataccccccgacatccaccacatgctgtcatcccacccccgcatacctcgtatgcaggaggcagacgccaaagttgagcgcgcagacgatgtcgcacgggcgggagcgcacgctgccgcggcgcgcgggcgcccctccctccccgtctgactcgtcagaggcgctgctctgcgagtcgctggcctccggcccggcctcgggaaagggcaccaggagcgccgagtctgccgggtccagcacctgtgagcggggacaacttgtgctgtgttggtggggcaggacaggctggtgtgctcaaagcatgcaagcctggcgggaaagtaaggcgcacccattgctcacaccatgggtgcaggcatcaagagccatcccagacatgcccacaacaacactcatgcttcagtgcagcaatggaccccannnnnnnnnntagtaaggcgcacccattgctcacatcacgggtgcaggcaccaagagccatcccagacatgcccacaacaatactcatgcttcagtgcagcaatggaccccaaactccttcccttgacatccccgatggcctcacattgccctccagcagtgcgagctggtgctgcgcagacccgcccagcatctcgccgttgtgccgagcgccccagtccagggtgggccggtccaggtcgaggcctacggctgagcgaaagacgccgccgcggcaccaggtggcggccaggagggcagtgccgcagaagtcctctcgcaggtgccggggctcctgtgggtggttggatagaggccaaggacattggtgcggcggcatgcacaagggaggcggctcgagctttctggtggcatgggtgtgcaggacannnnnnnnnncgggtggttgaatagaggccaaggacattagtggggcggcatgcacaagggaggcggctcaagctttctggtggcatgggtgtgcaggacatcaatatccttatcccaggctcacatgggagccaatgtacgtctgatgaaacttccggcagtacgacaggtcgccccggggagactgcacagcctgggattgtggtgggagagatgccagggtatcggtgtagcactagggtttggtgatgccaaaataatacgacaagtgctgtgcaaccttgtcatctcatgcaggtttcctgctttgccatcagcattacaacttgctctgtggtgtcaccnnnnnnnnnnttagcactggggttaggtgatacccaaatagtacgacaagtgctttgaaaccttgtcatctcatgcaggtttcctactttgccaccagcattacaacttgctctgtggtgtcacctgctgatacagctcatgccttcgtcctgaatctgtatcgatttttgtggatataaaaccggggggggacattggaattgtcagtgttgcaggcgtgggttccaggtgcgctctcannnnnnnnnnttcctgaatctgtagaatgttttgtggatataaacccgggggggcacattggaattgtcagtattgcaggcgtgggttccaggtgcgctctcaaagcgtgcaccctccctccctgaaacacgctgcatggccgaggactactccatgtcgatggccccattcccatacgcaccatcttccaccagatcatgatctgagcctgggtttctaccaattgcattcttcttccctccctttttgcccatttggatcgctgacgaaacctgggcagtctaggtgcacgaggcgaggtgttgcgtgcccaagagtcacatctgccgccaatgccgccgggaagaagagataactcttctcgtgcaacggaatcgacaccggtgtaatgcaagggatttggattcagccttcgatgcnnnnnnnnnntataactcttcccatgcaacggaatcgacaccggtgtattgcaagggatttggattcagccttcgatgcggtatttgccaggagctaggtgatggctcttggccagcgcgcgcgcgcaccttgggagggtttccctaacgaacccccaaatcaagaaccactacgacgcaagtcgccgcgaggcttacacatgtggcggcgacctctaagctatagtatcaagtcttcaagctttgcattggtcagtggtggtggnnnnnnnnnnacttaaggaggaaacgaaccgccgcgaggcttacacttgtggcggcgacctctaagctttagtatcaagttttcaagctttgcattggtcagtggtggtggtgatgtacttcattccacctcacatatccctgtgcatggccaccggcgatatgctgccccctctccnnnnnnnnnnccattccggagctcacatggaccccatcctcagtgctctgtgcgtggccaccggcgatatgctgccccctctccgcctgccgggcctcgcttggccgtccaccacctccgacctgtcgccgtagggcgagccgagggcggggatgccgcgggcgccggtggcagggccgccgcccagtgctgcgccctttggcagggagccgatctcctcgtcctccgcccccaccaccagggccagccctttttgccgcagcttcctgtacttttgccagnnnnnnnnnntcttgatgatctgcctcccctccctgggccccaacacacacacaaacgaacaagcacgcgcaccacgccgatgnnnnnnnnnnacgcccaccaccaccaccagccccttttgccgcagcttcctgtacttttgccagttgaacagcgtctgcaacagttaatcgagaagtgggtggggagtcaggtcagctccttggcatgcagggcttgccgcttggtcatggctacagccaaccggccggcgtcacacctgggtgtgatgtgccgcaggcccctcccttgatagtctgcctcccttccctgggccccaacacacacaaaaacgaacaagcacgcgcaccacgccgatgatgaggaccacgaggccggcggcgttgacgggggtgaagcgctcgcccaggaagagcaccgcggcggccacggtgaccacctccttgaaggtcccggccaccatgaaggtgagggcggaggtgtggccgatgagtgcaaactcagcccagaccatgaggaaggcgatgacggcacccgtggccacgatgccggcggtgagcaggcagtggccccagccggcaaagtaggggctggagggcaacgtattccacagctgctcgtgcgccaggctgacgacgcctagggtggcgctcatgaccggggtcaggtgcaggatgacctctacggggccgcccagcgcccctgtgcgtgttgaagggggtgagaggatcggtgactttggtgatgcagcggcgggtggcgccttccgagactggggcgccatgtgacgtgggatgtggaacggcagcgcgccatgttccgcgcatgcggcgttcccatggcggcgcccgtgagaatgacgcagaggggcaggggaggccccccgtgtgcatggatgaggggcccccttcctcaacctcttcattccccgcccagcttaccatgccccgtggcattgctgccctgcaggaggacctgcgtgatggtccagcgcagaccggccagagcggaggcggtcatgaccaggaggaagcccacgaggtggaagtccacctcccccgccaccagcagcatgagcccgatggagatgacgcacaccacgcccgccagatcccaggagggcctgtataagagaggggagagggacgggtgtcgttccggggcgctccctgtctatgggaagggtgatcaacaacatgtcatcgacataggccacgggactggggtttgcagcacccccagccctgcctagtcttcacccaccgtgcaagcagctcgacccagaaacccacttttcgattcgccacatgatggcaaaggccaggaggaagaggggaaccgtggacttgcacatgacgtagaatgacaagnnnnnnnnnnatccatgggaagggtgatcaacaacatgacataaacataggccacgggactggggggttgcagcacccccagccctgcctagccttcacccaccgtgcaagcagctcgacccaaaaacccacttttcgatgcgccacatgatggcaaaggccaggaggaacaggggaactgtggacttgcacatgacgtagaatgacaagctgatgaacaccaacgaatagttggacaggccgatgtccagccccgtcgccacgccgttggggaacactgcgagcattgaagggggnnnnnnnnnnnnnnnnnnnnnnnnnnnnnnnnnnnnnnnnnnnnttgtcccggccctggcaatcaatcctcgccaccccttttctcgtacggattagggagcgtcccacctgctcgccaccacctgggccacgccatcttctcatccgagccgtgccgcctgatcaggcccgaccagaggcaagcacgcgccagaaaatgctggaagatgaactgaacgctggacatcaggatgggggctgcggggaggacggagacacgcgggcagtggattccctacctggctggagggcacgtgaggaaggctgccaccagcctcacaaagggcggtggcccctgcgtgaactccgcccaggcttgcgcacctgggaagggccccttgccgaacagtccccggtccttgcccaccagcatcttgttccagaggctcagggaggtgctcaaaaagtacctggacgagtagggaatggaggtctttgcagataacgccactcctgggagaatctgggactgacgcccaaccaaaaggatcccccaccagatctcccctagccctcaccagatgcaaatgagcatcaggttgcgcgcagcgccggccagcatgtcctgctgagcccatcctcgcagcgcctctctccacgtctggtcccttgcctccccggaggtctggggctcggccatgatgggctggagctcgacctcatcgaggccctgcccggggccggccttgccattcatggtgcggtgcaagaccgtctcagctcatgcccctcggtcccacatactctcatgcgcggtttgtactggagcggggcagggcagcgtgcaggggtggtgggcagggatctgcccggggctagcaaggcccccaactgctcgttcaataaagacgtcgcagaggcccggcaggctgtgatcactcccttgtttcaagcctggtgatcaatatttgatgttgacaccaggagcgcggccagacgcccaaggagtgccgggaggatggtcgccctttcgcgcaggcgtagcgcgctcgaaacttgcctctggttcaccgtgccacacgagttcggtacgccacctcctccctccatcatccacccctccccaatcctgcatgtttccttcttgtgcctttcaagtacagcacatcccaccctccccttgtctctgcctttgcacccgtggcagtctcacacacgtctgcaccagcagcctggcactcaggccttgacacggcccagggaccgcgccttctcctccgcggtctggaagcggccgttcccaaacttggaggcggtgtcgatgaacttcagcttgatctcctccagcgcggagcgcttggtctgcgcgaagagcgtcttgcgcagcgtgatcacacgcttcttggtaccgggcaccgcgcccttgatcatgacgtagtcctcgttcaccacgccgtaatgcgggaagccgcccaggggggtgatgtccttctccgtcacgtcgtgctcggtggtggccaggtggctcgcctcgcccttcacgccgatgcggtacaccttcttgttcatctcggtgcggtggttgaagcccagggcacccgcgcgcgccacggtccagcccacacgggccgggtgccaggcgccgatgcaggccaccttgcgcagaccgcgatgggtcttgcgcggcaggcgggatacgccccagcgcgtcaccacgccctccgtgcccttgcccttggtgatggcgatggtgtcgatcatctccgactgggagaaaatggaggagacggggacctcgcgctcgaacaggcccaccgcaaagtccaccttggccgccacgtcaccgccgttgacctggatctccatgacgtgggccttcttctggcccacagacaccttgcggatctgggtgtgggcgatcacgcgaatgacagaggagtgcttcttcagctgcaaggtgtgttgagaaggggggggtttgtggagggggggtgagatgggagggcgagaaggaggggccagaattcacacttgcatgcccatgtccggcaaggcagagccgaaggcacaaccccagattgcactccgcgcaaagccggcggtgagagaggaaggcccagcttcacatggcgatgcgccatgccacaacctcgcgtgatccaggaatgggcctgggcgagccgnnnnnnnnnnccatagcgatgcgccatgccacaccctcacgtgatccaggaatgggcctgggcgagccgactgccagtccgtcgacccatcaacctccatccccgtccgccaacccatcaacctccatccctgtccgccaacccggcgccccccccgcctcgtacctgggccagctcagcctcgannnnnnnnnncgccactccgtcgatccgtcaacctccatccccgtccgccaacccaccgcaccccacgcctcgtacctgggccagctcagcctcgannnnnnnnnnagacaggtgctcggcccagacggcgcccagggagcgcagaccggtgggggtcttcacgtacccgaccacgnnnnnnnnnntctccttcttgccgtcggcgtacttgcgcacgtacttggtgaacgccttcttcttgctcttgtagaagttcttgtagaagcggcggcgcacctcctcggacaggtgctcagcccagacggcgcccagggagcgtaggccggtgggggtcttcacgtacccgaccacgccgacgaccaccatggggggggtctcgatgatggtcacggcctcggcagcctccttcttgtgcagcttggagccgggcttctccacgtcacggacgatgtgggtcatacccgccttgtaccccatgaaggcggtcaggtggggcttcttggtggcgtcatcccgggggaaggccttcaccttgccctttccgcgcttgcagcgcttcttgggcaggaagcccaagtggccgtggcggggagcctcgaactggggaggagagggggaacgagttcagacagccttgccaatggaaatgatttgccgcaattacatcaccgattcggcccgccacgggacccagtcgccccctcccgcagtggcccgaggccgcacacccagggggcccgcccggcccgagcccctttgaggcggcaccccgacaagtccattggaagctcaccttcctgtgcgacatggtgctcgtccgggtgaaaaggacagatgccggcactcctgcgcaccaagtgctgggcggccggcacgaggtcggtggattgtcgtgctttcgtcccgggcccctggctctccaacccatcgccttagtcgcgcccgggcccctgccagggatatcctgcccctcctttaaaaaaccctgaacccagaccccatcaaggcagaaaaccatcgccattctcccgagtcaagaagccctcgtgcttgaacaagactcgcttcgtcgcactctgggagacccttgtggcctaggaatctctttatcgtccagtccaggaacccttgcgcttactggttccctgagtgaggaacacgtacctccagtactcgactgggagagctagatggaggtcccagcaggtcaagacggcatccagcgcctgcttgcttccgagaaggaggcccaaagcgtggtcgcgaaggcccgcaaaggtacggcccgggcttgcgctctgttcacaaccggtttcatattcatgttgggtgctcgcgcatggacagccctcgacgtgtctccgatcgctccacgcccctcgtagcgcgcaccgatcgcctgannnnnnnnnntcgattttatattcatgttgggtgctcgcgcatggaaagccctcgacgtgtctccgatcgctccgcgcccctcgtagcgcgcaccgatcgcctgaagcaggctaaggacgaggctgacagggaggtacaggcatacaaggcacagcgtgaggaagacttcaagcgccggcagacagacgtgagatggtgttgggtggcagcagtgccactgcaatcctgccaggggtcggtcaatgagttgctctggggtgtcacatatacctcaaccagcctaaacctccctccacgcaggactcttcagcctccgaggagtctgcgcgcaagctcattgaggaggcggaggcgactgtccggtctgtgcagcagtctattcaggacaagaaggaggatgttctgaagctgctgctcaagcatgtgaccacagtgtgagtgtggacattcacaacacccaaaccctcaacagcttgatatagccctgtgattgatccaataacaagtaggcaaggggggttgggtgcaagcgttgcgagcgcacgcgcactggcagggaaggtgctccgggctgctttccaggctgccgcagcatccacagcggggtgcctatacgggcacagcgtctgacgactccttcttggggggcaggcccagcagctgcgccaccgagatgtcgcgctccgcagccacctgccgcagcgtgcgcatggcacgcaggccctcgatcgcggccttggcgttgttcaggggattgctgccgccaacctgcttgccgaaaccgttcctcacgcccgccagctccaggaccaccctcacggctccccccgcgatcacgccggttccctcggaggccggtcgcaggagcacctgcgtggcggacgagcagttgcgatcgagcagttcaaggttttgggtgtgcactgggcagaagttgtgtttcagcatgcacgtggagtgcagctgaacgaggtcagactgctcgtcaactctggctcatgtatatatagcagggagctctctcatggttgaccagaatgtctatctcatgaactgctcctccttagcaagtaggcagagcacaggctgacaactcccaaacaaggcctcgcaccttggcaccgctgaagtagctgtcaaatgcatggggcacggaaagggcgttccgggtgagcggcacggtgatgagacgccgcttggccttcagcacagccttctgcgctgcctgtgccacctccttggccgaggcggatgccacgcccactgtgccgttgttgttgcccaccaccacctgagggagcgagggtgatgggtggagcctccggcatggactccggcacagcatggcacaccagctctccctcccgccccactcaccacagcacggaagctcagctgcttgccgcccttcacaaccttggtgacacgccggacttgaatgacgcgctcctcgtactccgtgtccctcacgtagggtccagactctccgtcgtcgtcgttgttgtcgtcctggctctgcgcggggccccggcccgcgcgcatggtcacgatgggtctttgaaacgccacggagtggtgctgatcgtgagttcgcatcggcgagcacaccccgcgatggctagggtgccggggcagcgcactctggggacggaatgcatggccgggagccagtccacacaccgacatcgtggcttgaagaacgggcgccatgctgtcacaagctacagggatggcgacagacggggtgctggtgtgggaactgcctatgcctggaaggagtggtaggtgagcaggggataacgtgctctgcctgctgtgctgcgcagaatccgaccatcccccgaccatttgaagcctgactgaacacatcctcgacgtgttcctctgctccactcttgatcgacacagaaacactaccctgtatgatcaccagtgattctgagtcctgcatcctccagaatggggcggggtgggtccttcctgctgtccctcgtgtcggtggctctgctcggcgtccaggccgcggcactgaaacaggactgctacggtgcaacggtgcgtaataattcgtgtgtttcatggtatcaacgcttggtcgatgcagaggccgggagcatgtcccggtccggcccacgactctcgtgctacaacgccttccgccaccttccccggccccttccctccctggcccacaggtcaagatttctgccatccacgcccagcaccccgatgaacccgtgctggaggtgtacggctaccccagcgccatcgggcgggccatacccgcctcccccaccggctccatgcacctggagctggcagccccgccccacgcctgcgccgccgtgtccccgcccgcgctccccctctccgccgccctggtgtcccgcggcgagtgcgacttcgtccagaaggccctggccctggccgccgcggggtacagcgccatgatcctggtggactccgcccccggctgcgtgttcatgtcggccaacgacacggccgccgccggcgcgctggagatccaggccgccacgatcacggccgtcgccggacggcgagtgagggacgccctctgcgcttctcccgcgggcctcgacgtcggcctctgggcgcccgccccgtgcggccccgacctcgccggacccctcctctgggccctggcggtggggtgtgtggcgctgggctccgcgctggccgccgccgcgcagcgccgcgccctggacgccccgccgcccaaggacagcgacagcgaggcggagggcccgcgggcgcgggccgaccccggcttcgtcgtctcacgcgtcggcgccggtggcttcgtggtggtcgcctccactttgctcctcctcttctattacctggacgatgactggctggccagcctcctgacgttcgtgttcatggcggcatgctggtcgccgctggcagaggccctggcggctgcggtggagctcgcgctctggcgcgcgccgcgcctccgcgcctcgctgaacgatccggccccgctgcccctgctcggccccgtcgggctgctgcaggcggtgagtgtcgtggcaagtgtgaccacgatcgagatgtggcgggagcatcgtgacgcgggctgggccnnnnnnnnnncttcggccccgtcgggttgctgcaggcggtgagtgtcgtggcgactgtgaccacgatcgatatctggcgggagcatcgtgacgcgggctgggcctgggcggtgcaggacgccatgggcgccgcgctgctggtgtccctgctgcggaccgtccggctgccggacctggccaccgcatgcatcctgcttcccctggccttcctgtacgatgtgtggtgggtcttcctccagcccctggtcaccggcggcccctcggtcatggtggaggtggccgggggtggcgccggcgggccccgcttccccatggtgctcctggctccgaccccgggactgggggacaaccccgccatggccatcctgggcctggtgagtttcttgttgttgtttgttttttggggggggtccttttggcattcacatttcaagggtgatatgaccggcgtgctgggatggatcagtgcatcgttgaaattcccccccctcaattgacgccgccacgcccgctcaccctgccgtgnnnnnnnnnntggcgtgctagggtggtgaatcagtgcatcgttgaattcccccctcaatcgacgccgccacgcccgctcaccctgccgtgccccgccgcacccctcacaaccagggcgacgtggcgctgccgggcctcctggtcgtgctgacgtggcgctgggatgtgacgcagcgcttcctgggcgtccggccctcccactacggcccctgcgccctggccgggtacgcggtggggctgaccgccacgtacgccgcgctgcgagtcggcctatttggcgacgcggggcagcccgcgctgctgtacctggtgcccagcacgctgggcacgacgtgtgcgctggcggcggcgcgcagcgagctgggccggctctggaccgcggacgtcgacccggagagcctcaggagcggtggggggccggcaggggaggacgtggagcaggggcgggagaccctcctcgccacgtgacccaagccagtgtctctgcgctcgcatgcaccgggccattgccgtgcaccnnnnnnnnnntgcgggggaggacgtggagcaggggcgggaggccctcctcgccacgtgacccaagctctttctctgcactcgcatgcaccgggccattgccgtgcaccgcgtccgcagtatttgtagtagtagaagccccttcccatacagcaactctttcaatccctacttgcccacacactgagtcccttcgtcccccatgctctgctccgtatcttctgctctcgtcccctgccctcgtttcaggttgtacttactctcttgcctggcaggtcaggagtccaaggggttgctgaagggggtggatagctggtccagcacttacagactgcctccaccccccacctccctcccactcaccaaggcctactcctcagcctccaccagccaggcagctgtctccgcctgaatgctggacagcagcccgttcaggcaggagtcaaggggccggccgtccaccagccaggcctcccgccacttctcccagcgcatggccagcannnnnnnnnntgtcctggatcataacagatgacgagcatcttgctgtcaaacaggacccctgctccccccccaaaaaaccatcgtcaccatggctnnnnnnnnnntcccctgtacgggtggagatggggttcaacgacaagcgggaagagcacattggtttccatttctctggacatactgacgatgcagtcctggatcataacagataacgagcagtttgctgtcaaacagaacccctgctcccccccaaaaaaccatcgtcaccatggcttccagacgctcctccatcagcgcgatggccacggcggcgtctggcaccggcaggatctcggcacgatggcacagacgggcacaggcagccgccacacgtgccaggctcagcagcgccgtctgtggggatgggcgtgtcggggtcggggggtggggcacgcagacacgcacccagattccagccacgtccgtgccagggtcttcccacctggggcgcctgctcctcgccgagccgcaggcaggtaaagtatgccgtcagggcctccaagccttcgtgagtcatgcgcggctgccccaggccctgcgcaaccctcatgtgttgggcaaggtcatctggtgtcatggcggtacgctccgactcatctgcaagtggccatgtggtctgagaggcgtggaaaaggctgcgcggttgccgaagtcctcgaatgagacttgttgagcacccccgtggcggnnnnnnnnnncggcgtgctggggtcggggggtggggcatgcagacacgcacccagattccagccacgtctgtgccatggtgttcccacctggggcgcctgctcctcgccgannnnnnnnnngtctggtgtcatggcggcacgctccgactcatctgcacatggccatgtggtctgagaggcgtggaaagggctgcgcggttgccaaagtccttaaatgagacttgttgagcacccccgtggcggtcgcctgatgtccccccgcagccccagattgcccacacctctcccccatgccccgcacccggggcctggagcaggtcctccagccgcgccgccatggcaggcgcctgggggtcgggacaggccaccaggacgtcgaagacgaggggcgcgtcgcgcccatacttcctggccagcagctccagcggggagatgtggtcgtagcagctcctcccaaagtcttgagggcggggcagaatcgagtgcgctgagctaccagtggcattggaggaggtctccaagacaaaggatgacccacagcatatcgacgcgtatgacaggctggttgagcctggatcgggatcccagggcagtgaaccatccatcccagggccctccctcaccggtcgccgcgaggtggagccagagggtggctgtggcatgcaggtcaaggtcgggtgcatccgccacgacacgcagcctgtcccctgcacccaggcaggccatcaggctcgtgccagccctcaccgagcaggcccccgcgtccaggagcagcaccccgggccccgccgcagcgaggctgccgccttcagcaccctgccgacccagcgcgaggggcaggagctggcgcgcgctcgtcgacgcgtcgatgccgaccggggtgaggcgcctggcgagcgtgcgcagggagccatgcacccgcgggtcccaaccgggagtggccagagcgaggtggacctgctggatgggttggagggtagggaagaaaggacgtgccgggtgggaaagcagtctcctcagcgctgcagcctcggtgggcgggccccgcatgctggtggtaggtcaaccatcgcagccagcgccctcgtgcttgctgtcgaatggcggtctggcaagtgcctgcaccaaaactgcggcacccagcnnnnnnnnnngtgtgggtcaaccatcgcagccagcgccctcttgcttgctgtcgaatggcggtctggcgagtgcctgcaccaaaactgcggcacccagcaggtgaccatgcgccgccctgtcacccacctggcgacggggcagtgcctgcccgaccccgcgatgctcggcccccgctgcagccgcgctgacgaggatagccagcagggctgggcggtggcatgccccccgtcccacccacgcctctgtgctctccagcagggtgtccaggccgacaagcccctcgggtgtcggtgggatgcagggtggggggtgggcgggtggcgccccaggcttcgtacgctccacaccgacggcgcagacgctcagcgcccaggaggtcagccccggagcgcctttctggcagtccaggctggacagggcccctcgctgcaccgggccagccacgcgcacgctgtcacccaggctcacgtcccgtgtgaggtcatccaggagcaccaccctgacgggcggctgggccaaggcggcctcgtccccgggggcagggtggacccaggcggtgcgcgcctggcatgtgtgagggggaaacaggggtactgggaagggcgcccctcgaacactggtcaggtggatcgcacgtgctcaatcccatctcctgccctgcccaggtccagcnnnnnnnnnnggggaagggcgcccctcaaacactcgtcaggtggatcgcacgtgctcgatcccatctcctgccctgcccaggtccagcgcaccgggatcgtgacgcgcaggctggcgtcctccagcagcaggtggcccgggcagcactctggagcctgctccttgaaacccagaaccgtctcccgcttgcagcagggacacagcatcgttcgcgcatacctggcatgacgaggttgtgatctggggtgacaagtttgaaagaggttcactagccgcataaaatcatgaagggagggaactgcagaggctcagccatccctgctatcactcacgtcagatctgtcagggtctggagggccatcaccgtgccatcaaacacgacgaggctgcctggtctggacttgagcagcttggtgtggacaaggtcgggaggaatgctggagggagaacggtctcccaaccccaagcgtagccagactgggtgcgtgattggcacctgcttgtgacgtacataccagtcgacagcctcctgccgcacagactctgaaggagaagaatggaggggactttggcagtgcactgttttcaccttgcctggcaagcggatgattgccgccggagagattgtgccacatcgattgcctatcaccaagcgactacattcatgaccctcagcatacccctatctatctctcacccatgttgttgagcagagcagctgccaaggcacagccttccttctctttcagatcgtctatctatagcatggagtgaatgcgacacaggagtgacaaacctgtccctgattggggcatggaccaacttcatacccacgacacaagagactctccaggcatatcgacaacctgaacgacaatagagcgcgagggatccgcttgatactcctcgaatgctcgcgtaagggcggactccatgcctctgagtcctgacagcatggccacacaaagtcgtcaacaatctacacgagatcacatccagtccaatcgtactcgctcatctaatggctgaagtgtattctcatgaccatttcgcatgtatttcacgtcgtcctcgtacttgtgtcggtgctgcaggacgatgccggagctggccatgcccggggacaaagcttgggcgcaccaaagttaacaacggcatgagcagccccatgttgcatccatcagtggcaatctagaagctgtgagaccggagtcttttaattctactcattacatggcggtgtgcacactccagcatgcccagggtgtgattgtaaggtcggtttgtctgtctggcttggaaagtcatgcgcattgtctggtgagccaaggcagtctccctgacatcaaaactccatgtcctccacggcaggcacaggcgtcacgcgccaggcatcgaagagcgtctgctggccgcccgacttggaagtctggttctgtgtgggcgcggtgtgaggcgtcgccgccattggcggcttgtatgccttggcacggatggccgccactgcggcttttcggcgcgcgacgtgtggtgcatctactcgccctgcaaacagacgttgacgcacaggctctggggatgggaccgagctgccctccgtggactcttgactgagctgcagcatctcgccatcagtgggggagtggacgaggggccgggcggccgaccctgcaaagggctggaggggggtgggcggggccaggggcgggcgtgccatgcccgctgcgctcccaaacaggccgtagctggggcgggatggggtgtaggccacttggttgtatacgtcgcttggcaggggggaggggggggagtccggcagggtcaccctggtggtgcagaggtggtgggtggcattgtagctgggggtgtcagggatcgtacacacacacacctcgcaggcacaccaactcagcagtacaaggaagctgtggtgacagcatgcactgcgctccattgcccagcttgccagatgaattcggggtctgggtgaacttcgtatatcctctgtttttggtcggcactagcacagacggcgccgtccaacttccgatcgatctttttgccgctgcacagctcgatctgcaaggtgtgagcagcatggtgcgttctgttgacattaccagtcaagtatgaggtatggtgcaagaaggaggatctgcagtctgctggcactcacttgtgctgggacagcatgcctaacaggacagaaataggtgacggaacgtgatgcagcagtgttagtcagcttttgaggagctcaccctgtatctatgggctgggcatacgatgcaggcgtggctgccgctgtcttctatgtccccgccggccagagatgtgccctacagggagggacaatgggctgtttataggaggcaactgatgtggtacgtgcggaggatcggtcgccactccatgcctcgagcacacaccatgtggaagcagtgagcatctgtgcagtagaccgtgccgtggactcggaccaggaggagcttccggccgtgagcctcctgaagaaattggggcacggggttgtgcgttgagcttccagagcccagtcccccgcacagggacacgcctttgaattgaggctccgataccatgctggctgtgaacgctttcgagtaacgacaaggcagcgagtgtagcctccaggagactcaccttgacgaccttctgcccctccccaacctccgcctgccgagctacgcgaaggagggtcatggctacgttcaccgaatcacgccatgtgaagacagagctcgtcgcccgccacgagttattgcgtgaagggaaagggaggagagggcctacaccaggagacgagacactgagcgtgcacaggcttcgcattggatttcgtgtggtgccagggaggaaagcgcgagtggcactcttctgctaggatgtcccttgtccgtacgtccaacacgatcaaacttccaccacattcagtccagatgaatggtgtgactgtacaaaattctactannnnnnnnnnggacagtgagcgtgcacaggcttcgcatcggatttcgtgtggtgcccgggaggaaagcgcgagtggcactcttctgctgggatattctcttgtccgtacgcccaacacgatcaaacttcaaccaaattcagtccaggtgaatggtgtgactgtacaaaattctactacaacgcacgcagggggtgtctgcgggtgccgagctgatgctcggtcgcaaacacattcttcaatggggggacagtcgcttagattcttcaggtggcaagcacagttgtggatgacaccaagccatgggaacacgtatgcatgcttctaccatgtcttgcaagagaaacaacgatcttcatggtatccacggctgaagccagaatgaggtggtaaaggagcgggagcggtggtaaggcagctgtggttccaggtgtccagccacatgctcacctccctgaagcctcgggctgctgccgcagatcnnnnnnnnnngggtatccacggctgcagccagaatgaggtggtaaaggagcgggagtggtggtaaggcagctgtagttccaggtgtccagccacatgctcaaccccctgaagcctcgggctgctgccgcagatcacagggcagcccgccctccaggacccaggcttcaggccttgggggactcgacggcgcggtgatccaccttgccctcagccagggcgcggtcccagtgccagacggcgtggcccttgccgatgcgccgcagctgcgcaacatagtcggacacctgcttgatgtccttcacctgctcgtgcagcatgtcctcaatgaactgggtggtctgcgcatcagagttcttgtccgccacctcccacagccccagcagcttggagtagttgagcttctccagggccagcgccagctcaaaggcgtacagcgcgtcacccttctccgggtggtcatagttagcctcgggcgggaccagggcgttgaacttcacgcgaccgccccgcgtgttctgcaggtcaatcaggtactgggcgtgggacttctcctcctctgactcgttgcggaagtactcggcgatgccgtgcagggacacgttgtcgcggtcaaagtaggtgctgatggcgtggtacacgtagcctggggtggaggagtgggggtgatggggtaggggatgatggtgacagttgctgtcgcaatgggtgttgcgtacaggcaggcattggccagtctttgctgtgcccagatccagtcgtacaatcacacacacacaaaccctagctcactgatgttgtactccacgttgatctgctcgttgaccgcggcctccacggtctcggtccaggtggagtagcgagcaaagctgtgctcggggcgggggtcattaagggctccagacttgctggtgtccttcagcacaggggcgacctgtggaagacaaggatcgaagtcgtgctttagaggtgaggaaggccaaggtcctcacgactccaccgggttacactacagacaaaaccctgtgacaaccacacacctcctcaaagggctggaacacgacgccggtgatggcctcggtcttgtccttgccgcccgcggcgcggatgacggcccgacggggcgcacgggtgtgcgaggtggttggccgggccaacatgaccctcggcgtggcaatggtgctcatcatcgcgttctgtggacaggacgcagaaaggaagctgagagcaaatgagaccggggagttccggcaacttgggacggaggtcacagaagggtttgttaggaagaaagccttgcgatgtgtttgtgcagaatcattgaatgccacaggcaatgctccgcggttcagagctgaccatacgttgctgcagaccagagtcccctgccctgcccgccagacccgtggctgagacaatgtccgccccagcccaaacactcaccatgttacgtaagtttggaagagggattgtatgtcaattgagtcgtgccggggggggcgggtagcttgtatgctaaccctctgatttcctcggatgtagtccacggaggtgtggtgtgcgtgaagtgagtgtnnnnnnnnnnatcaattgagtcgtgccggggggggcaggtagcttgtatgctaaacctctgatttcctcggatgtagtctacggaggtgtggtgtgcgtgaagtgagtgtcagctgccggacagatgcccatcacatgccacaccaagcctgcgcaccttcaccgagcataattggctcagtggaatggcatccgacaactagtcggtgaagtttacacaagacgaatgtaacagtttagaatagtgcagaaagtgatgcacagcatgggagggcgctgtcacttggacagcatcgccattgcatcaaagcaggtgagttgggaggggggggggtcgcaagagcagggacacccactgcccggaaattccttcaccaccagccccactccaggctggtttccagggagtaaaaagtaaaccagctgatggtggccggcaggaggaccccctgcagcaggcacagcgcagcggtaagcccgcccaggccgctgcccggcggcgcgacctccaggtccctctccagcgccgcgcgtgcgcgctccctgaccctccccgcctgcagccggcccagcgcctgcatgccggcatgcacgccgacccaggtcccccagaccagggtccaggccgcggtgcccccgcccagccgccccacggcgtcgcgccctgccgcgccgcagcccaggcccaggcccagcacgaggcgggtgaggggcgcacggcccgcgtccagtaggcccagacggtgcatgacccagggcagcgcgcacagcgtggccagccccgcgcagacgttggcggcctgggccagcaggcacgcggcgcgccgcgcggtcagcagcagcgcccacggcgcccagccgcgccagcgcag

SEQ ID NO: 41548 - DNA, 20303 bp, Chlorella protothecoides
  modified_base (667)..(676): a, c, t, g, unknown or other
  modified_base (1247)..(1256): a, c, t, g, unknown or other
  modified_base (1731)..(1740): a, c, t, g, unknown or other
  modified_base (2276)..(2295): a, c, t, g, unknown or other
  modified_base (2550)..(2559): a, c, t, g, unknown or other
  modified_base (2637)..(2646): a, c, t, g, unknown or other
  modified_base (4198)..(4207): a, c, t, g, unknown or other
  modified_base (4476)..(4485): a, c, t, g, unknown or other
  modified_base (4635)..(4644): a, c, t, g, unknown or other
  modified_base (4696)..(4705): a, c, t, g, unknown or other
  modified_base (4968)..(4977): a, c, t, g, unknown or other
  modified_base (5769)..(5778): a, c, t, g, unknown or other
  modified_base (6782)..(6791): a, c, t, g, unknown or other
  modified_base (7495)..(7667): a, c, t, g, unknown or other
  modified_base (7802)..(7811): a, c, t, g, unknown or other
  modified_base (8459)..(8468): a, c, t, g, unknown or other
  modified_base (8890)..(8899): a, c, t, g, unknown or other
  modified_base (8969)..(8978): a, c, t, g, unknown or other
  modified_base (9034)..(9043): a, c, t, g, unknown or other
  modified_base (9902)..(9911): a, c, t, g, unknown or other
  modified_base (11102)..(11111): a, c, t, g, unknown or other
  modified_base (11788)..(11797): a, c, t, g, unknown or other
  modified_base (11860)..(11869): a, c, t, g, unknown or other
  modified_base (11932)..(12000): a, c, t, g, unknown or other
  modified_base (12174)..(12183): a, c, t, g, unknown or other
  modified_base (12365)..(12374): a, c, t, g, unknown or other
  modified_base (12765)..(12774): a, c, t, g, unknown or other
  modified_base (13217)..(13239): a, c, t, g, unknown or other
  modified_base (13311)..(13320): a, c, t, g, unknown or other
  modified_base (13615)..(13624): a, c, t, g, unknown or other
  modified_base (13892)..(13901): a, c, t, g, unknown or other
  modified_base (13974)..(13983): a, c, t, g, unknown or other
  modified_base (14297)..(14306): a, c, t, g, unknown or other
  modified_base (15430)..(15439): a, c, t, g, unknown or other
  modified_base (15822)..(15831): a, c, t, g, unknown or other
  modified_base (16348)..(16493): a, c, t, g, unknown or other
  modified_base (17509)..(17518): a, c, t, g, unknown or other
  modified_base (18701)..(18710): a, c, t, g, unknown or other
  modified_base (19949)..(19958): a, c, t, g, unknown or other
gatcttgttttgtgactcgtcaagcatgtggagccagatctcgcggacaaggcacattgacctaaaagctaaaatgtcaacggtgagagggtctgtttgcaatatgagctccacaaagttaagccctgctgtagtaggcccatcagcactgcaagtatcgacgagatgttcttgtggacagactcggattacatatttcgattgtgtggcttgcattctgcaatgagcaatggcacggccagtcttcattccaatctggccttcccactcaagaaactgcgccactgtataaaatatatatcagaagggcagcttaaacagacagggagccctgttgacagtgtacagggcccccacaagagtgcactgtgcactgcagtacgctctccagtgttgcacaaaaacaaagatctggtggatacgctctcccgggagtgatacttggggaaagaggtcaacctgccttacacaacatttcttatgtttacaagcagacgttctccctcaaccctgaaaggtggtattgacgttgcaatgaatggtcttgccactatcatactatgaatttgttgagcatactgatgacataaatcaatccatcccgctgccatgatccagttacatcaacaccgcaacaagtcaggcaatgggttcggcctcgatgtcnnnnnnnnnnactctccggggagtgatactgggggaagaggtcaacctgccttgcacaacatttcttatttttacaagcaaacgttctccctcaaccctggaaggtggtattgatgttgcactgaatggtcttgtcactatcatactgtgaatttgttgagcatactgataacttagatgaatccatcccgctgccatggtccagttacatcaacaccacaataagtcaggcaatgggttcggcctcgatgtccatgatgcaggaggacacccccctgcaccgccgcatctggccgacctcggcaggggccacgccggggtcaaggggggtgaggaggtacacctggccatctacctcgggggcgtcccactgtgtcctgcccagcagctccccgccctccccgatcccgtccaccagcacatcaatctattggttgagagtggggaattaactgtgaggttctgttgcgtgcaaactggtacttacggacacagatgagaccataaactagatgctgatccatattctgcttcactcggtaggtccaaggcacctctatcacagcatgtggtcttagccnnnnnnnnnnaagagtggggaattagctgtgaggttctattgcgtgcaaactgttattcacggacaaagatgagaccataaattagatcctgtatccatgtcctgcttcactcggtaggtccaaagcacctctatcacagcatgtggtcttagcccatgtcccttcccaacggaggcatctgtcgctgcgcacctccttgcccacaaggctctcggcaaacgcaatgctgttcctctgctggatggacatgagctcatcccgccgctcctctctgacttcctgggggatctgcatgacaagggggggtgcaagagagtggaggagtgaggccgatctaaacggagcaacagatctgacgtcgacacatggagcgccaggagagggtctcaaagagggcaatgacagtgtcaatccctggccgtgacgtgcatgcccctcctcctgacagatcaaggtagactccactcacacgcacactttgggnnnnnnnnnngagggtaatgacagtttcaatccctgtccatggcgtgtatgcccctgctcctgacagatcagggtagactccactcacacgcacactttgggctcccggcagccctctctcatctccccacctgctcaggaaagccagcggcgggggggccatcctcctcgctgtaggcaaaggcgccgcccctctggaacccaaatgagtcggaaaactctgccagctcctcgtgcgcccccttgctctccccggggaacccggaaatgaaggtggtgcgaagcgcgagatccgggatgcaatcccgcagcgtgcccagcaggcgcagcgtgtggtccgccggcggccggttcatggacagcagcaccaggttgttgatgtgctgcagcgggatgtcgatgtacttgcaaacctggtaggtggcagtgggggtggggaacgtgatgttgagagggaaggcgggggattgtagggaggcatcatgcagagagttgcgcgatggggggaatcccgttgcgcccactcagcctaggcctgatgcggtnnnnnnnnnnnnnnnnnnnngcccccgacaccctgtcaacagcactacattcttaagcttccgcccaacaagtcaccttggggttggtggcgatctcctggatgaggtcctcggtgaagtaggaggggtaggcgtacaggatgcggatccacctgagccccgggatctcggccaggtttgccagcaggccggccaacccggtcccgccgcggcgatcctggccatactgattggtgtcctctgggcgggcaggggagggaaaggggggggggggnnnnnnnnnnacccccaacaccctgtcaaacaggactacattctcaagcttccgcctaacaagtcaccttggggttggtggcgatctnnnnnnnnnntgctgagttgcagcgcactggaggcctttcttgggagggcatcccttgggtcacgcaagcacgccgccctacagtacgagcaactgcaaaagcagcccttcccacatgaacacacatcaggccctcatccagccgcgttagaaccgacacagtcccccctcgcatcgcacctgcaatgaggttgagctccagggcgccccccgcgaccagcgcccgggcctcctccaggatcaggcccggcggcttgctcctgaagcgcccccggaaacctgggatggcgcagaaagtgcacgcgtgattgcacccctccgccacccgcaggtaggcggtgtggcggggcgtcaggcggtggcgctgcgtctcctcgggaaagggcgaaaatgtggggctgccaacctggggttcgagcagggttaggttgggaggtttgaggggggtgttcaggtttgagccaacgataggcgaggcatttgccccgtgggctgcaatgacacagcccctcgggaagtcagtaccaaatgaaaatgccgggccatgccctgcaaaggttgcccctccctctccccccccccaaacacacacctgcaccgcggtctgcgtggcgcccgccgcttcgcccaggacgtcgtgcaggttctgcgccaggtcggcatatcgctcaaaccccaccaccaagtccacctcgggcagctgggctgcatgggttagaatgcgggaagggagggggatgttgaatcaaggtgaggcacggccgagggtggctggctggcagcaggccacttgggacagtagcaagcgcacgcgtgcctcccttcgagcctccaacccttaccaccagtctgtacctgccaggtcatcggcgtaccgctgggccaggcagccagtcacgacgactcgctggacagcgccgccctccgccttgagctgggtggcctccatgatggcctggacaggggaatccaggggccaacagtgggtggtgcagcacaccgggaggcacctgcccgatcttaatggggacaaggggtgcccagcacaaccggcacgggaaatcaacggtgcaaaggaggcactcccggcctgccaacccacgccaacatctcacatccagggactctgccttggcgtcctcgacaaaggcacaggtgttgatgacgatggcgtcggccgactcgtggtcgtccacgacggagaagcccgagcgctccaggttgcccagcatcacctcactgtccaccgtgttcttcgggcagcccagagacacctgcgggcgggcgtcgggtcgagtgcagggagtgatggatagagcaggtatggtgctccccagcccatggtgcaatgcggtatcgtaagtgcacgtctgcaccatgaaaacagctccaatcggtcctcaccagggacactcggggcttggaggtttccagcggggggctggtcgcggcccttgtcctctgatgcagggctgcaaaacgaggaggccgaggccccacacgaaagcagtccccatttcggaggtgggtgccagagggcgacggcgacagccacagccctnnnnnnnnnnggagtgcagggggtgagggacagagtaggtatggtgctccacagcccatcgtgcaatgcgggattgtaagtgcacgtctgcaccatgaaaactgctccaatcggtcctcaccagggacactcggggcttggaggtttccagcggggggctggtcgcggcccttgtcctctggtgcagggctgcaacacgaggaggtcgaggccccgcacgaaagcagtccccattgcggagtggggtaccagagggcgacggcgacagccacagccctnnnnnnnnnntcaacaaatgaattagaatccaccgttcaatatatgtggcacgatgtccatgccatggacttgccccatgtaacggtgctggacgtgttccagcccatgcagcgtcagagtagattgactgccccgccaaaatactcgcgccctgaagcnnnnnnnnnnattgtccaaaagcgaatcttatttgcgaggggacaacaggcgtctttgatannnnnnnnnngttccggggtactaggccatgatggacggcacgaccatgcaaccttctatgaatccaacaaatgaatttgaatccaccgttctatatatgtggcgcgatgtccatgccatggacttgccccatataacggtgctggacgtgttcctgcccatgcagcgtccgagtagattgagtgccccgccaaaatactcgcgccctgaagcgaaggtgagtcttcagctggcctagtcgacatttggccctcatccgacagcgaactgctnnnnnnnnnnagtctcccacctctccattccagccaggcgccttgccttgccaggtcgccggatgcagtctgctcatcggcgcggcaagaagcggaaaccagaggccgacctggaggcagaacggtccctgtacgcttctttcgctaccgcggcaaactctgtgtcccagctctattccttggccctcggacagcaggcccgttaccgcgacgagggcgctcgccaaagcctggtaggctgtgtcgcgctcgaactagtcatattggtgctgccctactcatgttccacgtgccgtatgtcctgcccgtgactggctgtttgtgacacacacgtcccgctcaccccatggccttcccctctggtaccctcgcattcggcaggaacgtgtgtatgaatggctctgcaaagagcacggcaacagctccaccctacccactgcggctctcatggactttctgaggcaggaggccttgctgctcgggacccctggcgagtgcagcgccacgcccgttcccgtcctgcccctggcgccccccgccgtcttctcctcagcagccgcagcagccaaagaggacgagggcgtggaagggggagacaagggcccggcagctgtggtgcggcgactgcagcagcagcagctgcatcaacagcagcagcagcacgaagagcagcaacagtctgggtggtatggggcgtgaccgccagccccccgatgagtgtatattaatatccgtcaagcgaagtcagtggtccttgtctcaccaattccttgttaaaatcaatgaatgtcattcgtgtccnnnnnnnnnncaggagcagcaacaatctgggtggtaatgggcgtgaccgccagcaccccgatgagtgtatactaatatccgtcaagtgacgccagtggtccttgcctcaccaattccctgttaaaatcaatgaatgtcattcgtgtcccagactgtcttgttcttccttgtaactcttctgtcaagatggtgtggtgcagctcggacatgccccagggtagaggtgaggatcatacacacacgcagcgcacgtggcgatgcacaggacacacctacgcttgcgggatacactgcgtcggtttcgatggtcttgtcagatcgatttgaaggtaatacgtcgaaactggagactcgcgaactcttccttggacagaagttggttacagtggcccggactcacttgcgtagatatcgagaccggtgcttgcccgggcatcctcagtactgaggggcctataactcttgccgatcccctacataatctctatcgcgcgtgcacgatgccctcgcggcgtgcgggctcgtccaggaattcgggtgaccctcctgcccaacccaacgagagcctggagctgatgtacgaaaccccggaggaaacaggctcccggttgagcagcgggacccgctcatcctcttgggacagcaggagctccagcagcgtaaccagtgacggtgggacctgcagccccaccccggcctcccccttccccacgcgctcctcctccgggactcctcagcgcgacagcccaggccccccccccaggacccgcacgcagcgttggagggtcctggacgtgaggcgccggtccacgaagcgcccctgtcacccaggcgccgagttcaacgcccccgacctgctcagctacaacccggcctcctcgctagccaggtactcgtggagggtgggctggaactgagcaggggtgagctcacgcacctgggaaaaaggggcagagcgtgctccaggaggacatggctgggatgcagaggtctgaccacggcgctttgtatctnnnnnnnnnnaaaaaaggggcagagcgtgctccaggaggaattggctggggcgcagaggtctgaccacggcgctttgtatctgatgcgagcccggcgcaccgaccctcgaggcaggcggacccttgggcgcaccctcgaccatgtcagccaccccacccccgcagggctgcctgcgaggtgaggtggagggcgacagggtacctcacgcgcccgaacatcctccagggctcgaatgccggggacctggaggcccagaggcagcgtgtctcaagcaggttcgagggttggcctggatcccggctcatcccgtcaggggcccaggcccgcgcggcgccctgccccttctcctgccccggccggatgtttgccaccagcgccggcgcgatccgcaagtgcctggaggcctgtgtctttgcctccaacaggtttgtgccagacccgggggatgttggggtttgagctggatgggacgcaggacatcacatcctgctgcttgatggggtcgcggctgtgccgagaggggcagaccttggcatgaaggtattcgtgaccaccccctcccactccacatgctttgatgcctgcatgcacagcgccgccgcctcgcctggggtgtgcctgagatgctccatgcggcatccacccttgcaagctatcggtttccggtgcaaaggagtcatcaccctccactcccccctcccccgccctccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggggggttgttcgtcgaggaggtcagcacctggcactgcgcccagagatgggcgcagggcccggtcaaggcatgggttacgacgcagacgctctgtttgtttgcttgcacaggcactgggcaaggttgcccnnnnnnnnnngtcgagctggatgggacgcaggacaccacaccctgctgcttgatggggtcccggctgtgccgagaggggcagactttggcatggagggattcgtgaccaccccctcccggtccacatgttctgatgcctgcatgcacagcgccgccgcctcgccgggggtgtgcctgagaggctccatgcggcatccaccctcgcaagccatcggtttccggtgcaagggagtcatccccctccactcccccctcccccgccctccagacccctcgacacccagggcgtgcagcccggatgggtgggcctgctgcatgacaaggggcgccgcgtcatctatggcctgtaccaggtggagagcatggggacaaatctggaccccagctttgggccgaccctggtctgccaggtacggcctgggggcggggtgtttgtcgaggaggtcagcacctggcccctgcgcccagagatgggcgcagggcccgggcaaggcatggggtacgacgcagacgctctgtttgtgtgcttgcacaggcactgggcaaggttgcccccgccatgctccccgacgcacgaccatagccttgctgaaggggtgcgctgtgtgacacccactcacacacccaactgcacaggctcgtgtgcggccagtcaggnnnnnnnnnncagccttgctgaaggggtgcgctgagtgacacccactcacacaccggactgcacaggctcgtgtgcggccagtcaggatgttccggccgctgcccgaggacgtcttcctgctggtgcatggatggaagcgggaccatgggacggggctggccctggagtacttccggagagacctgtcccccgcccagaccgaggcgctgtggaggctgtgggagttctgggatcgacactgagcccccaccggcggagcttcgcgcccgatgctcaccaccttgggtctgggtctgcccgctgcctcaacaccagcatctcggcacaggacctacagcatggagcagctgtcctggtgcctgtcagacctgcagggctggcagatcaccacgagcattgcagcctggagaggatacagctcaagatcatcnnnnnnnnnnctcagacctgcaggactggaagatcaccacgagcattgtagcctggagaggatacagctcaagatcatcnnnnnnnnnncgtctcctttcacaacccaaccaagatgctctgctgcttggaatgcgcagcgcgcnnnnnnnnnngaattgcagccgatctgccgtcgcctgcaagctctcccagagttgccctcagcgggtggtgtctactgtcacaacccaaccaaaatgctctgctgcttggaatgcgcagcgcgctcccaagctttacttccactgctcactgcgcatatattgcctccttggatgtatttgaaagctcatgtagcgtcgaggctcgcctgagaaccccgtattcgaggctcaggatcttgaggtcgccgtgcttccggaaaccagtcgggtccgagcggagatccgatgtcctcctccgcccgcgagcttctgatcccagctacctcctggtcgacgcagccacgcgaatgctcaaatctatgtaaaacgtccgccccaagttccgcaagtctgggccacatggtgttcgcacagctgggcctcctacccaccgcctggccccgccgcaccacaacaaccatgctgcacgggcgatggcgcaaggattacaaggtacgcatgcataccttgctgcatgattgtctcatgtccgatcgcacgagtggcctgaaagcactcagctggtcacccctgctgcgccctgcaggccagtgacatgtcgtccctgcaccgggccatgaaggccatgcacttgagccgcttcgactctgcagcagccattcgagtcctcaagggactggagatctgctcctgggaggatggtgtgcatgttggctacctcaccacggtgcgaggggccgtgcctgggcagtgtgtggtggctggccgaaatcggcaaccagggctggcgatgccccaactcgcgccatacacatcagcatcgtgcctccaccccctcttacaccctcaaaggtgccattttacaagnnnnnnnnnnccggcaaccagggctggcgatgccccaaatcgcgccatacacatcagcatcgcgccctcccccccccttacaccctcaaaggtgccattttacaagcctgtggagcgtttccgcccccatgaggagaccaccaatgctcggagggatcggaggagtggaccggcacggtgtaagctggtcaggacaggggcagacggcatggaggtggagctcatctgggatggggagtatccaggtaagaatgaggagttacacaggctggaccagtcaggaactgcaaacaggccgtggcattgccttcttccaggacgggcggcatgcacagtgatgtatcccacaggttcgcagttgctaatcttcctgctgcttacatcgtaatctcaagcgttttacccccgacccctgcaggcatcatccgagaggagtttaccatcaggccggatggccggttggaggtcaagggccggctgtctgtggaaggccgcgacttgatagtcacccaggtgtatgagcggtatccctgatcacaaagactggagtggcgccagtcgccagggttatgatagaagaagacctcgatctcaagctccctctttccatcacgggtttccaatggagtgttcgacctttatacctcttgctgcatggtacttctatgggttgcaccccctcataccatggtcgccacgcttgaagagttggacaggccacctttccaagcacttgcatgtacagagggtggccgccagtggccgccctggcttgggttaaaccgtggccccagactcaacgctgcccggtaccttccttctagatgtttgcacccaagctcccggtcctgctctccacgcttgcattgtcaatttttatgcatccattctttcatatgcctgttccactataaaggactgcacacccgagacgccaaggtgagagccttttgggttctccattcttcagcggcaatctgtaaggcaggttgcctgtgttagtaaattacaaagagccatggaagggtcaggaactgtccacctgcggccctgctgccctaattcgttccagctcatcctgagcagatgcaagggggtggttgagtcaggaccctcacactgctgacagggcaatcgtcaaccaatttcacagataatggcagggagatcgagtccggacatgaatgcagggctgtatcgnnnnnnnnnnttcgtcaactgacttcacagataatggcagggagattgagtccggacatgaatgcagggctgtatcgtggccttgaagaccgcaccccacctgcaagaagtgtcctcccccgtcgcccagcttctcccaattctgcaagaaggggattttgggtgcaggggattgacaggcctggatcatcctgtcacgcagccactcccgtttgctctgccacagtgaagcagggtatcacaacaagcgcagccattattcccatggagcgcctcgcgtacgagcacgtccgcctccggcatcacatcttctcccaaaacttgctccctttacaaccaactctctacctgtgcaaagagcccggccagccggcgtataccatcatcgtaggcctcgccgttgggccagcaaccccgtgggtccatcaggggcgctggcacccccggcacacagcgcggcatctctagtcccaggaccgggagcttgacgaggtcggcgccccgcagcgcatccgacaggattgcgtgcaccactgcttggatgtgccgcgggtcgtgcctggcgcctgcccctgcgccgcccccggtccaccccgtgttcaccagccaggcctgcatgccgtgccggcgaagcgcaggggccagcatggcagcgtacttgccagggtgccacacctgggtcgggcnnnnnnnnnncgcgcgttgcttgtcgtctggaacaaccctgcatggaccccatcagctcgtcggcaactcccnnnnnnnnnntgcgcgttgcttgtcgtctggaattaccctgtatggaccccatcagctcgtcggcaactcccnnnnnnnnnnnnnnnnnnnnnnnnnnnnnnnnnnnnnnnnnnnnnnnnnnnnnnnnnnnnnnnnnnnnnatcgccctcctcctccgtggacttggctgagtacccgctgaaaatgtcgcgggtacgggggggaagacgtcgaagaagagggccctgtagggctgggcagatgccggccggccagctacagcgcagcaagaactcccaatgcagatcactgacccaagcaaaggcaagcagcgnnnnnnnnnngcaagacgtgcttgcatgggagcctttctcaccaggaagtcagagcagtagcagggtgagaaggcgggctccggcgggacagcgtcgccctcctcctccgtgaacttggctgagtacccgctgaaaatgtcgaagggtaggggggggaaggcgtcgaagaagagggccctgtagggctgggnnnnnnnnnnaaggccggccggccagctgcagcgcagcaagaactcccaatgctgatcactgacccaagcaaaggcaagcagcgccgctccctctccactgctgccagcctggcgcctgcccacctcaggaagtagtagacggcctggtctgcggtcaggcgggcgacggggggcagcacgcccagggtgtcgcagcacagcatgatgaggttggccgggtgccgggcggcgcagggcatgcggttacggggtacgagggtcgtggggtaggtggcccggacgcgaggtgtggtgctcggagaagcaaggcccggcacccggccgccactctccaccgctgcgcccaccagcagcacgccaaacccgtcgcccggcccgtccccggccccagaccaggcgnnnnnnnnnncctccgccgctgcgccctccagcagcacgccaaacccgtcccccggcccgtccccggccccagaccaggcgccagccacggtgtggcagccgccctccagggcgcagacgccgtcttcgccccaggccaccaggccgtcggcgagcaggcggcgctcgcccctccccgccagcgccgcccttccctccgagcccaggaggagcgctgcgtccccggcaccgccctcgtcgcaggcggcgtggaagcagggcgcgccggcggcgggcagagcgtggctcagcgccgcctgcagcccccgccgcatgtcgccggggcacagcgtgcccagcacgaccagctcgcgccgggtcaggtccagcgcgatggaggcggcggaggcgttgtggctggcgcggcggttggcggggaaggcgccggcgttgtagagcgtgaggtcggggcgnnnnnnnnnnnnnnnnnnnnnnntggatattctgagggtgattcagggggatgtggcgtcttgggaggggggccctgcatctctggcgcggggannnnnnnnnnacgacgagcatgctgcgcgcggagagcgcgtggtgggggcgcgcgcagaccacgcgcaccttgagtcggacctgggtgagggagtgtcgtgcgggggaggggcggatattctgagggtagctcagggggatgtggcgtctggagaggggggccctgcatctctggcgcggggagcggtgagcgcggcacgtgtttcggggcaggcagtcgcatggccggggtggcatcgcgcccacgaggctcgccccgccactccccccccctcgctcccacacacctcgctccagccggcaannnnnnnnnnttgtttcggggcaggcggtcgcatggccagggtggcatcgtgtccacgaggctcgccccgccactccccccccgctcccacacacctcgctccagccggcaaagccgtcgacgatgtacagccgcggctgggtgttgaggtagtccacagcccgctcgcggtttatgagaaactccctggcgcagttcaatgggggttgggcggtggggccgtgctggcctgcagtaggtggctcccatcccccccccccccccaaaaaccccggggnnnnnnnnnncatggggtttgggcggtggggccgtgctggcctgcagcaggtggctcccattcccccccccccccccccggcnnnnnnnnnngcggcacaagcgcagagccgccatgtgcggaggacacttggtgcacccacacacactcctctcgcgtcccacctggagtccatggggatgttgggcgacccagggccccaccagacgccggcctgggtgcttggctcccgcaccacgctcaggactcccggggtctggctggtgctgccccccggcgggacggccagggccccgctggccgtgagccggctgccgggctcgtatcgcagtgcctggccagggtgggggtggagaggctttgttaatgcggtgctatgaggcccagggtgggagatcacaaccannnnnnnnnnaagggtgggggtggagaggcttttttaatgtggtggtatgaggcccagggtgggagatcacaaccatccgcagcggggctgatgagggtggcagcgggaggtccaggtgtaggagtctggaggccatgcgggatgcctgccccgccaccccctctctgccccagcagcagcaagtctgcatcccccaaacaaccacagccttacatgctcatagagttctgcgacgcaggcattgtggaagacgatggtgggtctgagcccggagtcgctcatcatactgagcacctgggcatcgccattctgcggtcgctctccgccaggctgtcgcttgaaggctggagaggttggcggggaccgagggatgtagatgtgctgccgaaaggggaggagggcggtggtggtgggtgggggggggtcggaagctggcacacctattcttcaccctttacctgggacaaccatgggctgcagctggaagccgcaagctcagccgaaatactcggcccaggcaatgctgtggcctgagctggttgaggctgaagccagacttcctcagacacagccaaaccttctcccttctccctcaccctgggttgccgagtggcgatacggggcccctggcctctcatgagagacttcagggagtctgagatggaggccgccttggagtgttcagcaaactctgcggaaggaacatgggcgctgggcggtcgtgtggggagcttggccaccagtatcaggcattggcgcagcctgcacaccgatccatcgctgcaggtcctgcgcaccatcccgtgtcttttgggtcatctgcatgctgaggagctcctccaggtcggcagcccggctagggtttccctcatcgcccagccgtcgatagtctgcgcatcgctcgatggagcgacacttggccctcctgaagtggtacattgatttgtgaattgggcggatctgccttgtggatcgcggaggtcacaggccgggcatgcgcgctgcacgacacggcacccttgccagccttcatgaatctgggacaagatacacgaatcttggcgatggtgcctaggtgcgtagccatattatgaacccagtattcagtggcatgactcgacttgagctgggannnnnnnnnngatgaatctgggacaagatacacgcatcttggcgatggtgccttggcgcgtagctatattatgaacccagtgttcagtggcatgactcgacttgagctgggacgtgcagcaccaaaaccaagctcaccagggtggaggaggcgggagggtcgccatcccagctggctagccctcaatccaaggagtatttgtgcaacataatatctccattcttaagcgccatgccctgaatccgtgctgcagcggggatctgcaccacagtagctgcaccaaatgaatcgattcgcatcccaacatcacgtgcttggaggacgtggttccagccgcctgcttgttcaagcatgttgaggcacccctcagactaagcgacgggagccacctgnnnnnnnnnngtctgcgccacaggggctgcaccagatgaatcgattcgcatcccaataatatcacgtgcttggaggacgtgattccagccgcctgtttgttgaggcagcaccccctcagactaagcgacgggagccacctgatcccagtctacttcgtgagtgagcatacaatagcggctatccagaatgtggtcgtgatgaatgtctaagtcactttcaaaggctgtctcctggcaatttgtccggggtggaaagcgcatccaacctaccttcatgaaatagagggaggggctgggcagaagcctgacaatcgatggcaggaggtcaattagacgcttgatcaggcagactttgctgtagctcggtttctcctccgcaagagtgggaactctctgggcgcgtcacctcctgcgcaatccctgcgagttataccagagtcgactggcggtgccacccaatccacatctatgaagcttgtatcctaggcaactgcactgtccactctcagtgtgcgtgcgctcgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagagtgatcagagcgagcgaggccatgccagtccctgccgtcaccgtgacgctgcattatggctcatcctccccaaccctctgtcgccacattccctgcgggtcatgggatgtcgacaccaacttcaaggggggatcactcacggtccgcggatcatggtacgcccgctcaagcgaggcttgcaccgtgcgagctgcttctggagttgcgggagggcgggatggaccccctagaaatagtgctgtgaacctggatctgcttgatgaaggatgcccagccaatcaaggccccccttgttccacaccgtctcaggcctgtactccacgactcgaccctgcttgtctgccacctcttgaccaaaggtctgtgcaagtacaggcatgcctgcagctgccgacgggctcagatggcctgcaccatattgttggcgagagtgcacaccgacctgcattgcagctgctgacctcacaattttcttgaggaggtcctgcccgacgctcgtattattgcagtacgcatccgaatcagcaatgcatcgccaacaacccctcccatggacagggcctgccttcttcctggttgccgatgcggaccccggcaatggccaaaccgcagcgtatgtgggagactaaggtttccagaaaagaattctctgtgccctgtcgaggccaccggcatgcacatggatgtgtccctgccccatgccggccgcatccgcctcactccacccacctgcattgtgccgcaggctgtcagatctgcatgaccactgcgtctggcagaagagggctggggtgctcatcgccgatgacggcagcgaagtgctcctggtccccctcagaggtgggggggggttgggcccctgcgctccccctacctgcgaagtataccatgccgccctagattaggcatgttgatttgcccttgtcttgaaccacgtcatcaatttgcccttcatatccatgccgagtaggcgagggcagcgagcaggtgctcgcgggcttccacaccannnnnnnnnngtgggcccctgcactccccctccctgcgaagtatagcatgccgccctagatcagacgtgttgatttgcccttgtcttgaagcacgtcatcaatttacccttcatatccatgccgagcaggcgagggcggcgagcaggtgctcgcgggcttccacaccatcatggcggcaggggacgtgctggggggctgcctggcttctggccggcttccgctcgtatttgacctggacgagacgctgctcgtggccaagagccagagccagctgcagcgtgagctggccgagctccgcgacgtcaggtctgcacgttgcacgggagtgcatgggcgttgtttgggtgggaaaatgtaaggaaggtcccgcaagtgtctcctagtccagattatggtatcccccagcttgccagcacccgactaaaggagcaactcctttgtcttgtgcgccgtcccaagaaccctcctgggggcctttgcgtggtcgggtgctcgatctttccccacttgagccctccctcaaaaaccaacaacacccccccaggcgcccggcgctgactcagcagcccagttcaaacgacagggcgctgggcctggccgcgctgcggcgcgaggaggagctgctggcggccgacctctccctcctccagcagtttgcggagcacgacgcggtggagtggggcggggcgcgcctggccgcaaccctggagcccgctgcgggcccggcgctgcagccactgcaccgccccgtcgtgcgcctgcgccgcgacggcgcctccgtcgtgctcacgcgcatcgaccccgccctgcccgccacctccatgatcttccacgtgcggccggggtgggaggcggcgcgccctgcgctggcggccgccgcctcccacgacgtctacgtgtgcaccgccgcccggcaggactacgcgctggaggcctggcgggtgctggacccgggcgagcacctcatgtccctgcagcagcgtgcgtgcttgttttttgttcttgggggggggggagagatgaagaggggaggaggtggagaggtggaggggtggggaagggaatctgcctgctgaagccagtgcaacgggaatggaggatggcgacaggagcatcttgccctcatatgcccatgcagggcaccgcatgttcatgagggctccacacgccattggatcttggcccctccccnnnnnnnnnnattgttttggggggggataaaagatgaagaggggaggaggtggagaggtggagggggtgggaagggcatctgcctgctgaagccagtgcagcgcgaatggaggacagcgacaggagcatctcgccctgatatgcccacgcagggcactgcatgtacatgaggccgccacacgccattggatcttggcccctccccgctgctcccagaaactcccctcaaccattcctcacgctttcctttccacgcaggcgcagcgcgcatcacctgcgtgcagcgcaagaacctggccaaggtggtggtcaagtacaagggggcggggggcagcgtgcacagcgtcatgcccctcaccgtcatcgtcgacgataggctggacgtgagctggggaagagggggttgtatgtggaaggggtcctcagatgaggaggacggtgggccaggcctcagtcgattgctactgcgacgctgctcatctcgctggttgtgggtcggagatgagagcagggtgcatctgcctgctggcgtgtctcaggcacatcagccgcccacctctcttcttgattctcacaccctcgcacatccccctcgcctcgctgccaggtgtgggacgtggccaatcgaggccaggtggtccagatcgagcccttcagaccgtacgaggagcgggcggcggcagagctgggcctgccggaccggcccacgctgcagacgctggacgcccagatgcagtggctgcagggggagatcgcgcgcctgcatgccgccatcttctcccacatcgatgacgtcgcaaggtgtgttgtcagcggcggtggagtgtgcgctggtcagtgcgcgggggtgggccgtggcgtttgtggggccaggatgccccctacacgtttgtcttcatggcagccctctgcacccagcctggaccccgctgcattcctcgctgccctcaccgacctcacacccgcaggccggcggcggagcggctcatgtcgggcgcgcggcgcctgaaggtggacgccctggcgagggactacgccgatgccatgcccacgcccacctggacagaggactgcgtacaggtgccggtggggtcgaggaggtgaagggttttttgtgtgtttaaaaggaatcatgggcccggagtcggggcaagaatgcgccgattctgcggtgtatgcggcccttctgtgcatggaggagcagcgtgcacgctgcctccaccggctccccacggccgcaacccccccnnnnnnnnnncgggctcgagaaagtgaagggggtgttcgtgcgtgtcaaaggaaccatgggcccggagtcggggcaagattgcgccgattcttcggtgtacgcggccattctgtgcatggaggggcagcgtacacactgcctccgccggctccccacggccgcgacaccccccccacccactccagaaagctccgcggctgctgggcctggccccggacccccgctcggcgtcaggcacggccctggtgccccaggacccacggcgtgcagcgcggcagggtgccgagggcgcggccgtggcggcggcggccgcaggcgtcggcgagctcagcctgccgcaggacccgcgccggc

SEQ ID NO: 41549 - DNA, 61 bp, Chlorella protothecoides
cacctccgcccccgtctcggccgccagtcgcgtcagctcccgcctcaacgccctggcaaac

SEQ ID NO: 41550 - DNA, 61 bp, Chlorella protothecoides
caccgcgcccagggggacggtggcgccgtgggggtcgcgggccagcagctcgcgcggcgcg

SEQ ID NO: 41551 - DNA, 418 bp, Chlorella protothecoides
  modified_base (113)..(287): a, c, t, g, unknown or other
gggacagggaaagtgagggttgcctcagctggccgtgggatccctgtctgctgcacactcaaatgcatgcaatcaacaaggcgccacaacgcccactcggctaattcaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccagcgccaggcccaagacctcggccaaagtctgcacagagatgtggaagggtgacatgtgcatgaggcggttgtttttcaacatagaaacaagcatctttgacaagctgggtgaaagtgggtgcggtc

SEQ ID NO: 41552 - DNA, 96 bp, Chlorella protothecoides
cgccctcgccggcgtgctggaccgcgtggacctcgaccaccccaaggtcggggaggagcctgtgtttccgttgctgtttgtggggggggggggggg

SEQ ID NO: 41553 - DNA, 70 bp, Chlorella protothecoides
gaggcactccccctggtctggacaagtgcacacccaggaagcactccccctggtctggacaagtgcaggc

SEQ ID NO: 41554 - DNA, 61 bp, Chlorella protothecoides
catggcgctggagctggggctgggccccggagtggtggagatcgggcaccaggccgcggag

SEQ ID NO: 41555 - DNA, 396 bp, Chlorella protothecoides
  modified_base (96)..(321): a, c, t, g, unknown or other
cggccggctcgcccgccgccacccccaccgcgcgctcgccctccgcgtccaccctgggcgggcgcggcgacgacagcgagtcggggggggacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctctccgccgcagcggcggcggccctggcggcggcggccgtggccgccggcatggccgcggagaccgccgag

SEQ ID NO: 41556 - DNA, 66 bp, Chlorella protothecoides
gggggggggtgagtcgtttctttgcaccgcggctcccatggctgagtattccagccggcgccctgc

SEQ ID NO: 41557 - DNA, 66 bp, Chlorella protothecoides
cgctgcggtgagtagccgtccagaaccaaggagtggcctggttcccacgtaccgccaatagacctg

SEQ ID NO: 41558 - DNA, 134 bp, Chlorella protothecoides
ggtaacacccagcacctctgctgcatctatcagaatctccgtatggccgtcccatggccactaagtgggacacgacccagaacccctgcgctcttgccaacccgatccaggctgggcccaagattgactgggcg

SEQ ID NO: 41559 - DNA, 61 bp, Chlorella protothecoides
actcgggtgagggccgtggacttgtggcggtgtgatgcgctgcagagcccggtgccactgc

SEQ ID NO: 41560 - DNA, 166 bp, Chlorella protothecoides
accgcctcccggaccccaccccgcctgtcgaagaagggcgccggcggggaggagggtgggtggccacttgttgaagcgcagcgcatgggcggcagtcctctccatgagatgtacagcgacccaatcggcccgccccgcagtcagcatgcaatcctggcgggctgca

SEQ ID NO: 41561 - DNA, 61 bp, Chlorella protothecoides
cagtgtgcccgcagcaggccggcagggcgcggcgtcagggagttcagctgaagatgcgcac

SEQ ID NO: 41562 - DNA, 61 bp, Chlorella protothecoides
tgcgctcaaggcgcaggccgccagcctgaaagccagcgaggccctgctgctgaggaccgtg

SEQ ID NO: 41563 - DNA, 114 bp, Chlorella protothecoides
cagcggcgtgccccccggctcgcctgcgcctgcgggcgagacgaagcagggcgacggcagggcgccaccgggcgtgcggcccaccacctcgtcctggcgctgcagccgcacctc

SEQ ID NO: 41564 - DNA, 63 bp, Chlorella protothecoides
ccccggtgggtctgaagcaaggcgcctctgtctgtggagctaagcactgttctcgctgggagc

SEQ ID NO: 41565 - DNA, 61 bp, Chlorella protothecoides
ttgcgttggctgggaaacagcgctgggtcgtgtggcagcagggcaagtgggatgagatatc

SEQ ID NO: 41566 - DNA, 61 bp, Chlorella protothecoides
cgcggccgccggcgcgagaagtggccctggcggcggtgctggccgcggcccacagcgagga

SEQ ID NO: 41567 - DNA, 61 bp, Chlorella protothecoides
gttgatggccagcagagactccacgaggtcgacggcccaccgggacaggcgcagacactgg

SEQ ID NO: 41568 - DNA, 891 bp, Chlorella protothecoides
  modified_base (405)..(414): a, c, t, g, unknown or other
aaccctaaccctaaccctaaacctaacccctggccctaacctggccctaaacctaaacctaaccctaaccccgaaatctagatctgccgcgtgaccttacgatcgtgcctctgacccacacagtgtccttcccatcccgcagcggagactagcgtgcattgtcacgtgtggcagctatcttcgacagtggggaccagagagcgacaccctgccattcagtggccgtgacgtggtgagttgcccagcatactgcggggtgttgtttggcgtggagacagctggtggtctgtggtgtggttctggccaggggatgggcggtgtgtcatgcgggtgtgattatcaggtttgcaggactcctttataagcttcccaccgcacggatgcgtctatccctcggcagcagannnnnnnnnntaacacctcccctttctctacgatgcagggaatgtcccgctactccctagctccacctgttgggtggattgtgcatatcagtgatccgtagatggctaacggccatggaagcacggatgcagccggtcccatcgccggcagttccctgggaactgctgtgcagtttgggttaaagactccggtggagggatcatagtggatcatggcagcacgtgccacccctcctatgaagatgcgtgagacccacgattcgatcgtgacgagtccacccgagagctctctgccactgattgtgggatggagttggtagatgcgaacgacacggcctgaagaccaacaatattatatccggctcttccggacgtagcacgcgggagaatccggagctgcagccggcacgccacgtgctgcgctctcactgccccgcgtcgcgacctcacttgatcgccatcgtgtcataatcactgttagctcttt

SEQ ID NO: 41569 - DNA, 100 bp, Chlorella protothecoides
tggacaccccgctcctctacgaggtggaaaggggggaaagggaggaagggggacggcgtttgacctggaaggcggtgcagcatggccgggtctgatgtga

SEQ ID NO: 41570 - DNA, 87 bp, Chlorella protothecoides
ggggggggggggggggggcggggggggggagccactctcaagagggcagagatgctggtgcagggggctgtcgtgacagcggtgagg

SEQ ID NO: 41571 - DNA, 76 bp, Chlorella protothecoides
cgtcacgccgctgcctggagggagggagggagggagggggtgtggagattggaagccgctgcagacgtggcacaca

SEQ ID NO: 41572 - DNA, 80 bp, Chlorella protothecoides
catcgaggaaagcggggtcacagcgacggccctgcgcgccgccgccgccgcagacctcgcggtggttgtgcaggagctct

SEQ ID NO: 41573 - DNA, 460 bp, Chlorella protothecoides
  modified_base (150)..(391): a, c, t, g, unknown or other
ctgcagcctcgtggactaggctgcggcggcctatggcagcggcagagcgaaaattccaggccaggaaatgaagcgtggagacaggatttacttgttgaagtccttcccaataattcccgaaaggcgccttgcagatcaatgcattgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccctccctgatttagaaacgatggcgactgcaacccgagtgaaggtcaccgaggatgagtcg

SEQ ID NO: 41574 - DNA, 80 bp, Chlorella protothecoides
ttgagcagctggtacatcatgctctgttgtgaggtgaatgaggggggggaggggggggggtcccatgagaggagcactcg

SEQ ID NO: 41575 - DNA, 71 bp, Chlorella protothecoides
agcgagagcccctcctgcatcagtcatcaggggcgatcggccaggggtatgaagtggcttgcgacagatgc

SEQ ID NO: 41576 - DNA, 61 bp, Chlorella protothecoides
accgcaagcctagttgtattcaatggcgggggccctctcccatcgtagtggagggtacgag

SEQ ID NO: 41577 - DNA, 616 bp, Chlorella protothecoides
  modified_base (95)..(104): a, c, t, g, unknown or other
  modified_base (532)..(541): a, c, t, g, unknown or other
ggaatgggggtgaatcggtggtcagggcaacaggggggagaaatgctctgggacgtgagtgtccgcgggtatgcaggtgcccgcatggcgtcgannnnnnnnnnggcgcggggccggcgaccgcggcggcggccgcaccctctccggcctccccaggctcctccccgacataggcgccggggatggtgaagcggtgcacgctagggtctgtgaggtgagtgtgcacaggggctgcgccggcggccaggtcctcctcgtactgcgtggggcggggggaatgggggtgaatcggtggtcagggcaatgggtggggggggagaaatgctctgggaggtgagtgcctgcgggtatgcaggtgcccgcatggcgtcgacgaggtggtggcaatatggtgcctcagccacccctcctatacgagatgctcgtgggtgtttgcacacgcccacactgccaaacatagttcttgtgcaatcaaccccccaacccagttatcccctgtcaagaccccccatcccaacccccgccccccacnnnnnnnnnnattgtgcaatcaaccccccaactcagttatcccctgtcaagaccccccatccccccccatgcctcccaccaaccc

SEQ ID NO: 41578 - DNA, 61 bp, Chlorella protothecoides
ggaccgtgcggtgcggggcgtgcaggccgcgctttccatcgcggcggggctgcgccgccac

SEQ ID NO: 41579 - DNA, 61 bp, Chlorella protothecoides
cttcagggcccgccccgcgtcgtggctggggtgtgactctacgctgcgcacaggaaacagg

SEQ ID NO: 41580 - DNA, 61 bp, Chlorella protothecoides
agaacgtgggcattgctggcgtggcggggggctgtcgagccgcgctatgcaccctcgcact

SEQ ID NO: 41581 - DNA, 61 bp, Chlorella protothecoides
gttggcggggcatcgcgccagcgatgcgggaatcggtccagacctgctcgatcatgcctcg

SEQ ID NO: 41582 - DNA, 113 bp, Chlorella protothecoides
ccagcagcggtggcgccaggccgatgcggggcccctggcggcccccgacgccgtctgggtccaggagcagccgcaagatctgtgctcgcagcgggggcggccagtcgaccgcg

SEQ ID NO: 41583 - DNA, 64 bp, Chlorella protothecoides
atgttgacgtctgcgtaaggcacaaggggggggggcccatgctggtcgatgcggtgcacacctg

SEQ ID NO: 41584 - DNA, 76 bp, Chlorella protothecoides
cgacggagtccctgcgcagctccagtgaggattttttctcgattgagggagtgggggggtggggggcgcaatggta

SEQ ID NO: 41585 - DNA, 91 bp, Chlorella protothecoides
ggtacttgaagccgcgggtgggctcccccgcgacgttccactccaccctgaggcagcgcttgacctcctcggccaggcccacgcgcgcgcc

SEQ ID NO: 41586 - DNA, 408 bp, Chlorella protothecoides
  modified_base (99)..(333): a, c, t, g, unknown or other
catcgctgcggcgaacagggcaacctgcgcgcacacaaagcaggacctcacagccatgagaggaggcagatgcaaaatgcacatcataaaaaccactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaatttggaagaatgtaccctattttgttcctaaaaactctcgggaggggggggggggggggggggggggg

SEQ ID NO: 41587 - DNA, 119 bp, Chlorella protothecoides
ttagggttggcggcgggggaacagaggacacacgaggagaagggggcagccggcggggctggagctggtatggtgacgggggtgctggtggatgctagcaggagcgttgggcctgctag

SEQ ID NO: 41588 - DNA, 61 bp, Chlorella protothecoides
ttgagttctaccgagtagtaaattccttatcccagcctgtgttacctttcccttcacgcgc

SEQ ID NO: 41589 - DNA, 63 bp, Chlorella protothecoides
cctcgcagccgaggcggaggccctggcggctgcacaccccggcgcgtccctcagcgtggtcag

SEQ ID NO: 41590 - DNA, 78 bp, Chlorella protothecoides
cccccccccccccccccccccccccctccacctatgttcagtaccggaatgaggaggacatgcgcacggtgggtcggg

SEQ ID NO: 41591 - DNA, 145 bp, Chlorella protothecoides
gatgcttgctctgcctccactgctgcccctggtgcggggatgtgtcgaacctcagatgcctcattccgatcccgattcgacccgacccccctcgccctccccgaaacactcagggccgggcttccggcccaaccctgccgcggtc

SEQ ID NO: 41592 - DNA, 61 bp, Chlorella protothecoides
gggaagggtcagacattgcattaccctcaggcatggaaggccaggaagacacagatgcccc

SEQ ID NO: 41593 - DNA, 101 bp, Chlorella protothecoides
ggcgtacattggcagagggatgatgcctgacaggggagggtatattcagagagggtgtggattggtggggggcgggcatgcctgcaagcctgaggttcagg

SEQ ID NO: 41594 - DNA, 671 bp, Chlorella protothecoides
cgctccgcggcgcgcgccgccgcgttggcgcgccgcgcctcgctggcggcagccgcgcggaagtcggtgcgccccgcccgcgccatgtccagcatgcgcgacgtgaccgcagcaagccccgccgcgtagccgtgcacttcggagccgggcgggttgtaggtctgcgcattgcggaacatgagctgcaggtccacctccagcgcgtcccaggaggtgtagtgccccgccgccaggttgcgccgcatggtggtgaagtccatcggttcgctgatcaccttggagtagccgggggcctatgggatggtgggcgaggtgtgggggaggggatcagactgataccaaatgtcgtgcatgcacccaaggaatcatgggggtcgggtggcgagccccgggtggcacttctgcgaggaccatgccaaacacaacccctgttacacagcgcccaggccctctaaccccccccccccttccaacagtcatgcaacacatcatccaggtcctcaccacatcatccgtcacggggtcgcggaagatgccgtgggtgtccttcttctgcacgcgagacaggatcttctccagcgcctccctgcgcggcacgccgtcgccaacctcgccgcccgcgccccgcgccggcccgctgcccgcggtgtcggcgccgtcgccggcctcgc

SEQ ID NO: 41595 - DNA, 514 bp, Chlorella protothecoides
cggcgcctcggccagctgcgcggcaaactcgggccagtcgggcaggcgcggcgccagcgcgcgcgcggcgcgcaggccgaaggcgtgcatgcgcgaccccggcgcgttggtccccagcgcgtccagcaggtggcgctgggccacggccaggggcgcgccggtgaccaggcgcgccgccatgacccggccccacagctcccccgtcagctccagctcgcggtccgggtagcgcgccaggaagcggtactcgtcaaacaggttgtgcaccacgcagtcgtgcaggcggcgctcgcggcgctcagcgctgcccgccatgcgcgccagctcggccaccagcgtggccacgggcagcgcctcggtgtacacgcgctggaaggtggcgttggcctccgcctccacctcctcgccaaagggcccgtcggggggggagtcggggccgggggcgcgcgcctcgtcgcccagcgccgggtcggcggccagacccgggtggcggcgcagcgcgccgcgccgcacg

SEQ ID NO: 41596 - DNA, 61 bp, Chlorella protothecoides
gggatgttccagcggctgtgggaaggggggggggaaagggtttgtgagcctctagggcctg

SEQ ID NO: 41597 - DNA, 107 bp, Chlorella protothecoides
cgcgccgagcgcggcacccccgcccgtcgccgaggggttgcacggtggtgtggcaggcacgccgccttccacggaagcttgcttgttggtgccgtcttgtggcgtca

SEQ ID NO: 41598 - DNA, 147 bp, Chlorella protothecoides
gggggggtggggggaggtggaagaggtctggcagggtggggaccattggggcgggggcgtgtggttcgactgcgcgctctccccaggtgggacccctcgcgcatgacagggcggccgggcacctgcgcgctttccatcaacagcaat

SEQ ID NO: 41599 - DNA, 105 bp, Chlorella protothecoides
gggcgggcgggcaggctgccagcatgaccatttggcgggcccagacgagtgcatccagcaggcttccctcacgcattcaggaagaaagaaagaagcgcccaggga

SEQ ID NO: 41600 - DNA, 101 bp, Chlorella protothecoides
atgctcctctatactcgtaagtatagtcatggctgggagtgtgtggatgacacttggagacaccaagagagccgttggaatgtgtaaacttgcatgccaga

SEQ ID NO: 41601 - DNA, 61 bp, Chlorella protothecoides
gatcctggacgaggccacctcggccctggatgcggagagcgaggcggcggtccacgcggcc

SEQ ID NO: 41602 - DNA, 94 bp, Chlorella protothecoides
ccccccgccctctggacactcccatcctccttccccccggtcgcgcagggcagggtcgcgacgttgcaatccctctccggcaccggcagcctgc

SEQ ID NO: 41603 - DNA, 72 bp, Chlorella protothecoides
gggggggcggggggggggggggggggggggatttggaagcacgaccacagcgagggcgtgtgtgccggggtg

SEQ ID NO: 41604 - DNA, 9125 bp, Chlorella protothecoides
  modified_base (1021)..(1050): a, c, t, g, unknown or other
  modified_base (1113)..(1122): a, c, t, g, unknown or other
  modified_base (1879)..(1888): a, c, t, g, unknown or other
  modified_base (1944)..(1953): a, c, t, g, unknown or other
  modified_base (3584)..(3593): a, c, t, g, unknown or other
  modified_base (4009)..(4018): a, c, t, g, unknown or other
  modified_base (4405)..(4414): a, c, t, g, unknown or other
  modified_base (4703)..(4712): a, c, t, g, unknown or other
  modified_base (5191)..(5239): a, c, t, g, unknown or other
  modified_base (5960)..(5969): a, c, t, g, unknown or other
  modified_base (6423)..(6432): a, c, t, g, unknown or other
  modified_base (6656)..(6665): a, c, t, g, unknown or other
  modified_base (6908)..(6917): a, c, t, g, unknown or other
  modified_base (8018)..(8027): a, c, t, g, unknown or other
  modified_base (8387)..(8553): a, c, t, g, unknown or other
  modified_base (8714)..(8723): a, c, t, g, unknown or other
cggcgcgcggcgcggccgccgccagccggccggccagccagagtgcacggccgcgtagaaagggcggcgagccgggcgccaggtcctcgaccaccgggccggagaggaggccggcgaggtcaaaggcgcggggccctaggcccagcagcgtgtcggccgcgctgcccaccaggagcagggccgcctcgcgctcgcgccaccagcccggacggcccgacgcccgggcagtgccggagcgcgccagcgcctcgcccaccgctcggctgagcgccggggcggctgcctcctcaaaggccaggaacacctcgtccaccagcatctcgcagctggccctgttgcattttgtgcggtagtgagtgggtgtgggggtgagtgggtgtgggggtgagggagtagtggtttgatggggatgagaggcaaaagaggatccagcagggcagctggcggcctgcccaaggacgtcactccaaggcccggcgcccaccattaacgatgaaccccacctttcagaccctccctccacccgctgcccgcgccttcctcgcacccaacaaaccaaagcccacctcagcgagctcatgtcgtcctcctcgtctgccacgtactggttggggcagtccgtccaccgctcctcctgctccgccgtcatctgcgcgtaccccaccgccaggcccagcagctggggcaggtgcggcgcgatgaggccccggaaccgcgcgttcccaaccacgcacaggatgagctccatggtctgcgccagcaggccctccagccccaccgcccgctcgccgtcctccgcctcggcaccgtcggcgggggctgggtcgccgaaccccgcgtcggcctcgccctccaccacggccgccacgtactgcggcaggccggcggagaagcgatgccacaccgtgcccagcacgggcgtgagcacgggcgcggacaggcggccgaaggaggaaaccaggaccgtgaggatgcccagggcctcgcgctgcgccgcccacagctcgggcacctgctgggnnnnnnnnnnnnnnnnnnnnnnnnnnnnnntacggtgtgcaagacctgaagccgaatcccatcccccgtgccccactcctccaacccctccannnnnnnnnngggagaggaggggattggggaggaagagcgtgggcagccaaagcctctcaatacagggcttcagcgcctgctcaacggtgtgcaagacctgaagccggatcccgccccccgtgccccactcctccaacccctccaagtccgggccggaccccgggtgacaccccacctcgcgcggggcaaggaccgcggccaggagcggcgcccactcggccaggacctcggtgagcagggccttgaccccggcggcatgcgtccccgtcacgctttgcatggcgcccaccacgctgcgcaggatgctgagcacgcggcggaccagggcggcgtcggcgccggaccccgggctcagcaggggggccatctcgtgcagcaggccgggggccatctgggtgagtgtcagagtgtggcgcaggctcttggctggatgggattctggggagtcaggtcatgcatgccagacacagccacaccgaggacaaagacaccagccggctgtagcgaagagggagtgcacggcgctgttcagctcgaggtgtgctggccggctcgatctccccacctccatccgttctttcctcgacctcatcagcaccacagcgcacctccaggatctgatcctcgccaagctcatccacaaacatggcgatgcaccggatggtgccgtccactgcggcaaggtcactcacgaaacagtcagtggaggctctgtgacagcactgggacctcccacccctcacctcctggagcacagctgttggcnnnnnnnnnnatggtggccggctcgatctccccatctccatccgttctttcctcgacctcatcagnnnnnnnnnnagaaacagtcagtggaggcccagtgacagcactgggacctcccgcccctcacctcctggagcacagctgttggcccttgcactcctcatggaagcaccattggcacacctgcggcacacacatgccccactcccagcacccccccctcaccgtgctccggcgatggcttctgggccaccacgctgagcagacccggcatgagctctggccagtcctgggggcagtcccagcgcgccaccgccgccaccgccatgccggccgcggtgcgcagcttgcgctcgggatcggccaggccgcggggcaggcgtgcccgcagcgccgccttttcctcctccccgatgggcggctcgcggaaggccccggactcgaaggtccagtgctccttcaggtgcttcttcaggatcacggccgccagctggcgcaggcccgtgggcagggaggggttctgggacacctccagcagggcgacgcccaacccaggctgctggctgccctgggccagcgcattctcaccccccctccgcgcctgcgggtctggggacagaagcgagttcaggcaggcgacgagaccctccatggccttcggaccagggccgcaggatcagagggcgcctggcatccgggcgcggtgtcggggcgtcgtgcccgccggggaacgggaggccggtgaggggtgaaggtgcaagaccccagcacgaatgcaccgccagcaatgccaggtaaacggatcaccgcacgctgccgagcttggtgagggaccgaagtctctcagcggccgtgtcgagcctgtgagtttgaagccgggaactcgcgcccgctgacgtggcggcaacggagacactccagaacctatccggccatgtctggccatgccttcaccgcatgggccggccatggggcgtggagtagagtgtatgcgctgtatctcagcaaggaagtgggcactcgccctgtagaggcgcagagtcccatgtcgcgggaggacagcctctctgacgaggaggtggaggaggcgacgatcctgggatcggaccccgatgaatcgccagagcccactccagtcacaggcccagttttgaaagggtatcgtaaagatgccaagaaactggttctcacggcagagccagaggttcgccgtggccctgtcctgccgttttggctgtgtgttgggctggcagggggtgcggcagccttcgctgctctgcagcgatggaggcgaagggatcccagcccccgtcgacccagcctcaccaaggcctctgtcttcctgaagcggttcacattggtgccgccgagtgcgggacatcccctcagctccaagacctttgtggtgtctgaaaggtagcttgggggagcccatgcggggcggtgcatctgcttgaatgagtcatgacgtggtgaaccagcacacagagacaattcaagcttccatatcattgccttctcgcagtctgggcattgaaggaactgcgtgtcgacggctccaggaagctgccctgcagctggaggccattgttcctgggtaagtgctcctttgaatcccagcacccttgggctgccatgcagcgctgtatcagtagctcgggaggtgtctgcacatcgctcatgaggctctggctctaccctcctcnnnnnnnnnnactttgaatctcagcacccttgggctgccatgcaccgctatattagtagctcaggaggtgtctgcacaccgctcatgaggctctggctctaccctcctccactgcagaccgggctggctggattcggctggcaggactctggagaatccagccgacgccggtctttggcatggggccggcgaggctgcctcggcagcgacggtagcagcggggctcgccgacgccgcgctggccctggaccagcttggcagctccagggtgtgttacctttcggcgatgctctccatgctcgcacagggggatctgctgagagaccattcgtcccaagcaattacatgcacttgtatctcgaccagtatacaattgccaaactcaatcgttccttgtcccttgcagctcgcggcggcttgttgtgnnnnnnnnnngcctttcggcgatgctctccatgctcgcatatggggatttgctgagagaccgttcgtcccaagcaattacatgcacttatatcttgactggtatacaattgccaaatcaatcgttcctcgtcccttgcagctcgcggcggcttgttgtggtgtgtattgcctgcgctgcaccgcgggactcctgcctctggatggcagcgagggctctgcaaaccccctggcctccactgcattgatggccagcgatccgaccctcctccctcgcctgggccaagccctggggctcccaaagggtgggtgcatggaggcaagagttgtgagcttgtgttgcaatccaacagtgacagggcagctttatctatgatctccatgcataccgtcgacctnnnnnnnnnntactgcattgatggccagcgatccggccctcctccctcgcctgggtcaagccctggggctcccaaagggtgggttcacggagccaagagttgtgagcttgtgtagcaatccaacagtgacagggcagcttgatctatgatctccatgcataccgtcgacctgagcacgcctcctgtctcctttggcatctgagagcagcaggcctcgctgttgcttgtgcccctttgaagctagactccctcacaggcccccaccttccctctccttcacctgcttcaacccaggcacnnnnnnnnnngcgcctcctgtctcccaaggcacctgagagcagcaggcctcgctgtcgcttgttgccctttgaagctagactccctcacaggcctccaccttcctctccttcacctgcttcaacccaggcaccagcgaggtggtcaattacctggtagcagtggacctgattgcagagtgccagggcggcctgcgcgcctgcctccccgccgtcatctccgcggtcaagcgctgggcgggcgcggaccaggcgcagagcctgagcctggcggagtggctgtatcaccgggtggcctcgctcaagcactttggctccgacgccgaggccgcgcgcctgggcgaggccgcggccacagagtcccatggcccggacgtgctgtgcgcgctgcgctccgcggcacgggccttgagggatgaggggcggggcgaagggaaggtgggtgggtgtgtgtgtgggggggggggggggagtatctcagtgtgcgcttnnnnnnnnnnnnnnnnnnnnnnnnnnnnnnnnnnnnnnnnnnnnnnnnncctgtggtcgggcgtcagcgcccctctggggcttgtcttcaaggtcgagtcggggaaatggcgaggctgcgctgcacctcatgcgccgccgctcccaccctctccgcagaccaccgccgagggcattgcggggcgaaaagttgccgaggaggccaccaacagcctcctgggcgccctgcaggagggctacatcttcgtgcttcccacggcatcgggcgcaccgccggccaggggcagtggggaggaccaggcggctttccaggatgacagcgaggggttcctggccctggcggcgctggccggcgtgcctcaggtgcggatgcaagctggtcctgcctgggaatgtgagcggggtgttgatgtcactggagttctcaagtcctgccggccgcccccctcccaggtggttgttccgttcaggggcgcagagggcgagcccctgtcggtgtcgctgatcacgctgcatcggaaggatgtggtgctgctgcaggctgcctccaggctggggcccctgctgcaggaggaggtggggaagctgtttggggcatcgtcccgggcgttgggtgccgacggcgccgcctctgggccgggcgccggcgcctcaaaggagggaagctggaggccgtttggcggcgcggtgccctccgcccgtgattccccgggggaaaagggcccccgcccccgcgacgccacggccgcccgggctgaggcgtgcaaggannnnnnnnnnatttggcggcgcggcgccccccgcccgcgattccccggggggaaagggcccccgcccccgcgacaacacggccgcccgggctgaggcgtgcaaggaggccggcaacgacgccttcaagtcagggcggtacgacgacgccgtactgcagtactcccaggccctggcgctggacccgggcaacgctgtttactacaacaaccgggccctggtgtacctgcgcctggggcggtacggcgcggccgaggaggacgcggaagcctcgctgcgcatccgcgtcagcgccaaggccctgctgcgcagggggtcggcgcgcatggccatggtgcgtgcgtcgtgcggttgggggggagggggagatgggagtggaagaatgcaaatcagtggggcgggaggtatgcgtggcggcagtgcagtgcagggtctaggggctggctcagagtatgagactgtggtnnnnnnnnnntggaagaatgcaaatcagaggggcgggaggtgtgcgttgcagcagtgcagtgcagggtccaggggctggctcagagtatgagactgtggtggcctggttgcacactacaactgaggcgcagtgtaaaccaccgagtcgcctgcaatgcgccgttgttgagcttctccaccccatccttgcctcttccccccttgccccacagggagaggcagagggcgcagccnnnnnnnnnnccgtttcgtgcctggtgccgcgagcagctaatcgcggtgggcagcaccccggacctggccttgtgcgagttcctcatgaccgtggactccaactccgaggccgcagagtacctcacgctctacctggggaagaccgaagcggtgcgggagtttggtggggaggcatggggctcgaggctgtgcccggccaagcaggggggtggagccgtatcccctgtgttgggcggccacagggctggagcnnnnnnnnnntgcactacaactgaggcgcagtgtaaacaccgagtcgcctgcaatgcgccgttgatgagcttctccaccaccccatcctcgcctcttcccccctggccccacagggagaggcagagggcgcagccagcgactttgagcatgtgcttcgcctggagcccaataatcggcaggccagggaggagctgcgtgccatccagcgcttcctctccacctccacggacaaggctgcgtagcaattgtcaccagctgatgccggcccatgctgcctggcagcttaaccccgcccccacccccaaaagatacatgctcgccgcgcccactcaagcccagccattcattcttcgtgttaaagtcagccgagctcgcagtgcaccctactcacgctccccaggactcaatgcagtgccggggggtggggggaacaacacgtgctcccttcacactccaacggaggctcacgcacggtcgcggcagccagctgcatgcaagggcggtgcatggtggtgcaggcactcgcctcgtgcacaccagctcgcttcacgcgtccaggtttgccagcatggcgtagtctgtgccggtgtcaaagcctaggagtgccgagtgcacgggcgtgcccttcttgcccttcttcttccccgccggcgccttgggcaccttctcccagccggaggcggtcgcgcccgaggccttggcggcgggcggtgcgggcggcggcgccacagtgcgggggcccaccgtggcggccgtggccaggctggcggcgggccgggcggggttggcggcggccgcctgcttgcgtgctttgcgcgctttgcggcccatcatgccggccttctcctccagcctgcggttcatgaactcggcggcaaacttggagacctgcacggcaataaggatttatgagggggggtaagaggaaggttgatctggatcagaccctggaggagcggggggggaggggtgtggtaatggggcaaggagtcgtcgcccggagccccttcccacgcctttccgggagtcgggcatgctgcacaccccaccgagcgctgtgcaggggcgaccatctgcgtccctcgccgaccctctcccatcattctgtgnnnnnnnnnngaataaggattatgaggggtgttaagaggaaggttgatctggatcagaccccggaggagcggggggggaggggtgtggtaatggggcaaggagtcgtcgctcagagccccttcccacgcccctccgggagtcggccatgctgcacactccactgagcgctgagcaggggccaccacatgcgcccctcgccgaccctctcccatcattctgtgattggcagggctccagccctgtggccgcccaacacagggcatacggctccacccccctgcttggctgggcacagcctcgagccccacgcctccccaccaaactcccgcaccgcttcagtcttccccaggtagagcgtgaggtactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggggggtgtgagatatgaggggcgttagcagtgctcaagatgggaattggacccacaggacgcaggggccacagcgctgcatggcagctttggagactgtgcttgatcagcgtatgcacacgtcacccatcgccaggtgctggctggatccagaccccnnnnnnnnnntgggggtgagatatgaggggcgtttgcagtgctcaagatgggaattggaccctcaggacgcaggggtcacagcgctgcatggcagctttggagactgcgcttgaccagtgtatgcagacgtcacctatcgccaggtgctggctggatccagaccccaccgtgccccagcacatgcaggaggcgcccatgccaaagctcgtgccttctcaacccagaccccagccgacacatcgctcaccggacagcgagctgggcctgtcgtctgtcgcctcggccgcggccggtgtcccgttccccaccggcttggaggctgcgggcgctggctgcgcgggggcggcagcagcggcggcagcggcagcgggccgcggcgcgactgcgcgctgctgcgcctgcggcacggcc

SEQ ID NO: 41605 - DNA, 61 bp, Chlorella protothecoides
gctggccaagcgcaaagaggccgcggcgaatgccgccggcagccccgccaaggggcctcgg

SEQ ID NO: 41606 - DNA, 94 bp, Chlorella protothecoides
aagaccggtgcaaacctggtgggtgatgggaagcgcaaaaactgtgccttggcgaacacctagcgtcaagcattgttcaagccgcgtactgctc

SEQ ID NO: 41607 - DNA, 126 bp, Chlorella protothecoides
ggagggggagatggcagggggggattctggagtagtggctgtgaagccgtggcgagtgcaggtttaaggacagggggccacggtgtccaacacccatggccccaggcaggctgagggagcgtgggg

SEQ ID NO: 41608 - DNA, 99 bp, Chlorella protothecoides
ccccctgcacaggcctggctgtggctgggggagcaggagatttccatgcaaaatctcgtacactgagatcaggtccttcctccctccctctcccttccc

SEQ ID NO: 41609 - DNA, 61 bp, Chlorella protothecoides
agcggcggctcattagactgggtgctgggcacccgggctgccataggagctacccgcagga

SEQ ID NO: 41610 - DNA, 79 bp, Chlorella protothecoides
aacaccgaccccaagtacgccagcccacagctgaccaagtgcgggaccaatggcgcctaccctgaggaggtgagactcg

SEQ ID NO: 41611 - DNA, 61 bp, Chlorella protothecoides
tttcctcggaatacgcaggctcggcaaccccccatcggtgggcggactgtggtgaagcggt

SEQ ID NO: 41612 - DNA, 96 bp, Chlorella protothecoides
ctccggccccgacacagctgcgttcctaccgattcgcggcccaaacctctttggaattgagtctgcccacaattcccaaggcggccacaccccaaa

SEQ ID NO: 41613 - DNA, 494 bp, Chlorella protothecoides
gcgccgggccccgcccccgccgcctgcgcgtcggggtcggcgctgcccagcgcgtcgcagagcagcacccagaggccgcggcgcggcgatcgcagcgcggacctcagcccgtgcgtctggccgcggtccgaggcgcgcggcggagccagcacctcggtcagcaggccgtgggtgaggtcgtgggcggccaggcgcccgcccgcgacgaggtgcgcgtagcgcgggaagcgcaggcgcgacaccacgccgtcgccgtcgcgctgggtccagaagccgaggctggagtgcagggggaggagggcggggacgcccaggcaccccgccgggtcgcccgcgtccagcagctgcagcgtgggcaggcgggaggggggccggggctcggcgccctcccccccgcgcggcagcgccgccagctcgccgctgcgcgggtggaaggccacctggcccacgccggccgaggagggggtgtgcgcgccgccgccgccccccgccag

SEQ ID NO: 41614 - DNA, 8749 bp, Chlorella protothecoides
  modified_base (2087)..(2096): a, c, t, g, unknown or other
  modified_base (2281)..(2290): a, c, t, g, unknown or other
  modified_base (2533)..(2542): a, c, t, g, unknown or other
  modified_base (3833)..(3842): a, c, t, g, unknown or other
  modified_base (4218)..(4227): a, c, t, g, unknown or other
  modified_base (5464)..(5473): a, c, t, g, unknown or other
  modified_base (6054)..(6063): a, c, t, g, unknown or other
  modified_base (6486)..(6495): a, c, t, g, unknown or other
  modified_base (7048)..(7057): a, c, t, g, unknown or other
  modified_base (7686)..(7695): a, c, t, g, unknown or other
  modified_base (8495)..(8504): a, c, t, g, unknown or other
ccagccgttgggccgacgcgggtcggggtccagccccgcgccggcgggcgcgggcggcgcgcccgccggcgcgtccaccaccgcgggcaccaccatgcccgggccgtagcgcctcgtcagcagcgcggacaggggcgccgaggctgcggccaggcggagcgtggccgccaggtggtgcgcctgggcccagagcggggagtaggtgcccagcggcacgcgccggctgtccaggccgtagacgcagggccgcgccgcgtcctcgtcctcgaaggtgccgtacaggcggtcccagacgatgagcaccccgccgaaattccttgggggggggtgtgggggagtgggggaaaaggggtggagagggggagttggacatcaggaggggaaggggctgagtggggaggcggtgcgacccggggttgctccggcatgtctgggtgggggaaggcctgatcatcgcccccacgccaccgcggccgcccggtccggccgcattgctgagccccatccaaggtgccatgcctcctctcctgggcccgtctccccagccacaacccaggcccccttggctcccacgatgccctcccacacctgcggccgtagttgcgggcgtggtgcactcggtggtgcgagggcgtgttgaacacatactcgagcggcgcccacagcttggggatcatctctgtgtgcacccagaactattggtgggcaaggggatggaggctcagagagggcggagggacagcactccatcccacccagctggcttggcagggggagagcatgcggcacgcagcagaggaaccccgcaccggcctgccgccagcacccatggcctcgcaatcaggctgacctgaatgacgacgttggcgcctttatgtagcgcaaacaccttcagcggtgcaaagggggccaggatcaggtagtacgcccagctgtactgcaggcgcgaacccggtgggtgaggaagggggggtgttggagggcggccgacagatgggaaggtcagcacccaagctcacatgatggtgatcaggcactggtcgcaaggatccaggagctgaacaccctggcgagccacaagaggctggttgacgccagggctgccactgcccagtgtcccacccaggccccagcacacatgcactgcccccccccgacacacaccacacaattgcatcgcccgcccaccatgctctcgcccactccctggcgcagggccgtgctcaggttgtagtcgttgctggagtggtgggtcacgtgtgccgcccagcccaggttggacatgtgggctgtccgatggaacctgaggggggatgtgtcggggctggttttggctgggcctcggcacattgaagcttgcatgctcatggccaagcatcatgaccgagcacccggtcctaggctgctggggcaggcgcccgcgatgcccgacacccaccagtattaggagtgatccacgatgaggaagcctagcacctggtgcagccagccgagctccaggtcatcggggatgatggcgacccgggacctcagccaggagtaagggaagatgaagagtgccttggtgaagacatctgcacgatgaccatggcggatgagaggttcctcttgacaggaattgcgggtcggcatcgcattgcaggccgcttgggatggcccatatactcgacccccgccgaagtgtcgctggaagcccaggagggccctcaccgaggaacacgaggaagaagccggcgctcaggttcgacagggactggcgtagattgtacaccttcttgccctggtaggtggagaccgccagctccaggagcatgaacagcacgaagtaggcgctgctggccttgatggggtccggaagctcgtaacccaggtgggcttccggatgcagccatgcgcgaaggagcgcccccatattcacaaatcagggagctatccgagaaggagctgggggcttacgctctggtcagcaagcggatccctgatgagcacgcattgtctgcagccattcctccgcggcctgggggacacgtcggatttttaagggagcgcgcttggggccaatgattctatcggatgcaccacagcannnnnnnnnncgggggacacgtcggattcttaagggagcacgcttggcgccaatgattctatcggatgcaccacagcagctgaccatgcatgtgtgcaagcacaacacaccattaccaccaggggagcaacgtgcaactgaggtcccactcttggagctgcaccacaagtggtacaatgtcctttgatgcaaggnnnnnnnnnncattaccaccagaggagcaacgtgcacctgaggtcccactcttggagctgcaccaacaagtggtacaatgtcctttgatgcaaggatgagagattcacacaagaaattccgagggtgcaagagcagtgctgccggtgcaagctttggaaaggcataactagcaggcagaaggatagttcaggagttaactctcaggagttgggtgtgttgggtccagaagaagtgtcgggttttcagtcatcnnnnnnnnnnattcgagagttcactctcaggagttgggtgtgttggatccagaagaagtgtcgggttttcagtcatcaggagatgtccctggcggccggcctgtacattatttccccatgagattatttcttaggtggagggggtgacttcttcttgggtggaggcggcggcgacttcttgggtgggggcggggcctcttcttcggtgggcgggtcggcgacttcttgggtggggccggggggctcctcttaggtgggagaggcggtgacttattgggtggtggaggcagtgggctctttttggatgggggagacggcttcgccttacgcggtgaggtcttttttgggggtggaggcgggctcgtcttaggtggtggggttgggctcttcttgggtggcaagggtgggctcttcttaagagggggagggctcttcatgattgggggtgaggggcttctcttcggtggaggagggaaactctccttgggtgggggtggggggcttctcttggtggaggagggaacctctccttgggtggggtggggggttactctttggtggaggagggaaactctccttgggtggggttggggggctcattgtgggagggggagggggactctccataggaggagggggggagctctccttgggaggagggggaggaatgttgggtgatggtggtggagtggtcggcgggaagtcacctggactaggaggtgggcttgtggaagtgggtggcggaatggttggtgggctgggtgtcacgggtgatgggctgggagtgggagaagaaaccggggtcggaatgcttggaggggggtaacagggcgtcgggtggaggcggtgaagggtagggcgccaaagcgatcgcagcagaccggacacttgttccatcccggacccaagcagtcgccctaattcttcccttcgaagttgtgctctcaatcggcgttatctccgcgacgacagtgttggttgggcgtatgtctagaatcttcacttgttcattgtcgaaggtaatctcgaaggtgaccatatcaaccaggatgctggtcacggcctccatgctgcatacgatggaccgatccttgggctctgtacaccaggcatgtgtcatggtgcaggtatgacccgcgggaggaggggtcgggctcgccgtttgctgcgctgggggatgaaggtcgcaactcgtgagcaatgaactgggttgtacatatacaaccccaaaccgaattaatttgcgagcctcgcaaaatctaccgcgtttataagcaaagcatagaacgcaagagtgaggnnnnnnnnnnaaatcaatttgcgagcctcgcaaaacctaccgcgttaataagcaaagcatagaacgcaagagtgagggccaacgttagtgtgaagggttttgagccgaccatccctcgcgacctggggagacccatgattcacttcgacctggtcagtatgatgatatctttgaccaattcgaccgatgctaccagaacctgccagcaacaggtgtttcttgtgttgcataaatgagcactttggagtaggtgagtcctcgttatgttcgcaaccggcatcattttccgccggatttcgccgtgacacaggcgaccggagtgccaggcactcctacatttgcaattgacttacaacaccattgttccaggctactcatttggttgnnnnnnnnnnaccagcaacaggtgtttcttgtcttgcattgatgagcactttggattaggtgagtccccgttatgatcgcaaccggcatcattttccgccggatttcgccgtgacaccggcgaccggagtgccaggcacaccctacatttgcaattgacttgcttcaccattgttccaggctactcatttggttgtgtaaaaatggctgagtatcgctgcaagaccaatctgctgccttccaggtgtttgctagaggtatcttgagccggagacagcaccggagccgggcaccccaggccaggccggggtgactgcaaacaaaggtgcctgtgcatatgcgcccacgcacacaggaagcgacaagtttgcttccctgatacaatcttgacttttatggtgtaatgtgatgtgccttgggcgtgaagaaattgcctgcggtgtttggcttgtcagcagggaggtcagccgtggccggattcgttagtgcagtcggattcggtgcgcagcaataccataaggagtgtcgcgtactcagcacgagatctcgttcatcttgagatgagaggggtaaatgatccgtttctgtgtaattacacttgattcggcagcttggtccacctggtgcccctctaggccagtgtacggaatccgccgcatgggtcgggtgcccatgacttggaaggtatcatttccacgaccgcagatgttggattctcttatggagccccgatcgatgagtctcttggtgcctcatcccaaagtaataagaaccgacccatcaccatgtacatccatactaagctgctgatgagtctaagcaaccacgcgctgacacagtacgcgatgcggcatgcaaaggcagcgctagctgcacgcatgacaaccagccaaagcattttcaaaagggcaactcagtacttcatatccaacctagctttgtaatccaaggaccccaaagcaccgcccaacgacaccgccctgcatcacttgggcggaaaatggcataccatctgctaccaaagagcacatgaagcaccccggagctgcactgattgatcaacccaaaggtcaaccaggcagtccagattctggcagcggagttcacaccaaccttgaaaggcgcgggacgaccgggacgcactgggaacggccagaatgagtgctgtgctgcccaggctcacagagcggctaccagaggctagtccccatgagcggcccgtcaagagcagctgacgccgtcagtgannnnnnnnnngctgggaacggccagaatgagtgctctgctgcccaggttcacagaacggctaccagaggctagtccccatgagcgacccgtcaagagcagctgacgccgtcagtgatctcgtcttgaggcgggaattagcaggaggtgatggcctggaagaggaggagttcgtggccaaggtgcttttgtacctgccgtggattccacctggatcaacgactagaccagtacccggacaggctttgtgacggacgcaagtgccagagcgattcaggtgttgtgctagcctccaaggtcccggttgcatccagcggacagcactcgatgccggtctaatctgatatgaagttctgacactcggtatattttcgatcacataagaagattcgcacaccagtcagcctcgtgcgttgcgtttgcaccgcctggcgttcagggtagggaagttgaggttgggagcgggaaggggttttgctcatggagctccccttttggaacagagatatatgtgaaccaatgggaatgggttcaggacgaatgacgtggtaagttgacgaattacagtccccgggatggccgagtgtaatgcnnnnnnnnnnaagggaagttgaggttgggagcgggaagggggtttgctcatggagctcctctttgggaacagagatatatgtggaacaatgtgaatgggttcaggacgaatgccgtgataagttgacgaggtacagtccccgggatggccgagtgtaatgcctgggcgatccaaggcaccatctcgagcaaacgcgcgcgaggacaccatcgtcaccataaaatatgtgtttactgagaactctgtgaagagtctaacactttcctccatgttttgtaatttatcaacgatcctgacacattagaggagcttccagcgctgagcactagcagacttcaacgctcctcacggccagctccaagccccgtgcggaaggctctcggcctggagctcgtcataatagagtctcccggttcccaggcgctgatgcggnnnnnnnnnntatcgtcaccatagaatatgtgtttactgagaactgtgcgaaaaattaaacactttcctccagactttgtaatatatcaacgatcctgacatattagaagagcttccagcgctgagcaccagtggacttcaacgctcctcacggccagctccaagccccgtgcgggaggctctcggcctagagctcctcataatggagtctcccggttcccaggcgctgatgcggggctccatgccccctccctcccctcgggctccccgcagacgggaggctgttctcgaggaggacgagtgggtggcgagagcagaggccatcatagagcgcgacttcttccccgagctcagcaagctggaaggaaaagtgcagtggctggaggtacgcacgtgcctgtggagtgtggtgcgctgtgaatgggtgcagcctggtcgtgcatgggcaaggggcatgcaaggtgcccagcggatgccagcgccccccccccaccaccacacacacacgtgtctcagaccatgtttaactctgctcccacgccacaggccgtgcgcagcggcgnnnnnnnnnntgtctcagaccactttgaactcccactcccacgccacaggccgtgcgcagcggcgacccggcccgaatgcgcgaggcgcaggtggcctttgcggcccggcgggcgggcctgcgcccgggcacctcgacgggggcgggccccctcttcactccgggtggcacgggcgcacgcgtcctggctggcgacctgcccaccccgaccggcgacctgtccaccccggccaccctccacggcggcgcaggcggcgcacgcgcggcgtccggcgccgcccaggcccctgcgatgtccctggacgctttcatgcgcgcgcacaccagcgaggacaacgcctccttcgccgcgctgctggccacggagaatgggaggagggcggaggcgtacgccgccattgccgccccgccggggtctggggaacaggccatcaaatccgccgcgggtccccggccgaccgacgggttcggaacgggggggcagccctccgaccgcctcgtgcagtggcggtacgagcccaggaacgccctcatgtacgatgggagccagcgggatgccctggccctctcaggtgaggattcttcgtcatgttgagaagttgtgtctccccttgccctgcaatgccgctgcagcaaccnnnnnnnnnngctcatgtacgatgggagccagcgggacgccctggccctctcaggtggggactcttcgtcttgttgagaagttgtgtctcccttgccctgcaatgccgctgcagcaaccctcactcacatcccctaggttccccgccgagccccctcaccaccagtcccacctcccttgctccacacattcctcagggaccccccccttttcctcccctgcacaccctatccacagataaggagcgggcggcgcaggtccagggccccccaaaggccatcaagcaccggaacacgcggttcccgggtccccaggccctctcctcctgcggcgacacaacccccgcctccagcgccaccgggacgcagcccgggtcacctgggacgcggcacggcgccgcctttgtcggcgtggacggcctgtcctaccccgtgctggccacgccctcctttgacccgggcgaggccacgcccttcatgacctggggcgacatccaggccacgcccctgcgcatcgaggcagaggacctgcctgcaggggatctcaatgcaggtacgggccatggtctattcatgtcgaagcgggagcaagtttatgttttccgagccatgaacgccgacgctggatggccgccgggagccggtgctgcgtgggatgtcgctcgtcgctgcatcctgcgctgccatgctgccatcctcgccaccgcgccgtttggccagccacgcgtggaatgtagagtacctccaccatcaaaccctctcctcctcctctgcgttgtgtgcccgcaggcgccgccaagttccacatccgnnnnnnnnnntgggagccggtgctgcgtggaacgtcgctcgtcgctgcatcctgcgctgccatgctgccatcctcgacaccgcgccgtttggccagccacccgtggaatgtacagtacctccaccatcaatccccctcctcctcctcctctgcgctgcgcccgcaggcgccgccaagttccacatccgcgagtcgtcggcgcgcgagcagacggggcgcgacctggcgcagcggtccgccccggcggcgggcggg

SEQ ID NO: 41615 - DNA, 68 bp, Chlorella protothecoides
cccccccccccccccccccccccctcttctaacccaactcacagctgtggggcacggtgaagctgaag

SEQ ID NO: 41616 - DNA, 8265 bp, Chlorella protothecoides
  modified_base (436)..(445): a, c, t, g, unknown or other
  modified_base (1550)..(1559): a, c, t, g, unknown or other
  modified_base (1928)..(1937): a, c, t, g, unknown or other
  modified_base (2448)..(2457): a, c, t, g, unknown or other
  modified_base (2525)..(2534): a, c, t, g, unknown or other
  modified_base (2724)..(2733): a, c, t, g, unknown or other
  modified_base (3420)..(3429): a, c, t, g, unknown or other
  modified_base (3824)..(3833): a, c, t, g, unknown or other
  modified_base (4178)..(4187): a, c, t, g, unknown or other
  modified_base (4624)..(4633): a, c, t, g, unknown or other
  modified_base (5090)..(5099): a, c, t, g, unknown or other
  modified_base (5324)..(5333): a, c, t, g, unknown or other
  modified_base (5634)..(5643): a, c, t, g, unknown or other
  modified_base (5835)..(5844): a, c, t, g, unknown or other
  modified_base (6491)..(6500): a, c, t, g, unknown or other
  modified_base (6654)..(6663): a, c, t, g, unknown or other
  modified_base (7197)..(7206): a, c, t, g, unknown or other
  modified_base (7842)..(7851): a, c, t, g, unknown or other
caggggtggcgccagcatggacagcgctggtacagcagccgatctccgagatcactgcatgtgctccgctagacagggcgggactatggttccttcggcacggccgccctccccctcatgatctgattgatgcatcgaggtccaccccaaatcctccaaaacctactcacgctggcagaggacttatggggggcatcgaccaggaagagcaggggtaaccccggctccaggtcctgcctctccgccgcgcggtccagcaggagcacgaggagcaggatgcgcttgagggccagccgtccgaggaggtcctgtggagcatgatcacggaagggggcctggtggacaggcttgagcgccgcgcccgacgggggggttgcactgcagatgtctcagggcacagatgatttcatgctcggagcagaggatatgtcttgcnnnnnnnnnncagatcgcggaagggggcctgttggacaggcttgagcgccgcgcccgggggggggttgcactgcagatgtcccagggcacagatgatgttcatgctcggagcagaggatatgtcttgcaaatagagccccttgaagaccgaccccgtacccccagcagctcacgttgtcctccttccgtgccgcgccggcgccgactcgcctgggtgccgccgcatcctgacagccagggtcgcagagcacgtgctccctaacaaaagcctccagctttgagcacccgggcttggcgactgtgactgtgcggtcgtgcgcggagtgtgccctggaagcagcctcttcgagtccagaggtgcgcgtttctcagagcgttcctccctcgagacgtgcgtgcaaaagatccaccgagctgctcaacacagcaaaaccgatctgtaatctatagacgctgttcccccccctcctgctgctcaccgctgtcgacggacttgcccaccaccacctccagggctgcggtgagccagaaggggtggtaagaaagcaggactcgtcgcgccgcagcctgctccttgacgttgcgcaggctcaatgcctggattatcagcagggggtaggggtgagggttctggcgtctctggagcccgtcacagctggacacgcgaccagcacatcagtggccttggtttccccgggcatttccccctaatcattccctggccccagctgcaatacaccacaccgtttgccagggccccgtgcccagcacccacctcgctcccaatccggagctgaccggtgtcgatcctggcctccaccctgaccatgacgtcctgcaggcccgcgtccgcctggtacatggaccacagccagcctctggtgcgggccgccagccgcgccatggcggcgttgctgggctcggccgtgctgggcgccagcacggcattcacccaggcagtgaaggtggcctcctggcggtccatccatgccctgcacacaagcaggtcaagcgtgcgctgggacatgcaaggctgaaggaggggggatgggggctgtagggtccgggcctcccgccacgacccagcatcgagcgctggacctccagggaatggnnnnnnnnnnagggatgggggctgtagggtccggccgccctccacgacctagcatcgagcgctggacctccagggaatggtgtgcagcagcagatgcagccatgtcgtacaccgaacaacaaagctccattcccaccacactttgacatgcccaactccccacaactgcgcacgtggcatggaaggcagtcagggtgcggggccccgatggaacctggcgtgggttgctgcgaggcgtgcccactgctccgcgggggtttggtgtgccggcccggggagtggcgttcctgtcgggggtgcctgagccacctcgcagagccatgtgcgacactagcggggtgagggggagtcccggtccagggccgcggccagcccttgnnnnnnnnnngcactagtggggtaagggggggtcccggtccagggccgcggccagcccttgacgactgaggggtgcactgccgggcactgacgagggtggggctcctccgccctggctgcagactcatggggctgagtgggaggcgggggatgcatggaggcttcatgtgagacgccctccctgcagaagactgaagagcaggggaggccatggcatcggattgggactcgagagcggcccgcatcgtggagccacctgctcccttgtgagatggaggggccagtcctcgggggggggtgtcgtaacccggatccattgcctaggcctaaccggcacgaggcgatggggcagctcttcgatgtttcccacgtaatgagaagtaatgtggcttggtcgcgctccccagtgctgctcgccccgtcgccggtcgacagaccacgacggtgggcaaccaggggccgaggccgtcagacttgatcgcggaggttcaaacgagcccccgcgcagtatgtatagtagnnnnnnnnnngggggccgaggccgtcagacctgatcgcggaggttcaaaacgagcccccgcgcagtatgtatagtagnnnnnnnnnncatgcattggtatcagtgatgaatacacctgagaatccatcaacaaagccccgtacccggagactcgtggctgggaggatgtgctgcgcggtctgtccccaaatattcaagccccaagatcaggaaaccaaagcactgtgctcatgcaattgatacgcagggagtcgctgcgaatcgctgcgcaccttgnnnnnnnnnnaatgcattgatatcagtgatgaatacacctgataatccatcaacaaagccccgtacctggagactcgtggctgggaggatgtgctgcgcgatctgtccccaaatattcaagccccaagttcaggaaaccaaagcactgggcccatgcaattgatacgctgggagtcgctgcgaatcgctgcgcaccttgactgcccaccagctgggtaatcagggtttctgagaggatctgttgatcttgtggctcctccttcgtgtgccagtccgcgattcaaggcgagggcctggagccatggggcgcccagactcctggccagaacacagcacgactctccttgcagcaggtgagcccctctgcatgatctgatcggatcgcatattgcatactgcatccaccgcacctcactctcactctcccaatatgcccacaatcagctgtggctggctatgcgacctacgtgggaagctacaaggcctcgcgatggctctccccactcatcacagcctcttattcaaacctctctgaaaagaaaaagctcgagtgggatgccaggcgagttgatcaacgccagtttcgcgtctctgactgtcagcccccggcgcacctatcccgggcatcggagggttttctcgagcccctttcacctgctcccgtcgaaattccaacaggcatcctcctgggtccctnnnnnnnnnnattttgcatctctgactgtcaggccccggcgcacctatcccgggcatcggagggctttctcgaggccctttaacctgcacccgtcaaaattccaacaggcatcctcctgggtccctccgcaggtggccctccaccctgcacgccgtggtgctcagttctgctgctgggtatctctttctctgcacagacctcttctcagactccaaggtttgtctgggtgtgcttatcagtggtggggctgcttgccagagttatggactcatgcatgtgcccacgcaatggagttcaggaaataggggccagatgcacttgtgattggatttgagatgcggtgctgacctttaaatcctcgtgcaattccttactccaggagtttggagaccctgtcatcctgnnnnnnnnnngctgggtgtgcttatcagtggtggggctgctcgccagagttatggaccaatgcatgtgcccgcgcaatggagttcaggaataggggccagatgcacatgtgattggatttgagatgcggtcctgaccttgaaatcctcgtgcaactccttgctccaggagtttggagaccctgtcatcctgaggatgaacccactctcaactgcagccctgggctactctctgggttacttcagcaccgacttggtcatgctctacgcccactacccggatgtgagtttgtggacgttgcgcctaggcgggcgaatgcagaccgcttctgccaacccttgctgccagcctgtgcnnnnnnnnnntgaggcgggcgaatggagacctcttctgccaacccttgctgccagcctgtgcatagccaggtgcaggctggagggaacaccccccctgcttctcgtctcccccttgcagtttggaggggcggagatggggctgcaccacgtggcggcttggatgtcgattgctgtgtctggcatccacgaggagggtcacctctacaccctggcgctcctcggcacggagtgcaccacgcccttcatcaacgcgaggtggatgctggatgccgtggtaagcacagggtgttgatggggagagcggcgatgttgctgttgctcaggcctggaagcttcagctgccttcaggatatggcaatgtttcaaggaccggcgaaggagtccgctcgagctgcacatttacacccccaagccgaattctcgctgagaggctcacccctcccacnnnnnnnnnnccaaggaccggcaaaggggtccgcttgagctgcacatttacacccccaagccaaattctcgctgagaggctcacccctcccacgcccaccgttgtgacagggcttgaggagctcgcgcgtctacctggtgaatggtctggccttggtggcagactggtttgtcatccgcatcctactcttcctctggttcttcgcgcacatgtacacgcattcagatgagatatatctggtgaggaggcgcggcttggatgcggtggtgaactgggcctggacccaggacgctggcgcgaggggcatggattgcgctcctcacacggcatgcttgcgtctgccccagggcagcactcatgatccatgccgtacccaacacactccctatcaccgcttgcaccacaggtctccgtgccgtgcattctcctcctctttactgtgccggtgctgctcttcacgctcaatnnnnnnnnnncgcaccacaggtctccgtgccgtgcatcatccttctcctcactgtgccggtgctgctcttcacgctcaatctcttttggttcttcaagatcctggctggtgcacggaagctgcttttcggcggacgagacagggtaggattgttggggcaatggggggttacaatacgatcgccacccaacagacacttggacgctttggctgcacactgggctcctgggtcttnnnnnnnnnntggcggacgagacagggtaggattgttgggggagtgggggtttacagtgcgatcgccacccaacggacacttggactctttggctgcacactgggctcctgggtcttaccccgtgctgattggcaggtatgatccagtcaggaagcactttcccacgacctagtccatgtgttggccctctacatatgctccctatccaattcccttcctcacacagactctgaagccagaggagttggactccagcattggcgcagcgtttggcgcgcccaggcatgatgttagcaaagataaggatctnnnnnnnnnngtccctgtgctcccctttcaccttgattttatgacagcattgacagcgtgcctgtgtttgtgaagagcctgtgctctcccccacgatgtactgtagtgccttggaccgacgtaggtgcactcggaatagagggaagaaggagccaagagaattgtgccgcgggcaaacacccttgctccatcaaggaccacnnnnnnnnnnacccacgatgtactgtagtgccttggaccaacgtaggtgcactcggaatagaggaaagaaggagccaaaggaattgtgccgcaggcaaacacccttgctccatcaaggaccacatcaggtcagaaaaatagtgctaccaccttgcagcctgcagcggtgcagggagatgttaccactctggcagcgccatcacccaaagccacggtgctggtcatgctgccgcggcggcctctggtcgagtccctgctcatgctcctcctgggcagcctgacgccgctgcgccctccctgccatcctcttctgtagccggtccttgagcccctgcatgtctgcctcgtggtcaatgacgatcggctgccggtcatcgtcagcagctgaccgcgactgtgggggaccgtgcgagagagcgccgctgtggaagtctcgctggtgcccgtggtgggtgtggccatcgtccatgctgcgctgggccgccagcagggagcgtatcagctcggggatgaggtcacgcagcgatttgtggaagttggctttgcatgcgcctgcaaaggcgggctgctccagccctgcaggcagaaggagatgtcggcgggacccagtcaaacaaagtcagggacccctgacccgccgagttatattgtgtaggnnnnnnnnnngttgagatgatcctcagaacaggtcgcattctcaaccagattgctttgtgaagaccacagacgaactcgaggtgtgcaagctgcatcagccttcgctcctccttccctcttcatccccgccccttgcctttacaagtacctgtgaactgcgtcnnnnnnnnnntgaggtgtgcaagctgcatcagccttcactcctcctcccctcatcatccccgcccgttgcctttacaagtacctgtgaactgcgtccagtgctggcacaccacgatcatctccttccctgtcattccagagaagatcaccaccgggggtgtgtcggcaggaacctgaggccaagcagcggatgggtcacggggatgcccgagcactgtccccaggccctcgtcggagtccagttgctctggtgtggcaggccacactgcatattctggggccatggcattgaaccaggtttgcacagccttgccgtcatccttggacatgccgacaaggaggatcgcctggcaggggagggagttggttggcaggggggtggtctactacacttcatttgattacccggtgggtgtacaatcatgcaatcaacgcaaccgactcgttcttttcttgatgagtgcctcgtcacccgtggacagcgtcttgcctttggtccatatctgccgacaccttctagtttgccgtgctcatgctcgtcgtnnnnnnnnnngttacccggtgggtgtacaaccaggcaatccacgcaaccgactcgttcttttctagatgagtgcctcgtcacccgtggacagcgactcgcctttggtccatatctgccgacatcttctagtttgccgtgctcatgctcgtcgtgatgttggtgcgtgtgctctgcagccctcaaaggggccagtcgtgcgcaggttccatttaatttccagacattggtgaagtatgagccacgagcctgcgcctttgggtgctggtgcgaggtctggacccgggtttggatgtattgaagcgcctgagcgctgcgggttgcaacgagcgtctgcgtgaccaggcccaacgccccggccgctaccattgcgacttttactcttcaaaatctccccacgagtaaattggctagccctcccgccgatcaccgtcccactatacctaccaatgcctgctacggagcctgactgtatcgaatttcgatcttggcgccttagaccgacttaaaaccgagcgccagcactgtcagcagcacgttcgtgacttgcaggagacatgaattatttcaagtgaaccaaaatccgaaatcaatacgtgtcgatttgcaggactacgcgaggacgggtgtcagctttcaaattcctcnnnnnnnnnntatatcaatacgtgtcgatttgcaggactccacgaggacgggtgtcagctttcaaattcctcgtcgatctgcaccattaccttacccggcgtgcatgaacggcatctctgtgagccaagcaggactccggcagcagaccctcggtcgattttttgccacaaaagctaacagcacatcttccaaagaggatctgggtcggggggcctggatcctgcatcgtccgtctctgtggtctgccagtgaggcagatgccatcaccgaccacctgatctggcgcctgccctggcagcagcgcgaggtcctcatccatggtcgcagggtgctgcagccgcggctcatcgtgtatcaggctgcggatcccagacttagttacacttacagcagggtcaagctgaacccagaaccctgggatgc

SEQ ID NO: 41617 - DNA, 72 bp, Chlorella protothecoides
tgaccagccacctggacaaaggggggtgggatttggtgtgtgtgtttgtgtgtgtgtggggggggggggggg

SEQ ID NO: 41618 - DNA, 61 bp, Chlorella protothecoides
tgacgccttcttgggtggaggcggggacgcttttttgggtggtggtggtggtgacgccttc

SEQ ID NO: 41619 - DNA, 80 bp, Chlorella protothecoides
tcctcggctcccggggggccgcctgctctcaggtgtttagatgggatggttgatgtttcgatgctgacatcgagcatgcc

SEQ ID NO: 41620 - DNA, 61 bp, Chlorella protothecoides
cgcatgcaatggcgcggatgcttctaggcgagtcgctggccgtcgttgatgctgcgcaaga

SEQ ID NO: 41621 - DNA, 61 bp, Chlorella protothecoides
cgaggcggattccgagtctgccggagactcggaggacctcgggagcgagggggaggagtcg

SEQ ID NO: 41622 - DNA, 71 bp, Chlorella protothecoides
aaggccgtgggacgggcctcccgggcgaaagaacgcttgaccagcatgagcatgttggccgctccgttcac

SEQ ID NO: 41623 - DNA, 818 bp, Chlorella protothecoides
  modified_base (370)..(379): a, c, t, g, unknown or other
gcgccgggcgccgggcagagggccgccgctgggaggcccggcccggactgcggcgtggcgcccagcacgtagtagggcggcttggtgccgggcacggcgggggcgggcgccaggttgctggcctccgacacgctgggcgccgcgctgggcgctgctcctggagcgcgaccctccacattcaccgtcttgcctgcggaagggggaggcggggggagtgtgtgtgtgtgtgtgtgtgtgtgtgtgtgtatgcggatgggagatatggggatgtcagtcgatcgatgtggtcggttgggcgactgcaccacccacagtgtcgggaaggtgttcaacccctgtttcgcccagtcccaaactccacctccccccnnnnnnnnnngggggatgtcagtcgatcgatgtggccggttgggcgactgcaccacccatagtgtcaggaaggggttcaacccctcattcgcccagtcccaaactccacctcccccaccccctcccaaatgcacacacacacctctgacgatgaggcggccgttcagcacgcgtcgctccggcggctgcgtggcgtacgccggcggcaggttctcggcggggtcggcgggcgcgacgtcggtgtctcgcaccagctccacgcccagctcgcggcggtcaaactgcacgcgcacgcaggtgggcgccaccgtcagcaccgcgccgtcgtgcagctggcgcgtggccgggtggcgtgccgtcacgcgctgcccgacgcccagcgcgcgcggcatggagccggcgtcgtgcgcggagtctgcagacggccccgcggccgggaggggcgcggt

SEQ ID NO: 41624 - DNA, 61 bp, Chlorella protothecoides
gggcacggcagggggcgtgcccgaccggggggcctgtgggccgctacaatgcttccattca

SEQ ID NO: 41625 - DNA, 61 bp, Chlorella protothecoides
gaagcaggccgaggcaggggcgcaggtgggtgccgccaatggcgcacacaagccctcacct

SEQ ID NO: 41626 - DNA, 98 bp, Chlorella protothecoides
aacccctccctggtgcacgcccagtccatcatcgccaccctggccatccaggtgctgctcatgggcgcggtggagggctaccgcgtgaacggcgggcc

SEQ ID NO: 41627 - DNA, 83 bp, Chlorella protothecoides
tgccgggtctgcagcagcctgtgaggagggaaatgaggagggggcctccaataacgcagcccaacccctgggagtggcgccag

SEQ ID NO: 41628 - DNA, 63 bp, Chlorella protothecoides
tgcccgacgctcccactcacaaccaccccccttcccctcccctcacagcacctgggacagcag

SEQ ID NO: 41629 - DNA, 61 bp, Chlorella protothecoides
acaaggtgaggagagacagctctcaaaagtgcactgtgagggcctggggcatcgcgccagg

SEQ ID NO: 41630 - DNA, 416 bp, Chlorella protothecoides
  modified_base (187)..(289): a, c, t, g, unknown or other
cctggcccaccacctggggccggggctgggccagcgggctgttggggcgctgggcgccgggccccatggtcccggccccgccttgggcgccgcccctcagggcgcctacggcgccgggtcccagggcgcgtacggcgccgccacccagggcgccttggcctccaaccccggggcggcggcctacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcagcaacagctggccgcacaccaggcggccgccgcagccaacgcctcgggcggcggccggccgcagggcgcgcaccagatcccggcctacctgcaggcacaggcggcgctggccgccgccgcc

SEQ ID NO: 41631 - DNA, 114 bp, Chlorella protothecoides
cagcttgggcaccatcacctgtggtgggtgtgtttgtgagtgtgggtggggggggggttccgacaggggtctttcgtcgtgcgaggtacctgggtcgggtgcagccgcatgcat

SEQ ID NO: 41632 - DNA, 61 bp, Chlorella protothecoides
cgcgcgatctccccgagtgtgttacggaggaggagttgttggcatgtgtccccatcgtgaa

SEQ ID NO: 41633 - DNA, 122 bp, Chlorella protothecoides
gggaaagaggtcgtctggggacgaagagtgtggggggttgggagctggcaaactccaccgagctccgtgcgcgcactggggcacggagggaagggtccagcccggcagtacatcccagctcc

SEQ ID NO: 41634 - DNA, 108 bp, Chlorella protothecoides
ggccggcccaacgtggggaagagtagcatcctgaacgccctcatcggccaggtgggtgtttttttgtggaggggtggggcccgcagaagacagtggcggcgggggggg

SEQ ID NO: 41635 - DNA, 61 bp, Chlorella protothecoides
gggggcggaggtgccaggaaccaggccggcatccttttgtgccttttcctggggcgggcag

SEQ ID NO: 41636 - DNA, 67 bp, Chlorella protothecoides
ctttccacggagcgattcgcgccaaccaaaacctctgtaccatgcttttaccctctattccctggcc

SEQ ID NO: 41637 - DNA, 79 bp, Chlorella protothecoides
ctccttgggcttgacctgggcgccctgggagtcaaaggcccccgcctcaaagaagaagctgatggcaccggcgctgtcc

SEQ ID NO: 41638 - DNA, 61 bp, Chlorella protothecoides
cccggccttgcccctcctgctgagcgcgctgggcggcggggtggagggccaggtcctggct

SEQ ID NO: 41639 - DNA, 68 bp, Chlorella protothecoides
gccgtggagtggcagaactggagcttccaggtgggcttctcctggcgcgagggcctggtcctgcacgg

SEQ ID NO: 41640 - DNA, 74 bp, Chlorella protothecoides
cccccccccccccccccccccccccccctgtcacccatgttaaaagggcacgccctgggaccaggagtcggcca

SEQ ID NO: 41641 - DNA, 72 bp, Chlorella protothecoides
tcccgtacctgagtgatccgacacttgccggccatcttggcgagctgcgatttcgaaaacatggcgttactt

SEQ ID NO: 41642 - DNA, 30552 bp, Chlorella protothecoides
  modified_base (110)..(279): a, c, t, g, unknown or other
  modified_base (373)..(382): a, c, t, g, unknown or other
  modified_base (543)..(552): a, c, t, g, unknown or other
  modified_base (1331)..(1392): a, c, t, g, unknown or other
  modified_base (1574)..(1583): a, c, t, g, unknown or other
  modified_base (1676)..(1685): a, c, t, g, unknown or other
  modified_base (1778)..(1887): a, c, t, g, unknown or other
  modified_base (2331)..(2340): a, c, t, g, unknown or other
  modified_base (4671)..(4680): a, c, t, g, unknown or other
  modified_base (7348)..(7357): a, c, t, g, unknown or other
  modified_base (8542)..(8551): a, c, t, g, unknown or other
  modified_base (9127)..(9136): a, c, t, g, unknown or other
  modified_base (9722)..(9731): a, c, t, g, unknown or other
  modified_base (9828)..(9837): a, c, t, g, unknown or other
  modified_base (9966)..(9975): a, c, t, g, unknown or other
  modified_base (10493)..(10502): a, c, t, g, unknown or other
  modified_base (11126)..(11135): a, c, t, g, unknown or other
  modified_base (12767)..(12776): a, c, t, g, unknown or other
  modified_base (13144)..(13153): a, c, t, g, unknown or other
  modified_base (13394)..(13403): a, c, t, g, unknown or other
  modified_base (13805)..(13814): a, c, t, g, unknown or other
  modified_base (15173)..(15182): a, c, t, g, unknown or other
  modified_base (16114)..(16123): a, c, t, g, unknown or other
  modified_base (17888)..(17897): a, c, t, g, unknown or other
  modified_base (19165)..(19174): a, c, t, g, unknown or other
  modified_base (23659)..(23668): a, c, t, g, unknown or other
  modified_base (24661)..(24670): a, c, t, g, unknown or other
  modified_base (28353)..(28362): a, c, t, g, unknown or other
  modified_base (29362)..(29371): a, c, t, g, unknown or other
  modified_base (29492)..(29501): a, c, t, g, unknown or other
  modified_base (29825)..(29834): a, c, t, g, unknown or other
  modified_base (30052)..(30061): a, c, t, g, unknown or other
gggctggaggcgctgcgcgccgagctggacgccgaggcgctggcggcgctcgacgccgcgctggccgccgagctggccgggctggaggcgcggctgggggggggccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgatgggtgtgttgttgctggtataatggcatgattcccaagcgtcaggcccccggtggcagctcccacgagaacgccctgtgcagacccnnnnnnnnnncgacttccgcccctccgacgccgacgccgtgccgggggaggggccgggggagcgccccacgccggcctgcgcgcaggcctgcgcgacgctggaggagctcatgctcctggccgagcaatgcctgcacggccccaaccgcgagtccatgcaggcggaggtgnnnnnnnnnntgcaggcatgcgcggcgctggaggagctcatgctcctggtcgagcaatgcctgcacgggcccaaccgcgagtccatgcaggcggaggtgggcatgagatgctggagcacttgagggacggacgatgggtgtgttgttgctggtacgatagcatgattcccaagcgtcaggcccacggtggtagctcccacgagaacgccctgtgcagaccccgaccgcctaccctgcctccctcccacaaacatttcaggtgggcctgcggctggtggatgcgctgcggcggcacatggcgcgccagcgcttctgcccgctgggcgcgctgtgctggcggcgcgacctgcaggagtaccggcgcgctgcacgcgtcgacggccccgcagcgcgccagctggctgagatggaggcggaggcgggcctgctggtggtggcgcccgaggcgctgccgggcctggtgggcagcacgctgggcctcaccgcgcagcgtgcccgccaggtcatcgcgctgcgggcggactggggcgaggccggcgcgcgcggcaagaggctggccgccctcttcccagacgaccagcggtgctgagggcgggaagcttgcttgagaggggttgtcatggcctgcaccgggaccccaggcttgcgctcccttgtacgaccacgcatcccttctcctgggtgacagcagagtgcagcttgagatgcgcggcagatgcagcagcaaggtctggcatgcaaaggcacgagggagcagggtgttggggccgcccgctcaggcacagtgcnnnnnnnnnnnnnnnnnnnnnnnnnnnnnnnnnnnnnnnnnnnnnnnnnnnnnnnnnnnnnngtcgctggagatcctcgcccaccgccgtcagcacctccaccggccgcgccgttgcctgcatggcgatgcgaggaagggaggacgcgctgtggcgaggtcaggctgaatgaaggcactttttggtgccgcgacatgcacatgcaacagcctgccctctccgacatcccacgcacgggcatgannnnnnnnnnatgtgcccagccagcgcagccaggagctcgccggctggatgactaccttcctccccgccgcccctactccagcctgcagcccgacatgattcnnnnnnnnnngtgtgcccggccagcgcagccaggagctcgccggctggaggactaccttcctccccgccgcgcctactccagcctgcagcccgacatgattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctgtggcgaggtcaggctgaatcaaggcacttcttggtgccgcgacatgcacatgcgacagcctaccctctccgacatcccacgcacgggcatgactgtggcgtcgcgggagaggcccagcctgagccgcgcctgcgggcccgagaagtgcacaaaggcctcgcccagggaggtgccgtcggcgctgtacaccagcgtcacatccgactcggcctgcactccgcagccctgcgcacagagggacatgaacggatgggtgtgagcaccggcactggattaaactcggacaaacatgtgggtctgttgcacgagcaacggctgcttctcacacgtgctgctgggccattgccacgcgatcagcaacacacccaggaggctcgaaccccagggagctcaccacaaagaagtcaaggatgtctttcttggtcacggtgggcgtcnnnnnnnnnnatgcttctcacacatgctgctgggccattgccacgcaatcagcaacacacccaggaagcttgaaccccagggagctcaccacaaagaagtcgaggatgtctttcttggtcacggtgggtgtcaggttcctgaccttgacgtacccctcctccagcggtacctagtcatgtggttgtgaggggtgttggtagggctaatagaaagaagaactggagtattttagtccccagggggggtgcatgcattggaaatgctcgctgtgtacatgttaaaatcaaaatcaatcgtgccaacacaatgcctcctcacagacaggcccaactcccaccaacccctttttccccctccccaacctcctcagcgttgatcccggcggtgagcaccgtcgcgattcccggattcgtctggaccagagcggagagcgcggagttgagggctgccagccccgtgatcccggcgggcaggggtgtcttggtatacaggcctggcgagaaatgcagccaggggagagggaagggttgtcaggtaagtttctggacgcccacgaaatacgatctctgcccatgcacagcctcccagaagtagccacctttgcccccacatgtacacacaaaagtctcggccagagtttcccgcgataaaaccccgtccttccctcgcaccaggaagtgggatgccggcgatgctgctgtgccgcgtgacccactgcccggcgcgcgagtcttgccactcctcgtctggcacgaggactgccttgatgacgttcccatccagcgtgcgtttattgaagatggccaccgccgccttggcgtcttccggggtcgcataccggatgtacacccgcgacggcatggcatcctgcgcaggtgggaagctggggtgttggggggcagggtcgcaggcagtgtgctgggcattggaaagaacccagcataccctctccagggcagtccagatgacaagggggatcacgctaggccgccctcacgctcttcccctccccaagttcattgtcctcgcccgtgatcatgccgcccttgccgagtgcatttctataacgaaaccccaatccacacacccgccatacaatagaaagcgcacctggatgctcgtgggcggcgctggcacagccacctcctcgacgcggccatggcgctccgcctcctccctcacttcagccgccagcaccgctcgatcctctgcctgccgcaccccgctcaccggaagcgcattgctgagcagcaaagtctgctccggggccgccgctggtgcagtgggacccgcggctgctgcagcggcgggcgccgcgctgggcagcggcggcgtccagcccttgggccggccgatggtgagcgggcgtccgcacagctccaccaccttgtccatgctcagcgccaccagcgtcatctcctcggtgcggaactccacaaaggcgtagcgggagggaccctccatggcagagcgggtgacagggggcgcgttgacggggtctggggtcaggtgggagaacgcctggttgaagaactcgcgcagcatgtcggccgtgacctggcccatggccaggttgccgatgtagacctcgcgctggcgcttgtcggtgaggccgccggccgcggcgccgccggccgcggcggccagccccgcagcgccaccgcccgccagcatctgctgcgccagaatctgcttctgcagtgcggcctgctgctgggcggccaactgctgctgctgcatctgggccgcgaagctggcctggtccgtgtcggtgaccaggaaccggctgcggcgctcatagtcacggctgctgctccgcctgggcgggggcaggagggagcgaggtgggtgggtgaggggtttggcagagcccagcggggaagagaggccgcatgcgagtcgtatagccacgcatgctcttcatcaacgacaccttacctccgttccctgctcctgctgcggccccgacgcctgcgatccgggctcctggaacgggaccttgccatcgcctcctccctctcactctgggccgagtctatccgaccagggcagcagaggtagattgtttatgcccagataatatatgtagatttactcgagagagccctttcaaatgcgtcctttcaccacggctatcgacatggcgctctgattgacccacacccggtggcggggggttgcggagatgcgagcatgcaagactgatcagatgcttttggtctcctgagcgaccgctgctgagttcttctacactctcaataacattcatttatcttcaacaactggtattgcagttgacctcagcatgattggtcggtgttcgacttccctgcgtgtatnnnnnnnnnngaataacattcatttaccttcaacaactggtattgcagttgacctcaccatgtttggtcggtgttcgacttccctgcgtgtatggaggagctggacgtcaatgtcgccctggcctgcgttggatcaacttgttgatcctgtctccaacgaggccatcaggtgagacatctcgagctatcgatatgaagtctgaagctcgcacagtcatgtgcatcggccgtgaagcgtggaactgtggcccagccaaacctacctcttcccaccacacaggctggtatcccacgcagcagccagcacctcctttcagagtacagccagcagcactccccgaccccaacccgcatcgaattcagtgcatggtcccagcaccgtgaacgcccgggaggctgccaagttcagggagttggcaggaaagtggtgggacccccttggccccttcaagcccctccaccacctaaaccccacacgcgtggagttcatggtccagtccatctgcgatcacctggggtgggtggaggggcgattggttttacggcgcggggggtgatatgaggttgccaggggcaaacccattccgtcattctgcttgcagtgtgtgcccagcccctccttgcctggctacacacttggaagcagggcgccctcgcctgagcaaggtgcctgctgcacatcctacgcgcgcctctctgctgactcagctacacacccatgcctcgcgcgtccctgcaggctggatgcatcgctgcctgcgccgctccgcggcctggacattttggacgtcgggtgcggcggcggcatcctggcagagtcgctggccaagcgcggggcggcagtgctgggcatagacgtgaacgaggaggggctggcggcggctcgggcccatgcccaggccgacccccggctggccagcctctgcagctaccgcgcgacgacccttgaggacctggcggctgctgggaacaagtttgacgtcggtgaggctgctgcatccagggaggatgtccactcgaggaagggaggggtgtgcaggtgccttggtgacagggccggggttctgcggatgtgcacacatcgggctgatgcactgccctgtaactgctgcatcacatcccccactcgcccgcacatcccatccctcactgtctcccacgtcccccccatactccagtcattgccagcgaggtcatcgagcacgtgcgttccctgccgacctttgtgtccagcctggcagagtgcgcgcgccttcaggcccccgtcctggtcaccaccctgaatcgcacccccgcctcctacatggctgccatcgtgggggcagagtacgttctgcgctgggtgcccaagggtgaggcgctgagagggtgggaggggaagaatgttttggtggatgtcggcagggtgcgtgaaggcaaggtgggggcttggatgtgctggctggcgtgttcaccgctgctcctgcttcggagtacgccgactcaccccctccctgtggcaggatgcatgcttcagcaccttgcctcccatccaacgtgtgtgtgcacggtatcacagcgaccatggctctgtgcctggtcaccctcgtccactcaagttcttccctcccaccacccaccacccctcccactccacaggcacccaccactggagcaagttcctgacccccacggagctcacccagctgttcagagcacacacccctttccacctctggcagctggccggcatggagttcaacccggtcaccggcacctggtccctgggcaccaacacctccatcaactacgctgcctgcttcacgagggcggcggcgaacgcaccactggccgaggagccggcggagtacccaccccccgaacagtgaccggggggtgtgcagagcctcctggggggttgcagtggagcgtgtgcgtatacatcttgtgccatgactcccaaccatggcacgcgtcatcgacaatctttcaaagaatgccaggccagccatcaggcctgctgctcctgggcctccccggccccgctctcagaacccatacgctgggcctccaggtcggtcagcaggttgacgcaggcctcctccaccaggtccagcacggtctcaaacccatctgggccgccaaagtaggggtcggggatggtgtccaggcccccgaagcgggcggagcgcaggtagcgtggcaggttctcgatgcggggcagggcggcgacgctgagcaggccctcgctgcgccagtgctccgcggcctccagcaccgccagctcgttcctgcgctccatcaccaggatcagcgcgctgtccaccaggtcctccggcgccaggggccgggagatggaggtcaggtagtagcccctgcgcttggccgcgcgggccgtgcgcttgtcggaggggttgcccaggttgtagttgaagccgcccttgcggtaccagtcctcgctgccgcccccggtgccgcaggagtcgatgaagtagtgctcgctcaggcccgcccgctccacctcggccctgaataccgcctcggcggtcggactgcacttgggaaggaatggggagggaggtaggggggagggtgggcagggtgatgatggcagatgaagcaggtcagtgctcgtgggcacaatgcatccgcatgctggagagtacccacatgagggccttgtgtaccgtctgtgggcnnnnnnnnnnccagtgctcgtgggcacaatgcatctgcatgctggagtgtaccaacatgagggccttgtgtaccgtctgtgggcaccgaccccttgaccgcaggaatatcgaatggagaggccctgcaaagtccgctgctggcccgcaccagggcccctcaagattaccttcggcagatgttcccaagacagacgaaaagaatcttgcgggtggcagaattgcccgcagctgcccctgcagctgcgtgcacgactgccgaatgacgcagccctccacccactgtactggggcgcgggtgagtctgtgccatgacaggccctacacgggcaaggcggcaggaccctcccagactggccaccacctgcactttgatccaagggacaccttgagctcccagtcgcctcgaatcggagcataaacaggcaaattctaaattagcggcattacaatgactgttggcaccctgatcggcgataagcatgggttgattcacatgttgggtgcggaccaatctgatgcacatatgtacgtgataatccgtgatcatcaccccacaatccgttgctcaccatgccaagtcaaccctcagatgcctggattgcgagaggagaaagaatgtgagtgccgatgttaccgaaatcctgcaatgagtcactcgtggccccggtgatgaaagtaaagaggtcctcatgatctgactgattttgcgcgcgcgcgccgctctcaatgccgagttcatgcaattgcttgcttgagtctcttcggtgaagtcgcagggcgttggttgagcggagtacatcccagacgagacgtattatcaataccacgaaataaatttagagtggagggagtaaccgcggttgtttactcgtagttcaggcccctcgtcgcaccttgccacagtaagcccagcatgcagacggcgtcctcttcaggactgctgttctgcccctacaccggttccatgctggtttttgacccgctgaagaacatagccagctccaagctgtctggctacacccggcagctcgacggtgagcattgggggtgtttctgcagggctgcttgctttgatgcagactgtgggtcgtctctcctgcacactcatcattcctaaactccgtttaaagccaccctcccttccctccacagagctggaggggcaagtgaaggtgacccagacgaccgacatgnnnnnnnnnntctgcacactcatcattctttacctccttttgcaacccccctcccttccctccacagagctggagggccaagtgaaggtgacccagacgaccgacatggtggactttgctcgccggtttgggctggagatgctggtccgccccgagtcggtgaagaaggaggaggacgagctgctgcacggccgcacgcgcgccacagtggacgaggtgtgccctgactgcggggcgcagggcatggagttctacacgctgcagctgcgctccgcagacgagggccagaccgtgttctacgagtgcacggaatgcggccacaagcatagcacaaataactagggagcgtgcatgaagtgcaacagtatatatgctgcccctcatttgggtggctgcctctctgtcctcaagtccttgccttgctcgctccgagtgcagcctactcattcgtcgtgtcacaagccgacccttgccatggagggggaggcatggaggggcggcaggcatgcatcgtgccgcagcccacagtggtgttctcaccaactggagtccatccagcatctcattccgcacactcttgacaccnnnnnnnnnngtgcatcgtggcgcagcccacagtggtgttctcgtcaactggagtccattcagcatctcattccgcacactcttgacacccatctgcactggccgccaaccctctgcgcccgccttcacctccaccctttcaagcctatcgctggaagctaaggtccatggacagggcctgggaggggtccacctccaggaacacgtcctcgatgccccgcgcgatggcctcgtcgctcagcgcctcctcccgcgcgcgctcgtccgagtgcaccgccgcctctgccagccgctccagcacctccgcctcgctctgcacctcctccgccaccgccgaacccatctcccccaggttgggcaggaaaaggcggaaccaggggtcggccatgatgtcggagaaggaggcacgcgccccgctgtcgatgaccagtattcggtgcagcagggccaggcactcgggcgagaccgggggcagcgcggccatggctgccgccacgtcatgcgaggtcaggtcctggatgtgccgcagcctgccattgtttgtagggggaagggggtaggaggtgtctggtgtatatatgtgtggatgcgtgccnnnnnnnnnnctgcgaggtcaggtcctggatgtgccgcagtctgccattgtttggaggggggagggggtaggaggggtctggtgtatatatgtgtggatgcgtgccnnnnnnnnnnccagctgttctctccactccacactacactcccccccactggccaatggacctaaagtccctggcactcacgagacacagcccggtcctgcagtgaaccccctcactaaacacacctgacttggtggtnnnnnnnnnngcagctcaagggagcgccacgctgcctccgcgcactgccaccagatcctcacagctgcctggcagctgttctctgctttccacaccacactccccctcactggcccatggacctcaagtccctggcgctcacgagacacagccggtcctgcagtgaatcccctcactaaacacacctgacttggtggtcggcgtcggtgaaggggtaccgccccgccagcatgcagtacagcgttaccccgcaactccacacatccgctttttctttattatttggggaaggtggtggcgaggcatgggtcaggtgatgtcgtcatgaacccaacacctcgcaattgtatcatccctccgtggtgcgtagcacggcaggcagggtccatgctcgtgtatctggcgcgcatgtctcctcaaaaagaaagcagcccacaacacgcgtgcatggctgcaccccactccacccctcctcctacagcagagccctcaatcagcttcccgcatcgtcacatttacccatcctannnnnnnnnncggcgcgcatgtctcctcaaaaagaagcagcccacaacacgcgcgcatggctgcaccccaccccaccccccctcccccagcagagccctcaatcaccttcccgcatcgtcacatttacccatcctaacccccatacctgtgtcataagctgtgacgccgtggctcttggccacctcggggctgatgtaggcggcggtgccgacgcgcgtcttgggcaccgaccccgtcacgatgttcttagagtagccaaagtcgcagattttgaggatgggtatctggtacttggtgttcagcaggatgttgcccagcttgatgtcgcggtgcgcgatgttcaggtgctggtggcagtagttgagcgccaggatgagctgctggaagaagcagcgcgcgagccactcgggaagcgtgccggcccgttccacatactgctgcaggttgccgcccccaacaaactccatcacgatggcgagatactggggatagttaaaagagggtgtccaggtggagggattgtgcagggttgcacaagggggggggacttccaagggggtccgcgcgatgcgctgggacctgcactagcccacttctcggcagcttccaacgcgatgcagcccacgctgcaannnnnnnnnnggggaggtgacgtcgagggggtcagcgcgatgcgctgggacctgcaccagcccacttctcggcggcttccaacgcgatgcagcccacgctgcaacatcgcgagggcaagtggagtctcgttgaccagttacgtcatcccccagcgcacctggggggtcacaaatacctccttgaacgccacgatgtgcgggtgggagaggaggcggtggttgatgatctcacgctccacaaagcgtttgtggaagcgggagcccagctgcaggaacttgatggccacatcctcccctgtgcaagcagcgatgattggggttgttgccagggatgctgggccaggtgagcagccggtggagctcggcgctgggcgtacctaggacaatgcccttggacactgctgacactaccgctggtcccactccctacacagcccgccctgcagatctcccacctgtgaagcggttgcgggcgtgctgcacccaaccgaatgcacctgtgcaggggcgcgggtggggctggtgggatggcaggaaatgagggctttgagtggaccgagccctggcaggggtctgaccttccggcatccgatcgaccgctgccacccgcacggagctcacctcgatcgagatcggctaccttttcgtacttgttattgttgagcaggggctcgatgcggtgcatcaaggaggtgggttgcgctcccacgcaccactcgagctcccgtccgatctgtggtggcaggcgagggtgctaactcgcacgcatgcctcacatcttccaggaacctttgggtgacccagtggtgtactgagggggaactgggaagggatgtagggacaggcacgacttgattcacattcgagccgtacaatctcctcgctctggctggaaagatccttcagatgctcatcacacagtcacggtggcacaacacaccctcggacatcggggaggatgatgcttgctcacaggtggctcagtgtacaacattgttctcactagagggcaggcacggcggcaggagcacgcttggcgaccgactctcgcacatgccggcgggcccactggtcgtaatgcacgatctcctccagactgggtcgctccaccagctccaccctgtgaaaatgtgaagagggggcatcaggctcccattcaagcagatgtggtgtggcagaagcaatccggccatcagcagtgctgcagggctcgagatcctgggattctttcttgacagcctccccccccccctcatatactccccaatgccacgcaagcaagcgcacctgtgtgcttcacacgctgcctccaccactggcacgatgtccaggtacccaatggcctcctccaggaacagctcgacggccgcctcattcgcggcggacatcactcccgtcatggtgccgcccgcccgccccgctgagtaggccagctccatggcggggtacttggcatggtcgggttgcctgtgtatatgaataggaatgggaaagaggggtctgcggggcgaggcgagcttgggctcgcaggggtaagccaagatcctgaggaatgttaccacagggcagcttagggactgagcatcgcaaggtagcgctcctgcagggatcgcaagggtccaacaggcagatggacccagcnnnnnnnnnncgtcaccacaggcagcttagggagtgagcatcgcaaggtagcgctcctgcaggaatggcaagggtccaacaggcagatggacccagcccatgtatcccaccccccccaagcccacccacacctgaaggtcaggttcccggccttgacaaagtccaggcgtggccaggtgacctcggagcagggcactcgctccggccaggacatggtgtagaggatggggagccgcatgtcaggccagcccagctgagccagcaccgaggagtcctgggtctcgatcatgctgtgcacgatgctctgggggtggatgacgatgtcgatgttgtcgtaggacgcgccgaaaaggtagtgcgcctcgatcacctccagtnnnnnnnnnnactctgggggtggattacgatgtcaatgttgtcgtaggacgcgccaaaaaggtagtgcgcctcgatcacctccagtcccttgttcatcagcgtggctgggtcgacagggaagaaacagggggtaagttttcggagaattatggcaacgaggcatggtctagcttacgaaacgatatgcgaaaatgcacatgcatcacagtgagccagagtgcagcacccagctcctgttgcttgaactccnnnnnnnnnnaaaaagatacgagaaaatgcacatgcgtcacactgaaccacagggcagcacccagctcctgttgcttgaactcctgctgaggcacatgaggaatcccccatcccaagaatgatgggtaagcagtttaattctagcccgtccctcctcaccggagtcgatggtgatcttcttgcccatggcccagttagggtgcttaagggcatcggccaccgtcaccttgggcagctccgagacggggaggtcgcggaaggcaccgccagatgccgttaggatgatgcgtcgcagccctccctcgggcaggccctgtgccgttggaggtttggggagggagggcctggaaccttggtgttggaggcggggttggaacattcggaggaggaaatagggggggggtgggggtgnnnnnnnnnnattggaggtttggggagggtgggcctggaaccttgtttttggaggcggggttggatcattcggaggaggaaaaaggaggggggggtgtagagacaggggcctttatagattcatcccaagctcaaactcagcaacaggcatgcctccctggactcctccgctccacccatcctcccacccaccccgtccactccccctcccacctgaagacactggaagatagcagagtgctcggagtcggcgggcaggatgctgacgccgtgcttggccgcggctggcagcaccgtcggcccccccgcaatcagggtttccttgttggccaggcagatgtccttcccggcctcgatggcggccatggtcgggcgcaagcccgcgcagcccacgatgcccgtcacgcaggcgtccgcttccgggtgggccgccaccgcgtcgatccccgccgcgccgatctgaatctcgggccgacggtcgaccccggcggcgtccagcgccgcctccagtgcccgcgcccctccactgtcacgcaccgagacgagtgacggcgagaagcgcgcaatctgctccgccagcagggccacattcccgcccgccgccagggacaccacctggaagcggtcggggtgctcggccacgatgtccagggtctgggtgccgatggagccggtggagcccaggagcgagaatttctgggtgcaggggatggggtggtgcgaggctggtgagtgcgggtatcatggtgccccgcggagctgggttgactgggggtcgacgccgtgaggtcgcgctgcaacacaggcgaatgcaccagggtccgtgctgcaatgcgggacggatcggacgtgccttgggtccggtcctggaggcggatttctccggcaagacgacacggcctggccaggcagagggcactggtgcagctgatgcactcacaaccctgcacgttcgcggccgcgcagagttggggagggtcggcccccgggtgttgaactgtgctgagcagcgcatggcgagctgcaccccggaagcaagctgctgtggctggatgcccgcaaccaccaacgtattcgaattctacccgtgagtggtggtaaacgcgtatctgtggatcaatgatgaagccttgcgcggtaacccggcatggatatctgaggggggctggtctcacggagacatgaaacgaatcatggggtttgcgggtggaaggggtacatgaagtgccccctcttttactccctgcaatggaattctgaaccctgatatcagacctcctctcactgcggatacagatgaacagcctctgagaccagtcaaggcgattttgcattcccgaggccactctggatgttgaaaagtagcagnnnnnnnnnncgggatttgcgggtggaagggttacatgaagtgaccctcttatactccctgcaatggaattctgaaccctgatatcagagctcccctcactgcggatacagatgaacagcctgtgagaccagtcaaggcgattttgtattcctgaggccactctggatgttgaaaagtagcagcccgctcaatggaacactggagctgtgcattgccttttgcaacacatggtctacagagcacttgagtatcacgtccatttacatctgaatgcagcagagcaataaatagtgcaaggaaggatcttgcagaaaaacagtgcaatctacagttcataggcctgctgctcaggagcctcctgcctgccagtctcggtggtatcattcctcgtcgacaccagtacctccggtccagatattcgttgcctccctgcctggagttcggcgatctcttcatccagggatgcgacacgggccgtgtattttgcgatgacagggatgttgtcctggatggcctccttgtagtcgcggtcaaattccttgtcgagctctgctttcagctccgcattggactctttgagcttgcacaccgccctatggagcctgtttcgctccgcttgaagggcctggagcagggtgtttccctcctcgcatgcaggctggcccatgctgatatatcacgccacgggtctcgacgctgcttgccaggcgatgcacgagactggcgagtgtattgcttgcttctagggggcattgtgagcggaagattgacaggtgttcgcacttgcaccccatcatcgcgcccctaaaccgatctcagtcgatgcagcccgagcgcgccccaggtgtgcgggggtgtgctgagggtggatgcatggaatcccaacatccacacgcccatgcctgtcacctcgcacccacaagctcttggcagttccatgnnnnnnnnnnccgcgccccaggtgtgcgctgagggtggatgcatggaatctcaacatccacatgcccatgcctgtcacttcgcacccacaagctcttggcagttccatgggtgacctgattcgtcgatccagatactctgtcccatcccctgacagcagccagtgctgctcctcattccccctagattacatacagccagtgctgggacatgactgcactggagggtcccctgcccaccaaaggttccctgcgcgaaaggctgctgccctgcccgccggctgtccgccatgcgtcccaccgagcaccgtctcccatcacgaacacgccgtgcatccgtcacccacgccgccgcgcggccgacagctccttggtcagctgcacaaaggcgcccacgctggcctccggcgtgccctcgatcacgccatgccccaggttcatgatgtgccgctccggccccgcctcctccaggcacgccgccaccccggcgcgcacgtcggcttcgctgccgaagagcagcatggggtccacgttgccctgcaccacgacgtcggcgcccagcgccgcgcgcgcgtcgcgcatgggctggtgccagtccacgccgaccgcggcggcgggcagcgcgcccagcgcggccagcttccccgcgcagccgttggtgtgcagcatgaccggcacgccggggcaggaggcggccaggcggcgcaggacccgctcagtctgcgcagcgccgtgggcggcgtgctgcgcgggggtcaggtggtgcgcccaggagtcgaagagctggagcacctgcgcccccgaggccacctggtactccaggtgcgccgcgatggcgtcggccagcctgtccatgaggcaggcgagcagggccgggtcgcgcagcatcatggtcttggtcgcacggcagttgcggtccgcgcgaccctccacgcagtaggctgccagggtccagggcgtgggcgcgaagcccagcaccgcggcgccgtcgcccacctcggcgcgtaggttgcgcagcgtctcgcccacgaagggcaggctggccgcggggtcctccaacgggcgcagcgcggccacggccgaggcgtcgcgcaggggggcggcgatgagtggaccgcggcccttgatcacctggaactccacgccgatggcggggaggagggtgaggatgtcggagaacatgattacgccgtcggggtgaaaggcgtgccagggctgcaggctcagctccgtggcgatgtcggcgttctcggaccgctccctgaaagtatacttgtcggagaacctgccgaaagggaggggggaggaggggggaggtcatgggggtgtgggcagaggaattgggatgagaggtgaggagaagcagaaactccacagagcggaatgggacttggcgggacaactgtttgaatgggatctgcaaggcagactggtgcatcgcacgaggcggatggataatgggtcaggcagcgtgccgaggagcaggtggttctgagagcaactctgtgcacacgccagccagtccctgcagaggggtccacatccccaagcacattccgcgcccctaccactcacttccgaaaggcggccatgtaccgccccgcctgccgcatcagccagaccggggtcctctccccacctggacaagggctggcacgtcacctgagttatgcctctcgaccttgggggcatcctaggatctcgcacggaggccgcatcatgatacacatttaggccaagaaatgtcccaccctgccaagctacgcactttctcctnnnnnnnnnngcaggggctggcacgtcacctgaattatgtctctcaaccttgggggcatcctaggatcttgcacggaggccgcatcatgatacacattaaggccaagaaatgccccaccctgccaagctacgcactttctcctctggcgacacgaagcagtagggggtccttggtcgcctggctggcgcctgggtgcgcctgttggggcgccgcgacgcttgagaccgtgcttggtctacatctcgaaaccggattggagggtgtgtaagcccttgccgtgaagggtctgttgctcagcatggtggccacgcttcagtagcacgctctcggaggttgcgcctggcgagggtgaccaatgccgtcgacagggaggccaggatgtcacgtcatgcactcttggggagaaatcagctgtctgtcagaagtttctaacaatggctagcattgacagccgcgtttggctttgtgacgctgcagaaagtcacatgcactgcatgcgaggattgatccgatttcgcgggtttgcagggaattggattaggcagcatggacagcatgcacttgccatgcacaggatttcggaagatttcgcgttccattaccaaaagcatgaaccaatcaagcatactgggctcaaagcaagcagttgtaactgtagatccccaaacctccagcgaatcccagcatggcctcgaggatggcatgccgcaccggcccagtgtcccaggtggcgtggagcactgcgcgatcccgggtgccgagggtgctcccgaggaccacgagatcaacgcgctgcagacccatgcgacagagcgccgcagtgtccgcgctctacggcgctgtctggaacacccccaccgacgcctacttgacgctggtggggcaggggattgcatgtgttttggagaagcagtgatggcatggagctcaggagcagatgccttgtcatatctcagaatctctaatggcattatgaatgcatatgcataaccccaccattcagaacacacaatgctcacacacgcactccattgtccccccagggtctggcacactgtttcgagaagacagacgatggcaagctggtggatcggtacatcattgaacccctgtcggcaaattccctggagtgcatggcaaacggtgcggacctggagtgtcagtggcggatggggatggtgtactgttgaccgccgccgggctcctctttttcaccccttgatgaatgtcgggatgcatgatacatcccaggacgctgctcgatcatggtgcctccnnnnnnnnnngacgtcgggatacatgatccaccccaggacgctgctcgatcatggtgcctcccgaccgcctttccacctattctcgcgactgacctcctccaaccccacctcccacctccatttacctccccaggcggcaagacctgctacaagcacgtattcagcacaaccctggagcaggcccagtcccgggacaaggcagccctgcccgccgagttcgccgaggcccgcttctgcgaggagtacgagacgcgctgcgactccgcggcccgcacctggctgcgcccccacgcactggacaacctgctgggcattgtgcctctgggccaggtgaagagcaacttccagtacagcgtggtggacaagcgggtgctgaactttgagaatgtggtggatgacgatgacaacatcaagcaggacctgagcatcgacgtgtacgggcgcaaggctgcggacgaggcggccgccgcgctggctgcggacggggcgagtcccgttgcggggggcgccgcggaggtggccgaggaggaagaggatgacatcgacgccttgctggcataagggttggcagttctattctttcccttcgcaccgcagttccctttgttggatcgatggttgggaaattttgctgaatgtacatagcggatcttgtattcttcacgtggtgtatacaggcgccgcagtagtaacatggttgctacgggcagcctttcctcatccacgcaccggcaacgacgaccatcaggacgacagacgtatcaagagtgtaaatcccgacagtcaccctcatgatcgattgtatctacgattgggctcttattctcgaccatgattgaggtcggctcgcggaaagcgttggagtcggagccgttccggctgcgccaggcgctggccgaggtcaacgccgcgcttgcacagcagcggcgggacaacgatgcacaggttagggaaattgccttgcatttaaagatgatatcgatgtctttgaacctatgggtcattgtgaaacaatctcgtgagttggcgatcgctgtgccgtgcaggagcgcatgctgcgagctcgggaggacgccatgaagaccaaggacctggagctgcaggcatcgatacttagatttgcacagttcctgcagcaaaatgagggtaagaggagtcgtgctgctcgccgtgttcaggaagagacttcggccgaggaagcggccagggtccgggcggaaaccctagccgccgaactcagggacgcacattccgcggtggagacgctgcgcaaggagctggcgaagattcagaggtgacaggctctggatgctgagacatgttgaacagtcttttcccgctacccgactccacttgagggatatgccggcgactgatacactgcaagcgcatggctcccatgcatacaatgttattccctcccctgatacaaaacgcaagcaggtaccaggacttcctcgtcaaagtagcccagagcagcaacggagaatttgccacccctgactccatcatcgagcgccactctcagctccagaccgcgggctcctccctcatgcgccagcaccttgccaccctcaaggaggtccaggcctgccgctcagccgccgcgacagcgtcagctgctgcgcgggcccaggctcaggagctgcagagccgcctgtcaggtgtgcaggcttcttgccacgtggcgctgcagcgagcagaggccctgcaggcggtggtggatgcagcacaggcagcagagctggtcaggcagagggacgagtggcgggtgaggtggtgggatacttaggcgctgaggctgtgtagttggatctggcacatagggaggtccatatccgaccaatatgatctgtacatctccggctctgagcctttcggtgccaatgtgacaagagcgcatcgcctgcaaacctttacaggggcaagtggccgtggcagacatgtacagcagggtgttgagtcggagcaggctggggcatccgagtgagttgcaggggcaagacgcccagctgaccgccataggccagtttgtggcggacatgaggacggccctggggggactgccaggggaggccatgacgacgaagagccaggcaggctcatgctgtgaggccaactcatccaaagtgtcagcctcaacttgactgatgatatcccccagcatgcctgtggacactggaagttgagcttgaccgggcatgcagactgccgccgtgccactgcatggttgtacacagcgtgccagggtagccagacgcagcgctgactacgcttgctccgggccacagaggtccatgggcagtctgtgatgctcgctggcaccccaaggaaccctgccatcttcgtctccagccgcaactggcctgcatgtagcagctccaccgcgccccccccccacttttcttcaaactcaccgctgccgcctgtcatcccctggcccggctccagtccgggtcctcgcgctgggcggagggcggcgccgcgcccaccgcgcgcccgttgtccagcgcgaccgtggccttgaggcagaacttcaggtccaccagcatgtacttcagcgccttggtccagttcttgtccttggccagcatgtagcggatggactgcgaccccacccggtccccctcgattgcccagggcaggctgaaccctgggctggccccccgggccgccagccactccgcatactcctgcggtgcaggggagggtgggtgagatgcttgtgagttcagggggggggggatcaatacctgtgccaggtggggccttgcaaggcgtacatcgtgtgacagcagtcagccagccccacgcagactctccagcagagttctgctgctcactcagcaacgttgcaaggcaaatcccctttagccggcgcccagtaagcatctgccgcaccgctgcagagcattccctctcccatgatgcaacgcatgtcatgcagcagggtaacgctgggctcacacaatctagggacatacatgctttgagcccctgcaccatacgtctctcatgtgcccaggtgcccgcccgtcaccaccacccccccaggcccaccttgaggcaggcgaggaagccgacctgggccttgtcgtagctggggcagagcagcttggacacggggccatagagctcgtgcgtgccgcgcgcgtcggcgacgcgcgggtaggagcccatgggcagcaggcgcgcggcgctcagctgcgcccctgccagccgcgccaggatgaaaagcagggccacggcggcaccccaggccgcgttcacctcctcccagggcacggggcaggccggggtgcggcccaggcgcaggcccccgatggtgccaaagggccccgagaaccagatgcggaaggcgtcgttcagcacgttggcgcggcgcagcgtgcccagcgcggcactgccggcctgcagccgcgcggccaccgcatcacgctctgctacgtgcgccgccagcgccccttggtgcgcgttaaactcgtgccagtatgccgtctccgcggccgacaggtcggcggcggcggcctccagcgcggccacctccgcctcagccgccgcggccgccgcctccgcctcgcccaggcgggctctgtgatgttgtgagtgtgtggggtgggggagggggagttcaagaaggtttgcatggctgtgtgtcttagtgaaccaagggaaaaggagagagagggaccatgcgcgctgcgccagaagggcaggacaccacccatggaccaaaatccatacgccccccctcgttcgtggcccaccctgcacccagaagagtcccccaaagcccccccacctgccctcctcgacggcccgtctagcagcggccagctctgcgtcctgggcggcggggtccggggtgtcagggggcgcgccctccagcctgcccagcgccacctccagcgccgccaggtcggcctgcaggtccgcggtctgggcgtccagctcccggtgcacgtccgcggcgcagtcggtgcagacggggtggtccacgcccgtggcggcgctggcggcctccaggacgttggtcagcgcgcgcagcgtggcgtggaagggcacgcggggcgcgggcggagctggggggccgcgcgcggtgccggagggcagcaccacgaaggactcctccatgcgccgtgcaggaggatctgcttcggggaattgggattggggtgagggttgggggatgccattcgatggaggaccacatgggacaaaccaatccaagaaacgtgtgtgggaccgagccttgaaggtgcaccacgctcccaggtgcggtcctgaatgcccgtcactgccgccaatcccactcacgtgggctggactcgccccgtggcccatacagagtgtcctccagctgcatgaacgactcctccagcgcagagggcacttcgccggggcccggcagcggaggctccgcatcggaggccgagatgaggatccgagtcttgcactgctgacagaggaagacggtgggctccatgcagagcnnnnnnnnnntggcagcggaggctccgcatcggaagccgagatgaggatccgggtcttgcactgctggcagaggaagacggtgggctccatgcagagctctagtatagtgcgaagggggagctccccgtgagaggacggcgttggcgtcagactcactacatccaatatcccatggtagagatgatgttagctcatgctatgggatgcgacacgaaaatgagggtcaagctctccaggcaaagggttcggcgtgccgggcaagatcacttcctgggcgtcagtgcccgcttcagcgggggcatcatcgcaagggaggaggacgaaggagatggttgatattccttatctttggtctgcaatcccctgaaaaataggaggggaatgcatagtacctggcacgagtgttttctaggatttttcttgcgcgcgcgccccgtgagtaggagaccggcaagcaattatggctgcagatgagcatcaactagacccttggcattctcgttgaaagaaggtgaatcctgcaagcctttttacccaggaaatgccgtgcttgaccacctgatcgccacaggcgccatgtccacggccaccctgccctcgcctcggaccggcaccttccttgaggtctccttccgccggctgctggaggagtgcgaagctgttgtgcagggcagcgacaggtcacagcctgagtttgcccattggccggtgtcgcctctctttcaccacgtgagctgggtgttatgagggtagcctttgctgcgcgcatgaggccatccacacttgcacagtgagaaggcttgagctgacgcaggactccacactctttttttacccttcctcagtacattgcaacgctcgaggagcagctggtcgagctgcagaaagtctctggctcgaggcaagtaccgccaagtgtgtctcgcgatgagttgcctggctgagtcggggctccgcctgaggggaggaggaactgttatacatgccaatgcattgtaggcnnnnnnnnnnaaggcaagtaccgccaagtgtgtctcgcgctgagttgcatacctgagtcggggctccgcccgaggggaggagaaactgttatacatgccaatgcattgtaggcctggtgaactggtcacccacgccagcctgcttgccagctaggacaccccctgcgcaggctggaaccggaggtgctgcgggcgtacaggggtgcggtggctgcgctgcgggcctccctgcaggagcccgcagtcccggccaccttccagggcccggaccctttcatttcagaggatacacagcctgccgagcaggcggatccggccgcgcccccctccccgcgcacgggcctgggcctgcgccgccgcgacggccctggccccgatgccaatgatgaccggggtctagactcccaggcccagctccaggacgcgctgaccgacgagctggcggtgctggccgcctcgctcaagtccaacacgctggccatggaggggcgggtgagggagcgcggctcgctgctggacgccacggagacggcactggaccggagcctggtgggggtgaaggcctccaacctcgccgcgacagccatccaccgcaagtgcgaccggtggtgggtgctctgggtgtgtgctggcgtgcgcgagtgtgcacgtgcgtcgctgtggctggccaccgaccaggagcaccgctggcaaaccttggcctttgactcggtcctcaccttcgtctccatccccatgtcatgacgctcacccacctgcaggcggcgcatggggttctgcctgaccctgctggccctcctgggcatcgtttctgcgtttgtgggcatgtacctgttcatcaagctgaccagcctggcaggctaccgcgcggtgaaggtggtccacgtgacacatgcccgcgggcaggacaggtgggcccctcagcacttggagctgtgaccccaagcccgggcctggcgccaacacgaggtctccgggtgtggttccgcactaccttgaggcgccccgacataagttaatctgggtcctccctcttgccgcagcttgcatggcaggccacgtccgtgtcaagcggcttgtaaggatcgttccatagaaacctgccgccttgtattttctgacggggggatcttacagtacaagcaaaacttggagggtacatactccagcaacgcacattcgagtgcaaaagagatgcggcacacatgcacatctctgcagacagaaacaaccctaccactgcgctcgggacctgagttcggctgcaaactcgatgcacatcttggtgtatgcctggaggtgctgctcccggaaagcctcggggctccaggcccgccgctccagttggctctccagggaagggtgccagacatagtagagcaccgactcgaggcggtccgtctctgcattgagtacagcccccgcggttttcacatactcctccgactcaaattcatccatcaccttgacttcgtgcgcattcagcccgtacagggtgtaacccttgacctaggggtggaggttgggtgcggcctttatggtagctgaggacagggtagccgggcaccgagggacctgccctgctgaccgagtgtttcctcggcctcctgctcatccttgtttggcagactctctcctgacatcacgaccaggaaccattgaacctattctgggtccactcaccgagtcgtcagcttcccctgggatgatcgctgggaagacttgctgggagacacagtagcgccgatacccagtcagcgtggctggcgtgaggtccggtactcggccgatcagtgctcggaggacctcgggatactgcagggtgccatacacgaagatgtctgtcatcaaggcccagccgatggtgaaccggtgacggagtcgctccgaacccagatcaataccggaccgagatgggagtacgaccattcgatgtcagtatcgttcagctccgtcccatcgccagcagggagaggagtgagatccttcgtcgcgcccgcgccctggccctcccagatcactttggcctcacgaggaagtcacgggggtgtcacacatgcgtcttccatcgaggtgcaccattacagcccacgtgaaatcttattttatcgacatgatgctcctgaatgccgcatgtgcgcgtcccgcactgttcaatggtctctccccaagtgtgtcagggtggcgcacacccgaagtgaggttttggggagcgggacgatgccctcgacagcgcaggccaacatccacagcagcacatagcaatggatttgatccagatgatacgattccccgcaccaccaccccccactccggctaccatttcgacggatcgggtgagtgggagagcatgtgtaatgcacactgacctcctcaactggtgcgattggtcccgcctcaccgtgcaggtgtggcagccacgaaggcaaagttgtactgaacaagatcatctccaatcccgctgcatggcatgcctgctcccacttccatcacccagcccgtcaacagccaccccaccccctttccccctcccccagaccgccgcttcttcgaggggtggtactggcgcctgaccctgcccggccgcggccagagctttgccgtcatctactcggtggaggaccccggctcccagcgccccaccagcggcgtgggcgcccagatcatgggcccaaacgacagctacctgctgcagtacgaggagggcaccgccggcttctgggcggacccgcatgagctggcgctgggcaaggtcttcgccgccagccccggctgcgcccccgcggccgcgccctgccccccggagcgcttcgaggccctcgtctccgagggcttccaggtgcagggagggcggcaccaggggcgcatcgtgtcacgggaggccggggtcgtccccggccccgcccccagcgttgcctccgcgcgctgggacttccaggtcacccccaggctgggctggggcagccccgggcagcgccagctctccaccgccggctggctggccgcggtgcccatcttcgagccgcactggcaggggctcatggcgcacggctccgcctcgggctggatcgagtggggaggggagaggtacgccttccagggcgtgcccacctacgcgggtgagcgcctcggcatcgggagggttgctggtggaggggcgggctggtgttgcccccaagaggttgaagttgggtggcggtctcgcatggcacgccccggagcagggtgccgttgtattgagtcaatgagtgtgcagtcatcagtctgctgctctcttccccggcccctatcgcgtgccctccaacacccaatcccacgcacgaccccttgctccccacccgccagagaagaactgggggggcggcttccccagccgctggtgctgggtgcagtgcaacagctttgacggccacccaggcaccagcgtcacagccgtctgtgagtgcggggcgggggaagcttgcctgctcccttgcattcgtcgctcctgatgacagcaggcctcgtgtgcctcccatttatttcccgatggccaccccccgtggccgatgagcggcatgcaccaggctgtttggctggccccaccgtctgctccaggtgcccacactccacacaccgtgggcatgggtccccccccacgccgccccacaggtgcccggcgtggggtccgcctcgtgccggggctggaggagnnnnnnnnnncctgctccaggtgcccacactccacacactgtgggcatgggttccccccctccgccgccccgcaggcgcccggcgcggggtccgcctcgtgccggggctggaggaggacgtgggcctgatcgggctgcacgcggccggcgacttccacgagttcgtgcccaacaagggcgacatcgggtgggaggtggagccgtggggcacatggcgcatccacggcgagaacgcggagcacacggcgctggtggaggccacctgcccccctgaggtgggcaccgtgctgcgggcccccaccgccgacctgggactggcgcccttctgccgcgacagcttctcgggcagggtgaggcgcttgcgatcgagagggtggggggagggggcctgctggcccgggcttggcgatcgtgcccaaagcgtcctcccccgaggggccagagcggccactccggccactcaccgggttccaaacaccatcccaggtgcgcgtcaggatgtggcggcgcggggaggaggggcgcgcgccgccggtggtagactgcgtgagcctggaggagacgggggcggtggaggtggggggcgggccctggtggagcgggtggaaggcccgggcggccatggcggggggggtcaaggcgctgctcaacctccccgtggacgtggaggggctgacgggctggctcccgggaggcctccgccccaagggactctagggtctgtgtcgcgaggcagtcagagactcctccctcgaggtagtcccgctggctcgaatggaaaggtcctcattgtcagcacccgaggtctgcctgattcacatgggaggcacctcacagccaagccgaggtctgccgtacctcggtgatgtgggactactcgcatcaccattcccctgctgcttgcctaggctcctgctgtcaacccccgccttctcctcccctccagcctgcttcctacttgtgtttttccacgaggttgcgtcacccgaaccacccttgccagagacaannnnnnnnnnccccctgctgcttgcctaggctcctgcggtcaacccccgccttctcctcccccccagcctgcttgctacttgtgtttttccacgagttcccgtcacccgaaccacccttgccagagacaannnnnnnnnncatggccgagtttcctactctacattcacacctgctgcccgctcaacagctgtcttgcttgcaagctcgcacactacagcagggagaaataaaggaagagcctgcacgtgtcgtgggtttcaatgcgtttggtggtgcaccggtccgttctccggcacgctcagcaggggctcgtgaaggccgtctgctgcctgcgcgggtgatcgccgcgggggcgctgcatgcgctgcaggcttcccgtccccgaacgccagcgcctgaatggatgggaggggtgggctgttgtgacgactgggacagccctgcccctctgcgtgaacagcnnnnnnnnnngtgcgctgcaggcttcccgtccctgaacgccagcgcctaaatggatgggagggatgggctgttgtgacgaccgggacagccctgcccctctgcgtgaacagctcggaatggcaaaggacgacctcaccagagcacagaggacccagaaatccttaccacttatcagaccaatacaaggagacaacgacccacctggaggaggatggcgacgtccagtnnnnnnnnnnaacctcaccagagcacagagtacccagagatccgtaccacctatcaaaccaacacaaggagacaatggcccacctggaggaggatggcgacgtccagtgccacggtgcccaggctgccgatgagccagggcagcgcacctcgcacctccggccagtcgtgggcacggacgaggatggaggcgccgtaggtcaggttggcgcccaccgcgacgaagaacatggagagggccaggccctctgcactgcgccgcaccgcgttgcggtacagctggctcacgcggctgagcaggtagaggacgcaggagccgtagcccagcgccacgcccaggtcccgcgcccagaggggcaggcgctgggccaagaaggtggccagccggagcgtcgagcccgggcggctggccgccaggctgccgccgcccagcaggcgccgcgccgcggcgccgcccggacgtaccgcggggcgtaccgcggtgcccggggcgcaggccacc

SEQ ID NO: 41643 - DNA, 4161 bp, Chlorella protothecoides
  modified_base (315)..(324): a, c, t, g, unknown or other
  modified_base (752)..(761): a, c, t, g, unknown or other
  modified_base (844)..(853): a, c, t, g, unknown or other
  modified_base (2125)..(2134): a, c, t, g, unknown or other
ctgggccgagcgccgcgccgccacgctgccagagaccgcgtcccaggcctctcttgccgcgccgagccacgcccggccggaatgagggtggacttggcgccgatgcttcacgtgcgctacggatgcagcgtggggcctcagcaccttgcgtctcaattcctccccgcagcagcgaactttctttttccccgtcgccccgtgctccgctgcctggcgcacccccctcccccatgcgacactgttcgtggttgacgtgcacccctggcccctccccatgtgcttcctgcaccacatccctacggtttgacagctggnnnnnnnnnnggagaccgcgtcccaggcctctctcgcagcgccgagccacgcccggccggagtgagggtggggttgtcgcggatgcttcgcgtgcgctgcagatgcagcgtggggccccagcacctcgcgtctcaattcctccccgcagcagcgaacttgccttttccccttcgtcccgtgctccgctgcctggtgctcccccctcccccatgcgaccctgttcgtggttgacgtgcgcccctggccctccccatgtgcttcttgcaccacatccctacggtttgacagctggcagcagtgttcacaccacagacagggtgacaggcggggatccacagggggagggggcggcgtgggcgggaggggtgcgggcgcgcgccgcgcctccggtcgggggtgcctgggatctcgaccccggcgtgccgcgcgcccccgcnnnnnnnnnnatcgtacaggaccaggacgaaggcgccgccggcgccgcgcaggacgttggacagcgcgcccttgaagaaggcggaggagcccnnnnnnnnnnagcaggcggggatccacggggggagggggcggcgtgggcaagaggggtgcgggcacgcgccgcgcctccggtcaggggtgcctggggtctcgaccccggcgtgccgcgcgcccccgccgcgcctccggcccgtccgctcactcggaggagggggcggcgttggggttgatcagcttcttgatctcgtcgtacaggaccagcacgaaggcgccaccggcgccgcgcaggacgttggagagcgcgcccttgaagaaggcggaggagccctcctgcgcggcgatcttgcgccagcagtccagggtgccgttgtacacgcgctcgccgccggactgcatcatcagcctgcggcgcacggtgtcgaaggggtaggacagcacgccggcggcggcggtgacggcctgggcgatggcccacttgcccaggaaggaggcgttgcgctcgtcctcgaacaccgcgcccttggcggtgtcgtacaggccgaagtaggcgccgcggtagaccacgatgccctgcactgacacaccaaagccctggtagaggccgatgggcccggcgcgcttggcggtcttggacaggcagtcgatgaggcccgtgaactcgcggttgccgccggagccgacatcagcggcgaggcgcgtgcgcgcaaagtccaggggatagacgatgagcagggagccggcgccagccaggccgccggaggccaggttggtggcgaagaacttccagaagtcggccttgggggagtagcgcgggaacaggcccttgatggtgtccttgaacgcaaagttgaaggcctgggtggggaagtagcgcaccacgttggccaggttgccacgccagaaggaggcgatgccctgctccgcggccacgcgggtgaagcagttggcgatgcccgtgtagcgtgggatctcgcccgacttgatgcgcgggttggagtcctgggtctgcagcagcagcttcacacgctcgatgggggccacgatggtcttggacaccgcgccggcggtgccgcccgcagccaggtcggccaggaaggcccacgcgttgctctcactgcgatatggtggtttgtggggaaatttgagttcacagacgagcggggggcggggcggggcggggcggggcaggtggacaaggcagccgccaggggggcctcctcaacccaaacacacccagctggcaagtgcgatacggatgatattgggacgaggggacgtggcggataccattggagacaggcatcatgcaggtgcacaccccaaaccccagtgnnnnnnnnnnaattttgggacgaaaggacgtggcggataccattggagacaggcttcatgcaggtgcacaccccaaaccccagtgtcccttccaccctcatgtactcacgcaggggcggggatgaaggggccggtggccgcgggggcacggctgttcttcatcagaccggcgaggccggcctgctggtaggcctgggaagacagcatcctgactgcaaggggaaagggcgaccgcgcgtcggcttgggcagcgggcatgcgaggcaggaccgggggcagagcgaacccggagggcgaagccgggcacatagtagccatgcaaacatgccgtgtgatcaggcgtaaggcgactgcgtcgagccaggggaccgcggcgctgacgccaggcgcagcgggagggcggggaagggacggggcaaccacttgcccgtgtgcaaccctacgacccagcgcccccagggtgcaagggatctgttgcccagcacactccttcaaggcatcgcaccccctcccgagccggacagtccccctgtcatcaaccccaaggtgtcctgcaccaagctgccacactggggcgcaccttgcgaacagggaacacctgccccgtccaattcctgagaagccgagttgcgcctcgacgagatccagaaaaagaggggcgccttcaggttcacgggacgtcatgagcagggacgccctcctgtacgctcctgccgcactgaccccggggtcgagtggcccgggggggcgccgatgagtaatattcgagcttggccaggggtgagtcaggggggtccctcctcggcccccacgtcctgcccgttctgggacgtcaatgctacaaaaacgctccagtgagcgacaacttcagcgcatgacagatgcgccagaaggggcagggagcaggaattcgggggaacagggggtctatggcaagcactgtatatggaacgtggtagccagggggaggcatggctgatcactggcatggggtaggaggggccgtgcagcatgtgcactggcatttcgcacagaggagacataatatttgcactggggagacagcggagcgcgagggaaggggtggccagctgcgcgcagccgcctccggcagggcggtgcgcatgcatcgtagtggcgcggcgacgtttccttgcattggtcggcggagagtctgtctcttgaggctcaccagttctttccggcttgctcctgggtacgagggcggttgcgagccctcacgccacgtgcagcgagtaccaccccggcgccgccggccgccggcccccctgcccagcagggctgctccgcgactccccgcgccccgcgccaccgccccgccgcgtgcgctatgccctccaggacatgacgcgcgccaggtcgaagcgggaggtggccagcgggtcgtcgaaggtgggcacacgctccagcatctccgagtcggccacggtggccagccaggccagcagcccgccgcgctttgcggccagcagccgccgcacctcggccagcgtggagtggcgcgggtccagcgagtggctccacccctccagcaccagggtggtgaccaccgtggcgcagatgtgccccggcaggctcaccgcatgctggcggcacatgtccagcaccaccgccagctcctccgcgccgtcggcctcggaccctgcgcccaggcgccgcgcggtgcgcgcctcctccatgcgcgcgcccaggtccgcgcggaaggcggcggggtcggggcaggtctgcgcctcgccggagaagcgcagcacccagtccgccacgctgctgccgtccaggcgcgagaaggcgtcgaacagcccgcacatgttggtgtggtccttgggcgacaggctcatggccatccccgcatccagcagcaccatgcgcggccggcgcagccactccacgggcggcgccaggtccatgtgaagaagcctctgtggatgcgagtgtgtgtgttggggggtggggggggttgtgtgtgtctgagtggacaggggggtgctgtgtgtgtttggggggtggggggggggg

SEQ ID NO: 41644 - DNA, 61 bp, Chlorella protothecoides
gccctgctttgagtgcgctgctcggggcggtggggaccccctgacactggaggccctgctc

SEQ ID NO: 41645 - DNA, 72 bp, Chlorella protothecoides
ggccaaggtgactaggtcaagcgccccctctaacctggccgcgagggtttccctgcatggtgtgcagggtgc

SEQ ID NO: 41646 - DNA, 73 bp, Chlorella protothecoides
caatgcgccctggtgaagggttctagagggacaatgacgattccgtgcccagtcgtcacgagtcaggggctgg

SEQ ID NO: 41647 - DNA, 42742 bp, Chlorella protothecoides
  modified_base (516)..(525): a, c, t, g, unknown or other
  modified_base (3376)..(3385): a, c, t, g, unknown or other
  modified_base (4147)..(4156): a, c, t, g, unknown or other
  modified_base (5806)..(5815): a, c, t, g, unknown or other
  modified_base (6472)..(6481): a, c, t, g, unknown or other
  modified_base (8529)..(8538): a, c, t, g, unknown or other
  modified_base (9433)..(9442): a, c, t, g, unknown or other
  modified_base (9768)..(9777): a, c, t, g, unknown or other
  modified_base (9842)..(9851): a, c, t, g, unknown or other
  modified_base (10638)..(10647): a, c, t, g, unknown or other
  modified_base (13284)..(13293): a, c, t, g, unknown or other
  modified_base (13605)..(13614): a, c, t, g, unknown or other
  modified_base (13865)..(13874): a, c, t, g, unknown or other
  modified_base (15711)..(15720): a, c, t, g, unknown or other
  modified_base (15797)..(15806): a, c, t, g, unknown or other
  modified_base (16622)..(16692): a, c, t, g, unknown or other
  modified_base (17547)..(17556): a, c, t, g, unknown or other
  modified_base (18047)..(18056): a, c, t, g, unknown or other
  modified_base (19141)..(19150): a, c, t, g, unknown or other
  modified_base (19730)..(19739): a, c, t, g, unknown or other
  modified_base (20907)..(20916): a, c, t, g, unknown or other
  modified_base (21289)..(21298): a, c, t, g, unknown or other
  modified_base (21537)..(21546): a, c, t, g, unknown or other
  modified_base (21623)..(21632): a, c, t, g, unknown or other
  modified_base (22633)..(22711): a, c, t, g, unknown or other
  modified_base (23183)..(23192): a, c, t, g, unknown or other
  modified_base (26076)..(26085): a, c, t, g, unknown or other
  modified_base (26550)..(26559): a, c, t, g, unknown or other
  modified_base (27638)..(27871): a, c, t, g, unknown or other
  modified_base (27928)..(27937): a, c, t, g, unknown or other
  modified_base (29573)..(29582): a, c, t, g, unknown or other
  modified_base (29655)..(29664): a, c, t, g, unknown or other
  modified_base (30039)..(30048): a, c, t, g, unknown or other
  modified_base (30277)..(30286): a, c, t, g, unknown or other
  modified_base (31113)..(31122): a, c, t, g, unknown or other
  modified_base (31429)..(31438): a, c, t, g, unknown or other
  modified_base (33054)..(33063): a, c, t, g, unknown or other
  modified_base (33521)..(33530): a, c, t, g, unknown or other
  modified_base (33743)..(33752): a, c, t, g, unknown or other
  modified_base (34514)..(34523): a, c, t, g, unknown or other
  modified_base (34691)..(34761): a, c, t, g, unknown or other
  modified_base (34919)..(34928): a, c, t, g, unknown or other
  modified_base (35705)..(35714): a, c, t, g, unknown or other
  modified_base (35841)..(35850): a, c, t, g, unknown or other
  modified_base (35910)..(35919): a, c, t, g, unknown or other
  modified_base (36151)..(36204): a, c, t, g, unknown or other
  modified_base (36639)..(36829): a, c, t, g, unknown or other
  modified_base (36924)..(36933): a, c, t, g, unknown or other
  modified_base (38012)..(38021): a, c, t, g, unknown or other
  modified_base (38429)..(38438): a, c, t, g, unknown or other
  modified_base (38903)..(38912): a, c, t, g, unknown or other
  modified_base (39271)..(39280): a, c, t, g, unknown or other
  modified_base (40888)..(40897): a, c, t, g, unknown or other
  modified_base (41212)..(41221): a, c, t, g, unknown or other
  modified_base (41906)..(41915): a, c, t, g, unknown or other
ggcccacctcgcgcactgggccccgcccggggacgaaggccccggcgcccgccccgtcctggtcctgcgcgtgggcgcggcctcgcacgaggcgcgcggccgcgccgcggcggccgcctacggcgacgtcatcgtgacgctggtgcagggcgcggtgatggaggggcgcctggcggacgtccccggcgagggccggccccaggacctggtggtgcgcgtggatgccggcggggccagcgtcctgtcctccacccgcatcctgccggtggtgcgctacgtggccaccaccctgaatcagcacttcccgggccgcctctacgtcatggagctgcacaacctgccgccatttgccacctggctggtggtggcggtcaggggactcatgcatgccaccacgcgtgacaaggtggtggtggtgggggagggcggacgccgcgccgcgccccccccctgatgctgcacgcaattgtcccggggcgggggcatgggtgagtggtcctcctcctcctcggtgcnnnnnnnnnngcttgtcccagggcgggggcttgggtgagtggtcctcctcctcctcggtgccatgggctccgccaggccctctggctggcggtacactcggcgccagctaatatagtgtctgacactgcagacaccccatgtaatatgtctcgagcacttgccaggcaaaggctcaggcagtgccctgaaccgggaacgagctggggcggacacttacatcgtgagggggtgggaaaaatggaggcagacgccgtgcaggaagatacagggaagccggcgctgggcacggcggggcggggtacagtgacgtgtgcacatccaggggggttcattcttgcgcaaacagcggcaaggccgcgggcgcgctgctgctgtctctccttggacaggagcggactggccaggactacttgaggcgctcctcccgggtccggcgcaggagcgcccccgccagctgcaggggtccgggcggcccgctgccgtccgcttcgtcggccagcaccacgacgaccgcctgtgcggcggccgtgctgcggaagagggcgtgcgacgcggtctccaccaccgccactgaggcgtggggcagcccccgcgcctcctccagctccgccgcgtaggcctcggccgccaccagggtccggaaagccacgacgccgtctgccacccggctgcaggcgatgcgcgggctgctccagcccatggcctgcgatgttgggcggggtgggggtcacgggggagatgcgtgaactgctggaacgggagacctgacccctgccagccactcttctcgccaagcaggccccatgcccttgcacgctgtcccccgttctagcttgatcaagccctagccacccaaaagagagcaggaaactccgcacgacacccacctggttgagctcgtcctggacgcccgccagcggcaggcgggtgcgcagcgtgtgcagcgcgccgggcgccccgcttgctggcccgccctcgctcagcgccagcacgtagagggggcggggggccggccaggggcagccctcgtgcacgcggtagcttcgctccagcttctcctcctcggcgacggcccgggccaggaactcgggggatgtcatgcgcttgagcagggccaggggcgagtttggcacctgggagttggcctggggcgagggtacggggtgtgtgggtgggaggtgggtgggtgagtcagccacgggcctcgtacacgatgctgccaaaagatggcagcgatacacgctggaccacagcaggtcggccccacatccagcaggcctcacctcgtccctgagggcaggctgggcccgagggctccagcctgtggacgacttgtatgcgttcagcgtctcccaagcctccacgagcgtctcctcggacgtctccgtcgtagggagggggtaccggatccgcctctcctgaccgtcagggtaacgcaggacacgctcggtggcagcggggtcgccgtcaggcgcccctctggtgcctgtataggctcggcatgagatgaggtgtgccctggaggggccccgctgtgtgcgcgctctgcgagggagacaggtgccccggcctgggaccactggtccagtggtcgtgccagcaacctccggcgatctgccgactcccatgcctgacgcccggaagtcgtgcacgagcgtggaaatcagcgggtcaggaatgtttcccagagggcagggagcccaccgcccatatgagctccgagaccctcgatcgcaaatctgggctctggtctggcttcgcgccctcgctccggagaacccctgctccctccgaaagcgcgtcgcgagggtgtgctttaccaaggcgatcacacccatttcccttcctcgcattccagatatcccgttccgatacctataatgttttcctcggcggataacaagctgctggaccagatcttcaacctcaagttcacgagcaagcagctggtgcgggcctccaggaagtgcgagacagaggagaaggccgaaaagataaagatcaagaaggccatcgaaaaaggtatgtcccttgcgaatcacacgtcgaggtggtgggcgccacatgctgcccagcttcaccacccacccacctgcccagtacgtcctgacccacgcagacaaccatgagggcgccaagatctatgcccagaatgccatccggaagagggcggaggccctgaactacctcaggctggcctctaggctggatgcagtggtgtccaggcttgacacgcaggccaagatgcaggtgcgaggggaaggggggtgggaggagactactcgggcagcgcagggcgctgctgtgtgaagtctctgtcgcctcggtccctcaagcggatgcgcaagaaggcttgcccaacatgtattttgtcgaggggtgcaatgacgcatgacgctcccacccatgaccccactttccgcctctcctatgttcccgaaacccctcagatcatcaacaagagcatggttggcatcgtgaagtcacttgactcggcactcaaggctaacaatcttgagaaggttgctgcaaccatggaccagttcgagaagcagtttgagaacctggatgtccagagcgagtttgtggagcaggccatgggcaaccaggccgcgctctccacacccgaggacgaggtcaacctcctcatgcaggtgggctgcatcaaaagttggtcaaaatcagcctggtctttcccccgtagccatcctgtctttgattatgggggctgagaccggtgccgagtctttgatgcaccttgacgccacgaacggtaccttcccactgctgagagtgcagaaaatctggcattctttcccccacagccaacccctcaacacccaccttcccctttttcccnnnnnnnnnncagtctttgatgcaccttgacgccacgaatggtgccttcccactgctgaaagggcagagaatctggcattctttcccccacagccaccccctcaacacccaccttccccttttccccctcctcgcccttgcagcaagtggccgatgagcatggcctggacaccaagctcggcctcccagcggcgggtgcagcccaggcagctcccacaccagcgcagaaggaaggcaacgacctcgcacagcggttggcggagctgcgaggcaagtagaggccccggccaggctctgcactgtgtaaatcaatttcataagctggcttgcactggaatccgcctgtgtccgggggatcgtcacttgctcttacagacgggtgtaaaacttggagggtgttgagaaaaaagaaagacgcctcgggttccccgggactggtgctccggatcgtcgtggggtgtcatgcgtgaaattgaggcaacgccacaaagagccatgggctgatcacagctgattgaaggcatcctccagatcactcctgtcctggcatcctcgtgatgaggaggtgtttgctggacccagccccgtgcccgccccctgccacatgctagaagaagaggcgcagcccccacccggtcgtcccatcgccatggcatatgcagggtgagggatgtgtgttgcgggattccgtgccatcgcgacgcttgcaagggtcataatggagcagagtgccgactccttgttgccactccctgcaggcagtctgccgtgnnnnnnnnnncttgcgggatccagtgccatcgcgacgcttgcaaaggtcataatggagcagtatggcgactcctcgttgccactccctgcaggcagtctgccgtgcccaaaatacccagcgagagtaccggggccaagtgggaggatctgcgacgagaggtaggccttagttcattccgaattcttagctctcatccctgcacatcggggctgctcactccgtcggcccgtacgctgcacaggcccggaagatcgagggggagttggacataaagctggctgcctatggaaagctgtgcaccagcttcgagtacggatacacccgtggggagagtgggatcgcagcggaccaggtgcgataagggcaggctgcagtggggatgcattgtgcacctggcggcgaccccactctgtcccacacgctctcccctgctcccctgcacagctcctgcaatccaaggccagcgacatagagcgcttgctgtcacggctgtctgacaccaacgagtctatgcagcggagcatcgggggcgggccagacgcgcgatcgcacaccctagcgcggcaccgcgacatcctccacgactaccagcaggtctgactggcgtgggcgggcctacgggggctggggctattgtgtctcgtcgatatgtgggctgtttattgcattcagcaaccgtgactcccgcaggatgcacgatgctgtggctgcctggagttgtaatcatggtctgtgttgggggaagtgcctgacgctactcccattcttgggcactccaggggcacccaaggccacctgccggtgtgccctttcccgagtgggtggggggaccctttgccgatgcctctatcgtccagccgccacccctcaaaccatcgccgcccaggcaccgcccctcaaatcaacgcagccccgccggcggcgctcaccccaggcaccgccccaccccaattcaacctcttctcacccccccctcctcactgcaggagttccggcggcaggccagcgtggccgggtcggcccgcgaccgcgccgacctcctgggcgccgctggcacctccggcagcgcgtcagcctccggcctgggcgcgcccggctcctcgatgggcctcctcctgcgcgagcgcggcatggtggccagcagccacgccgcgctggacgacgtgatgggcactgcccacggcgtcgccgcggggctgggccagcagcgggaggtgttcgagggcgtgtcaggcaagctgggctctgtgggcgccgcctttcccgtggtcaacaccctcctcaacgccattcgccgcaagaagaacaaggtgggttgtttttcattgcaggagggggggggggttgtggtgatgtgcagggatgcatggcggctggggatggaagggggggggcggctgcgttcttggccgctgccgtcttctgtagagcctgtgacatccctcaccatctagccctgcccgcatacacacaggacaacctcatactgggcagcgtggtggctgtgtgcctgctcttcatcctgatctactgggtcaacaagtaggacgggacagagtacggacggcgtaggcgcggctggcaaatcggttgtctcgcccagatgtgacgcttgcttggcgacaaggtgcccgtggtccagactgaatagctgccatnnnnnnnnnnggagtacggacggcgaaggcgcggctggcgatcggttgtctcgcccagatgtggcgcttgcttggcgacaagttgcccgtggtccagactgaatagctgccatcaatcattctcgatgcgaggctcctggcgatggaggggccgccgctgccaccgctttacccctgcctggcatcaggtcatcaggtcacagagctgacgctggaaactaaccgcctgctgtcattctatggtcccaaatggttgtacggtgcccgccactgcgacgtgctccgtgatctggtggtgcgcgcaggttgcaatcctgcccgtcgcttgaccagggctctaccaatggctaaaagtactgccaattgggaagaatgcaagtcttaactggcaaggagtagtttattggagctgcggtaaaagattatttgatctatgtggacaaagctgcgctcctttgttctgagggcttgtcagacatccgtatgccttggggttggccgatgccgggcattgccctccccgcatagagtaagtgatcccagtgtggctaaagtgcttccgagcctccatccttgaactccatccgagacactttcaagtgtttccaaaaattctcagcgatttatccaagagagagcttcccacgtcacggaatgaatagcagtnnnnnnnnnngctctcaagtgtttccaaaattctcagcgatttatccaagagaaagcttcccacgtcacggaatgaatagcagtggtctggctgcagaggccctgaacgtggcacacgagctcgccaagctgctggacacgggcctcgacagggaacagctatctgtctgcatcgctcttctagaaaccggtgtaaatccagaggtaggtcagggatcactgggccaccttgtcccgcgaaacgcctggcttacaacctatgctgccaagcctgggcgcgatccgacatcacaggccctcgcggaggtagtgcggcagctgcgatcccaggacggtgcttccacgcccccttcctcctcctgatcgcgcgcctcgcgtcgccgcatggccactctgggcgtggaggccagcgtggcctcgggggcccagagtggagcggactgctccgagccccccccgcccctggtgggccaggccggccaagagtttgtgcagaacacgctgagcacgcacgaccccctggaggccatcgccgagatacagaggcgggggggcctgccagacccgcgctgcgcccccctgctcggcctcctcgaccagctaggggtctcacggtgcgtgcctgtgcgtgtgtgtgtgttgtaggggggtcggttgtctcaaggggagactggggattccccaagggcatgtgcatgcaggttacccccctggctcgttcgcctgggtatccccactcttgcccgcgctgcggctgcggcagccggctacttgcatccctgccatccccatcgccagcgcttcttggcagacctgacgtgcctcgccatccagcccctcccctccctgtcctctgaggaccccatccccgcgcgcgcccccccccccattcgcccaggtctgaggcctgccgtcatgtgctgcagtccgccatgcgcgacctgctgactcgggtggaaagcatggggcccgatgcgctgctgggcctgctggagctctccttcccctttgtgggcctggccgagctgcgcgcggtgcccctggcggtgctggatcgcctgcaccccgtccccgccagcttcctcaagcagctcaccgccgacggcgccctcttccgcgagctgcccctgggcgtccagcgccaggtctgggacctggaccgcaagctgctccaggcccatgcactgcccctggtcctcggctacgcgcacgagacggccaccgtgctgcgcgcgctggacatgcgcgaggcggcggcagcggctggaaagggcggccgtgcaggcgccccggggccgcgcacgggcaaccctccggccgcgccgcccgcgctgccgcgccgcatcctgcgccgcggctcggcggcgctgcagcgcctgacgcgcatggtgggcgggggccgccagatctaccgcggcctggcggagctgtgcgccgcgcgcttccgcgacggcgatgcactgtacgtgggcgtgccggaggccgcgctgtgcacgctgcgctcccagctcctcatggccctgcacgacctgggccaggcggagctctgctcccgagacccctgccacaagctggcctggacgctggatgcctgcctcatggtgatgaggagggggggaaggggttggggtgtgtgagtttgggaggagtttgtcggcggggtaactgcgccgcggatcaaacagagggccaccaccgtgatccccagaagcgatgcaatctggatgcttcttgagtgcggcgctacgtcctggaggccgttgggttgtcctcaaacctcctttcgacccttcgccccattcgcacatgatcgacaggataagcgcctggactcgcggcggctgcaggagatcggcaacttcttcgtgcggttcgaggatcacgccccctttgcggccagggcaggcagctcacggcgtggtcataggggggcccagcagcaaagatcacagcgctccgggagccggggtgaggtgcacaggaaacggtgaatcaattgggcgacgggtgtcgggagtcctcagccgcaaggcgccaagcttgaatggatgctggcannnnnnnnnntaggaaagggtgaatcaattgggtgacgggtgtcgggagtcctcagccacaaggcgccaagcttgaatggatgctggcaatctgcgcatgatcggggctggcaaggaagtgccgggtggcacatcagccgcaggctcacctggcatggtctctgggtttggaggagagtatggtattcccctacattgctctgctttctccgtccatggctttcacccctgcaccctcacaaagaggtagtccctgccaagcctgaccacctcgcctccccttccctcccggcctttgcgtgcagcctgggaggatgatgcggagagttcgggcgcgccgggggcgtctgctgcactggaccccttccaggagctgggggatgcggggatggtgctcagagacccctcaaccctccacctcattgtgcacaatgtaaggcgacggggggaggtctggagggtggggcaggttgggcaatggcgccctggtccccacacagagggacgaaagggtggaggggcgagcgcgggaacccttcagcgccagggcatttggggctggctgctcggcgcatgatctcggtgcaccaaatccctttctctccaccccatcccgcgccggcgcagatcctgcagcacgtttcggcggcagtggaggaggagcggcagcccaaggacgacgccgagctcgttttgctgacccgcctcctgcagctggcagtcggctgccgttcgggccttcgccagggccgagtggtgtatgcaggtgaaggctgtgtttgtggtttgggggggagggatgggtgcgtgtggaggggaccaggggctctcagcgaggcagattgggggtgactcgcccctgcacgcctcatccccgagctggggcctaagaatcaagtctcctnnnnnnnnnngtgtgttttgggggggagggaggggtgtgtgttgggggggaccagggcctctcagcgacgcagattgggggtgactcgcctctgcacgcctcatctccgagctggggcctaagaatcaagtctcctcacatgcgtccaaagttccctcttctgtttacctcacccgcctttaccgttgcacagaggccagcccagagatcatgaccacgctgtaccccacgctggccaacttgatgctggaggcagccctgcgtgaccctggggagcccattgactcaggcaaaggccacggcttgctttttttttgggggggggggggggggggnnnnnnnnnncgtgacaggatggccagcaggggcgcgctgcatcgtggcacagggccgagactaatcactgcgcnnnnnnnnnnatcgtgacaggatggccagcaggggtgcgctgcattgtggcacagggccgagactaatcactgcgcagagtctctgtggcccccccttgcacctctcgccagccgtcggccttgcccttgccgctgctgtcatcggcaaccccctttcctccacacagagacggaggcggcggcgctggagaccctgacgcccctcctcagcaggagtgaagctgtgcggaaggtggcgcagatgttcctactggagcggttggaggagcgggacctactcacggccactcttctgctgcagaccatggcgagtgcctcggtggttgagaggctgagggtgcatgctgtgtggttgacagcggtgaatcaagggctcagtgccctgcctgcaaggcaggccttcagatgttgcttcaaggtggcgcccaagtccacagctacgtgaacctggcttgccaggttcatgttgcatgcgtatgcccgggcagccctgaccagacccgtggcttcggactcgtggcctttccccttccttccaccaggcgggggccatggagaccatgaccgacaagtccatccccgagttcgcgccctttggcttctctctcgcccgccagctgaccatcctgctgacaggcacgggcatgggtgttttgcgggggcagatgtgtcgccagccgcccaaacttgggagggtgttgtgatgagggggggattcatctgcgtcactcctgggcttccctggagtggggcggtgttgtgtttgtgagctcatgtgcaccccgctgttggcccnnnnnnnnnnaggggattcatctgcgtcattcctgggcttccctggagtggggcggcgtcgtgttcgtgagctcatgtgcaccccgctgttggcccattctatgagagcacagagggcgtggtgaaggtggaggatgggatctggcagctggcggtagaccgcgtgctcatcaagcttgtcgactccgagacagcggtgagcattctttctccctggcttgtgttgcgagaagcagccgtgcgcatgtgctgttgaggctgctggggagcaagcaccaaccaggcattgggctaggccggcgcgctatcctcaggtgaaagtgtccaccgcctcgcaccttctgttccaggcacccgcctgcattctcctggccccaaccaccgcaggtgcacgaggaggtgctgcgtctcctgctggcagcgtcctcccagatcccgctgctccccctggccaactacctgcaccacacgctgagcaacagcaggtgcccctcatgtttagctgttgtgacatgcatggtttgactaaatgccaagcggtacgcagtctggggaggtgcgaggatgcagtctatattcagtcgccaacaacccccctcatcctcccagaaaaagccgcaagaggttcaagaagaggaagctggtcagcctggagctggaaccctggtcagagtatgcaggcgcggcctccgagcctgcctactcggacggctacgcctctgcaggctataccagcggtgcgtgtgtgctgtggagtagttcagagggaaggcgatggccagaatgcgcctgcttccttgtggacgcttgcagaagtctggtgtgccacgagccccctaatgctgctgcccgcgctggagggccggcctcctccaagttgccctgccaagccttgtctatgcctcagcgaccccttttctccccaacccccgctccccctccgcagccgggtatgccagccagggtgacgacacggagatggggtccaggggcgcagacggcatccgcgccacctacgtcctgtttgcgcagagggtgcctggcctgaatgcgaccaccgccccaaccttgcatgcatatctggaagccgggtgactgtggtgtcttgtattctacatgaagtgagcaggaagagtcatgcagccagggtcagcagggagcggacagggcacgagaggcccccttgcgccacagtccacgcattgcaggggcaggcagtcgcagcctgacatgccatgacccgcgagcagccgtacgctcacccaaacacgccgcctgacgcggctcccaggcggccttggcacacctgtcttcagcttccgcaagcatggtgctcgaccccttgccggcagctcgagccagcacgccgagcgccctgccgcggtccaggcctcctcactgccctcgccgaccgctcgatcaccgactcagtcgcccaggtagtagaacgtccccgccgacttctgctcccggtccttgagcgactccttcttgttgatgcgcggccggtagttggtggggtctcgccggaaggtgatctccaggttcttcaggaacaggttcatccccgtcagcagcgactgcggcgtgcgcgccgtggcatccactgacggctggccttcgtagaccaccacccggtctgccaggtaggccgccatgatgaagtcgtgctccacgatgaaggccgtcttcttgctgtgcatgatgaacctggcattgttggggtgttggtggggttgggtctcaggcgtggggcagtgggaaacagtctccctgtgttgcgacagagtacccccaggcacgacagagcagcgcgggggggtggggggtgggggcgcgaaccgggagtgcatgaccacaaacaaggcctcggtgccatgtcagcggcagcacagtgtgtgatgcgcgcgccggcagggagcccgccccgccaaaccctcatgtccacggtccctccatcactgcgcacctcttgatgaccttggcggcgatgatgcgctgctcggagtccaggtaggcggagggctcgtcaatcaggtacacgttggcgggctggccgaggcacatggtgatggccacgcgctgcagctcgccgccagacagcgtctgcacctcgttgtcaaacaggccctcgatctgcagcggcttgatgacgtccgcctggaaggaggggtgcatgtacgtctcccggatgcgcttgtgcagcagctcccgcacctgccagggggtcaggggaatgagtgtcggaagggggggaaagcgtgcagggatgagggaaggggctcacgcgcagggctgcttgaagggcccctcatgcaggccgggaacggccagggaatgcgatgtttccccggctgtttcgctcccccgcctgtttcactccctcgcaactacacccaccgtcccagggaacttggggctgatcttctgcggcttgtacgacaccgcaaactcatcgagctccacatccagatccaaatctgcgagatacggggcatgatactgtcacaggtcgatcatgcgacggcaggaattcaggtggcagtgccgcatccagcccgccacagcagcctctgtacatacacacaaacatggggcctctccacatcaccccctgcacaccgggcttgagcatgccggccagcannnnnnnnnncgcacacacacatggagcctctccacatcacccccgcacaccgggcttgagcatgccggccagcatccggatgaaggtggtcttccccgtcccgttctcccccagcataacaatgatctcggagtcggtgaactccccagcctcaacctatgaccaagccaggaggggtggggatgggatgctgaggtggctcatgccgtgcaggggcttccctgcctcctccacctcgctcgcactgagcagcctcctcctgttcccatgcaccggttgtgtcatgcacaagagcaccggggaggaaaacccctgtcaaannnnnnnnnnactcgcacaaagcagccttctcctgtttcccatgcaccattggtgtcatgcaagagagcaccggggaggaaaacccctgtcaaaggcatgacagcacatggatgcctcaaggcccttgttgtcctcatcatccccttcccctgatgtatgcccttgttcaacatcccccaccacaccaccacaccacacagccctccgatcgggacccacatggagcttgaagtttccctgcgtcttggtcatggcggggnnnnnnnnnnaacccttgtttaacacccaccaccaccacaccacaccacacagccctccaagcggaacccacatggagcttgaagttgccctgcgtcttggtcatggtggggtacttgtaggacaggaagcgcttggcgccctcgtccccatccacggtggtgtcggagaccttgaagctgaggctctcctcccggaagcgcaggttctcggtgggaacaaacccgcccaggaagatgttgattccctctcgcacggagaaggggagcgtgaccacgccgtaggcgccgggcttgccatacaggcagcaaatgaagtcggagaggtagtccagcacgctcaggtcgtgctccaccacgatgacatacttgtcggaggccaggaggccacggatgacctctgcggccttcagccgctgccgcacgtccaggtaggaggagggctcgtcgatcatgtacacgcccgcctcctgcagagccaccaccgcgatcgcaaagcgctgcagctcgccgccagacaggttctccacgttgcggtccgtcacctggtttgttggttgttggatgaggagtggcatgttatttgacaagaccagatgagaggctcagacggaatgctgtgtccgtgattctgcctgagccactgtggcgccccgagcctgtggtcgcaggacttgctgcggagcatccaggcccaccccccagcctgctgccctgcgatcaaagccaggcgcacgcagactgtcgcacctgttcgaggtcgaggtcgcggaggagggcctccttctggcccctctggtccttttcctccagcacgacgccgacgttgccgcgcacggcctgcgaattttggtggtagggacatgggattgagaagctgagactcttgtcgtccaatcagcacctttagcactgccagatgcaagcggctccactgcccagccccctgcctcgccttggggatgtggtccacatactgaggcttgatgatcgccttcacatcgtcctcaaggatacgagtgaaatagttttggagctcggagccgcggaagtgggtcaggatgtctgcccagtcggggggcgactgcatgcggcggggaatgggagaggtgaatgggaggcgggggggggggatccaaatgtgctcaaagcggcatgcattgatgtaaacagcacagcgacatgtctgagtacatcgcaaccacacagcgcaggaaggaaggtggacccctgcgccagtcgcggccaccattcttgcgagcaccatacacgcatccgcagcaggcccagaaacaccacccctcttgaaaactcacgttgaacttgccaaggttgggcttcagcttccctgccaagatcttcagcgccgtggacttgcccgtcccgttggaacccaccagccccaaaacctggcctgggcgcggcaccggaagcctgcgtggagtgagcattgagaatcacaactgtgcctctcttcttgttgtgttggcaccaagacagagaacggctcgagcaggattgtacagcttgacattggctctgcaatgctaccccaggcagaggctcgccatgcctgcacgcccagtgttcaaaaggcaaaggccacagagaccctggaatacagacctgtgcagcttgaaggtgtttgcgccataccgatgcgtggtctccttctccaggtccttgggcagattgatgatcatgatggcatcgaaggggcatttctggagtcgttgggagagtgacggtggtgatgggatttggttgatggagaggctgggattgttttccccatttttcaaacataacaaacgcacattatgcttgctgcccaccccccctgctcgannnnnnnnnngggatttcagagggaggggtgagcaactttgaacgcacggtgaaaagagctctagggagcgttgccattcaataaannnnnnnnnnatttccccatttttcaacatcacatacgcacgttatgcttgctgcccaccccccctgctcgacaaacacatccagaccttgacgcagatgccgcagccaatgcatagctcctcagagatccaggcaatcttgctggtggggaccacctcaacacagagcttgcctgaaggattttagaggcaggggtgagcaacttcgaacgcacggcgaaacgagctctagggagcgttgccattcaataaatgtagggcacacttatgccatatctagtgcccatggtctgccgctaggtgtcggccagttccgaagccccagctcaccaactttgacaactggacagctcttcttgcactcctgacggcatttcttgggcttgcacctgcgtggaggatggcgagctgttgaaaggacggcgggcatcaccacctgcgtgttacacctatttgcatcacatcgcaatatccttacttgtcggagctgacaatggcaattcgcgtcagcgtctgctcgctgccggcgtctttatccttcttcttgggcggcatgatgcctcgtgaagcctccccctagtctgcagctgcctggggggtcctgcggcgcggatgctcgacacaccaccgacgcctcgtcctggttgttgtgtaagacccttcgatcgaaatgtatcgaaacctgctgctggattctacaatgttgcccgtctgcgggggtgggcgatcggcctttgcatggcgcccaggaagaaatggcggggttgtccggaaatgtcccgagccaaagctcatcgccctgcgttgccacagcacagctgagacnnnnnnnnnnnnnnnnnnnnnnnnnnnnnnnnnnnnnnnnnnnnnnnnnnnnnnnnnnnnnnnnnnnnnnngatatcgcttgcatgcagacctagtagggacgcgagcttgacaccctgcttttgcaccgggccctgtggatcggttcctcacaggaaacaccctgtcgagacacccttttgcgcaagtggaagctgagaccttacgtcagaaatttaaggaatagtgtcaaatcttccaataccctgaaggctgttgtcagtatcatgggcgaccgcgagacgtccgccaacgatggcggtggaggcgagatttccatgtccacagaagagaccaacaggtatgccctgagcattgtgtggaagcgcttgtagaactgactttgaccttgctccaggggcaacatcggcagtggccttctgacgaccgcctgccctccatgccactcccacaggctgcgcatttctctgggcctgaagcctctctccacgaccacccagccctccgccctcaaggagctggaggctgggcaggagcgccgtaaggctgcagaggatgccgaggccagcaatgccttggtcgcacggctagcacagtatgtgttggggtcggtttttggcgtgtttacccgatgacaaagcggtcgcaagatgcatgactgcgcaatgtgttcgactcttattcttccttgccccactcaccactggcagagccaaggagaagcggcggcaggaggagctcctgaaatccaccaagaagctgggagagactggagatgatgtcgacaatgacaccctccagtggatcgagcggtctcgcaggcaggtctttcatgtgagattgtgttcagtgcttgtatttgcttgtcaactcacccaggcatacaagttgaaagtgacttctcgcctatttgcagggtggaggcnnnnnnnnnntaggtctttcatgtgagattgtgttcattgtttgtattagcttgtcatctcacccaggcatacaagttgaaactgacttctcgcctatttgcagggtggaggctgaaaggaagaagaaacaggcggctgcaaagcccatccgagcaatgaatgactctgacgaggatgaggaggtaggcgctgggatgacttgggggcaggcggctgtggcaatcaggaaatggtttcaagggatcctctgtggcggcagcatggcctttgcagttacatgtatacacagtcgcgccactcacccttgtcaccgcaggaggatgcagcggcaagccacactggcgcagacctggccgggttcaaggtgggtggcaagggtaaggcaggcactcaccggatgagatttattgctctttcaagcgtcagggtgtgaagaatcaacgatggtttgtgtgtcactggccatgttaaaagctttgctcctcccacacctaattgcnnnnnnnnnncgctctttcatgcgtcagggtgtgaagcatcggcgacggtttgtgtgtcactggccatgttgaaaagctttgctcctcccacacctaattgctcaggtgaagcactcggtggatgatctggaggcaggggagtcggtcatcctgaccctggaggatcgaggcattctggacgacaagggcaacctggtcgacgacgaggaggcagcgctggagaatatattggtggtgagttggtgtctgggtgaggggtatatcactcggggacatgtttcagtctccatttgactgggtcccatttcgacaaccatggaacgggaggcttgaccacccaggagctcttgtgccctgccatgtagctctcacagtgccaagacttgtgcggccatgtgttgttcgtacaatcagtgagcccccactccactcctgcttccacacagagagaaaccaagcagcgggaaaaggcgtatcgcgactctggaaaggtggccaagcctctgtgggaggaggatgggcggcagcgcaccctgctggacaagtatgacgaggaggaggagcaggtcattcaggtgaggccggggcccgtggacggtggcggactcaagactgcgctgggtgggccaagcacgccatcctcgttgcccacagaactgctgcttgtgacaatttcacacttctccagcatcctgctcctccccttcctcacctggaccaccaccccaaaaccgcagctggggggcgacggcagcgtcgtggccacgcagcagcagcagctccagggggacgtgaatgcgcggttgaaggcggggctggctttgctggaacaggtcaagccagcgtccgactactacacgccggaagagatggagcaggtgcgtgttgatggcagtcgtgtggaggagtgggaatggatatggtccaggaagaggctggcagagggtggtgacatggggaaaggcagagattggtatgatgtcggacttcagtgcgcagagtgagagaggagggatgatcatccagcccgtgcggtgcgggcttgagcatagggtcctgcatagtggtcctgcgcaggcgctcatgcctggtgnnnnnnnnnntaggaagaggctggcagaggctggtgacatggggaatggcagagattggtatgatgttggacttcagtgcgcagagtgagagaggtgggatgatcatccagcccatgcggtgcgggcttgagcacagggtcctgcatggtggtcctgcgcaggcgctcatgcctggcgcctttttgacctgcgatttctcatgcgactcctacccccccccaaaaaaccttctcgcctgcagttcaagcccaagaagacgaagaaggtgaggaagctgaagaagaaggccctgactgccgaggagctggaggcgctggcggaaagcaccgcggcggctgccgcgggcgaggacctgggctcccgtgcctctcgggaggcgcgcgccgcggccaaggccgccgcggcgggcgaggccgagaaggagcggcgcgagaggtgagtggcaggggccctcggtggctcatgcacgccattgggtctgcacggtgatggtctcctccacctggctgctagttcatttctgactttcggtggctatgcaccccccaggcccccgctatgcatccccacttgattctcattcgactcnnnnnnnnnntcgagaaggagcggcgcgagaggtgagtggctggggccctcgttggctcatgcacgcagttgggtctgcaaggtgatggtctcctccatccgcctgctagttcatttctgccttccggtggctatgcacccacaaggcccccgcaatgcatccccacttgattctcattcgactctggtcggaaccccggtttctttcccacaggttccaggcagcgctgaaccaggtcaactatgcgtccctggctctgcggaatgcagacgcgcagccctccaccgcagactttgacgacgacgacgatgatgcggtgctggctgcctccctgcagaggtgtgtggtgggccggtgtgtcaagccgttttgggccaggattggtgtctgggggcatccgcttgccagagactcgatcaacatcctgattcttgatcccaccacttcgacgcacgcctgcgcagggagaggctgcgtgcgctgaaggaggggggcacggcgggggcagacccggattcgctggcagatcagcttcggcagcggcgctccaggcgcccggccgccgcggagggcgaggggccctcaggtgatgccgccgatcaggggctggtgttcaccgggatcggggaaatcacgcgcgccatccaggtggcccccggcgagcccgcagaggggtcggccggccagggcgcggcccccagtggggccctcgagcgcatggaggtagatgaagcgccgatgcccacggagcagccgccgcccctgccgccgagcggggaggccgaggcgggcgaggcagagcccatggacggccagtcacatgcgatcgacgagccgcgggagtcgggatttggccggtgggcgcctgtgagcgagggtgggtcggcagaggacgccatcaaggagaagatcaaggccaagattcggccgccgggtgagtgtgctcgatcctgtggggagcaggagtgtggattttgttggctgggagcagcggaggatgcagacatccaggggtcggaggctgccgtggcttgattcctacgaatctgtgcggcacctggtgccgggtgctggcatcagctgttgacgctctgccaacatgtggcagccagcactatttctggagggcgcgtgctcacctgaatactctcaggacctgatcacgagccccagctgnnnnnnnnnnggccagcactacttctggagggcgcgtgctcgcctgaatgctctcaggacctgatcacgagccccagctgcatgtcccttgtcttcaaccctcccatcttaccttctcccttgcagcacccaaggtggagacgggcaaggagaaggtgaccctgcagcgggacgaagtcgtcggcgaccgagccatcggcgccggcatggcgggcgccctcgctttcctccagtcccgcggcgatctggacactgccgtggagtggtctgggcggacgaacgactccaaaaaggtcaacgtgagtggccaaggggggagggatttggactggtttattagtgcagttcactgttgatatgcagcacctcttcagatattgagnnnnnnnnnntgggatttggattggtttattattgcagttcactcttgatatgcagcacctcttcagatattgagcagacctgtaattggtcccctggctctagtgttgcagctttggcaccgccatgtcttcctccaccccctcttcccccaccctctacccaacacgcagatccaaggcctagacgaggtgtactctggcggccgcaccgaggacaggcaggcgctgagcgtggaggtagcgcttannnnnnnnnnttggttatactcgtgtgcaaggggaggcatgttcctcattccggcgttccccttgccgggctggaatgatagtcgcnnnnnnnnnnggtgttgcaggtttggcaccaccatgtcttcctccaccccctctcccctcaccctctacccaacacacagatccaaggcctagatgaggtgtactctggcggccgtaccgaggaccggcaggcgctgagcgtggaggtagcgcttacgaggaaggacgagtatggccgcatcctcacccccaaggagctcttccgccagcagtgccacaagtgggccggaggggggtggtgggtatactcgtgtgcaaggggaggcgtgttcctcattccgaccttccccttgccgggctggaatgatagtcgcccgctcctccaccactcctcgactgtctgggagggcgaatcccagcgccaacttctgatccccccctaaacacacacacatacacacacacacacacacacacacaggttccacggcatcttcccgtcccagaactccaaggagaagaagcggcggaaggtggaggaggagatggcccgcaagcgcgcggcctcgggcgcggtggagtccggcgccctggagcagatgaagcaggttcagcgccgggaggcgcagccctacgtagtcatctccggcacggttcgccccggccagagccgggacgtggtggcggggcgtggcgggtacgaccccggcgaccccgacctggacgaggacggggtggacccccttgcgccgcgcctgggcggcagcgccagcctggcgccgctgaccgggaacgccaaggtggcggccatgttgggcctcgccggggtgggtgagggggggcggagcgtgagcagggggaagcggaccccctcccgcggtgccaggggctcctgaccaaggcgctcgactgcttcctgcgccctgacagcgcgtcctctgcagccggttccccattgcacctggcctgcctgactgcccactacctttctggttgccatgcccatcactactacaagctgacgtcgtcagggggacgattgtgacaagggccagctctctggacacacannnnnnnnnnnnnnnnnnnnnnnnnnnnnnnnnnnnnnnnnnnnnnnnnnnnnnnnnnnnnnnnnnnnnnnnnnnnnnnggcttccaagtaccggaggtggcgggcctcctcctcctcccccacctcgtccgcctcaagcaccgcctgcaggccgcccaccagcgtgccgccagcctcgtgctgcgtcagcgccagccgggcgcggggcgcgggacgtggcgacccccagcggcaggcaaaggcctccacgtccaggcgcggcaccgaccccgcatccagcgccgccagcacccgcttcgtctcccgatactgcgaggcgcgcgctagcaggccccgcacactgctgcctgcagagtgaggaggtgtggggtggcggtccagggtgggctgcgtgctggctggcctggcagaaagtgtccactccccaggagttcatccccaagccctcgtgcctcccttactgttgtcagtaaacctgctggctattcaccttccaccaaacatgtacgaggcagaacaccaacccttaccgcggtggtgcgccagccgnnnnnnnnnntcctcccttactgatgtcagtgaacctgctggctattcaccttccacccagacatgtgcgaggcagaacgccaacccttaccgcggtggtgcgccagccggtccctcagcttctgcaccgcagaggcgagccacttgaagtggaaggtgaggacgttggcaggcgccgcagtgaccccccacttgggcaccagcgcattttcctgggtgacgtacctggatgattgtgtggcagggaatataggttgagtctgatggggctgaggcagttccacacgtagtagcaggatgcgcctggaggcaaaagaaagtaaggacactgcccaacccccttcatttttctggaccagcgcagaagcgtgctgattcccgctgcaggccccgccaactctctgagccctccctcaccggtgggggtactgggagtagggcgtgaggtggtacaggtccccgtcgtcctcgccgtcctcctgccagccatccttggccagcccgccggcgccgtagtacagcggggcctcgtgggggctgatcacgctgcggtcctcctgcacgcgatgggggtggcagttgctgacgtggcagggggcctgggcgctcgagcggctcgggtgcaccggtggccgctgctgagctcggaatccccgtgctgccgcgtcgccgccgccccgcacgcaggcgcccccgatgcaccgcaaccaaccccacctggtctgtacggaggaaggctttgtaggcagccaccttccgggtggggccagtgctggcagcgcctaccaccgcacagtcccagggatactgctcgtggatgggcacgtcgctgcgcaggggctgcagcgtgccgtcataagaaagcctgggagggcaaaggggaatggaggggagctcatcagcaggtgtcaggagcttccagagctgacacagcctcattcccatccctcgcagaaatggaatctggcgctcgctgggatacattgcactgtggcaggtgccgaattgggcccaaggcatccccaacaaggcaccaaagaggaccagggcaccttccttcgcctgcaggctcacctgtccctgaggatgccccagacgtaggtggcccccactgcgtcggcagcggccaaatgctggggaatgctatattctccatagctctggaactcatctgtagggcagatcatggtacagcgggaggcaggggtagggcggggtgggggaaccgttgatgagaaagcttttgcgcggacaagagtcgtactgccgctgcaagggccctgtggaggtgtaggacacaggcggccgtgcggctgctacaagagtcccagtatgatgcaagggtgcggctggttgccctcttccccactgcaggctcacccgagttggccaccacaatccagtcgtccaggctggtgaccagcccattcagcaggatgagtttttgccgcatctcatgggcgccgctgtagggacccagccacaccctggtattgggggggcagaggaggagtcaacttcacctcgtggcatgacacatagcgcagcatgcacgcaatgaataagcaactcatttctaaaaaggtaagccgccatgctcaaccaaagcccaggtgttacctgtagtttatgttgaactccctgagcacagtcagggaatcattcagtccttgcagaccatgcctgaaaaggggtatgcagtgaggaggtggtgagtgtcagggacccagcagccatcgcagctggtcccggtctcctacgtgccttgtccaggcacagatgcacagagtcctgccaacccctccacaaccccgacagggccagcacccacttcatgggattgtggtggaccaggaggaagatcttgtccgcggggatgcccagccccacgtagtgccgaatccagtgtggcagaattgcagcgccctcgtggtccgctgccaccacagagtacagccagatcctgagacaagtgagggttggggacttggggatggagattatgcgatctcgggggtcgtcaggacggagctcccaaaacgaggagcagcacaagccaagggacggcagcatctgaagcctggaccagagagcgaccattcatgagatattgaaaggggtgggctgctgcagcaaacatgcgccccgcctcgatgaattccacggctcacgtgtagttggtaagagtgggcgcggccacctccctggctactgcagagtcaaaggcggcagccgcctgctgctgtgcctcctgggctggcagactgatgtcatccaggccacccagcatctcgtagtgcacgcgagacaggccggacccgaagtcgatggtgtgggggtgacgttccgtggaccacgtctgcaggaagatcagtgcgctcgtcccaaaggctgcaaaccagaaggcgagggcttgcttccgcctgttgtaggaggcagagggtggcgagagtggagtgcacagcccgttgccgtgatgacagccacgaactcgttattccatgccttcccttcagatgaggggtctccttcacctctgggttcctatgcctgggcaaggcctgcaagcacatgagggtgcttgcccaagcgcttggtatgcagccgggtcgttgtttgacatggcatacaccttttggagcggagggctgagcacctaaacgcaggcagcaacgccgcagtttgcgtgcccttgcaacagctgggccgttgtcacgcgggcgacagagggtccgaaagaccgcgacaggacaacatccgcatattttgccagacttgattgtttctagtactccttgttcacctacgataccgaagctgatgtcgaggcgaggaccggtgcctctcattcgacagatgccggcaattcatgcggagggggactccccgattgnnnnnnnnnngaaaacccgcatctttcgccagacttgattgtttctagtactccttattcacctacgataccgaagctgatgtcgagacgaggaccggtgcctctctttcgacagatgacgacaattcatgcggagggggactccccgattgcgcgccctccctgcaaaacgcacaatcacccatcgagaccatttttcggcaaatccgctccaagctggctgtgagctgttgccggacgtagctctgtttcgaggtatatttccaagtaagagcgagtccctggtaccaagcattgtcggacacccatcactcctctgaggaaagagggtgatttgcagtgcggacacagggagcgacctcaacacctttttaactgtgggctagtcttataaactaggccaggatggccgcgacgctgaagcttcagactcggagacttcctcccgaagtgaataggtgaggattggttggtnnnnnnnnnntcggacacacggagcgacctcaacacctttctaactgtgagctattcttctaaactaggccaggatggccgcgacgctaaagcttcagactcggagacttccccccgaagtgaataggtgaggattggttggtccctgtctttgtcagggctcgttggcctagacagaggctctcgtaggcgtgtggaagtagcattaaagaacccattcaatacacttttccacctcagggctttgtatgtgcgcaacctgccgttcaacatctcggcggaggaggtgagggggagggtctgcctgaaggtcccatttggccctgcatgcattccagtcgctcatccacccagacacccaccatcccccgagccggcgccctcccaccccccccagatgtacgaaatctttggcaagtacggcgccatccgtcagatccgtgtcggcagcaccaaggagactcggggcacggcgtatgttgtgtacgaggacatctttgatgcaaagaacgcggtggaccacctctcgggcttcaacgtccaggtgtgctgggcacagaggcaatgggatgggagtggggagtctgtggcctcattttcacggcctgcgcttatgggagtgtgttggcgtgcagggctgcatgcctcaggggggagtttggcgtcactcttctgccctctcacagacatttccctgaccatccaacacagaatcggtatctcatcgtgctgtactacaacccggccaagatgaaggcaaaggccagcctgaaggagcaggaggagtcgctgcgcaagatgcaagagaagtttggggtggatggccagcagcaccctgcgccagcgcgatgaggcccctcctggatgctgcctttgctgctggtgtcgctcccctgcggctttgctgggtgagggcaagggtcagggctggatctgtggtgaggcgcctttccctgggctccaaatgcacccgtgcttgcacgcatgcgggcctttgatggacctgctggatcaagtcccagccttgcctctgcccccagccccctacactggtgcctgccagctgctcccatcccgccggcttgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgcttcccccctctctgcaagaccccatgggctcagactgccacggcccgcgcgnnnnnnnnnngcctcaggtgtgcgcctgcagtgctgctgtgaatgactgatctcaacccagggagcatccagccctggagcaacatccgcgtgtacttgagtgggagccggccaggagctgctcgtaccccacaaggctgtccagtgttgctatgtcttactctcgagttacagcagacagaggcagagcatgagggtggctcgatgtctcgtgtgcagtgcacaccgcctgtgcatcctgccgcaaaactgcttcccccctccgcaagaaaccatgggctcagactgccacggcccgcgcggcagcggcggcgggcgaccccgcgtccgccgcggccgcggccgcctgggccgagacgtaggggatcatgcggttgagggcggagatgtaggcgcgcgcagaggagaccaccacgtcctcgtgcgcccccgtgccgctgaaggcgcgcgtggtttgcccgccgcggcagtcggtgcgctggcccgcggcggcggggtcgcccgcggggcggatgacgacgcgggtcacggccagggcctcgatgccctcggtcacaccgttcatggagtagtccaccaggcgcgcgggcactcgcaccaggctgtcgatggccttgtaggctgcgtccacgggcccggtgcccatgcccgccgccacgcggggcaggccgtcggggccgatcagcttgaccgtggcggtgggcaggcccatggagccgcagaccacctgcagatcacccagcgcccacaccgcctccggctggtgcacgccgtcctgcaccagggccagcaggtcctcgtcggcaatgtccttcttcttgtccgccaggtccttgaagcggcggaacagctccgccacgcgctccgccggcaggtcgccgtaccccagctccgccaggcgcgtggacagcgcgtggcgcccgctgtgcttgcccagcaccaggcccacgcccgaggcgcgggccaggccgatggactcgggggtcatgatctcgtaggtgtcccgcgacttcagcatgccgtcctggtggatgccggactcgtgcgcaaaggcgttggcgcccacgatcgccttgtgcggctgcaccggcatgccgctgtagtcgcacaccatcttggatgtcaccgcgatgtgcaccgggttgatcccggtccagaggccgcccagctggcgctcgctgcggggtggaagggaggggaatgggggagagctgaatggggagtctgaggatgggaggacgatggcggtgaagtaatgcgtgactgacgagcaatctcaggttgccacgggcatgccgtgagaccgcggcggtcccgcctcccggcctcacccgcgcagggcgatggccatgacgatctcctccagcgaggcgttcccggcgcgctcgccgatgccgttgatggtgcactccacctggcgcgcgccgcccatggcacctgagggagcgccgggttgatgagggattggggtgagtaaggcagcatgcggacagggtggttgcccaggcatcagctcataccacatgtgggccccaaagatgcacaagacgccaaagggcggcaacagccttgcaacgcagcaccgatccccacgtccatacatcccacaaccctggaacaaccctgcacagcaactcaaaacgccnnnnnnnnnncggcggtgaactgattggtgactggtgagcaatctcaggttcccacgggcatgccgtgagaccgcggcggtcnnnnnnnnnngtgagggattggggtgagtgagtcagcaggcggacagggtggttgcccaggcatcagctcatactacatgtgggcccaaaagatgcacaaaacccaaagggcggcaacagccttgcaacgcaccaccgatccccacgtccataaatcccacaacccttgaacaaccctgcacagcaactcaaaacgccctgcacccaccagcaagggagttggcggtggagaggcccagatcgttctggcagtgggtggagaagatgacgtcgttggcgccgggcacattggcgcgcaggtccgtgatcaggccctgcgtgtgaatgagttggtaagggcaaggtggggcggtgtgttgtgtgggtgggcagaaacggggccggnnnnnnnnnnatgtgaatgagttggtaagggcaaggtaggacggtttgttgtgtgggtgggcagaaacggggccggggttcagatgcccggtacaaactggaaatgggccgctgtgcatgtcctgcttgctcacagtcacttcctcctagtgccacagtcgaaaacatgcaggctgcctctcgtacagcaaggatgctccccacccgaagcacctggaactcatggggcaggctccagnnnnnnnnnntccttcctcccagtgccacagtcaaaaacatgcaggctgcccctcgtacagcaaaggatgctccccacccggagcacctggaactcatggggcaggctccagccggtggtgtctgggatgttcagggtggtggccccagccttgatgacctcggccagcacctcatacaggaaggtcgggtgggaccgggctgcgagggggtggggggtgatggagggggcttggagggctgtgaccgaggaagccgggtgatggtggaaggggcaagatgcatggcatgctcttgggtgccacttcactaagaagcaatcaggagggtcaggttgaggcacaaccccgcagattcccacccacccaacaagagtgcacgtcacagacacacccctcccccacccgcggctcactggcatcctccggcgagaactcgatgtccttgcagcccagggagcggaggtgcttgacgctctccaccgcctggcggatgacctggtcaggggtcatgcgcagcttgtgctccatgtggatgggcgaggtggccaggaagacgtggacgcgcgggtggcgggcgtggcgaaccgcatcccaggcccgctccaggtcggcctcgctgcgtgatggggagatggggaggagcagggcgttgcacttggcgtgtggacgagggcaatggtagtggctcatacgaggggcaagcagtgcgcaacatgctccaccaaagatggctcctggcctgtacagcttggataacacaagcacggcacgttcatgagggcactgcctgccgtacaccctagcatttgctgccccttaccctaccccaggccctnnnnnnnnnnattaatgagggcactgcctgccgtacaccgtagcgtttgctgccccttaccctaccccaggccctcaccccacaagtccgccacctccccccctcaccgcgaccgagacaggccgcagatggccgggacgtagccgtcggcgtccacattgttgcccacctccatggcaattgagcgcacggcctcgaagtcgtcgggcgaggcgatggggaagccagcctcgatgacgtccacacctgcacgcgggggggcggggtgcgggttcaggggtctgcttgcatgttctggagcaggcgatgcgcatggnnnnnnnnnnaggggggtggggtgcgggttcaagggtctgcatgcatgttctggagcaggcgatgcgcatggcaagccgacccgccagccatgctctgaatccagtgggcggcgtgggcggcaatcaacagcatgcaaatgaacgagtccctcccagcagtcaacatcgtggtatgaatgtgtccctggtcctccacaaaacaaccagctggcgcacccagcttctgcagctgcttggcgatctccatcttctccttgctggtcagggtggcgcccggggactgctccccatcgcgcagggtggtgtcaaacacgcggacgtagttgggatcgtcgatgcggttggggatgtactctggacgcttccgctggggccttgccgagcccgccgacgcgcgggtgaccaggctgcgacggcatacccgggtggtcaggggtcgcgccgacccaaaacatgccgtgcggctggccatggcgcagccaagtcacggtcaggtgacaaggcctgcagacgagaagggcgcgtgggaggaacgccggctcgtgagcgctcggtcccgtgcagactcgtctgtatatgccaaatgtcgagttgttctattatgttaccatgttgtgaggatcggttgcaggcaaaaacgaccagtgcctgcggagcacgtgctggatgatgaggacgacgtggcatacccccccagatcggaactttatggaattgagatgcatgctcatcaggtcgcctatggggacaccccacaacaggtatatatatgtgataacgaatcttctgacaggaggccatcgtattcgtgttggaaaggctcgtggagcggcctgcggtgtcccaccctgcttggagcgcaccggcaccgaaccctccgacacgagactggggacaggcgcagccactgcgccgcaccgcagcgatgcctggcttcaagacagcctttcaaggctatggcgtccggttctcgcccttcgaggactccaagatggccgtggccacttcccaaaactttgggatcattgggaatgggcgccagtacgtcctgcaggtgcttgctgctcagattggaatactgcttgagaggaggcgctgcatggcatgtctctgccctctttgcgcgctactctgcagcccaggccccccttcacgcgacctgcctgcagatgacgccccagggcctgcaagaggtccggacctttgacacagtggacggcctgtacgattgctgctggagcgaggtgggccattggggtttggtatggagccgatggatcagcgagggtgtatgacagccagagggtacttctggtgcctgggttggattgaaagcccgtgccaagttgtgttccctccctctgagtatcaggaaaacgagaacatcctgctgtcggcgtctggcgacggcagcatcaaggtctgggacgtgaatgccccaccccaggccaaccccctgcgcagcttcgaggagcacaagcacgaggtgggaggccggaggttgtctgggagaacctgtgcaggggcctgcctgagtctttgcccgacaagccctggccaacactctccccacatgccccatctttttctccatctccaggcgtactgcttgcattggaaccagnnnnnnnnnngctgggagaatctgtgcaggggcctgcctgaatctttgcccggtaatccctggccaacactctctcctcatgccccatctttttctccaactccaggcgtactgcttgcattggaaccaggtgcgacgagactgcttcctcagcggctcctgggacgacacgatcaagctgtggaacctggagtccccccactccctacgcaccttcgcggaacacagctactgcgtgtacgccgcgcaatggtgcgtgcccgcgtgaggggatttgaggggtggcaggagggcagggcatggcctgagcgcttcggaggcgactggctcctgggctgcaggggttgcctcccttccccgtcgcctcgccttccaggggcctgcagccctgccccgccccctgatcctcatcatcacactccccgcccgccaccaacggtcacagcgcctctccagcgtgatcgacannnnnnnnnnttgcctcccttccccgtcgcgtcgccttccaggaccctgcagccctgcctcggcccctgatttccatcatcacactccccgcctgccaccaatggtcacagcgcctctccagcgtgatcgacagaaccccctgtcccaacctcatcccacccccccctccccttatccccgacacaccaacgcccaggaatccgcagcaggccgacatcttcnnnnnnnnnnacccccctccccttctccccgacacaccaacacccaggaatccgcagcaggccgacatcttcctgtccgcctccggcgactgcacggtcaaggtgttcgacacgcgccagccccggcccacgctctccctctccgcgcaccagcatgaggtgctgaccgcggactggtgcaagtacaacgactgcctgctggccacggggtcggtggacaagagcgtcaaggtgtgggacgtccgcgcgcccgcccgccccgtggccgtgctggcggggcacggctacgcggtgcgccgcgtgctcttctccccgcacgccgagacgctgctggcctcctgctcctacgacatgacggtgcggctgtgggactttgcggcgccggaggaggccgcgctgcgagtctgggatcaccacaccgagttcgcggtggggctggactggagcccgctctccgagggcctcctcgcctcctgcggctgggatggcatgacctgggtctggcacagctccgcagacccgcgccaggcctagatgtgggaagggtttgattctggagggaggggggagtgcgccagaccagtgacctgcttcttgttcgaggctccccaaatgtaccgcatgttacagagctagccttgctgtcagggaaggagtgggtgctgccagagagcgaaaaaggcagaggtcagggagagtgggcgtgactgcgccaccatacaaacgcaccgtggcgctcaatccgtcagggccgcactctcggccagcaggnnnnnnnnnngccgtacaagcgcaccgtggcgctcagtccgtcagggccgcactctcggccagcagggcctcgccttcctggatggcggcggcgacctccgggtcgggcaccgcgctcacggcgtgcaccgcgctcagctgctgcagccgccgccgcagcgtctcctgagaaaggaannnnnnnnnnnnnnnnnnnnnnnnnnnnnnnnnnnnnnnnnnnnnnnnnnnnnnnnnnnnnnnnnnnnnnnggacatcagcactcctgttccacaatggagcaggcagtgtgggagcacgtccccagttccgggagatttagcccactgcggcatcctgcaccccgtgcagtcacccccttccccagcgcaacaccctctgagccccacctccgcctcccggacgttcnnnnnnnnnnccctgcaccccgcgcagtcacccccttccccagcgcgacacccactgagccccacctccgcctcccggacgttcaggcgcgacatggtgccgagggcgggatcgccgttggtgcgcagcgccagcagcgtggacttgagggcgccgacgccctgcagcacctccgccagctcggcgaggatggcgggcggcgcgtcgccgacgccgctcacatccgcgccaggcgacagcggacgcgccacgccgtcctcctcgtcggtggtgatggtccaggtggccaggcccggcgcagaggcgccgttggagctcggcgcggtggccggcgccggctgctggcgctggagcaggttgttggcaaaggactgcggcttctccgcggccgccggctcggcgcgggatgcggggccatcgccgctccccctgccagtgtcccgccccagcagcgactcgcgcagcgtcgccgggatcgcgtccttgatgccctggggcagcacggaggctacgccggccttcagcccggcctccagggcggtgcccttctccacgtagtctgccactcgcgtctccaccacctgcgttgttagtttgtgtgggggggtgggggatgggaggatgagaggactatgggggggtccggcccgcacattggcctgagcgagcgttgttaacacaaccctgagggcgtacagggtgactaattcccagctgcacagcaaaccagccagcccacccgcccaccctcccaccccacctccaggacctccgcttgcttctggtnnnnnnnnnntgggggggttcggccccgcacattggcctgagcgagcattgttaacacaaccctgagggcgcacagggtgactcattcccagctgcacagcgaagcagccagcccacccgcccacccccccaccccnnnnnnnnnntgaggggcctggggtcctggaccaaggtccccagtctttgaagatccaagggcctgcatnnnnnnnnnncgatgggcctggggtcctggaccaagcttcccagtctttgaagatccaagggcctgcatgggaatgtggaacggaggtcgtgcccaatgcatggacgggctggcctccccgcttccgaacacgtcgttgccctcggaacaaacccaactcacagctgggacagtgcttccgggaacgactggagcacacccaaagccactcgaggtcccagggctagtacatcggcgggggnnnnnnnnnnnnnnnnnnnnnnnnnnnnnnnnnnnnnnnnnnnnnnnnnnnnnnaggcgatcacccggctgtggggtgggaccgaactgtgccctcccttgaacacctcgccggggtcggtgcacggggacggaccccagaccccggacctggatcacacttttttgcatggcgtggaatgtggaaatgaaacactactgtcgctcgacaaagagcgggatgaaggctgaccggagaatccgagctgcacaatatccatccagccgcgtgcgacgctgtgctgtgctaccgcaggggctccgtaagtcttgagagatagctgggatgccaacgcaggtggtgctcaaagtataaataattatcgcaatattatcgggctggagcatcgaggcatcgataatcttgagacctaagagcgtggcagcaatcactctacaccctcgtgcactgaggggatccctttcatcccagacgtattgctgatccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaggacgccgatgcctgaccctggtccgaaccatgtttgtttttatcagcctcaacctgaaacccttgcaggccttcccctgatgaacaaaannnnnnnnnncctacacccacctgcagtgaggggattcctttcatcccagacgtattgctgatccgtgcagtagcctcactgatgagcgctatgacgaaaacaccacctgcgaaccaactaaaggtgttgcttggcttgagtgccggtctcatcatcgcaggtgagaggtgactcttcgagggggtacgtcacagccccacataatcagggaacatcctgaaattcggtccgaggacgccgatgcctgaccctgatcctaaaatgcttgtttttatcagcctcatcctgaagcccttgcaggccttcccctgatgaacaaaaaggtgtaccagcgggagcaggcggtggctgccatgcgggacgccacctactccagtgagcctcaaatagacaaggggcaggcgaaggatgcagcgaggaacttccggctcaaacgatcggcgtgagctggtcgcaggcagctgctcatgggcagggcaccctgctcagacagagtttgcgctgatgatgcacggcagacggccaggtggaaggcctgtcctgtgggcccaacgcaggcgttccctgctgatgcagcaggctgctggtggagctggactcatacaccgcccggaactaatgatacgtttcaacagtgccaccaccagacgcctgtccctgtggtctggggccatcgctgtgccagcgacatgtactccacactctcatgcgctgtgcactacttccgcctcttcttcttcttgcttttcttcttgtgactcttgctcctctccctttgctcttcatcgctcgagctgccatctgagtccgggacctctatgcccgccgcccgcagcacgtcctttgcccgctccagctcactcctgtctgcggccttttgggcggcacgagcctccctggccacctgcttggctgccgccctgcgctcagcatccgtcatgccagcctctcgcagcgcacgctcctctggaaaagcaagaagaggggagagtttggcccattcagaccgaccgccgaggcagcggatagtggtggagtgtgcactccaaagtgagtatttctgctgttccccggcagcgaacgccaannnnnnnnnngggtggactgtgcactccaaagtgtgtgtttctgctgttccccggcagcgaacgccaagctcttgcccaatttccccaccaaaccagcatgcgccccccaccttcctcgctgtccacttcagcgatgacaaactgttggttggcggcccctgcatccaccccgccgcggggagggctccgccccatctcagccccgccccccttcagctcgaacctgcaatgacaacactgacaacagaacttggcacggtgttgctgaaggaacttgatgaaaggagaggtatcaagcagtgattttgaatgcagggcatgagcatgcatggcgccccttcccgacccggctccactccatcaagccactcccagaacatcaccataccccacgcacttgtctcccttggcggcccnnnnnnnnnncagccgctcccaggacatcaccacaccccacgcacttgtctcccttggcggcccgatacccctccagcatcttcgcaaggtagttggcccccaggcctccgcctcctgggccctggcctggtgtctgtccgctgggccccggccccgcctggctcgtcgtgcctgccgtggcgcccttgcccaggggaccaggtgggggcgtaaaccctgcctggctgctgcttgcccctccagaggccggaagcgtggacggctttgctgtcccatcctgacaggattgagtggcaggagatgcactggtggcgatcgagtagcacaaggaagcttgtgggatcgaaaacaagtacctgaaaacatggcaattgttcatgcggctctgtcctgctgacagagtgtcgcagctttccaatgtccaacgcctcatcgcacccggttggcttgctccaacctctccagagacgcatnnnnnnnnnncgagtggcaggagatgcactggtggtgatcgagtggcacaaggaagcttgtgggattgaaaacaagtacctgaaaacattgcaatcgttcatgcggctctgtcctgccgacagggtgtcacagctttcaaatgtccaacgcctcatcgcacccgggtggcttgctccaacctctccagagacgcatcgtagcctggaggcttcatgtacaggaatgaaacagactgcatgtacatgatgaagagggagcgtgagggcaggaacgtctgggcgagaatgatgtgcttatcgcataggtatggcctgtgcaagaggaggcagagtctcccccagggccctccaccatcctcaacaggctgnnnnnnnnnncgggtgagaaagaataatgtgcttatcgcataagtatggcctgtgaaagaggaggcagagtctcctccagggccctccaccatcctcaacaggctgtccctgcttgtgcagctgccccaagcccatcgtgcacaacacacacgaccacacctgtcgctgccggtacttctcctgctcctctgcgctcagcatggacagcgtctgaagatactcctgctccgcctcaaactctgcctggggatggatcgggcctgctccttgcaatctgggacagtgcaaggtacgcaaattacccgcagcaaaagcctgcctcggcaaagtgcgcccacgcttgccctacaggctgtacttcagaccactttgcaatgtccaccaatgcaccttggcctctgccttcttcttctcctcctcatacttggcttgctcggcctcccagacacgggcctggttccgaaagttcatgggatgccatggcttctgatttagaaagctgtgggggtggaagcaggggggggtgagggacggacagtcatggatcactcctaagacttgctaatgcatcctgcgggcataccatcgccctgctcacttgtgtgtccatgcagctccaacgctgttgggatcggagagatctcccttcttctcagcttccttggcggccttcaggtccctccgcacaccttttgaggggggatttcttgtcttcagtgttgagcaagttaaacgcaccgacgatagggttgttcacaacaaagtgcaacctctcggatggcgtcataggatggtagtgacgattttaagctcaaatggcctctcaccatctagtgcgcccatggccgggccacggcgggtgggaggctggggcacccccgacatggccgtccacttttccctcttcgatgtggatgcagctcccttactggttcacaaagtgcgtattgagacgaaacatggtactttctggtacatggtcgacggcttgctgcagatgcagtacagcaacatcgaaaatttcatgcactccatcagccacttccgattcctgctgcgcgtgctagacaagcacccccgaagtgatcgtcgagattctattctgtaacgacaacccccccaatacccaggcgcaggacaaagagtatgcatccctgagctgtctatggttcctgatgcttcaacagcacatgagagcgccccgcgagcaaggcgtgccggggcgcgtgcctgctgattcactctagctcccatggactgagcacttgctccatgcagcgcctcctcgcttgggccgtggttgccagcctcggaggcgtcacggccgacgctttgctgggccacggtgggcacccggagacctgggcgctggcatgcctctgcctctgggccggcttcctagtctccagaggtgacgagggctggatggaaggggggcgatgaatgacagcggacctctccgatgtcggctcaatgccttatatgagcctccttagctccgtggggaattgggatgcatgcgatggagcgtgaggcagcgcttcctcccccgaatcccttgcggacagggtctcggcacgatcgcataccccgccggtgcgcagtctacccccggcnnnnnnnnnnggcgtgagacagcgcttcctcccccgaatcccttgcgggcagggtctcggcacgatcgcgtaccccgccggtgcgcagtctacccccggccccccgttctccatgcacccatcacacctccctaatctctcgccacaggacctcggcgtttcaccgcatgggagctgcgaaacgtgttgtgggcctctgccagcctggtcagcttcgccttcctgctgctggatggcgaccttaactcgtgggccgacgtcttctacttctgcggcgaggacatgcggtactgcacctcggactaccgctggaacgtacgtggcnnnnnnnnnnttgggccgatgtcttctatttctgcggcgaggacatgcggtactgtacctcggactaccgctggaacgtacgtggctggaggaaggccgtggccctctggaacttcatgctggcgggggcaatgggcctccagcggctcgtcattgtcctcggcctgaatgggctgcacccaggtgaggcacggcggccggcgggtgacacccagggattcttgacacatgcacatggtgctgtttggtgacatagtttgcagcctggccatgcaatgagggcagaggtccatgccccgagatggggcagtgcagggcattgggattccatgcagcggggcgccacctcaaggcaatctctcctcacgtttggggaccaatgcgcaaaccaagcaggggaggacgtggtgacgcaggagtcctttgtctccatcggctggcggctcatcccctattggctgaacaactgggagcagcaatggggcgcagagtgctcctccatggtgtttgagctgccgcactttgcgctggagctcctggttgtgctgccctgtgtccaggtccgcggcggggaggcaggaagaatgggccaagtgcgtcggagttcgcacaccccagcccccagtattcgcccgcagacagtggagcttgctggtggaccccacccccctcccacgcccccaatgcccagatcnnnnnnnnnncgtccaggtcagcggcggggaggcaggaggaatgggccaagtgcgtcggaattcgcacaccccagtccccagtatacgcccgcagacagtggagcttgctcgtggaccccaccccccctcccacgcccccaatgcccagatcctctgcgcacggctgaagatcctggcccagccccacgtcgccgcggccctgccgccggaggatgcccaggccgaggcggcgggggagggtccaggggacgaacgggacgcacccgtgtggacccccaacatcctggcctgccggtgggagcggcggcgcggccagcggcgcctgcttccccgcctcaaggccaacctgcgggccatgagtctcaccctcttcgtctgctcacgtcggtggaggatggggtgggggggtgtatagtcgtacatggggtcctgcagtgttgtacgcgcatggtcgccagatgggacctacatttcagaaccaaaatgtgcctggcggtcagcagggggacccccatttcccaaaactacaacctccccccccccacacacaacacacaacccctgccccatgcagtggcgctgctgaacgcactggtcatgccgctgctgctggagcggtcggttgtgctggacccgcgctccgccgccgtgctggccgtggagcgcgagttgcacgccgtggtcagcgcggggcggtacgctgacctggcgctgtggtacggcggcggcggcggccggcgcgcgccgtcggaactgcgccgcgaggagcacgtgcgcctgccctggatggtgcccccgcccctggccccgctcggcatcggcgccgggctggggcc

SEQ ID NO: 41648 - DNA, 61 bp, Chlorella protothecoides
tattgcaagcttaccaggctcatcggatagggctatcgcccagaatcctcgtcgacacagc

SEQ ID NO: 41649 - DNA, 80 bp, Chlorella protothecoides
cgccgctgtcctcgcgccgcccctccacgcagggtccgagcgaggagcgcgggtcgcggctgaggggcgtcagccgctgg

SEQ ID NO: 41650 - DNA, 436 bp, Chlorella protothecoides
  modified_base (170)..(329): a, c, t, g, unknown or other
agccccgccgccgcctcggccacggccgccagctgcccggcaggcagcacgaggcaggcgtcggcgacctccagccgcgccgtgcgcgccgccccgccggcgaagctagcgatcaccgaggctgtggccagcacgcgtggcacggccaagcccggcaccgccatctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcaggcggcgcccccggcgcccaggaacgacagcgtgctgccggcacccaaggacacgcgcagcgccagctggcgcgccggagcggggaccgctgcgccggccg

SEQ ID NO: 41651 - DNA, 61 bp, Chlorella protothecoides
aggtgccgacgccgggcgagggcgcccgggtcgccggcccacgcgccaccgcccccgtggg

SEQ ID NO: 41652 - DNA, 69 bp, Chlorella protothecoides
ctccgccctccctcctcataattaaacaaatccttccttgaccccgcccctgcctccccacctgacagc

SEQ ID NO: 41653 - DNA, 908 bp, Chlorella protothecoides
  modified_base (342)..(351): a, c, t, g, unknown or other
  modified_base (571)..(580): a, c, t, g, unknown or other
gcggggcggggcgggcgggtaggatctggcattgccggctccgccgcgtcttcttcttctgtaggtccagagatatcagtggccggggcggcggctgtcggcggcgctttaccatccttggtgccgtcctttccatcattgtcaccgtcgctggctgcggcgcccagcaggctgtcgatgatgccagtttgcatggcagactccgcctcgggcgccaggagtgcggcgggagcagcggcctgccgatgaaaggtaaggggaaacactggtatgcgatggaagatgcagctcctgccagggtcagagtactcgtatcacacactccatggccagcaatcaccnnnnnnnnnnacggcagttggagagtttctactttttgggggggtcccgggaaggggagggggaggggaaagttgcaagtggttgcttgtgcactgtatcatcttgttcagagatggagaggcttgtctagaaacaacctgcagttgtgtcacgatccaagtatgtgcatcgtgaattggtgcctgggcagtaatgatcatcatcctgtatgcatgctcaccaccatgcnnnnnnnnnnaagaggctaatctagaaacaacctgcagttgtgtcacggtccaagtatgtgcatcgtgagttgatgcctgggcagtaatgattatcatcctgtatgcatgctcaccaccatgctcttgtccgtcccattttcctcacagaagccgcagcggtgacgctgggctctgatgacgaggaggacgccgcgtcagactctgaccttgacctggaggtgattgctggccatggagtgtgtgataccagtactctgaccctggcaggagctgcatctcccatcgcataccagtatttccccttaactttcatcggcaggccgctgctcccgccgc

SEQ ID NO: 41654 - DNA, 61 bp, Chlorella protothecoides
catcagccaggctggcaagggcagagagcgagagggctcgatggctcggcggccctcccca

SEQ ID NO: 41655 - DNA, 1194 bp, Chlorella protothecoides
  modified_base (591)..(600): a, c, t, g, unknown or other
ccgccgccgccctcgccgtccgccgcgccgccccccgcgcggccctcgcccgccaggcgctgggccaggccgtgcttgtgcgcctcgtaccacaccgccgcgctttctttcgtgaaccgcgccctggagaagcggatgcgccgcacgcggcgcgcgccgcggtgcagcgtgaaggtggcggtcacgccctcctccagcgcctcgtcccactccggcgcggccgagagcgggctgccgggcaggctgccctcccggatcaggctggacgcgcggctgtgcgccgccgggccggagtgggacgacgccggcggcccggcctccgggctggggcagcaccagtcgccagccgcgggcgcctccgacagcagcgccgagcgttgctgcacgatcgtgtgcgtgctggggtgagcaggggtgtgtgcacgcaggttgtgggtgggtgtccggagcaccaggcctggtcccccctgccagacagggcccatgcacggtgccagcgcagggccagggggcgtgagaccgactcacaccgggccccgccgcgcgcaggccccctcaaaccccgctcggtgcaaggccaagcctgtgcannnnnnnnnnggccgcgggcgcctccgacagcagggccgagcgttgctgcgcgatcgtgtgcgtgctggggtgagcagggcgtgtgcacgcagggcgtgggtgggtgggtggagcagcgagcctggtctccccggccagagagggcccatggacgctgccagcgcagggccaaggggcgtgggaccgactcgcaccgggccccgccgcgcgcagctcccctcaacccccgctcggtgcaaggccaagcctgtgcacacacctgcaccactccccccctgcctcgctcctgaaacccagccagagtgaaccgagaaatccttgcctggagctccagctctcgctggcgcagctcctcggcccacagccccaggcgctgctcctggttgctcagctgcgcctggcgccgggccagcaacgcctccatggccgacatggtggcctccaggtccgagtcggggatggagggcgccaccgaggagccccaccccgccgacaggcgcgccagcgagggcgggccggggagggcggcgcaggcggggagggcggctgcagagccgccggcctccctccccccctcggtagcggacgcctgctcggcgctcg

SEQ ID NO: 41656 - DNA, 83 bp, Chlorella protothecoides
atagcgggggaggggggctgcaaggtgcgctgatttgccgataggggatgggttcaactggtaccggcccgccataccacgca

SEQ ID NO: 41657 - DNA, 79 bp, Chlorella protothecoides
acacccacagcggcctggaggtggggggggggagggagcagagattgcaggggtggtgtggtggcttgggactcagggt

SEQ ID NO: 41658 - DNA, 61 bp, Chlorella protothecoides
ctgttgatggcacatgagctgtcgtcacactactgcatccgtgccaccctctctcaagggc

SEQ ID NO: 41659 - DNA, 455 bp, Chlorella protothecoides
  modified_base (129)..(263): a, c, t, g, unknown or other
tgtacaaggcctacctggacgactttgcggtcctgtgtgggcgcctgggcggcgccacacaccaggtcatgggagaccttctggcctttgaggccgaccgccgcgcgctgaacatcacgctcaactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgtggggggcagggaaggggaggggggtgttcctgcgtgtcggggcgaggcgcaaccagtgcgtctccggcggcactgttgctggaggttcattggttggttgagggccacgcgaccctgtttgcttcaaaaaataaccctcccacctacaccacagcaaatgagcatgccttcacacacctcaccctc

SEQ ID NO: 41660 - DNA, 61 bp, Chlorella protothecoides
cctccagacatgggaaggaggtcatattttcatggctctgtctggcggcagtaccctgtgg

SEQ ID NO: 41661 - DNA, 2033 bp, Chlorella protothecoides
  modified_base (222)..(231): a, c, t, g, unknown or other
  modified_base (423)..(461): a, c, t, g, unknown or other
  modified_base (595)..(604): a, c, t, g, unknown or other
  modified_base (656)..(665): a, c, t, g, unknown or other
  modified_base (756)..(765): a, c, t, g, unknown or other
gatgaaggccgaggatctgatgagggtatttgccaggggttgcagaattgacgatggcccaggcacctggctccatgcgtccctgtgcaacgccggcacctgtggacagcagcacatcacttccgctccaaacactgccgctccatggtcgtcaaccctcctcctgatccatccctcttctttccccacgtcgcagcgctgagctcaagagctacctgggcnnnnnnnnnncgccaggggttgcagaattgacgatggcgcaggcgcctggctccctgcgtccctgtgcgatgccggcacctgtggacagcagcacatcacttccgctctaaacactgccgctccatggtcgtcaaccccctacctcatccattcctcttcgttccccacgccgcagcgctgagctcaagagctacctgggcnnnnnnnnnnnnnnnnnnnnnnnnnnnnnnnnnnnnnnncagcgtttgctgacctggcattgagcgtgccttgtaacaaccctcctggaaagccgcaggcatgagaggccctggtgcccttcacaccacgagcagggttttgagggagagggaggggtggacatggtcgttcnnnnnnnnnntacgccacaagcagggttttaagggagagggaggggtggacatggtcgttcnnnnnnnnnnttgagcatgtacagtggggttccgaggcttgctttgggggggcctggcaccacgggccgagggcgacaggagctgaggccgacaggaggcnnnnnnnnnncagaggagcgaacgcctgtacaagggattcattgtcttccaagcgacaagacatgggggggagcaattgatgcagtaatgagcatgtacaggggtgttccaaggcttgctttggggggacctggcaccatgggccgagggcgatgggagctgaggccgacaggaggcgagggaggttgtgaacttgctgtgcctccttgacgagcggtgaagagccttccctgactccttgagagggcgggaccgccacatgcgtcccatccggcaggcactcattgccggtccacttccccaggacacttgatacagtgagatcaaagctctggctcgggatggagagggcgtcctctcacgcctccgccacaccggcaggaggggctacatgcacaacgcgcgtggcgacgagcgcttgccggcaatgcgactcgaccttttcatgcttgtggaagctgaagaaactacacagcgggaagggcgagggggggggggattgctggttccagggcaagtcagaggtggtcaaagccctggatgttacccaggcaatccggaagaagtgcaaaggcatgaatgcccccgagtccccacccaaactcacgtctcagcccaccacaacagcaccagtggaacatcagctcacccatgatgtggatctcgtttccgggaccccagcaccagaatactggcgttgacctccttgcagaaggtagcgatgcagctgtgcacggagtgcttgcccagaggtcggaccacggtctcgatcatggcgtcggagaggcgcgtgcgcttgagcagaatggcccgagccttgtccatgacctccgacatcgcgtccgcgacatccttcgggccagtgaagtgcaacatgatgactttgtccctggatgaccgtatgagaaacttgatggcataattgagctgcttctcccagtacacccgggggcagagggcgaggacgaccaccttgccctcctccacgaccgagctcctaggggtggcgtccaggcatctccgcactgcgcacaacgtgagagtacaggtggttgaatgtgtataacgatggcgtgacgctcctctggccccacccaacctccgctgcgactcacagtcagtgtccacctcgaaggagtttacgcccagtccggagggagactccatctttaagtggatggtatgagtgagtagtatgcttttgtaagaaggtttcaattagctccagaaattccccaaagtacggtggagcaccacttcttaagtgctagacctact

SEQ ID NO: 41662 - DNA, 78 bp, Chlorella protothecoides
ccacgccagcgcccgtcgcagcgacagaggcaccggcgctgcatggcgtggcaagcgatcaggatgaggggctggccc

SEQ ID NO: 41663 - DNA, 121 bp, Chlorella protothecoides
tactttgagaattggtgccaggtgaggggcgaggggtggggcttggaccggcctggaggtgaaggctggtgaggtggttggccacacgacatgcctggggagtgcatcatgtggagggatt

SEQ ID NO: 41664 - DNA, 144 bp, Chlorella protothecoides
catcaacgagcccaggtggagcccggggccaggcaccagcagggtctgacgacgccatggcgctcttccggccaatcctgtgccgcattctgtagatgtccttcgcggtcccctcctccccctccccctccacgacgcccgcgc

SEQ ID NO: 41665 - DNA, 61 bp, Chlorella protothecoides
gctggacccatacccacgatggccccggttggacattgacatgctatgcgcaggatgtgct

SEQ ID NO: 41666 - DNA, 59504 bp, Chlorella protothecoides
  modified_base (210)..(219): a, c, t, g, unknown or other
  modified_base (5059)..(5068): a, c, t, g, unknown or other
  modified_base (5566)..(5575): a, c, t, g, unknown or other
  modified_base (5966)..(5975): a, c, t, g, unknown or other
  modified_base (6648)..(6657): a, c, t, g, unknown or other
  modified_base (7365)..(7374): a, c, t, g, unknown or other
  modified_base (8518)..(8527): a, c, t, g, unknown or other
  modified_base (9250)..(9259): a, c, t, g, unknown or other
  modified_base (10193)..(10202): a, c, t, g, unknown or other
  modified_base (11361)..(11370): a, c, t, g, unknown or other
  modified_base (11622)..(11631): a, c, t, g, unknown or other
  modified_base (11918)..(11927): a, c, t, g, unknown or other
  modified_base (12100)..(12109): a, c, t, g, unknown or other
  modified_base (12362)..(12371): a, c, t, g, unknown or other
  modified_base (14598)..(14607): a, c, t, g, unknown or other
  modified_base (14885)..(14965): a, c, t, g, unknown or other
  modified_base (15246)..(15255): a, c, t, g, unknown or other
  modified_base (15618)..(15627): a, c, t, g, unknown or other
  modified_base (16021)..(16030): a, c, t, g, unknown or other
  modified_base (16352)..(16361): a, c, t, g, unknown or other
  modified_base (16917)..(16926): a, c, t, g, unknown or other
  modified_base (18174)..(18183): a, c, t, g, unknown or other
  modified_base (18622)..(18631): a, c, t, g, unknown or other
  modified_base (22185)..(22194): a, c, t, g, unknown or other
  modified_base (23114)..(23123): a, c, t, g, unknown or other
  modified_base (23610)..(23619): a, c, t, g, unknown or other
  modified_base (24567)..(24576): a, c, t, g, unknown or other
  modified_base (25810)..(25819): a, c, t, g, unknown or other
  modified_base (26601)..(26610): a, c, t, g, unknown or other
  modified_base (27087)..(27096): a, c, t, g, unknown or other
  modified_base (29630)..(29639): a, c, t, g, unknown or other
  modified_base (29960)..(29969): a, c, t, g, unknown or other
  modified_base (30056)..(30065): a, c, t, g, unknown or other
  modified_base (30230)..(30239): a, c, t, g, unknown or other
  modified_base (31026)..(31035): a, c, t, g, unknown or other
  modified_base (31524)..(31533): a, c, t, g, unknown or other
  modified_base (31612)..(31621): a, c, t, g, unknown or other
  modified_base (31958)..(31967): a, c, t, g, unknown or other
  modified_base (32030)..(32039): a, c, t, g, unknown or other
  modified_base (32094)..(32103): a, c, t, g, unknown or other
  modified_base (33725)..(33734): a, c, t, g, unknown or other
  modified_base (33911)..(33920): a, c, t, g, unknown or other
  modified_base (34596)..(34605): a, c, t, g, unknown or other
  modified_base (34939)..(35104): a, c, t, g, unknown or other
  modified_base (35349)..(35358): a, c, t, g, unknown or other
  modified_base (35869)..(35878): a, c, t, g, unknown or other
  modified_base (36333)..(36342): a, c, t, g, unknown or other
  modified_base (36587)..(36596): a, c, t, g, unknown or other
  modified_base (36813)..(36822): a, c, t, g, unknown or other
  modified_base (37211)..(37220): a, c, t, g, unknown or other
  modified_base (37477)..(37486): a, c, t, g, unknown or other
  modified_base (38090)..(38099): a, c, t, g, unknown or other
  modified_base (38331)..(38340): a, c, t, g, unknown or other
  modified_base (39326)..(39335): a, c, t, g, unknown or other
  modified_base (39562)..(39571): a, c, t, g, unknown or other
  modified_base (41477)..(41486): a, c, t, g, unknown or other
  modified_base (41680)..(41689): a, c, t, g, unknown or other
  modified_base (41888)..(41897): a, c, t, g, unknown or other
  modified_base (42350)..(42359): a, c, t, g, unknown or other
  modified_base (45158)..(45167): a, c, t, g, unknown or other
  modified_base (46402)..(46411): a, c, t, g, unknown or other
  modified_base (46636)..(46654): a, c, t, g, unknown or other
  modified_base (46993)..(47002): a, c, t, g, unknown or other
  modified_base (47424)..(47433): a, c, t, g, unknown or other
  modified_base (48252)..(48261): a, c, t, g, unknown or other
  modified_base (50696)..(50705): a, c, t, g, unknown or other
  modified_base (51312)..(51321): a, c, t, g, unknown or other
  modified_base (51830)..(51839): a, c, t, g, unknown or other
  modified_base (51892)..(51901): a, c, t, g, unknown or other
  modified_base (52118)..(52127): a, c, t, g, unknown or other
  modified_base (52271)..(52280): a, c, t, g, unknown or other
  modified_base (52430)..(52439): a, c, t, g, unknown or other
  modified_base (52919)..(52964): a, c, t, g, unknown or other
  modified_base (53118)..(53127): a, c, t, g, unknown or other
  modified_base (53184)..(53193): a, c, t, g, unknown or other
  modified_base (53250)..(53259): a, c, t, g, unknown or other
  modified_base (53697)..(53825): a, c, t, g, unknown or other
  modified_base (54667)..(54676): a, c, t, g, unknown or other
  modified_base (54960)..(54969): a, c, t, g, unknown or other
  modified_base (57115)..(57124): a, c, t, g, unknown or other
  modified_base (57412)..(57421): a, c, t, g, unknown or other
cgggcgccacgtcgtcagccaggtggcgcgcggcgtgcgtgcgctcgcggtcgctgtaggcgaaggtgaaggcggcgtcgaaggcatggcgcaccatcagatccaggctggcggcgtggtcggcgggcgtctcgccgcagaagccggagatcatgtcggtggagagggccacgccgggcagcgcggcgcggacgcggtcgaccagcgcgnnnnnnnnnnaggcgtctcgccgcagaagccagagatcatgtcggtggagagcgccacacccgggagcgcggcgcggacgcggtcgaccagcgcgtcgtaggcctcgcgcgtgtacccgcgccgcatggccgccagcaccgcgctggacccgctctgcgcgggcatgtgcagctgggtgcagacgttgggccggtccgcgatcacgcgcaggacggcgtcggagaagtccttggggtggggcgaggtgaagcgcacgcgcagctcggggtctatctcggccacgcggtccagcagctccgcaaaggacaccgcgccggcgcggcgggggcgatacacgctgcggaagccctgtgcgcggggttgggggtgtggagggggtgggagggtgagaggggggtgggttgcatatggacgcagggactgggtgaacaacgaggctgggatccccaaggggcagaccccgcatgcggatttgaccgtgaaggccagctgccctgcgtcgagaccatgccaccagcttgtatactcaaacatcgccaacaccagaagcccttgcctgtgcatagacttcctcgtctggggcaccgaaggtggcgcgggccgcctcgccggcagcggaaaagtcggcgtagctgttcacattctggcccagcagcgtgacctccttgaagccggagtcggacaggcgatggacctgcacgagaaggaggggttgtggtggatgcagagggtgggtgacgagccacgatgttgaaatttctcgagtaagccatgcagcaggctgcggccagcggggacaaatcctctgggcatgaacgtccaaaaacaagccctgtcaagagcctcggaaagactaatcatgcccctcacggtggatctgccgccccgccggatagggcggggcaggcagtcaggcgagtgtatgtgttcgtcatcggcaacaaggcaagaccaatcgccgtgtctggaggtaatggtgctgacaccaggtgccattgcagtgcaggcacgatggcctgcccacctgccatccaagcagctgcccttcccatcgatttccggccctgcctggcggcacccagcccacctcctccaggatgctggccaggggcctggagcgctcccggccgcggacgtagggcacgatgcagaaggcgcacatgttgttacagcctcgcatgatggagaggtaggcggagtggctgccgccggcgcgcaggggcgccacgtcggcgtaggtctcgtcggcactgagctggacgttgatggcggtgcccgcgccgcggcccgacaccaggtcgatgaggcgaggcaagtcgcggtacgcgtcgggcccggccacgatgtcgaccaggcgctccgactccagcaggcggtgcttcaggcgctcagccatgcaacccagcacccccaccacggggccgggggaggcgcggggtgcagcgcgcttcaggttggagtagtagcccaggcgctgccagaccttggcctccgcgttgtcgcgaatggcgcaggtattgagcagcaccaccgaggcggcggccggggagtcggcacgggagtagccggcgctggccaggatgctgtgcaccacctccgagtcggcgctgttcatctggcagccataggtctccatgaacacgctgccccgggtggaggcaggggcgtcgccgagctgggcggcggggtgccggggctgggaggcaaagtcctgcagggtcaggccatcctcgggaagccgtcggctggcggtggatgcctggcgcagggggcccagatgccgcagcacgccccgctggcatgggcccgtcacgctcatcctgcggggttgcgcccggagcgtgacctcaaggcaccgcgatcatcgcatgtgtgtaggaagattaatgtacatgattgcatatagcatacaaatgatccgattgcatgcaatggtcaaagcagccccatcacactgcttcatgctgcaaggtgcaaacgggtggtaccgcaggtcgggatggtaccctcatagttcgacctgttcctcgacaggcgcgccatacccgacactgggaagcgtgtttctggctgcattgtcgcatcctcagacacgggcataaggaagtggttcattttacagccgatgagtccagtccactcgttgccctagctgcctctgcaatactccgcaccgcaatctactgcaaggaaatcaggccggaagtttgatccgcacctacactcgcacccagacccggaaatgttgttgtaaggggcttccgggactctggccgcaccgatatatggcgcattgcaccatcacgtccaagaatgtgtcttcccctcgcgccctcgaaattggctggggcgaggacagggagctcaaggacgacaattacacgtgagtccctggagatgggcgatggggagatgtaacatggaagtgtactgccggggcatacatgtgatgatgtcaaccagcgttgccttgccccaccacttcgatactcttgcggttgcacacagaaagctctcggtgatcgatctgatccgtgagcgctggggctggctcctgatcttcttcggcggcctggtgctggccgcgctggtcgtggaggcctttgaggacgttttgaaacacaacgtggagctatcgtactttgtccccctcctcattgggcacggcgggaacaccggcagccagagcaacgccaccgtcatcaggtaggaagccagagccggtgttccgggtctacgagtggatgtctgggtggcggccctctgtagaaacacccgttgcgcgtgagctcgacgcttcacgcccgagctgggaggctggtcacgctggggacctctggatcatgccatacttcccatcctccctttcccccggaaaaccatcgctcggtcctgaatcgcagggcgctggccctgggccacgtcaagcccagcgactacctgcgcgtaatggccaaggaggccggggcagggaccttcatgggcgccatgctgggcctcatgatcctgggcttcagcttcctctgggacagcatctccacccaggtcggccttgtggtcgccatctccctgccggtgagcggggttggagtgacgggggaggagcgccaggggggaggaggttgctggccaggagcacacaccatgcacgtgcattcagggagtgggcaggcagcggctcggagtgcggggccggggcgccgatgccgccatctcggcgcggccaggccctgagatcgggtgcgccagcctccactcttctccgctttctccacaccccgcagctggtctcgctgtgggccaacgttctgggcggcgtcttccccctgctctccgcgcgcttcggcttcaaccccgccgtcaccagcgccccactcatgaccaccgtggtcgactcctcgggcctcatcatctacttttacatcgccaagatcgtcatgaagatgtagggggcgggacgcgccccgcaggaggcgccccggcccgaacagggccgcagcagcctgcatgcagcgagcaccacctgactcccgtgaaccctcagaacgcagcctgcccgtcaggtctcgcacgtgttttgtcacagcaccgctgagcgcatgggtcacccctcactgggccaccacatccccgtaggcgttcaggtccagggtgaaggtggcggaggcgctggtgtccgggtggcggcacacccccaccagcgcatcggccttgtcgtagaagctgtccttcaggctgatcacgatgccctgcgtggagaatagggtgttggacgggagggtggcgtcgaaggtgcgcgccggtctcaggcacggtgaacgcgggcgccgccgtgtcaagcaggcggggcaggtgggtgctgagtcgacacgcgggacccatggactgtgcggggtcggggtggcaggctcccggctccctcctcccgcgatcacgcacctggaaggagccattggtggagcggcgcgtcatgtggcgcaggtagttggcgacccgcaccacgttggccgcgtccagggccgcatccacctcgtccatcacgaagaaggggcagggccggaagctggcgggagaagtgtggggtggggtggggtggggaggggatgcagatggggcgaggtgaggacccctgaagctggccgccaagcgtgcgaagccagggccgacactgggccccagacctgggcatgagaccccctcaccccgaccaccagaccccactcgacacacctgaggacggcgaagaggagggccagggccgccacggtcttctcgcccccgctcagcgcctccatgtcccggaagcgcttggtcgggggcatggcgctgaacttgaccccggcgcagaagggctcgtccgcactgtccagcgccaggtaggcctggccgccagaggggtgcaccgcgctgctcgtcagctcctgtgccaggggagggagggacgaggaggggttcggtggcactgcgcgcgctggccaggtgaggctgccctgggtgttcagagcctgtgatcggctgggcgccagggctgacctcgacctccgtcaaagtcaagccccaccagcaccaacacattgcgctgcccatcccagagggccctcctcaccttgtagatgggatcgatgcaggccgccacgtgctcgaaggcggcggtgaaggcgtcgtgccgagcggcacgcacggcggcaaaggccgccgcggcagctcgctctgcgcgccgcgcggcctccagctcctccaggtgctcgcgctcgcgggcgcgcaccgcctcgaactgcgccgcggcacgtaggttgggtgccaggcgggccagcgccgcgcgcagcgaggccagggcctccttgtgctnnnnnnnnnngcgcaggttgggcgccaggcgggccagcgccacgcgcagcgaggccagggcctccttgtgctcgaggtcgaatcggccgcgcgccgccgggtcggtgctcctcaggttccggggcagcgcgccaaagtcgatgtctgcagtcgtgggtggggacgggggtgaagagggaggagtgatggaaggtcggagaggggaggctgggcgactggccctggctccctccagccgcccattgaagagctggttgggtgcatcattaggcatttcctggagaggactaacctccatgcccactgcactgctgatcatagtctcgtcaccctgtcctggaaggactcaccaaccagctgaccaccccaccatcacctgctgccggggagtcggcagcctcctcgccgtcctcctccatggccgataacggcgtggccgcccgccccatgcgcgggaggggcacctgctccctctccgcctcctgcgccacctccacctgccgcgcgnnnnnnnnnncccaccccaacaccacctgctgccggggagtcggcggcctcctcgccgtcctcctccagggccgataacggcgtggccgcccgccccgtgcgcgggaggggtacctgctccctctcggcctcctgcgccacctccacctgccgcgcggccagggcggctgcgttgctcgaggcggccttcagcgcacgctccgctgcagcgactgtggcgagggcagtaggtcggaggatggtcttaggattgcgtctccaggacgagcgggaagggtgttcctgaatcttgacaataatgagccaggcattcttctgtcccgtgccctgcgccatggattgcactgcccctactgcctgtgtcagcctattgtgcgcatcacgctgatccccaatcatcnnnnnnnnnngcttccgtcccgtgccctgcgccatggattgcactccccctaccgcctgtgtcagccctttgtgcgcatcacgctgatccccaatcatctttacagcaacctccccctccctagccccagcagcaccttctgcagcttggttcagggccaccccctttagctcccggaccgaggcgtccagctcatcgatcgccgcacgcaggccggcgctttcctcctgggccgccgcaaggcgctcctgcccgcccttgctgctctccacgagctttgcctcggcctggatatcaaaggtgggcgggaagagcagcacgcttgtactcacgagggtgcgcaggagccagcggtctgaaggaagaggcacttataccaagattgcaagaaattatttcagatgcggacaaaaagctattcattacagccctcgagctgacggctcacttggattcccatccacacacctcgttcagttccccctgggcagcctgctccgctgccagatcgcgctcgaggccagccactgtcccgctgatatcagcgcgccggtcgtactccagctggctggtcagctttgagatctggggtgagggggacgtgcatgcatgcgagggagcctgaaaatgcagtgctgatcgatgaggacactgaggagggtagaaaggcgggggagatttgnnnnnnnnnnggtgagggggacatgcatgcatgcgagggagcctgaaaacgctgtgctgatcgatgaggacattgaggagggtagaaaggcgggggagatttgcatgcgcactctgctgcacattcccatgctatcgagctcgggaggcacctgggtggtgagctggagcctctcccgtgacgcccgctccgtgcgcatcaggtggtcctgctcccactcgcggatgctcttgacgccgactttcctgtgaatggcatcgagcttgtttggatgtgagagggaggctttcaagggttggcaggacgctcgcgtgtgtgtactggcatgtttcccgaatctatagtccatgcgagtcccacacagagccagcatggaccccgtcagatccctctacccaccttgagaaggaggcaaacacgcggtcggtgatctggtggatggatgccgtcagcctctcgatgtccttggcccgcgccttcatgctctgctgctgtttggcggtgaggggagccctgaccgcacgctcctgaaaaggatgcattgtgaaagtttcatgatgtgaaagtgggtctgtgacgtcatgctacagacctatggacctcattaaagcatgggttcagtgagggtcccaagacgccagcaccctgacaagccatgcgcattgaaggtccacccacgccccagctcaccttggtcagcgcggccagctggcccttnnnnnnnnnnactacagacccatggacctcatcaaagcatgggttcagtgagggtcccaagaagccagcaccctaacaagccttgcgcattgaaggtccacccacgccccagcccaccttggtcagcgcggccagctggcccttgacctcctgcaccctttcctccgcggccttgacgtccacccgtgcaaagtggagctcattggtggttttgctggagagtaggaaggagaaatgtttgagggtggcgcgagtgtggagtggtcgagagatccaggataccctggggggtggtgtgtccagacctcagcacagcgtccagctgccattgtaggcattgcccacaccaccgtgcaagcatcctcctctccaggccccagcccctcacgtgaggcttgtctccagctcctgcgccctggtgaccagctggcgcgccgtcggcagccgtgccagctccccctccaggtcggcatgttgctgtggggatcgggtgatgcagagttggggacgctgagtcagcactggaccggcaaaaaccgaggcgccaagcctggttggccacaaacgcatgacgcccttctccctccatgcacagaggcatggcttgcatcccaccacgcacatccctccttccccctcagatggcccacctgcttcatgttctccagggcctgcctgtcccacttctgggccctggcctccagcccagcatacacgccgccggagatgatgccagacttgttgatcagcgtcccgtccatggccaccacctggacgcgggagggggaccagggaggaaatgttgaaaagcagtggattgctcgcgaagtcaagcaattgggtcaggccagccgggagcgggggcctgtccagcctgtccagcagcacgcagcatgagaaattaaacccaccttcctccgcatgccgggcgtgccaaaggccagctcccgggcctcctccaccgtgtgacagaccagggtgctcctgcggacatgttggaggaaggaatctggtgaccccttgctggtgcaccacgtcctcatcgaggctggcatgcccaaggagcattgcacccataaaccccactactgccctccccagggccatgcagcgcaactcagcgctcccgcccgtctaagccctcccgcccgtcnnnnnnnnnnggtgcccacgaaccccaccactgccctccccagggccatgcaccgcaactcagccctcccgcccgtccaagccctcccgcccgtccaagccctctcgcccgcctcaccccacgatgcccttaaagacacggaccagggtggggtccttgatgtccaggcactggagggccaggcgtgcagaccccggcagggccccctgccgctcgtccacgtccttgacctggggccaggagtgaggggtggcaggaaggctggtctggaaatgttcagccaggctgctgcatgagggtctgagaccggaggcagcgttcgtaacacagcatcaactggctcatccaacggtgcgatgaaccctactccagggtgtcccactcgcactcttccccacccaccaacccaccctgaggctggcgatggggaggaaggtaatgggcggcacccgctgctccttggcgtactggatgcacttcatcccaacctcatctacatagagggcggggaggggacggaagtggcaatatgctgtccaggaggctactgctggacctagtcatggtgctcacgcccagctagggacccctcgtcctctgtccgattactcgaactgcccgtacaagggcatagaacggctacccagaggtgctcttctcctgccacattactatacctccccaacagccgcaccccaccgttccacccccgcaggtatgcggcacgcagcannnnnnnnnnccaccagccggcccccaccactccacccccgcaggtatgcggcacgcagcacctgtgtccaccacgacggcgtcaaagtcgcggcccatgaccaccgccaacgccagcttccacttggcttccaccacgtccgccaggtcgtgcacaaacccgtgcacccctggcgcaggtgtgggagggatgcttggtgagcgacatggagtgacatcttggcagtggtggtgggcagggaggtggccccccacaggccaaccacgctttcgcaatggccatggcccagggttgacatctctcaatctgggtcgggaaacagcgctcggaggtcccacctaccccacccccccctcgactcccctgcccacctggaatctggcggcgcatggcggccaccacctcggaggtgcgctgctcccgcgccccctcgcgcttgtcggccctggcctcgcggatggtgttggccaggtcctccgcccgccgcgtcagcgcctccctctgcatgagtgagaggcgagcgagcacatgggcgtgacgatggagcctcccagctatacatgttgaggagtttcttgaggttcctctatcctaccaacacagcagtgtggtgcagcatctcatgcatctggctagtgcctgaagcaatgccctggcactgctcccccatggacccaccccacccaccctggagtccacgcgccgacgctccccactggccccctcccgctccgcctgcagcgtcgccagccgacccgcgagctcctgcacccgctccttggccgcggccagccgctcctcggcctcgacacgctctgtctctgtggcgatggatcgcggcggcgggcacagggtctcatgcgcaatcccaaagtcggcggaggtgagcgcatgccccactgccaaggcctgttccccccgacacatctccacccacccaggnnnnnnnnnnagcggcgggcacagggtctcataagcaatcccaaagtcggcggaggtgagcgtatgccccactgccaaggcctgtttccccccgacacatctccacccacccaggccggcgatgcgcgcatctacagcctccaggctggcctgcgctaggcgctgcgcctcctgctccgcctggtgcgtggaggaaagcgcggcgcgatcgagctccagtgctgacacctgggcccccacctcggccttcagccgggcgtactcggccagcagcgtctccgacatcgccagctcgtcgctcgaggcggctgccacatcggcgtccagctgggccagcgctggggtgagatgggggagggaggcggtgtgggatgtgaggcgctgcatccgggtcacaacctcacacccgtcctgcccagcggagcacacgcccgcgctgcacccaggcacacacttccctgcccacccaccatcgttcaggctttccagctgccgctccagggcggcgtgccgagccctctgctcctccacgccatgccggccctcctccagctgcttctgcagggacgcgagccgcttggcgccgcggctcagctcctcccgcaccctgatcaggtcgggactgccccgatccagctcggccgtcatcttgcggatcctggtttccaggagcagccgcttcttggccagcgaggcctgctggcggcgctgagactccagcagcgccttgttggcctgcagaggtggttgggggtggagggtcggcggcatgaccccgcaggctgtgcctgggcattgatcctgcgcagagaatgcatcgacacccccgcagtcgctgcggcagggaggcaggcacgtgccgtcaatgaatatgtacgacaggtgccagcacatgaaaaagagtggggcccatccttcaaggcacaccttgatgtccttctggatctgagcaatgccctcgcgcttggcatcggcctcttgccgggcagcaagctcatcctgacgaaggtggaagaggctccacaaaaagtgggtagcgcgccgctcgtcctggagagcgaaattggcgaggtgggagatgtttcaggaatgttggcagtcccttctatatcaaatgtggctagggttttacgatcacagcaatccactcacgatttctttctggaggnnnnnnnnnnattcgatgccaaatgtggctagggttttacgatcagagcaatccactcacgatttctttctggagggcgatagcacgatctgcctcctccttctcctctttcttctgctttttctctgcaggaatgtggaaaatgtaattggttctgaggagaggggtgacagagctggagttcatgaatgggatatcctgccaagcagtcaattgcctgcccctggaaagtagcgtccttggtcatgcaccataccacacnnnnnnnnnngtcctgccaagcagtcaatcgcctggccctggaaaatagcgtccttggtcatgcaccataccacacccacccaagccaaagctcctcaccatgtgctatcgatttctttgctgcgtgaatgactgagaggcgcgcttcagctgctgccctttcctggtccgctcgttcatactcctgcgagcaagcttagggggcacatgcatgatatcgagtggacaacatgtctgcatgtcagcaaggtcatatttgtgaaagcaggctcaatgagtgattcgacctggggcctnnnnnnnnnnaacatgcatgacatcgagtggacaacatgtctgcgtgtcagcatggtcatatgtttgaaagaaggctcaatgagtgattcgacctggggcctacagattcaacgcatgacaccctgaatcttgctccaaggacacatcacactcacctctttgtaagcagcagaccccgagannnnnnnnnntgcttgacaccctgaatcctgctccaaggacacatcacagtcacctctttgtaagcagcagaccccgagatctgctcaaacatggctgtgagctcaagtggtctcatctgcgccacattctcaatgtcaccctgcttgcatgggcatatttagggtggagcgagatgggttcactttgcaagaggttttaagagatgagaagatggtcggtcgctagtcaactgagcttgctgtgagggcgcccgctgagaannnnnnnnnngttagggtggagcaagatgggtttactttgcaagagtttttcagagatgaggagatggttggtcgcttgtcaattgagcttgctgtgagggcgcccgctgagaacgagtttcaacaatgtcaagaaacaccagggtgccttcatcagggaaccgaatcatgcctgagcggcgggcttggatgtgtgcccaatgtccatttaaccctcatgaccccacctggaagacgaggaaggtgcgtgctttgacgaggacgccaaacccctcgaggcgggggttgtatgcctccagcgtgacttgcttgccattgatacgatactgactcgtgtgtgtgctgccgtcgcctgaggccacaatggctcgagtgaagtgcacctcctcggcccctgggtccccaggctggaagaccagcgtcacccgaccagtcttgggcctgcaaggtgggcgttatgtcttgcggtaagctcttctggacgtcgatttggtctttcagagcaatggtaaccagcatcacacgattcttctgcggtatgcaacgtagcatgaatatcacggagccagccccaccgtcacctgtcctccggcgactggctgtcggagttaaagtacagaagctcgctcaagctgcctcgcaggtgcgctgtgcgcacacccaggacgaagcttatggcatccatgacattgctcttgccactgccattcggaccgatgatggtggtgaagtcatggaagggtccgatgacggtgatgccgcgatacgatttgaaatcctggacctccagacgcacgacgcgtccataactgctaggctccataatggtaaagtcgaatttttgtttcgtcgtaggcccggaaagacgctggtgggcgcctatgcgctctgcgccagatcgtccgcctcagggtggtgggtctcgtggagtgcgacagtactagaccagatggggatgtgtctagcggtgcgtgacatgtatggcatgcaatcatgaatgacgatccctgctgcatgccctgcgcatgccgggaatgctttgttcatgctgcacgattcgtattcgggacagagcatgccgagcacgcgagggagacgatccgtttcaaggcagcgcgtgacagacggagtggtgtgggtgtgggaggcgctggtatagggctttaccacaaccaggtctacaaagaggaaataaaatgcaggcgggatcggggaccgaccgtctgctcctgcagacggtgaacgatgtgcttcgtgcacatgaggtgggtgtgctggtgttttgctcgggctcctaagcacatgattgctttcctgccttatccctcgatggccatattatcgcatttgtttgttttacgtgacaaaaggagccttcctgctgcgttatgtacatttctggccaaccctatttctccgcttggcgtgcataacaacaccagtatcctctgttgtttgctcccccctcccacaaccccttacccccccttcacatgttcgaccacagacccgtgatgccctggccactgcaagcctggccgacctcaactcttacaccaagcgctttgcccgcctggccggccctgggagcggggagatcgatctgcccgccctcctccaccacttcgactcggagctgctgacgggcacagccctgcagcgcatcctggagcatgtcggggtggcgggggtggcccacgtgacccggggccagttcctcgccgtggcccacctcgtgtgcaccgtgctgcagcaggtgcaacaggcgttgtttgagggcgaggcgtcagatgggagcctggcctcccccactccggcggccaagcacgccagccccgccacctcccagcacagctgcatcgcgcggcgccgcaccgccagcgggccgggggggaactggagcatccgggccgagcggggcgccgcccgtggcgctcggcgcacccaccatcccaccgtggcggagctcctgagccaggcgggggcggaggagggcagccaggctccctcttgtagcgcggtgggtgcaagtggagacgaggcggaccctggttttctcatgtggacctgctcggatgcttggctgtccggctgtccagcggtggatggtgcacgaaagaggtggaccaccaccaccccaccccctccctcccctctctgctcatgccagagtgacgagggcagccgcggcggctggcaggccttctctggctcgctggaggaggtctccagcgccnnnnnnnnnntccctccctcccctctctgctcatcccagagtgacgagggcagccgcagcgcctggcaggccttttctggctcgctggaggaggtctccagcgccagcctggactgggaatgcgtgacacccaccagccgccccctggacctgtggagccaggtggtggagcgccccggcgcccccgccgtcccgcgcggcagcccgcaggccgccgcgccgcccggcgcacgcaccgccgaggagggagcgattgccgcagcggcctcgcgcgagggctggacggcnnnnnnnnnnnnnnnnnnnnnnnnnnnnnnnnnnnnnnnnnnnnnnnnnnnnnnnnnnnnnnnnnnnnnnnnnnnnnnnnncaccagccccatcaaggcgctgcgccgcgccgcgccgccggcgcccgtggcgcccatcaccgtgccgcgccccgccgcgccgcccgggctggaggtcatgagcgacgcggaccgcctgcgctgcgagcagctgtacgaccgcaaggtgcggcggggcgggggcacggtgtggtgcaggggcccctgagggtcaccaggcgcctctggcagcgacaaacctcctgcaggtgcaggacatgcgaccccgttttcctccgcgccgctgccgcagggctaccacnnnnnnnnnnggccctgagggtcaccaggcgcctctggcggcgacaaacctcctgcaggtgcaagacatgcgacccccttctcctccgcgccgctgccgcagggctaccacatgcgagggggcctgagccgggagtccggctggcgcctgttccagcgcagtgggatcggcgccgaagacttcctggcggcctggacgctggccgcaggggggaactccgggcccctggcgcgccaggtgagccaggggtgcggggcctgtgcgccagcccaggctgcgccaaggtgtccagcccgtcctctcctcctgtcggcactgggctggcccggcgcaggccacctgtacaccaccgccgccccccacccaccctgcnnnnnnnnnnagggtgcggggcctgtgcgccagcccaggctacgccaaggtatccaacccgtcctctcctcctgtttgcactgggctggcccggcgcaggccacctttacaccaccgccgccccccacccaccctgcaggagttctgcctgctggtgcacctcctgcacagcatccagcgcggattcaacctgcccagcagcctcggcccagaggaggtgggcgtggggcagcagtggggtggcggactccggcgcgcatggcacggcccaggcccgtgccatcgcaaggctgtgcctgggtgcgggaagtgtgggcctggacgtgagctgcccttgcggggtggtctgtgacgctcccccggttgccccaagcaccttccacacccctcagcctcttcccccnnnnnnnnnncgccatcgcaaggccgcgcctgggagcggggagtgtgggcctggacgtgagctgcccttgtggggtggtctgtgatgctcccccggttgccccaaacaccttccacacccctcagcctcttccccctcgtcaaaggcccaccggctgctgggccgcatgctgacgccaggcggctccagcgcccacctccgcctggacctggaccggctgaggattgcactgcacacagagggggcggcgcagccggcctccagccgccaggtgagggaagggtgagggacggtggaagatccgcccccaggccatgcctggccaggggccnnnnnnnnnngctgcacacagaggggtcggcgcagccggcctccagccgccaggtgggggaagggtgagggacggtggaagccccgcccccaggccatgcctggccaggggcctcagccccacgaggcccgcaccagctggtgtgcctgctcatggggtatgaccgtgctgagcagccccccaaaactccctgtggcccccccgtcatgcagacctcccccggcgcgctgaccacggcccgcacggaggccgtgtccaccggctttgccaccgctcgagggcccgaggccacctccttcctccagggtgggctccagtggggtggtgccgggtgctgatcatctgaggatcgggagacagggcaggcgaaccggcgtcgctcagctccgcctgtcaccccgcatgccccgtattactctggacttcccacgcccaccatcgccattgcacacagcatcgctagtaagccaagccaaacacccctcccgcattgccaccctcgcatcccacaggccaccacgacaggctggaggtaggcctcagggtggcccgcttcacgtaccgcnnnnnnnnnngagtggggtggtgtcgggtgctgattatcagagggttgggagacagggcaggcaaaccggcgtcgctcacctccgcctgtcaccccgtgtgccctgtattactctggacttctcacgcccaccatcgccattgcacacagcatcgttagtaagccaagccatacatccctcccgcattgccaccctcgcaacccacaggccaccacgacaggctggaggtgggcctcagggtggcccgcttcacgtaccgcaaggacctggaccgcccctttgtcaccatgtctgttcgggacggagccggaaggctggtggagatgccccaggacagctgccctggacgctactcgcgcatggccgactccgtcgtcttcaggcagagcatgtgcctgggcacccccctgtcccagctgcccccaggtgagggactgtgcttgagtgtgcgatttgatgcacggcatgggtggcaggaagtgggggcggagtaggctttcaacatacgcaccgtgggagagcgtcctgggcatgtacttgggctgcgggcgaccccgctccaccgcaaggccagatggactctcctccagatgtcatgcaaagatgagctgatccagtcagaaccccagaacctgggcagccacgccgatgctacaatgcgtctgggaaccattccacgtccccacccttgaatgagcagggagctccatcttcttcgagctgcggcactggaaggggaaggagcaccgcttctcgaccctggcctggaccgcagtgcccctggaaagggtgctggacgcagggccggccgcgaccagggtgagtgctgggagcatgagcccacgacccagatgttgttgtcggctggtcagcgcccagcagagggtggctggaggccgctctgcatgcgccccatctccaccccttcacgcactgacttccccgtggacaggtgcgagagggcgacctcaagctgcccctgttcaaaaagccgctggacgtgtcgctgcagcgcatgcgacgcctgggcggcagagccgacttccagctcgcgtgtgtgggactgcaggacgagacgcctgcgacggccgggtgagggtcgtgggcggtgcatgccgatgttgagtgagtgaaaggcagcagcacgggcctccagccgtgcttgtgactctatcattgacgccaggcagcgcaaggttgatgggacatgctggaatggggcatggtcgtggcgtgcgggcagcaactgcctctgannnnnnnnnnaattgaccccaggcagcgcaaggttgataggacatgctagaatgggacatgttcgtggcgtgcgggcagcaactgcctctgaaacgccaagcggtagagctgaacatatggatcgacacgacacatctcggaggcgcacgattttgaatccgggccgagaactcgacagcgacagcactggagcagggcaaagcccacaccgtttttgcatgtgactatttacagacaactttcaggagcgggaagatccccctgccatactgcatgcagcattgagtgcatgacgagcaaggcctcgagcaggagcccgacgggagtgaaacatgccaacctcgcaaggaagaagatcaaggggccagaggtgagaaaacattttctggtgtaacatagatgatgcagcatgcttgcatccatccatggcgactcgggaggctcgcannnnnnnnnncctggtgtgacttagatgatgcagcatgcttgtatccatccatggcgactcgggaggctcgcaccgcgcaggatgtgctggcgaaagttgaggctctgcgcaaagccgctgcaggcagtaaagggcctgtcaggtgagccaagactgacccaccctgtggtctacatgatgctctccgagtagctacctgcccgatatgcatgtctgtttgtccaatgcaataatcctgtgcggatagaaatgaggtgcagacctggcccaccccgtcacacacccacatgccgccgtggcgttgatccctcaggacgctgtcggacctcggccttccccatgcctgtcgagaggtcgtcgacaaggcagaggtgtctgtcctctccgagatcgagcagtccatcctgcagatcgccgtgagcatcctggagggtgcggggtttcagtacgccattccaaacaggtccaagggcaatcagctctacgttcccggtgagtgaatgatgtcagaggattcctgtatggcctgggttttgccaggaggaacctcctctgcccgagttcccactctgtattcacccttcctacccaaacatccatgccagtggagtcgcactcactcgccggccaccccacccactcgcagagctggaccgaatcgtgctgaagagctccacatcgcagcgtgcttttgcgagcaccgcgacctgccgcaaggcggccatcaccacccgcatcctgcagctcgtccacgagctgtgcaccaagcgcatccacgtcaccaagcgtgacctgttctacaccgatgtcaagctgttcgaggtggggctgggatgtcctttgatgaggcgtgattggatctgggggctcacatccggccgtgcagcgggcctgggtggagcgtctcctggggtgggcatgtcacatggggtgacgtgcatgcacacaagatggtttggggaacgccgctcatggaccgtgtgttcgccccaccccttgccgtcgcgcgcaccccccaaacccaccgaccccacccaggatcaaggccactcggatgctgtgctggatgacgtcgcgtgcctcttgggctgcacccgctccagcctgaatggtgaggggctttctcggattgagagtaccgggtttccggtaccggttggcaatccctggtccagagtgggagttgatcagcatggaaaccgctccctgccccctcgccaacccctgcagtcatcgcgtcggagaagggagtggtggttgggagactgaccttcagggaggacggcgatgtgatcgactgcagccgcatgggggtcggcggcaaggccatcccgcccaacgtggacaaggtgcagcggggacgggacatggaggcgccgccatgggactcgctgtcttgcgcccgcccagtgcagcccacatcgaggctcggcggggatgaaggccccggagcgctgggcaggcaaccacgtcctcaatgcctagatataaaagaaccatccctttcccccaaaacccgccaggtcaccgccatccagtccgatgccaagttcatcctgctggtggaaaaggacgccgccttcatgcgcctggcagaggaccgcttctacaacacctacccctgcatcatcatcaccgcaaagggccagcctgacgttgccacgaggtgggggtcacaagttgcagtccccggtagactatacgatttggagctggcagtgccagtctgcttcgtggcactggttcctcgcgtggtgtgatttcccactccacctttcctacctcaacggaaaaataacacaggctattcctgaggaagctgaagctggacctgaagattcccgtgcttgccttggtggatgcagatccctacggcctgaagatcctggcagtgtacatgaagggtgagcagggcgcccagtggggtggggttggtggaggccagggggtgtggtgcgctcaggcgctggccacaggactcctgcctcccacccaaaggtcgccgggaggatgtttctcatcgagccattccctgcctggccctgggacagtccctgcgtggaacccttgatatacctcttgccgtggggcatatcgccctgaggctgttcccctcgcccacttctcagtgattcccccgtcccctcccctccataaacttgggacctctcgcagggtccatgaacatgtcgtacgattcctccaacctcaccacgccagacatcaagtggttgggcgtccggccgtcagacctggaccgcttcagcattccggagcagtgccggctgcccatgacagaggaggatatcaagaccgggagaaagcttgtgagacagtgaagggggggggggggctgaagggagggtaagggggtcttggcagctgtcaccaccaataaaacactgcgccggcgttgtgcaccccctcatggtacacacggcgggtcgtgcccaaccctccatgcagctggaggaggactttgtcaaagcaaacccagactgggtgcgggagctgcagctaatggtacgaggtgtcggggtgcacgcgactggaggattgggctccccgtcctgattcgtgatgcaaggtgactgcggcaccccgccccacccacttcctcgccacccgctctttcccccacacagcaaaccagcaaggtcaaggccgagatccaggctctcagcagttttggtttccagtacctgacacatcagtacctcccgctcaagctacaggaaggagattggatttgagaccttgtgacaggatattcaacgggacagaaaacagcatctcatagccattgaaacttcacataaatttggctgtgcggattcgaggagggttagtcaacagcgcccgccctcctacgtcatcaaatcgaacgtaagattcgacaacaaatctcggattctgcctgatccccgtcgtgcgggctgtgtgcatggcgttcgaaaccaaggacaccaccagcaactcgctactttgttcgcacacaaatccatttcatcgaagacgtatctgacagcagtctgggcaacctgtggctcttgtgtgaagcaggttttctgtccccgcccgaccccgccgttctcaagaattcaagctgccgaacctgccattgcccacctctggacatcctctttaccgcacatgtgtcgcataagtactataaatccggcgcttcggcggcaagacaccaaggaggttaccgtcaaggacgtacagaaggtggggtggaccctaacccccaatccttcgtgccatgagtgaccccacgaccccctgcgaccccagcctcaacctctgtcgtgttcctttcagatacatgctatgacggaacagtgcctgttgcatgggctgacgaaagccgagacccaggcagcgctcgccggtttccgggtgcatccgaagattacggaaattggtacggacgcggccctcgcggtgggtttgggttgcagcttcctagagggtgctcaaccaccccccacgagtcctgattctgcccccgttcctcgcctttccagtatggcacagactggagcttgaaaatccggagnnnnnnnnnngcccacgagttctgattctgccctctttcctcgcctttccagtgtggcacagactggagcttgaaaatccggagtattttgctgcttattatgctgcccttcgcgctaaggtgtggtgggagagggggagagagagagagtgcgggcgtcgcgcggccgcaatcctgaggatggaggccccacacccactccccctcgattatcaggttcacaccctactgcgtcacccctgacatttgcagactctgaagagctgatgtgttgacctgaccagcacagaatgaattctctcccggaccaccctcccctctgccagttgaggtctgaggcaaggaaggatctcacaggaccccttcccattgtgagagagcctcgccacagtcagctgcgtatgtcaggagttaccgtgctccaatgatgatagataggacccaggggtgctttaggaagtcccaagtatccgatgcccaacattctgccccagccctatgttgtaccctttttgatatgagctcgaactttgtgcctacacgatcgtggcctttacccccaagaaacggtggccagatctctgcacaccttgtgaccaggccgcccgactcttttcacagtaatttgaacttgacagcccattctactccccacttcagtgtctcaaacttgaatggcatgcactctgccctgccgctgggcatcattgtgttcctcaccgtcgccctacctgctgtgctttccacccttcctgcaatggaccccaacctgaaacgagagtctcaccctgtaaaatgccgaggagaatgctgggaaaagggggttttggactctttgagcgtgacagacctgcaactgcccgtgcgctatagctctgcagtgtcatgcaagcctgtgcacaccgaaccgcactgcagattcgccaagtnnnnnnnnnngcagctctgcagcgtcatgcaagcctgtgtacaccgaaccgcactgcagattcgccaagtgtgttcttattctcaatgcgacaaggggtcgattcgtttcatcaatgcccagcgccgatgcgatgcccattgaggttgactcagtggcaggcaggagcacaagatgtgcggaggattagtccaatgtcagagggctggatcctgtcccctaagtcccagcaggagcttgttctcccccgacacctcggggctgatgtaggcgactaggacaccctccatcccgccgcgccccgtgaggtaggcgagccgccccgcgtcgatcagggccttgcagtgttggcccacggcgatgcgggctgaccgcgggaggtggtggtgtggctgccagtgcgttgaactctgttttgaggtgggcccccccgccgccgccgccttccgctttgctccgggtggaggaatgcctgggaacggcggcgcagctgcaccnnnnnnnnnntccccgcccccgccgccttccgttttgctccgggtggagaaatgcctgggaacggcggcgcagctgcacctgcttgatcgctggcgccaggctccgttcctgcagaggggccagtcgcgccgtcctcgtcgccctcctcgcagccggcccctgcaggcgcctcgtggccgcacagtgcccaccctggggtggaatgttggaaattgggcttcacatgcgtgtgtgtttctgtgtgcgtgcccgggggtggtgagccgggacgcggctgcaatggcatagtctcttaggcagagcagccttcatcaacattgctgccttcacgcgagggactggtggtcggtccagccagcacgttccccatcctaatgtcttccaagccctcaccagccctctccatcctgcagcacatcaccccaccagacatccacgacaccagctcaaactctgccggggcgaagccacgctcggcaaaccactccttcccgacgtaggccctccaggagcagcggtggtggcagcacgtggcgaggcccagcccgcggcagcgccgcggcgcctgctccaccgccgcccgcagcgcaaagtcggaggcggcgccgcacaggtgcttggccacgcccacccaggagcggggcggggcaccgccgctggggccggggcggtccaagccggggcagccggcgagcgagaaatccttcaggtcgcagcgcaggcggtgcaggtccaggtgacgcagcgctctgcagtttgggggggagggtggggggagtgagcgctgtcggaaggccaccgcgacagggtagacgggaatcgtggccagtgcgccccagggctctgccctgcccagacaccacgccgccccggaatcctgccctccatccaccccctgccctcgcctatcggccttgagcttgaagccccggcagtcgaccaggacgaggcaggtcnnnnnnnnnnctcctgccctccatccgccccctgccctcgcctgtcagccttgagcttgaatccccggcagtcgaccaggacgaggcaggtcagcgaggcgcagtgccccgccaccgcggcccccaggtacccccttcccgcgcccagctcgacgatgacatcgtcggcgacacaccgcagcaggccgtgccgctccaggtggcccacgatggaggcctgctgggcggcgtgcttggcggagtagggcggggtcgtgaccccgggggcgggggcggggggcgccgccgccgcctggttcagggcatccacggggggcaggggcgggagctgcgcggcagggaaggggcctcgcatgattatcgtacggcagcatgggctggcatcatcgggcgtcgacggtttccacaacatgctcggcgtgggttctggccaccagaaagccccgccatcaacggccatgcacccctgccacgccagcagacgtcgcgagtgtgactcaccctctcggcagcctggcagacgcgctcgatgaggtcgtccaagccatcgggccccagggtcgcggcataggctgccctgcgctccgccacgctgtggccaggcaggcaggcgccgggaatcgggtccacgtccagggccgcgccggcattgatgtccagctggtagtacggggcggcccgctgggcctggatctggaggtgggcggggcacttcagtctgtgcttctccacctcgtctgcatagatttcactggagtacagcatggggggagggggtgtgagacttgctggccaacagtagagcaccgcatgcatgcatgcatgcgcttatgggtccagagtaaacatgccatgcacccctgctcccgcatgcacccagatgcatgccgtgcgccgccttcgcctcctcggccggcatgcatgtcccacccacactcactgggcaccagcagggtcccatggacagcgtatgcgaggacgagagccctcggcttgcggcaggtgattgccgcagtagttcttgccaggtaccacatcaaacttgcaggtgcggttcttctgtgtcaagaaaaattggcacttttgaggggcgttcatcggagctctgcaatatgtgccggagcgtgctgggaggcgttcatactaatatcgtatggaatgaatacatggcaagttctgttatatctaacaactactatgtttataaagtagcctgtggcatcaggtatggtgcgtgccgaatnnnnnnnnnnttaaatacatggcaagttctgtaatatggaacaacttctatgtttataaagtaatctgtggcatcaggtatggtgcgtgccgaatacgcattggaagtgctacccgatcccacaccaacctcagcgcgcgatgtctcggacgtcctcgggagccaaggtaacaaccgggagcgaggcaagcaaacttcctcagaacacgaagcctcatcacgcatcaccactcctcactaccgtcatgtcgggcgtctgtcagtctggccagtgtattcaaggagtcctgagcccccggatgggcctcaggctccaagaattcgccacggcagcttcgggcatggtgggagactcgtggccgaagtcacacggtgagatgcccgatggaggtgtgggctgagctccgtcggctcccgacgggagatccgggtgcatcgctcacgcctcgccccacctgttgctctgccagcgggaggctccctccacgacccctccgtctacctcttggactacgtccccgttgatctgcgcctggaagtcagccacgcctttgtggttgggttttcgaactgtatggcaacctttgcctacctcctgcggcagaaacagttcccgaagcccgccctgatgaggcagtgcataggcttcgttcctggtctggacaaggggtgagatttcgaggggtccgactcgtcggttgtagccaggccgcgtgtcgtgttcattgcattgagactaggccatgcaatatatactgagggactgacatcctgtgcaaacacccgcatgtnnnnnnnnnnagtccgactcgtcgtctgtagccaggccgcgtgccgtgttcattgcattgacactagcccatgcatctatacagagagactgacatcctgtgcaaacacccgcatgtagggcaagggccccaacctgttaatttggaaccctcccatcctgccctcctccacgcagggccactgcttcgtacttccaagctggaggacgtccagagtatgccatagatgctgtgcttgcgcggtgcgaggaggatgtggtggaggccgcgagcctcggcatggtggaggatggggtgctgcaggaggccttggaggccctgccagcctgccctatggacggtgcgcggaggtgtggtgcttgacagcgggacgcattctgttgtggagaattgagcatgctgagatgatgccttttcaggccacttcttgcggctgcttcgcgccgcgcctccctcgctcggctctctcatgggatgctttcccacnnnnnnnnnnaaattgagcatgctgagctgatgccttttcaggctacttcttgcggttgcttcgcgccgcgcctcccttgctcggctctctcatgggacgctttcccactcacagatcgcttcgatctggtgcggcaggccctcttccagaacagcgctgtctggccttgcggtccgtacagcatggacgaggagcagtatcagggggatgatggctgggtccactacgacaccagtggctggagcggacagccggggcaatagcgccgctctgacgcgccctttttgtgccattggcgcctcagctaccccccctttggactcttattgcagcctgaacgttgcagctctgaccacattgaacatgtacactacggcggactgtatcatgcactgcgtgtgttgggtgctggagatagcatggggtgcaagggccacgatgctgcagaactggcacccaccagtcatggaaaggggccccttgagatgtctcatataggatttaagagatttcagagcaatggagatgccttttattgtggtgtgcagcgcactttataatatttgctggaactgggcaggtcacgtgcttcggtcgcgtgaggggggagactggctgaggtaacccgaaaccctcgttgcacatgaggacacgaccggacgccgaaatttggcatagcaaagaggaagtcttcctcactcctctgacgaagctttccacccgtggaggactgggctgccggacgaagccttcccgcagccgcccccgagctgagcctactccgagctggggtgtcgaaccgggccgaggacaccatgcagtcggcatgctccacccccagccgtccgtgcatgggtcagaggcggtctgtcatcacatgcgtggcgacgccctcccgtcctcccaccgcccacgggcccaagcggtccaaggtggagatcatcaaggagaagtccgacttcctgcgccacccgctgatgcaggagctggtgaccaaggagaccaacatctctgaggaggcggtgcagctcatgaagttccacggctcctaccagcaggacgaccgggagaagcgggcctttggctccggcaagctctaccagttcatgatgcgcaccaagcagccctccggcctggtctccaacaagctctatctcgtcatggacgagctggccgacctggtatgcatgcctggttggtttgtgtcatggaggggggggaggggccccagggatagctgcagcacggcatgcgtcacggtccagggcacacctgcgtacactcgtcacccttccacatgggcaccgtcacctcacacacacacacacccaaacataaaatccttccgcagtacggcaacggcacgctgcgcctgaccacgcggcagaccttccagctgcacggcgtgctgaagggcgacctgaagacggtcttctcgtccgtcatcaaggccatgggcagcacgctgggcgcatgtggcgacgtcaaccgcaacgtctgctccccgcccgcgcccttcaccgaccgccccgactacgcggcggtggccaaggtgtcggaggacgtggcggcgctgctggccccccagtctggcgcctactacgacgtgtggctggacggcgagaagttcttcagcctggcgcgggaggacccggcggtcaccgccgcgcggctggacaccagccacggcgcctccttccccggctcgccggagcccatctacggcgacctgttcctgccccgcaagttcaaggtggcggtgacggtgccgggggacaacagcgtggacgtgctgaccaacgacctggtcatcgtggtgctgtccgaccccgccacccgcgccaccacggggtaccacctcatggtgggcggcggcatgggccgctcccacggcaaggcctccaccttcccccacctggcggcggacctgggcacggtggcccccgccgacctcctggcggcggtcaaggcggtggtggcggtgcagcgcgactacggccggcgcgacgaccgcaagcaggcgcggctcaagtacctgatcgtggagtggggcatggacaagttccgcagcgtggccgagcagtacctgggcaagcgcttcggcccccccgccgcgctcccgccctgggagttccggccctacctgggctggatggagcagggcgacggccgcctggcctacggcgtgtacgtgcgcaacggccgggtgcggggcgaggccaagaaggcgctgcgcgcgctggtggagcgccacgacctgcccctgaccatcaccgccaaccagaacctgatcctgcgcgacgtgcggcccgagctgagggacgaggtggaggccacgctcacggctgccggcctgccgggccacgagaccttggacccgctggacgcgctgtccatggcctgccccgccatgcccctctgcggcctggccatcggcgaggcggagcgcgcctcgccagacatcgtgcgccgcctgcgtggcgtgctggaatcgctgggcttccccgccgccgagcgcttcgtcgtccgcgtcacgggctgcnnnnnnnnnnggacatcgtgcgccgcctgcgcggcgtgctggactcgctgggcttccccgccgctgagcgcttcgtcgtccgcgtcacgggctgccccaacggctgcgcgcggccttacatggcggagctgggcctggtgggggacggcgccaccagctaccaggtctggctgggcggcacgcacggcgccacgcagctggcacagctctacgcggagcgcgtgaagctggacgtgagtgcgggaggtggtggtttggggggggagggagtgtcggtgggagggagtgatggtgggagggggtgtcggggggacggagtgtcggggggagnnnnnnnnnngttggggggacggagtgtcgggggaggggagccattggtgctggggtggtcggcacggcgacggtgctcagagtccctgctgcaaannnnnnnnnntgtttgggggagggagccattggtgctggggtggtcggcatggcgacggtgctcagagtccctgctgcaaatcagcacagcaacggaggacatcccacacactctcctctcccacccctcctctccacaccccacaggactttgagaagttcttcacgcccctcnnnnnnnnnnaagcaacggaggacatcccacacactcccctctcccacctctcctctccacaccccgcaggactttgagaagttcttcacgcccctctttgcgctgttcaaggagcagcggctgggtccggaggagagctttggcgagttcgcttctcgggtcggcttcccggcgctacatgcgcgccagctggcggacggcgcggtggaggagcccaaggccaaggggccccgcggcggccgcaagcctgcaggcagcgccagggtggccgcttcaaattgagagagaggagaggctgagcaccccggaggaggcagggcacttgcgctgtctgtggcgcaccctcccatgtggccccatcagcagccgcgaggagcatgcgagggtgatggagccctgaagattcgaggggagtgctgtgtccttgtgcatggcagtaccctgtgcacatgcttgttgtagaattggggaagatcgatttcctggggccccctgatcacctcctgggcagagcatgtgagcacaaggcctcttcagaggaagatatacactgttgaattgttgcatgtgtgtaggttgacgatctggagcaaccgggggtgcaggaaaagcggacaccagggcaggactgagtgccgtggccgtgttgtcgacagtcgagcaagattgcccactagcactcttaactcgcgattctttaaagctaggtgcgtgattgctcgtaaagcttaacgctttatatcatgacaggatagactcacatctcattcagcatgcgctagggcgcacagtccannnnnnnnnncagcactcttcactcgcgattcgtaaaagctaggtgcgtgattgctcgtaaaccttaacgctctatatcatgaacgaatagactcacatcgcattcagcatgcgctagggcgcacagtccactcgctgtgccggtgtggccactcaggcaccacatcgcactcgattcacacgtccctattcatggagcctgcctccatatccggagagcaatgggtcgccagggtttcgggcgaggccctggatcttgcccagtgcatgcagtttgtggaggacccaggtgccggtgccatctccaccttctcgggggtcactcgcaacagcttcaagggcaaggccgtcgtgaagctggagtacgagtgctacaccgacatggctctcaaaaaactcaaggcacgtgctttgagatgattgggattcatcggcggttctgcacagcggtgacttgcaggttcatggggcaggcggcttggggagcgggaggattagnnnnnnnnnnaacgtccctatccatggagcctgcctccatttccggagagcaatgggccgccagggtttcgggcgaggccctggatctnnnnnnnnnncacgccataattaggctggcggtggctcacagggttggtgaggtgtgggtgggccagccgagtgtcctgattgctgcctcctcggcgcaccgcctcgaagccatccaagcctgccattgggtgatcgatgccctgaaggcaacggtacccatctggaagaaggaatttttcgaggatggcagcatctggaaggagaatgccgagtgccagctgcttgggaacagcagtgagaagctggcatgaggaggagcaggtcgctggtgcactgttgcatgtccactgtttctgatgtacctggtggaacggcctgcagcctcatttcaagcattggctgggnnnnnnnnnnatggaagaaggagttcttcgaggatggcagcgtctggaaggagaatgccgagtgccagctgcnnnnnnnnnnaatcaccaaggggctcgtggatatccgcagtctagaaagcaaggaagcgcacgcnnnnnnnnnngatcactaggggctcgtggataaccgcagtctagaaagcaaggaagcgcacgcgataggcgctggtacacttcccgtcgtaagcctgcagatgttttgaggacacaagacgtcgagccacaccccgtgctattcatatacaacatttgggagcgaagtgcaagtgggtagctcatcggtcgagctcagagtcgactccgcctcgggtcgagcatctgcgtaccagcaccccccctcaggtcagcggcccctacacagcatcgcccgacatggttgtgcgaggcttaccatatgtgatcctgattcattccttgccgtgcagttcctggggagcactcgacggtcagatccggaactcctccttgcgatgtcctgtccttctcgctgcgccctggccctcttgctggccctgctagcgcccctggccgccctgggcgccgcgaacgatgcatgctggacggatcccaccgcctccacctgctccaccctgctgctgtcctccacgaagctgtggacggacctgaatgccacctgcaacaccggctctgcaaccgtggagggctggcctgcggcctgctctcttcgcgaggcatgcgtggaggccggcaccctgaccgcctgcaaccccatgtccctcatcctggcggcatgcaccgaggactccaccatctccacctgcgagaagtgggtcactggatggcagagaggagggttgtgctgccatggcagcgccagcatggacaccccaacacggcccccccaaacacaccagtattgatctctcacacttgccctcttcaattggtgcaggtacaagacgctgtgcggcacgggcagcgtggttccggcctgtaccagcgcaaagagcatcactggtctgaccagcgccacctccttctacaatgacgtccagacgctgtgcagcagcatgaccatgaccgggtgtagcaactgcgttgccgtcagcggcacgcccaccgcggcccagctgcaggccagctgccccaaccccctcggtgagcggaggggcgggcggttgtgcttgtgttggcggggccaggggacccctctgctgccaagcctcaatggcaatggcaacgccctgccgatagctttctccatgcttgccgctctttgctgtcctggcaccctgatcatcggcccaagctcaacctgtcacaaccttccaattcctgacacccaacaggcacactcgcggagctgtgcctggagatgagcatggacgggtgcggcgactggacgaccttctgcgcctccaatgccgccgccttccccggcctgtgctcgtccacgcccgccgccggccccagccctgccatggccatgagtccctccatggacatgtcgcccgccgctacccccagccctagctcctcccacagcaactgggcggtcggcggctgctatgacgaccccaccactgcgagctgtacagactttgtccagcccacctcgatcaccgaggccaacatcaccgtcctctgcgactccatgcccttcatgtccggttgcaccctgcacaacatgtgcaatgtgcgtgagggtttcatttgggttgggggggatgactaaggcgtgggtattgatggggggggggggggnnnnnnnnnncgcgaactttgtccagcccaccgcgatcaccgaggccaacatcaccgtcctctgcaactccatgcccttcatgtccggctgcaccctgcacaacatgtgcaatgtgcgcgaggatttcatcggggtgggggggtgggtaactaaggcgtggatattggtggggggggggggggggcnnnnnnnnnngatagggcccaagtgctgcactcataggagggccccaagggtgccctgcctttgtgcatgcatgcatgcatgctcacccttcacaccgccccccccttccccccttccgtcatctcctgcccttcttaactgtgcaggcgggcactgcctccggcacgtactgcgaccccttctccatcctggccgacctgtgcgtggacatgcccggcatgaacggctgccagggctgggtggccctctgctccgcctccggcaccaaggtcgcccagtgcacccagcgtgagtacagtgggcgcgtgtgtgtgtgtgtgtgtgtgtgtctgcgtcggggaagggattcttaggatggacaggtgtgttggccgcttcgccactgccaggtgcgccatagccgcccgacgcagacctgcctcaccctccctcccttccgatccatgtgcagatgcggcagtgcccaacctggtgatcaccttcgacgccatggaccaggtcatcgacatgtgcggccagatgtacatggacggctgctcggactgtacatcacgcaccgcctgccccaaccccatcctcaccctggcccaggtgggctggacagggccatgcagggggttggcctgtggttgtatgggaggggggaacgatggctgcttgcttgaccaggggtgggtgctcccannnnnnnnnncttccaccatctcctgcctttcttaactatgcaggcgggcactgcctccggcaagtactgcaaccccttctccatcctggctgacctgtgcgtggacatgcctcgcatgaacggctgccaggggtgggtggccctctgctccgcccccggcaccaaggtcgcccagtgcacccagagtgagtacagtgggcacgtgcgtgcgtgtgtgtgtgtgtctgcattggggaagggattcttaggatggacaggtgtgttggccgcttcgccgctgccaggtgcgccatacccgaagcagacctgccccaccctccctcccttccgatccatgtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggtgggctggacagggtcatgcagggggtttggcctgtggtcgtatgggagggggcaacgatgggtgcttgcttgaccaggggtgggtgctcccacagcgtgcccacaccccagtgcaccgccacgcatgccttgcaccctggttgtgtttccattccccgcacggctgttcgaattcccccccaacccaaacccacccgaaacatgcacgtcccaggtgtgccagggcatgccctccatgnnnnnnnnnntgcatgccttgcaccctggttgtgtttcgattctccgcacggctgtccgaatcccccccaacccaagcccacccgaagcatgcacatcccaggtgtgccagggcatgccctccatgcccgagtgcgcgtcatacaccgccatgtgcgatggcggcgcggccggcacctttgccacgctgtgctcctccgacccggcaggcagctccacgccgcccatgaagatgtacatgcacgcggcctggacggagctgatcctgttccaggcctgggtaccgcggaacaagggcgagtacatcgcctcctgcctggccatgatcgcgaccgccatcctggtccagttcctcaagtcgctgcgcctgcgcctggaggccgtctgggcgtcccgcctgcgcacctcctgctgcggcggcgacggcgcggcctccgacagcggctccgagtcgctgggggcgggcgggtccaaggcctacgtcggcgccagcggctgtgcgggtccggcgcccgcgccggnnnnnnnnnnccggcctccgacagcggctccgaggcgctgggggcgggcggggccaaggcctacgtcggcgccggcggctgtgcgggtccggcgcccgcgccgggcctctgggccggctggcgcgtggcctccctggcgcagctgcgccgcaacgtcgtccgctccctcttcactggcgtcgtggtgttcctggactacatgctcatgctggtggtcatgaccttcaacatcgggctcatcgtcagcaccgtgctgggcttcgcactgggcgcgctgctcttcgggcacatcggggaggtgggcgaccgcgcggccgccgcgcccaccgccgccggcaatgagaacgagctggaggtgcagttcgtggagccggggtcctgctgcggcaaccgccaagtttaggacggagggtggctgcagcgggggacctggccagtgggtcttccaactccattgccggctgnnnnnnnnnnagccggagggtggctgcagcggggacctggtcagtgggtcttccaactccattgccggctggacagacgcctggccaacgccggtcagtcatgccagctcgtcccctctcctgcgcgtagtaagccagggcagcagctttgtattctcacccccaaatctcataacttaaatctcaattcgcattacactttgcctttgccgtgctctacacctcaaccatctaccctttgggaaccaccgctcnnnnnnnnnncctcacaatttcaatctcaatccgcattacactttgcctttgcagtgctctacaccccaaccatctaccctttgggaaccaccgctcatcctttgtgtgtgtaagcaccccacgtgccacgtgccccccctgcccctcggtcaagcacacgtgctggagtgcgtcgtccgcggggcagttagcagaagaagcccacccgatccgatacgcgatacgnnnnnnnnnnacgtgccacgtgcccccccgcccctcggtcgagcacacgtgctggagtacgtcgtccgcggggcagttagcggcagaagcccacccgatccgatacgcgatacgcatacccatcaccaaaaccgcagcacgcggcgtctgcagagcaggtccggtccgagagctctggagggatggcaacccttgcgtcctgcctgagcgccaggccggtggctcgagtacaccatggcatgaccgacaggaaggggcatcgcggtcgcagggtgagtgaagtctccgcatgggtatcccctgcatgggtctcggcggtgtggtggggtgttgaacccctctccatgccaaccctcccatgtctccctgtgcttgcaggcggtggccccgcgggccgcnnnnnnnnnntggtgtggtggggtattgaacccctctccatgccaaccctcccatctcaccccgtgcttgcaggcggtggccccgcgggccgcagcggccccctccctgcacgagtccacccagactggcgcagatctgacggcggaaatcatcgccgatgagaaaaagtgggattgggggagggtatgggagagcccagcgttatgtgccctgtaaccattctttttccctgcatggtctcctcagcaccctcactgcatgacccnnnnnnnnnngtgggggagggtatgggagagccccagcgttatgtgccctgtaacaatcccttttccctgaacggtctcctcagcaccctcactgcatgaccccacaggtacatcctgcagacctactcccggcccgatatcgtgctgacgcatggggagggctcccgcctgtacgacctggagggcaaggagtacctggacttcacctctggcatcgccgtcaacgcgcttggccacgcccacccagcctgggtggatagcgtgagcgagcaggccgcgctgctggcgcacaccagcaaccttttccacaccgtgccccaggtggccctggccaaggccctggtggagaacagcttcgcggaccgcgccttcttcgccaactccggcaccgaggccaacgaggcggccatcaagtttgcgcgcaaatatgccaagatcaggggtgggtgaagtgtaggtgggtgtgctgggtggggatgtgggccttactgcagatgatggtgagaagggggatgggtggtgttgaggaagtgggcccaccaggccgtcgtggtagtgtataaaaacctagctatgtattgaaatccgtggggcacgtagcgacagagagagnnnnnnnnnngtggggatgggtggtgttgagggagtgggcccaccaggccgtcgtagtggtgtatagaaacccagctatgcattgaatccgtggggcacgtagcgacagagagagacccagagaccttgcctgtatcgtgttgaccatagcacatggtgtgtctgaagtcaattgagtcatcccttccctcaccacctttccatctacattgtccacagccggcgtggacccatacgatgcnnnnnnnnnncgagtcatgccttccctcaccaccttcccatctacaacgtccacagccggcgtggacccatacgatgccgaggcctcggcctccgcgccctccgacctgctggccttcgagggcagcttccacgggcgcacgctgggcgcgctgagcctgacctacaagtcgcagtaccgcacgcccttcgcgccgctcacccccggcagcagcctggtgccctacggcgacctggacgcggtgcgcgccgcgctttccagtggccgcgtggccgcggtgttcgtggagcccatccagggcgagggcggcatccacgaccccggcgccgacttcctgcgcggcctgcgcagcgcctgcgacgaggccggcgcgctgctggtcttcgacgaggtgcaggtgggcctgggacgcaccggctcgctgtgggcgcacgagcgcgccggggtcacgcccgacctgctcaccctggccaagccgctggcgggcgggctgcccatcggggcggtgctgctgagtcagcgcgtggcggacgccatggccccgggcgaccacgggtccacctttgccgggaacccgctggtctgccaggcggcggtcaccaccttcgacatcatccgccagccgcgcttcctggccgaggtggcgcgcaagggcgaggccctgcgcgccggcctgcgcgccgcgctggacgggaacccccacgtccgtgaggtgcgcggcgtgggcctcatcgtgggcatccagctggaccaggcggcgggggccgtggtggccgcagcgcgcgagcggggcctgctcatcatcaccgcgggcgccggagacatcgtgcgcctggtgccgccgctcatcgtgtcggacgaggacatcgacgaggcggtgcaaaccatccagaaggtgtgcgcggaggtgctgacgtgagcagggtttcagtggtggctgggccctggtggcctgccatgcccctggtgacccgggcaggccacgacatcgccccnnnnnnnnnnctttgtcgaattgtaaagcctgctgactctttcaagtcctgatggacggagtctctatgaatggccggtgagatcatctggaaagcggggccaggctccgacacggccggagagaagttccgcggatccaacatatgccgactcggcaggacaaaccccaccaaaaacacacaaaacggcgttgttctgactgcaccgccagctcaaagtgtgtggctttcggctgnnnnnnnnnncagttccgcggatcgaacatatgccgactcggcaggacaaaccccccaaaaaactcacaaaacggggttgttctgactgcatcgccagctcaaagtgtgtggctttcggctgcctgggaggggagtcggggacactcgctgccatgaagccctcagcggaggccggcctgagggcgactcggggcctgtaccgatccctgcacaccactacggcacccagggccggtccaacgctggattccgtgcttgaaaatctgtcccccgctgtctccaagttcggggtgaggaggcggggtggaggggttggtgggcagctgaggctttctctcagggtttaggcccctggcaccccagtccatgcgccccgaggccagccatccgacctgaggtaggcccaacccccatcgtaccccttcaggacctggtggccgactacggcaagggttcctacgtctggagcaccgacgggcgcaagcacctggacatggccaccggcatcggcgtgctgtccacgggccactgccacccccgcgtggtggcggccattcaggagcaggcggggcgcatgatcatggcccagcagaacatcttccccgcctcccgccccatggtcgacctggtggagcgcttccgcgacatcatgccccccagcctgacccagtacctcttcgtcagcagcgggagcgaggcggtggacaacgcgatcaagatcgcgcgctcggccacgggccgccagaacgtcatcgcctttgacggcgccttccacggccggacctacggcgccatggccgccaccacctccaagacggtctaccggcagacctttggcccgctgccgtcgggcgtgctggccgcgccctacccctactgcctgcactgcaaggcgcgcgccgccgccggcggcctgggctacggcctggcccccaacgtgcccggcgtcggcgccgactacgccggccgcgcctgctgcggcggcccgctggaggcactggagtggatgctgaagatgcactccgcgccggcggacactgcggccatcctgatcgagcccatcctgggggagggcggcttcctcacgccgcccccggggttcctggacgcgctgcgcgtgctgtgcgaccgccatggtatcctgctcatcttcgacgaggtgcaggcgggcatggcgcggacagggacctggtggagccaccagcagctgtcggccgagcagccggacatgctgctcttcgccaagggcatcgcctcggggttcccctttgccggcctggcagcgcggccgcagctgttccaggccatgtccccgggcatgctgggcgggacgtacggcgggagcacgctgggctgcgccgctgccgcggccaccatcgacgtcatccgggaggaggacttgctgggcaacgccacggcgcgcggcgcgcagctcatgcgcggcctgctggatgtcgcctcgcgcttccccgccgtcgtggacgtgcgggggcgggggctcatggtggccgcggaactggcggcggccgacgggaagctgcccgcgccggcggggctggcggggcgggtgaccgccgccgcgggacgccgcgacatgcttctgctctccgccggtgcgcgggagacgatccgcttcctgcccccactcaacgtgagcgagggggagattgacgccgctcttggcatcttcgaggactccctggctgaggcggtgcgcgaatgcacgtaggcgaggggcttgctgagaaatccctgcaggtcctgaagtagaacgcaatcctgggtgtcaaaatgtgctgacgtgacatgggcccaaatattgctgtagattcagaatcgagcaaagtgcctgcagtggagagctgaatgtgtcacgagcgacacggcctggcaggctcaatgcgggcaaaagctnnnnnnnnnnctgcacgtaggcgaggggcttgctgagaagttcctgcaggtcctgacgtagaatgcaatcttgggtgtcagtgtgctgacgcgacatgggcccaaatattgctgtagaatcagaatcgagcaaagtgcctgtagtggagagctgaatgtgtcacgagcgacatggcctggcaggctcaatgcgggcaaaagctnnnnnnnnnngacgtcctcttgttgaagattatcgtcttttccactcaatatgttgttgggggatgtcgccgggtcgcatgttgttcattctaccccacagctttgcgcatcctctgataggacactcgggttgtactgagaagtcgaagtgtcgtcctgcacacaaatgtaacctttacaggctgcctcagacggctcagtctgcatnnnnnnnnnnattcgttctaccccacagccttgcgcatcctctgataggacactcgggtcgtactgagagctcgaagcatcgtcctgcacacaaatgtaaccttcacaggctgcctcagacggctcagtctgcattcgtgcgttccggttcggcggcgagacagtcctgagaatcaaaacacttccctgacgccggagcactgcggccaccatgccgcaagtgcggccattcgtgatggatggctggcgcaggagtagcataccctcattgaaccatgcagggggggacgagatcgaagcgtcggtgcagggtgagcgccgggggttgcgacccaaccctgccagtgcccagcttgagttgttgcctgcatgcgtgattcatccgctgatgaggagacccgcaattactcctccttccgtcttgcaacccaacagcctgtccaaaacgattcagggatgacannnnnnnnnngtgattcatccgctgatgaggagatccgcaagtactcctccttccatcttgcaacccagcagcctgtccaaaacgattcagggatgacatcgccgccctgtttccctccatagacatcaaaggtatgagttggataatgacagtttctggaatccagaccagccctcctcactggtgcacagcatcaccaccacccgtcactggcttatgcacagacttgtttattcttatgacctgccaaaagtcgcgggtggaccttgtgggcaggggccctgaagtggaggaagagaaggatcgcctgctggagagggtgagctgggggaggcttgcagaggttgctgcgcttggggataagccttggcgcagcgtcgtcgacagcggcgcgcagtgcgacgctcgcctttgaacagtatgtgcttgaacctcacccccaaactcatcctgcctcctgccagttcttcttcctcgccaaggcggtggtccggcggctggaggcctctgggtactgggcagactacattgacccctgctccggcatgtccatggtgcaccgtgacacatgcgccgtgtacgacgaggtggcggcgctgtgtgcgctgtgcagcttccgtatacagaacgccgggtgctgcaaggtggcgctgcacccctcctggggcagctgggtgtaccccgccaccatctttgccaaggcgccggcggaggtggtggaggcggtgtggcaggagacgctcatgacgttgaagccacggcacccgccctactgcgagtgctgcgggggcaagcgccccggcatcttgaccggccccggggtgtgattttgtctcccatggatcttgctccccgcgcccgcgccctcgcgctcccatgcaacgacatgttgggccggatgtacgcacgatcgagctcgaggtgcaacgagaaactacatacagatattctagcaatacttaagtttagaaggatcgcgcggcgcgcaacgagaggggtcccgtgatctgtccgggcaatcgttgcgtcgcgcccggctgggtgtagcaactcagcaaggcgaccggggacgccctcgctgcatgacctgagccctgatgtccgtttttgaggagctgggcgtgtcgcccgagctcattcgtgctgtggaagagctgggatggacgtgagtgccatgcttgggtgttctgctggacagggcgtcgaggggcagggcgtcgctgggcatcctgcacttacctgctgctctgggactgcccatgaatcgcattgctaatatggatgctgcgcatccttcccctagatgcttcatctgtccctcgtaacctccagctggttgtgcgccctccctcaaccctccgcacccctccaacctcccctccaacacccccaggctccccaccgccatccaggcggaagccgtccccctgatcctgggagggggcgacatcatggccgccgcggagacggggagcggcaagacgggagcctttgcgctgcccgtgctgcaggtggtccaggaggtccgggcggggctcatgcgcgccggcgcgccgactgcggggcgcggcgcagccactgacccagcgcccgccgccgccgtctggaacgcggcggaccgcgacgacgcgctggccatccagcccgacggcctggtctgccagtcccgcagcgaggcggcctggagcggggtgcgcgcctcgctgggcgccgaccccgcgtccggtccccgctactttgaggtcgcggtgtgcgacgaaggcctgtgccgggtgggttgggccgcgccggcctcctccctggagctgggcacggagaaggggtcctggggctacggcggcacgggccggcgcagccacgcgggcgcctttgagccctatggcaggccctacggcctgggcgacgtggtgggcgccgcgctggactggcaggcgcggcgcctctccttcttcctcaacggcaaggacctgggcgtcgcgtacgacctgcccaaggtgggtgtgatgtgcaggggggtgaggtggcatgcacctgtgggggagggggggtggagggcagacagggagacatggtcttccacctgggcattgggtttggagtcgagcaagaccacacctgctgcctggtcgtgtgcagccctcaatcacatgcgtcaagtcatgtgctcagcagcgtctgggatctcggcgcctccatgcatgtgtcctgaccctctctcgtcgcccctccaactcacccactcaacccctgcagcacctggcaacgcccctgttcccggccgtcacgctgaagaacgccgagctggcggccaactttggcgcggaggcctggaagtttcccccgcccccgggctaccagggcttcctgcccggcggcagcatcggggagggcctggtctcctgggaggtggccagcgccccagcgcaggcgggctccaatgcggcgcggcggcccctggccctcatcctggagcccacccgcgagctggcggagcagacccacgacaacctgggcctcttctccaagttcctccctgtgcccggcgtccgcaccgccctgtgtgtggggggcaccaaccccaaggccgccgagcgggcgctggccgagggggccgacatcgtgactggcacgcctggtgagagctgttgacctctggatcggcgcaaggaggggaaggtgttgacgatatgggatgaaattggagtgcatatgcgtgttcctagcaggctcggcaccgcgttcgcagctcaatcgccaccacccatgcccaaacctgcatcctgccagggcgtgtgatggaattcgtgnnnnnnnnnnagcgttgacgatgtgggatgaacttggagtgcatttgtgtgttcctaccaggctcggcaccgcgttcgcagctcaattgccaccacccatgcccaatcctgtatcctgccagggcgtgtgatggaattcgtggagagcgggaagctggttttggacggcatcaagttttttgtcctggatgaggcaggcaaggacttgggaagggtgtgaagagctgaatggctttgcacagaactcgcttcgcacatgtgcacatggcagagggtgtctgcccaacatcaccgtgcctcacatcaccccaacccccaaagccttgccttgtcccagatcgcctgctggacacgggaaaccaggaagccatccggaagctgttccgccgctttcccaaggcgggggctggcgtggcgcgcctgcaggtcctgctcttctccgccacgctccactcagaggaggtcagggcgctggcgcgggagctgtgccaggacccgatcctggtggaccttcggggcaagaaccacctgccggacacgggtgaggcgggcggcgggagtgtgcctgggtggccttgggagtgatggcgaggccgtgaggcgctgggttggatggtgccaacgatgcagaggtgcgatggagaatagtcctgaccatttctcgcactgcctctccctgcccctgccatgccacgctttctcacatcccctgctccaccacgcagtggatcacctggtgctggaggtggacccgcgggaggaccgctcctggctgcagacctcccccgccgtgatcagcgacggctgccacacctttgacgcgacgggtgagtaaatgtgcatcgagcgcccagggggagaggctggtggatggcttgccgtgcttaccttgcgcccttcagcttcgagtgtcgcggctacgagcctacacctaggagcgcggcccacaggcacctccccttccaccagtatagccgaaagcgttgacccctgcagctcatcctgtttatccctgacaccctcccttccccccttgtcaggcaccgacctggacacccccgagaactggtccgaggccgtgaagaggctgaagccccgcctgctgcagcgctgcctcacggctctgggcatggaccaggccctcatcttctgccggaccaaccatgactgcgacaacctggagaagttcctcaagaacctgagcggtgcgtgcgagacagaggctggcgggaatacaagaaagtnnnnnnnnnntgggcgcccagggggagaggctggtgccaggcttgccgtggttatcttgcgcccttcagcattgagtgtcgcggctaccagcctacacctaggagcgcggcccaaaggcacctccccttccaccagtatagccggaagcgttgacccctggagctcatcctgtttatccctgacaccctcctttccccccttgccaggcaccgacctggacacccccgagaactnnnnnnnnnnnnnnnnnnngcaggcgctcatcttctgccggaccaatcatgactgcgacaacctagagaagttcttcaagaacctgagcggtgcgtgcaagacagaggctggcgggaatacaagaaagtgggggaaacgggggagtagagatgagcctgggccctgcatgctcacccacctcctgcaatgtggctgcatgggagggcacacatccctgtcagaccgccgcacacggcacgtcacctctacttccttgctcgctgtgttcaaacctttcccgtccccctgattactgcaggtggtgccgcagcgggcggcggccccgacaacccctactcctgcgcggtgctggcgggnnnnnnnnnnttcagaccgccacacacggcctgtcacctctacttcttgctcgctgcgttcaaacccttcccgtccccccgattactgcaggtggtgccgcagcaggcggcggccccggcaacccctactcctgcgcggtgctggcgggccagcgcagcatggaggagcggcgggcggccctcgccgccttcaaggccggggaggttcgtttcctggtcgccaccgacgtggccgcgcgtggcatcgacatccaggtggaatgggtggggagggaaaggggaaaggggcacccggcacacatggtctcaccagcgttggacccagcaacggtcaggattgccgagcctgccttattcgtgcaaagggatggctcatcgatgctccacatcagggtcgcagccccctgactccttccacgggccgcgcccagnnnnnnnnnngacggtcaggactgccgagcctgccctattcgtgcaaagggatggctcatcaatgctccacatcagggtcgcagcccctgactccttccacgggccgcgcccaggcacccttgcttctgacatccacccgctcctcccacacaaccacagggcctgcccttcgtgatcaacatgacgctgccggagcgggcagaggactacgtgcacagggttgggcgggtggggcgtgctgatgcactcggcctggccgtctccctggtctcggccctgcccgagaaggtgtggtacgccagcggcaagggccagcggccctggctggcacccagccgccagaacacggcgaccaacgaccggccgggggggcagacggtgtggctggacgagcccggcctgctccgcgacgtggaggagaggctgggcgcggccgtgccgcgcctgccggccgacatggccctgcctgccgacatcgtagcgcggctgggcaggggcccgcaggcctacggcgggggcggcgccgacgctgacctagcggcccaggaggcgctgggccggcgcctggcggcggtgcagccggccctggccgcgctggcaaaactggagcgggacgcgcaggccagcttcttcgacttgaagcgcaagtgggccgaggtggaggcggtgcgcggccgcatgcagaccgtcccgctgggagagtgaagatggggagcggggattggaaagatctggcggataaagccaatggcgctgtcctctgccaagcttggtgaaatctgagggcggtaccaaattctgcatgcatgcagaccgtgctgtgttgannnnnnnnnnaccgcatgcaggccgtcccgctgggagagtgaagggggggagcggggatgggaaagatctggtggacatagccaatggcgccgtcttctgtcaagcttggtaaaatctgagggcggtaccaaactctgcatgcatgcagaccgtgctgtgttgaggttgttgtacagcgttacccacaaaacagtgtcacaggcaacagcgctcgtggaaagtagagttgtgcatgcaaaggccagcggcacaggggccaggagacgcagaatgtctcggatggaagggtacaaaatgtggacacagactaaaaaaggcaactgtcatcacagacgtcactgggtcctgccggcgcgacagagccgcagaattccgcctccgtaggaggaaagcaggacatcctgctcagacacggtaacggagctgagcgggtccgcagtcatcctgccgggatggggaagaaagaaagtgtgcatgccattggtacaatcctgccgctcatgagctagctccaaccgcgctccaccccaccttgccgcaacccctcacctctgctgcaccagaggccccaccaggggcatgtccccccggcgcagggcagcaaagctgcccgggtctagtgacttcacccccctccagctgcgcacgctgtgcgtcctggtcgccgccctgaccgccggcgcggagacctcccagagcagcagctggcagtcctgccccacggaggccaggcggtagctggcactggcgcgctgcagccgcggcgacgacgggggggtggcctcgggggagggcgggggcgtcccgcttgcagtcctgggatgggcgaaatggcaaggggaagcgggtgagtgtcacgagtcgctgcatggcaggcgaacacctccacaccaatgggctcggaccctgcggccctgacatccggcctccccgtgcactcaccaggggtcaaacgcgacgccggtgatccaggaggagtggccttggcacaccgcagccaccgccttgctgacgaggctgtagacggtgatgaggtcatcctctccccctgccgccaccagattcccgtctgcgctccaggccacgcaggtaaggccgccgtaatagctctggcgggggtccagaggggaaaggcgggggttgattacgcatgcacacccctgccacagggcagactgttgcccatcaggaatgaatggcttctgttgggcgtgggcccttggccagggtactcaggaatttggcttgtggggccttgcagcacccacccgcaggccctagcacctcatcaccttgaagccgccgatgcaggctcctgtggggtaggcatgaatggccagtcttccgtcccttcccgccagcgccaccgcgtcccccgccggcgacatggcagcgatgacgctgcacccccgtgacaacgcagacatggtccgatgggggaccatcttcaggggctccacctcgctattggtcctgtgcagcagccacttgtcagagctctgccccaggatctgtggggggtgggaaagaggggccgggcagcgagtgggacaaggagagcagtgtagacaggacgcaggacagactgagagtgatgtgcatggtgtgacagatcgtgcagtggaggcctggggaatggtgcacccccgatgaaagccgcacccctgtgccccatcccgggggaccaagaccaagtatccaacccgatgataggcatggaaggccccgtcggcgtgggtggctatgaaggagccgccgttcgtccccgggatccactgcaccgacaccgcgcgcgcgggcgtgtccaccccggcctcgttgtagatggcagcggggacgggcttgccgccattgggctgggccaggcaccctgccagggacaggagcagcacctccccgctggccatccccaccagcaggtccaggccgtcctgggcctccggagtgaaagcgacgcaggtggggctggcggtggctgggccggggcccgtaccccgcacctctaccagccgcgagtcgctgcccgcgccgggggagagcgcgcagaggaagagggccctgggaaggttgaagacggccacaggggccttcttgtcgggtaggtggcagatcacgcaggtactgggggtctcggggttgaaggggtgggaggtgcgacgctcggcgacgagggaccaccgtccctcgggcgtgagcacgccctgcatggtttcgagccagctcgacgccggatggatggtattaccacatgatcgggtgacaattgatgggcagcagcgtcatcagcactgctgggccggagtgatgatctgtgatcacgagggaggagcactcgcgccctccagcatggcacaagccaagcgaagcacgacagcgtggcagagcagcttagtacctcgtcagccccaaagttctactggagtattgtattggcatcatgcaannnnnnnnnncgatcgggttaaaactgatgggcagcagcgtcatcagcactgcagggacggagtgacgatctgtgatcacgagggaagagcactcgcgccctccagcatggcacaagccaagcgaagcgcgacagcgtggcagagcagcttagtacaccgtcagccccaaagacctactggagtattgtattggcatcatgcaaggatttacagtatacctcctctggcagactcatgagaggacaatggcaactggccgcttccagcggcaggcaaggcatgcaacggggtgggtgccccctcaaccagactcgatgaaaccaaaggcggacaagtccagggcggacagcaggtcctcctccgagggctgtgtcttggggcagctgggttcctgcccagcctctccatcgtcgtctggcaatgcttgaggctgggctccctgctgctcggagtctgatggcacagacctcagcaactggccagcctggtgatgggctcccagcacgtcggccgacctttccccgtccaagggccgcgtggggatgaggccggcatcactctccgagctcggctccgggagcgacgagtccgaggacggtgccggctcggcgggcgnnnnnnnnnngctatccaagctcggctccgggagcgacaagtccgaggacggtgccggctcggcgggcgccggcttgacgggaagggggccgacacggcgcggcgctccctgccgcaggctcattaccaccatccccctctccgccgtggagggcttgggcgacggccgttcaccgggccccatcgtgtcctcccacacggacaggggggcggacccggccgcagcgcggggccggccctgcagcgtcagggagcgcgaggaggcgcgctgcagcgcaccgctcgtcagggggaccagcctggactggcgggggcctgcgccggccgcctggcctgcagacctgacagtggctgccccgggcttgctggcgagcttggagacgggggccggtgcggctgccggcgtcgctcctgcggcccatgcgccggatgcgggggggagggaggagaccggggagggtaggtctgggatgccgagcgtggggtccagagcaggggccggcgccaacagggcggagnnnnnnnnnnggggatgccgagcgcagggtctagagcaggggccggcgccaacagggcggagnnnnnnnnnncgttagtcggcgtgaggctgagggcgtccagcacgaaccagaggcgccaggaaccgccgcatggttcaagccgcagcaccctgacggtccgcagaatgggcccagccagcctagcgcctctggcacacaatgcctcgacacggcgaccactcgtcccatgctcgcatcccagcctgcccagggacacaacctcctcccccccccccccccccccccnnnnnnnnnnagttagtcggcgtgaggctgagggcgtcgagcacgaaccagaggcgccagggaccgccacatggttcaagccgcagcaccctgacgttccgcagaatgggcccagccagccttgcgcctctggcacacaatgcctcgacacggnnnnnnnnnnaccgttgccgcaggcctagaggtgtggtcagtcctcgcgtcatgactataatgagactctgaccgcccagactgggggcccctgtcgctggaatagtttgcccgtgaagcaaaggcactgacggggcgctggtctgtgctggatttgcgnnnnnnnnnngtggtcggtcttcgcatcatgactataatgagcctctgaccgcccagactgggggcccttgtcgctggaatagtttgcccgcgaagcaaaggcgccgacggggcgctggtctgtgctggatttgcggaaatctgccggaggggtggcgggcgccggcgaactggaggcccatggcaaccggctgggcgtgagggatcgcgtgctcaggggtgcgggactgcttgctgccttccgagggctgttgaactctgtggctcaatagaggggcaaggcgtcaggcgaagggggtagacgagcccaaggacatgcccaccagagcgggaccctgcaccacacctttgtcatggggtagtacaccgggaccgtgtttcttctcgcgaagccattgtggtgccaaacttggctgatccaccattcgctgcgtgggcaaagctcgcgcggcgcaattgtgtcgtgcgcgagagggacgggaacgggggnnnnnnnnnnnnnnnnnnnnnnnnnnnnnnnnnnnnnnnnnnnnnnggggtgacggagaagtagaccgttaccgacgtcctgcgctcgtcagaccagaatgaatgggaattgtaacctacagagactaaacgcgaccctctgtggcgcggcgaaggacgcgtaagcagcgtggcgaccagaggcacggtccagtcggcannnnnnnnnnaaacaagcggtcggggaatgtttgtcctggagggggtggagggcactgccaggctcnnnnnnnnnncaacaggcggtcgaggaatgtttgttctggagggggtggagggcactgccaggctcnnnnnnnnnnctgggaattgtaacctacagaggctaaacgcgaccctctgtggcgcggcaaaggacgcgtaagcactgtggcgaccagaggcacggtccagtcggcacacgcgattgacaccgaggacttggctgatctcagacaaggatatactcgagcggcgatgggggaaccaactttgcgcaatgatggcgacaagctgcaagcattcacagatgaatcctcgttcctggactccgtccaatcaacccttcgagggaaggcgcgagcgctgaacctcagaacccttgcaacggggacactcagctccaacgagcacctataatcgtgacgaaatcaccacatcgataagaaggagtttgaaccctgtcgaagttcggtgcctggcctcctctccccacgaccatgcctctgcaacccaaggtgataccatggacactcgcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatcgtcaagtataagcgccatgtggtgaaggacgatgacctccccgacacctacctcatgtctgctctgtgcctaggaatggcagccctcttgctaaaggtgaaattggaggcttcagtgtgggggaatcagcgtgatgaggactgtcagcgatgtgcacgccacattctcggcggagttgagtgctggctcccactggcagccctggtagggcactttgtccctgtctgagcttcttaaatgtgctggccaccatggcctctgttttcgaatgtgcaggggaagatggcagcctggacggcaatcatctgcatcctgtcctcgctcgcaaactacggtgtcaaaactgatctgaagcagctgctcaggtgcgtgatttggggcactggaaaggcacacccttggcattgctaggtgactggtgctcgaatcagaaagctacaagtgttcgagtgagctcctgccccctcctcgtcccctgcagctccagcgtgtttgtattgttcgggacgggagccgtctacctcctccctgagaatgcgcccaagcgctccctttgatcttggcactcgatgatcgcgggtggaaggtgcatggccaggaaatgccaccagacactttcatctgctggaacagatggccagcccaagagggagcccatagctcgctagtgtattgagcaccacagattgcaccccagcgctgcccccacttgaggctgcctgccaggagagcttcggcgcaatcttcacaaactaacccaaagcagttctccttactattctttgtccgtttgtaacctcagctcgcagtggtgtgggtgttacagtgcactggtnnnnnnnnnngagagggaccccatagctcgctagtgcattgagcaccacagattgcatcccagtgcctgccaggagagcttcggcgcaatcttctcaaactaacccaaagcagttctcctttctatcctttgtccgtttgtaacctcagcttgcagtggtgtgggtgttacagtgcactggtgaagagtgcaagctgagtgcggggtactggcagggagctttaggcctaccaacaccccgtcatggaagacagaaggggaatgcacaaggccaaggagcgcctaggaggagtnnnnnnnnnnccatgaaggacagaaggggagcgcacaaggccaaggagcgcctaggaggagtgacagaacacagcgtgcattgccgctggcccgctcctgcccagtgtcaagcaaataaggtgaaagcggagaaggtgtgctgttttgaggtgccgggttggctggactgcgtctgcagggatgcccaccgcttgaagtgcagccacccaggcttgaggacagaggggatgcagtcctcgtgcagttgatactcacgttggccctctgcatcagaggaaagggacaggggaagggcatgtgaggggaggggagggtggggaaggggccttggaaaggcatgcgtgctagggcgcccacagatggagcctggcgcgctctctgccaggacatggaccaaaatcggcggcagtcccaacacaggccatgcatctgtgcccagcgcccatcccaccctcaaccaccccaccccaccctctccccaacacacacgggcacacacacctgtcgtgacatgtttctgtatcccccgcccatccaggctggaggttgctaggtacttgtgcagctggttcacccagggcaggaccacatgaccgcacagcagcgccgcaagggtggcatggatgcaggcaaggctgccgcgctgccccggcagctgggacagcgcatagcagcacagcatccagatgggagcgtcgtacagacctgcgtcgggctcggcggacaggggcctgggcctcatggagtgcatgatcgatgtgaatgaggaggaggggctggcatcctgtgggaatgtgagagggggcgtggggcagggtgagtgggggtggtcgacggggtccgaccggaggggggtgcagccaagaccccctctcaaggggtagattcggcgtaggggtcgagcggtggcatgaagccccggcatgccagattcgcgcgcctccccgacctcgccaaccccacatggcacactcgacacggtcgtctggaaacacgggtgaatggggcatgcaaggcgccctcgtcccagcccatccgcgcctgtgaggggaagcgtgttggaaggctggcgtccaggttggcctcctcgtccgcctggttgggggcacctgccgccagggaccattccagtctattgcatggagtgattgcgctatttgccaaaagcagtttccgtctcgcaggggaggtgggtccctctactacccccccgtccaggtcggtgacaggaccctccagggcgcgagcgggatagccgaggttcgccattgcccactctttacacagacatgatggaatttaatgggtatggagaatggtgggcggtgggccatcgcgctgggttggagcccccccttccaagttcccctggcccaatcatggggaggatccgcagagtcggaccctgcaaccctcatccgagagttgggagggttgtacgacactcaacctccccacttccccaaaaggccccggcatgcccccccaccacgacattcttcctcgaggcatcgatgttaattgttcgtttgttctcgagccctgtgcacgcaccaccggaggcttgcttgcccacccaaagcaccgttgatgacgtggcaatgtcacgggcgtgtaccccggaaggcgcgagagcccctctctgcgacaatgtgccgggccaaacattcctggttagcggcagcgggtcgtggaacggatcatttgggcgttttcttcctcgggggcacggtcgcgacagacacatccgacctccgagggactcgcggtggtcctagggtggttttgcgcgcacctgacgagagcccccttcaggcacagcccgccgtaaagcagtgcctttgtgcaccatcctcgagctgcgtctgtaatctcgtggggctcagtacaagcataatggacagcacggtcagtatcagaggcgacaagcaggctgggaatgggggaagtattcccagtccaggagctaaaccggattcgaacgctgggcaggcacggcagcaggaagggagagggggatcgcagtcgcctggcagacttccagcggtgttgatgagagtaggaagggcgggagggggggatggcagcgtcagggcgtttgaacacactcacgacgggaaggatggcagggccgctctgggctggcgagattctnnnnnnnnnngatcgcagtcgcctggcagacctccagcggtgttgatgagagtagggagggcgggaggggggggatggcagcgtcagggaggctgaacacactcacgacgggaaggagggcagggccgctctgggctggcgagattctgtgccgacgtctagcaggggatcggaccagtccctccctgttgaaggcctcttggcccagggcgccgcagacaccctgtcacgccgttgcctggcgcgggcgtgtggagtggggcaggtgcggctcggctgacgtgcaggcgcggggcgnnnnnnnnnnactggcgcgggcgtgtgggatgggacgggcgcggctcggctgacgtgcaggcgcggggcgcgtgaggagggcgccgcccccgtgcccgcctcctgccgccccgcgtctctcgcagactctcaccactggtacttggcctggagcagcacgtcctcgtactgcgcggcggcgtggtcccaggtcaggtcctgctccatgccgcggcgctggatgccggcaaaggagtcggggtactcgcgcagcgtgtagagcgcgtcgcccagcgcgttgcggaaggcgcccgcgtcgctccactcgaacacaaagccggtgccggcgttggcgtaagggtcgtaggcctgcaccgtgtcgcgcaggccgcccacggcgtgcaccacaggcaccgtgccgtaggccatggcgtagagctggttcaggccgcagggctcgaagcgagagggcatgagcaggatgtcggcgccggcggtgatgcggtgggccatggccgccgagaagcccacccagccgcggcacttgtcgtggttccggctctccatgtccctggaggggtgtgtggggaggtggggtttgggcaggtggagaagggggctggtggtcaaggatcctgagagcccacaggtgggacccatccctgcgcagaacccaggcgggaggtcgccagcgacgcaccgccccgccggccttctcacatccctcccatcccccagcccggctccttcactcgcctgccctccccgcccattcaagtcaccccctcacccacctcaaagacgcctccaggtcttcacgccccgacccaagcatcaccagctgcacgccctcccccatcagccactcgtaattgtcgcggatgaggtccacgcccttctggtagtccaggcgcccaatgaagcccagcagcgggcgccgcacgtccaccggcaggcccagctccttttgcgtttggtgagggggcgggtgtgtgtgtgcgtgttcatgtcccaaggcgcacgagccatcagtgcaccgacaggttgcgcaagggccgcgccccaggccgcactcggtccgcccgcttgcccgtcggggtgagcgggcgggacccggcacaccccccctccccccgcaaccccccaaggacagaagaagaaccgagagcacaccttttgcagggctgccttgcaggccgccttccccgccatgtcctgcaggctgtagttccggtagccatcgtgctgcaggtggcggtcggtggcggggtcccactcgcgcgggtcgatgccgttgaccacgcccgccagcttccaggcggcctccctgaagacggcgtccagcccccagccgccgtcctgggtctggcactcccaggcgtagccgcgcgagacggccaccaggcggtgtgcggcggccacgcctgccttcatcacgttggcgtgctccccgcccagcgggtcgtccaggcggaaggactcggcgtagtcgccgggcacctccagcagggccaggtcggccagcggcccacgcccctgatgcgcgacgttgtggagcaccagcaccgagcgcgcgtaggtgagctggccgtggtcccggtagtgggcctggaggtagacggggagcagcgcggtgtgccagtcgttggccaggaagagcaggttgtcctcgccgtagggcacgccgccgcagggcacgtgccacggcacctccagcgccgccttggacagcagcgcgcagcggaagagcacgtcgtggcgggagccgccgtagatgtcgcccgcatgcgcgtggaaggcggggtggtccacgaagatgaagtccacgccgtcctggaaggcgtggaagaagccgacctcctgctccgcatggaagacgcggaggcgcaggcgcacccccgtctcccaagcgtcggggtactgcgcgtagcgcggggccaccaccgccacgcggtgcccgcgctgggccagcgccttgggcagcgcgtgcatcacgtcgcccagcccgccggtcttggaccagggcgcgcactccgcgcccaccatcaccacgttcatggcgttggggttggggcggcgggccggggacggcgggggcggggtcggctcggggg

SEQ ID NO: 41667 - DNA, 76 bp, Chlorella protothecoides
aaatacaggacccaagcatccttgcggaattcaaaaaggctgcagttattgatgaccttggtgttccctgtcttgt

SEQ ID NO: 41668 - DNA, 61 bp, Chlorella protothecoides
gggctgggtgactcctcggggctggggctaagcgagggagactcctcagggctggggctgg

SEQ ID NO: 41669 - DNA, 61 bp, Chlorella protothecoides
ttcctgtccagggtggggactggctggggggcgagaagggggccgaggagggactgcctga

SEQ ID NO: 41670 - DNA, 61 bp, Chlorella protothecoides
actggccgacagctgggagtgttacagccccctcagccagctctgcctctcctctgtcccc

SEQ ID NO: 41671 - DNA, 61 bp, Chlorella protothecoides
gccagtccctgtcttggctactcgtaagagggtttctaatattgacatcttcgtgtgtgag

SEQ ID NO: 41672 - DNA, 86 bp, Chlorella protothecoides
aggggagggggtgggtggggagctccaaaacctgctcaggtctacgatgaatgctctgcaccacagatcggctgtcccatcgagca

SEQ ID NO: 41673 - DNA, 750 bp, Chlorella protothecoides
cggcgcctgcccggcggcgcgcgcgacgtggcctgcgcgctgtgcccgctgcgctgcggcgccttccgccgcgcggcgggcggggcggggcgctgggtgcactcggtctgcgcgctgtggacgccggagacatacctgacgcaggagggcgtggtggcggggctggagggtgtgcggctggaccgcgcctcctgcgccatctgcggccaggccagcgggtcggtggtcacctgcaacgcctcgggctgcgcctacgccttccacccgctctgcgcccgcaacctgggcctgtacctcggtgcggggctgtgagggtggcgttctttgtatcaggggggaggcgggcgatgcgggggaagtgagctggggtaggaggagtggaggggcgatgagaggagggcggtgtgccgagggcgcaggggcgcagtcgctgcgccgtgggtgggctgccggcgacagcctggagagggactggtgtaccgcggggcccgcctccatcgcacgattccccggcgtccccgcctgccatcgcagtccatccccagagcacgtccccacacatcctcccccctgacccaaaacaccccaccccccccgcagcggcgcgcgtggatgggcaggggcgtccccagtaccgcatctactgcgcggtgcacagcgcccgggagcaggagaaggaccagcgcgcctgggctgcgcgcctggagtcggcggcggccgcggcggccgaggaggcgcggcgcggcgcgg

SEQ ID NO: 41674 - DNA, 66 bp, Chlorella protothecoides
cacgggccttccgttggaggtgattcgaatccagcagaagcgtggggatgaagcggagcaggactc

SEQ ID NO: 41675 - DNA, 65 bp, Chlorella protothecoides
ctgggacggggccgccgggagaggctcgggggaggtttgtatgatggcagccccggccacgagtg

SEQ ID NO: 41676 - DNA, 61 bp, Chlorella protothecoides
ccaggccggcagcacgacgtgcggcgcgcggctgcgccgaccccgcggccccttggtcccc

SEQ ID NO: 41677 - DNA, 62 bp, Chlorella protothecoides
tcgcaggtgcgtttgtgtgtttgtatgttttttggggggtccccctccaagagggcgggggg

SEQ ID NO: 41678 - DNA, 77 bp, Chlorella protothecoides
ccttcgcacctgggaatgcgggtgccgcccgtatcagcgctgtgcggagttgaccacccagaacgtccagcggcggc

SEQ ID NO: 41679 - DNA, 61 bp, Chlorella protothecoides
tagttctccctatatctgtctatatagattcttcctatataagtgtcattgtatttataag

SEQ ID NO: 41680 - DNA, 61 bp, Chlorella protothecoides
taggtgggaggagcggaactgcagtggcgggggggccgttgcaggcatacttgtaccagtg

SEQ ID NO: 41681 - DNA, 2582 bp, Chlorella protothecoides
  modified_base (211)..(220): a, c, t, g, unknown or other
  modified_base (298)..(307): a, c, t, g, unknown or other
  modified_base (1496)..(1505): a, c, t, g, unknown or other
ctccatcaacgacatgggcctgcacagcgtacccggggggggccgcgacgccttgcccccggcggaggtcatgcgcagcgtggaccccgacgagctggaccgcatcttcgtgcacagcagccgcctgaacaggtggcgggggtggttgggacctggtgctgtcttggacaggagggagaggggggggggggggggaaaggggggggtctcnnnnnnnnnngtgagagccggcggctggtacacacacccggcggctggagtggacgcgcctgcgtcgtgcacgaccggcactcgctcnnnnnnnnnnatgagagccggcggctggtacacacccggcggctggagtggacgtgcctgcgtcgtgcacgaccggcactcgctctcctggccacccccactgccgatcccgcgtccatgctcagccccctgtgtcgtgcccccaccatcccccatccaccgcacccgcaccgactccatcccggacccgaccccgcagcgacgccatcgtggagtttgtgaccacgctctgcacgattgcccgtgaggagctgcgccccgtggacgcgccccgcgtcttctcgctcaccaagatcgtggagatcgcggcgcacaacatggaccgtatccgactggtctgggcccgcatctgggccgtgctctccgacttcttcgtggaggtgggctgcgcccccaacctccaggtggccatgtacggcgtggactccctgcgccagctggccaccaagttcctggagcgcgacgagctggccaactacaccttccagtccgacttcctgcggcccttctgcgtcgtcatgcgccgctccaaggccccggagatccgcgagctggtcatcaggtgcgcggccggaccggggcgtgggtgtcggggaggggaggtgcgggctcatgcgatggagacccagggcgcgcccggggcgcggggcggtccagcgggtgtctgggtgggtggtgcgacgactcgagcgctgcaggtggtggagtgcaggggatcacaggccgttgcgcctgtcggggggtacagccgtcggcagggacccgaggtgctgagctgcggggctcagctccccagccgcggccggagcttgccgcgtgaccgccgtttgccgtgaaactcggcaccggctcgacacctgcatgcccccccccgctcaaccccccctcgcaggtgcgtctcccagatggtgctggcccgggtggccaacgtcaagtcggggtggaagagcgtcttcatggtcttcaccaccgccgcggcggacgagtccccccagatcgtgcgcctggcctttgacaccgtggagaagatcgtgcgggagcactttcactacatcaccggtcagtggatgggccggaagggtttgggagggtggtggagcgtgcggcgtggcgtccccctcccatgtgatgcagcatgtgtcacccgctgactctagcaagccaaacacctggctgccagatgctccatcccccccgcnnnnnnnnnncgtgaggcagcatgtgtcacccgctgactccagcaagccaaacccctggctgccagatgctccatcccccccgccaaacctcctccccctccattctccgcttcacagagacagaggccgcgaccttcaccgactgcgtcaactgcctcatcgcctacaccaacaatccccactctctggacgtggccctgaactccatcgccttcctccgcttctgcgcactgcagctggccgccggcggcatcggcgacgtggagaagctgccggagggggccgtggcccgaacctcctccgccgccttccgcatccggccccgcggcgacgccgcggccggcgatgtgacgagcgcggcggcggcggcggcgacgagtctgtcggcggcgacgagcgcgtcgaaggcgtcgaccaccgcacccggcgacgtggcgcactccaaccacacaaccagcgccacagtcggttcgctgcgctttacggacaaggagcagcacatgtactactggttccccctcctggcgggcctgtcggagctgaccttcgacccgcgaccccaggtccgcaccagtgccctggacgtgctgttcgacacgctgcgcttccacggcggctccttcacccccgccttctggctgcgcgtgttcgactcggtcctgctccccatcttcgacgtggtgcgcgccgagatcaccgacaccaccaccttcaccgacgagcggcggcgcgcggaggcggaccgctggctgtacgccacctgcacgcgcacgctgcagtacatcgtcgacctggtggcgcagtaccacgcgggcgtggagccgctgctggcccgcctcctgcacctgctgctgggcttcgccacgcgcccgcacgccgagctggcggcggtgggcgtggccgcgctgtcccgcctgaccctggccctggcgccgcggctggacgagcccggctggcgcgcgctgctggacgcctacgccgaggcggcgcgcgagacgctgccggacgtggcggggctgatgcagcgccgctccgcgcgcttcaagaaggacgacgcggaggggcgcgtcggcgcgggtccggctg

SEQ ID NO: 41682 - DNA, 70 bp, Chlorella protothecoides
gggtttgaccgctactaccaggtgcgaagccgggtgtgtatgtggcgggtggggtgtggcgtcgcagctg

SEQ ID NO: 41683 - DNA, 23669 bp, Chlorella protothecoides
  modified_base (206)..(366): a, c, t, g, unknown or other
  modified_base (465)..(519): a, c, t, g, unknown or other
  modified_base (833)..(842): a, c, t, g, unknown or other
  modified_base (1438)..(1447): a, c, t, g, unknown or other
  modified_base (2074)..(2083): a, c, t, g, unknown or other
  modified_base (2365)..(2374): a, c, t, g, unknown or other
  modified_base (2725)..(2734): a, c, t, g, unknown or other
  modified_base (3590)..(3599): a, c, t, g, unknown or other
  modified_base (3822)..(3831): a, c, t, g, unknown or other
  modified_base (4392)..(4529): a, c, t, g, unknown or other
  modified_base (4973)..(5232): a, c, t, g, unknown or other
  modified_base (5548)..(5557): a, c, t, g, unknown or other
  modified_base (5849)..(5858): a, c, t, g, unknown or other
  modified_base (6184)..(6193): a, c, t, g, unknown or other
  modified_base (6317)..(6326): a, c, t, g, unknown or other
  modified_base (6524)..(6533): a, c, t, g, unknown or other
  modified_base (6670)..(6679): a, c, t, g, unknown or other
  modified_base (6868)..(6877): a, c, t, g, unknown or other
  modified_base (7035)..(7044): a, c, t, g, unknown or other
  modified_base (7495)..(7504): a, c, t, g, unknown or other
  modified_base (7874)..(7883): a, c, t, g, unknown or other
  modified_base (8049)..(8058): a, c, t, g, unknown or other
  modified_base (8534)..(8543): a, c, t, g, unknown or other
  modified_base (9372)..(9381): a, c, t, g, unknown or other
  modified_base (9694)..(9747): a, c, t, g, unknown or other
  modified_base (9922)..(9931): a, c, t, g, unknown or other
  modified_base (10545)..(10554): a, c, t, g, unknown or other
  modified_base (11405)..(11414): a, c, t, g, unknown or other
  modified_base (11545)..(11662): a, c, t, g, unknown or other
  modified_base (12187)..(12196): a, c, t, g, unknown or other
  modified_base (13105)..(13114): a, c, t, g, unknown or other
  modified_base (13454)..(13504): a, c, t, g, unknown or other
  modified_base (14348)..(14357): a, c, t, g, unknown or other
  modified_base (14568)..(14577): a, c, t, g, unknown or other
  modified_base (14664)..(14673): a, c, t, g, unknown or other
  modified_base (15649)..(15658): a, c, t, g, unknown or other
  modified_base (15873)..(15882): a, c, t, g, unknown or other
  modified_base (16561)..(16570): a, c, t, g, unknown or other
  modified_base (17045)..(17054): a, c, t, g, unknown or other
  modified_base (17736)..(17745): a, c, t, g, unknown or other
  modified_base (18581)..(18590): a, c, t, g, unknown or other
  modified_base (18842)..(18851): a, c, t, g, unknown or other
  modified_base (19136)..(19145): a, c, t, g, unknown or other
  modified_base (19311)..(19320): a, c, t, g, unknown or other
  modified_base (19393)..(19464): a, c, t, g, unknown or other
  modified_base (19662)..(19671): a, c, t, g, unknown or other
  modified_base (19830)..(19839): a, c, t, g, unknown or other
  modified_base (20364)..(20373): a, c, t, g, unknown or other
  modified_base (21809)..(21818): a, c, t, g, unknown or other
  modified_base (22230)..(22239): a, c, t, g, unknown or other
  modified_base (22600)..(22609): a, c, t, g, unknown or other
  modified_base (23405)..(23414): a, c, t, g, unknown or other
actgaacacccagaaacccgacgggttccaaacccccccaaaccccaactccggaagaccgaactcccagggtcaacccctctttccccctgccccgcggctatggagccatgcctgcccaaacaaccctgctcttctgaaccagcactgcctctccccctcattgcccatgccacacaaggccgttcacttcccggcagcccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagctatgattccctaccgcgggtgtctctatcctccttgcaccaatgcaacgtttttcctcaagatctcccattcatgcctggaaatcatttttcnnnnnnnnnnnnnnnnnnnnnnnnnnnnnnnnnnnnnnnnnnnnnnnnnnnnnnnagtcttagtgcgtaccagagtacaccaggtgtcgacaggcggacactaagattgatgggtgacccaacagctaccaatgtgggcccacttgtgttggtgccgacgtgacaccagccatggagcacttcacaggcctacgtggtgatgccagtgcctgcgtcctctccataatacgtgctcgatgtaaccagaaaaaggggactggcctcacatcgttacaacgtcggtctttgcaacgatttcacagcgggagcgccccggataaaccctaaagaaacatgttgaatacggcgggaaaccggaacctggcacgnnnnnnnnnntacgagacaccagccatggagcatttcacaggcctacgcggtgatgccagtgcctgtgtcctctccataatacgtgctcgatgtaaccaggaaaaagggattggcctgacatcgttgcaacgtcggtctttgcaacgatttcacagcaggagtgccccagataaaccctaaagaaacatgtcgaatacggcgggaaaccggaacctggcacgaaactggaccactaaagggtcagctgcctctctaggatggtcatgcggtacgctggatcttcgcaggagtatttcgaggtgttccacaatccacgggggtccggagacactgagcgacggcactgagcgacgattggctgcagtgcatagtaaggacgagctatgggcctattgaagtacccttgggtctgaatacccgaggcgtgagtagcttcatgaccaaattattaaccttttgggaacttaagatcggtgttccggtgtcgcgcagaaaggcaaaccccgtctgactccattggcagacaccattcccggagatttgcccacggcgcaggaccacgagtagatcttcaaacattgcacagcttgcagcttcccaaacgnnnnnnnnnnggcagcttcatgaccaaattatacacctgttgggaactgaagatcggtgttccggtatcgcgcggaaaggcaaaccccgtctgactccattggcagacaccatcacgggagatttgccaattgcgcaggaccacgagtagatcttcgaacattgcacagcttgcagcttcccaaacgcccctcgctgagtgtttatcatgcaagtggaacgcaacatttgattgtagagtccaactttctccataccctagccaggactggctagggcattggggcgcgcacccggagcagtaggtgccgcgggaagcgaacctatcctgtaggggccgcgcgttccgagacccgataaattgctacaaccctggtcccgatatcagaacttcacttttctacagcggtttctggtgaataattgtcttgaaaaggctcacgggcctggctcagtatgtttgagaaccaacgcaccgccgctttggtggacgccaaccccaatggcatccccaacttaaagaagggtaaggcgttacaagatatacccactcaaattcacacacattatagggtcgttcaggacactgtttgccagtgcggtgctgctggacgcatggggcccgggtacttcgtgcnnnnnnnnnngaagaagggtaaggcgttacaagatgtacccactcaaaatcacacacattatagggtggtttaggacactgtttgctagtgcggtgctactggacgcatggggcccgggtacttcgtgccgtaataacagcggagatgatccgttcccatcgcgcacccctctgcgcaggcacgctcttcacaggagccatccacatcttctgcggcatcgtcggtgagtgagcgtcgcccctcgcatgtctcgttccggttgttgtcaccgcaccaggcccaggaggctcnnnnnnnnnntccatccacatcttctgcggtatcgtcggtgagtgagcgacgcccctcgcatgtctcgttccggctgttgtcaccgcaccaggcccaggaggctcatctggtcccccccggtcgtgcaggtgccggtgtgctcgccctcccccagtccctgggctggctgggatgggtcgcgggtcccatactgctcatcacgttctacatcacgtctctcatctcctcatggtgcgtttcggagtgggtcggggcgtccctagggttgtccgacggggacgggggcacgcgggcccgcggcctgttcccgcctgttcggaggtctctcacaatcacacccacctcgcccacgcttgccannnnnnnnnntgacgggggcacgcgggcccgcggcctgtccccgcctgttcgggggtctctcgcaatcacacccacctcgcccacgcttgccaccaggctgctcgccgactgctacgaggtagatggcgtggagaacgggcgttatcatgacatcgtgaagcacatcctggtgagcaggacccacctcaccgatcctcgtggggatgtggccgggcaccatgcataaggacccagggacctttatatacctctttcccccacgcgctgaaacctgcagggcctgaagtgggcgtatgtggtgtccactttccagctggtgaacatcttcctgatcgacatcgcctacacaattaccgccggcaaggccatgtccactctggccctgactgcatgcggctggcagggcatcgccgagggcgactgctttgacacagtgcgtttggcctggaacgatggggtgcctgaaggcaccgtggggaccccgggaagcagcagggtagttttgcgtgaatggcctcagaacattgcgcgcccccttggccactcatggaagtgctaagaccctggctcaccgcatccactcaccctcccctcctcttctgcagacctgggccatgaccgtcatctttggaggtgtgcagatcgtgtcctcccaggtgcccaacctggagtcggcctggtgggtgtccttcatcggcgtgctcacctccctcttctacgcctcggtggcactggtcctgggcatgatccacggtgaggcgcctagggctgcatgggcgacacggatctggttggtggaggcttgggtgatgtccgtagccctcgagcacaagccatcatggggagaacggcctgcctccagcannnnnnnnnnccctggggccgcatgggcgacacggatctggttggtgggggcttgggtgatgtctgtatccctcgagcacaagtcatcatggggagaacggcctgcctccagcagctccaagacacgagaagatctgctgggctgtccttgcacaatgtctcctgattgcagtccgtgaccatctttcctccccatccaaaattgcgtagccaagaaccacctcgggtctgtnnnnnnnnnnccaatgtctcctgattgcactccgtgaccatcttccctccccatccaaatttgcgtagccaagaaccacctcgggtctgtgggtggtctgtcggccagccccatcaacaaggcgttcaacgtgatgggctccttgggtgcaattgggtttgcctactccttctccaccatcctggtcgagattcaagacaccctcaagcagccgcccaaggcctccaagactatgggcaatgccatcaccatctccgtcaccggctccttcctcttctacttcctggtggccattggcggctacgccagcttgggcgagggtgagcaacggagtacggtgcatggttcagcgtgggggccctgggatgctcccccaagtcgcaccagcgacgtcctgccgtgcagcgttctgagttccgatggcctggtctgcatcctaacaccccaccctgcccccgcagacgtgcctgggtacatccttgctggtctcccgggtcctcagtgggtcatttttgtctccaacctctgtgagtttcacagggtgtgctccttgggatcctgtgccggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacatcgccggttccctctgcaggcgtcctgctgcacatgtggtccgcctaccagatctttgcccaccccatgttcgacaccctggagtcacatgtcaaggccttcatgtgagcctgtctgcatgggggggagggtgttctcatgcagtcgcctggttttgggtgtgcgtttctgcaaagctcgaatgccacactagggctgcccctctcgcatccgctcatcagacattccccgaccacctccacaggctgcgccgtgccaaggcccgcggcgacaccgagctccccgcccgcgtggaggagctgaagcgcgcctccatggccgccaagaccaacaccgctgatgccaaggccacgccaatggacgccaagcccccgggggccggcgccgacggccagccgcagctgcgtcgcctgtcccgtgtttccgccatgtccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcggccaggtgggggcagccgctttcctttccttgtcaagggtctttatacgaggtgtcaagcgccgtgacctacctgcgaacgtcgccagaccatcgcctgcacaagtcgcccacaaaataaacaccccctttttcgccaggcgccgcgtgtacaagcccaagggctggttcaacatcatgctggccaccatagagatcttcatgggcctggtgtccatcgctgccaccatcgcctccgtgcgcaacatcatcaactcctggggctcatgtgagtgggcgaaaggggggaagtcggggaaggcgtgggggannnnnnnnnncaccttgcgcctggggatacaaggggaagggggcgtcagggcctggctcggtgggaggggtcgaggagacaggctcccacagcaccttgacgcgggcaacactgcattgttggcggggtcttccacacagcccgagcacacagggccctggatcggccctggattccatacccagcggtccctcctcgtggcttgggggcaagctgttgggaggccatgccccctgaccacaccccgttccctagccacccttcctctctactcaccagcactcaatggggaagaagatggnnnnnnnnnngctctgtttcatgagctgcaggtgtgatgcactcttcacacttgcctgtcctttgcactcgtcctcaggctccatcgctcatcctgccccctccccacccaaacactgcagtcaagattttcggttccaccggcggaatccactgaacccaactcccatcaaacttaacactgcttgtgcactcgccccccactagccctgtacaccctcccgctctgcccgcccccctgcgcctggccgcgtctggacttggtagagctgtggtcgcgtgggggtctcgcaatgatcctgggggcccccgaccccaaacacttgaagctgcccannnnnnnnnngggcgacgttcgcaggtaggtcacggcgctttacacctcatatgaagacccttgacaaggaaaggaaagatactgcccccacctggccgcagcccgctcaccagcactcgatggggaagaagannnnnnnnnnatccctggccacccatcctctctcctcaccagcactcaatggggaagaagatggtcagggggaagaaggctagcgctcccaccagccccgccatggagccaaagaagggcatgaccacggcgatgatggtggtgaccaccacgtagcaggagcgaatgatgacgcgctgccagatggggagcaggaagtgctcctcgnnnnnnnnnnagcagacgtagaaggtgcgcgtgaggatgcgttgccagatggggagcaggaagtgctcctcgttggagggcacggtctcgttgacaaatccggtgctgacgcggtacatggcggcgttctgggacaggcgctgcagnnnnnnnnnngctgcagggccgaggcggggcggaggtgttgaggggggtgaaggccggcacatgctggctggggacagggaaccccacccacaggccccacccacgctgccgagcgcaggggccccttccccacccaaccccaccgctcctcactggaaggccttgatgtgagactccagggtgtcgaacatggggtgnnnnnnnnnngcgcagctggggctcgccgccggcgggggcggcgctgggtgccttggcgtcaaggtcggtggccttggcgtcgaggggggcggtcttggcagccagggaggcccgcttcatctcctccaccttggccgggagctcggtgtcgccgcgggccttggcannnnnnnnnnggccatggaggcccgcttcagctcctccatgcgggccgggagctcggtgtcgccgtgggccttggcacggcgcaggctgcaggaccgaggcggggcgggggtgttgagggggtgaaggcgggcacatgctggctggggacaggagaccacacccacaggccccatgcacgctgccgagagcaggggccgttccccacccaaccccaccgatactcactggaaggccttgacgtgagactccagggtgtcgaacatggggtgggcgaagatctggtaggcggaccacatgtgccccaggacggcaaagttggcggcgaagatgacccactcgggaccgaccaggccccccaggatgtagcccggcacggcgtcgcccaggctggcgtagccgccgacagccaccaggaagtagaagacgaaggcgccggtgacggagatggagatggccttnnnnnnnnnngccggcacggcgtcgcccaagctggcgtagccgccgacggccaccaagaagtagaagacgacggcgccggtgacggagatggagatggccttgcccatagtcttggaggccttgggcggctgcttgagggtgtcttgaatctcgaccaggatggtggagaaggtgtaggcaaacccgatggcgcccagggagctcatcacggagaaggccttgttgacgggggtggcggggatgccggctacggagcccagccggttgtgcgcgctcttcaggcccaggaccagcgccaccgacgcgtagaagagggaggtcagggtgccgatggcagacacccaccacgccgactccaggttgggcacctgggaggacnnnnnnnnnncgggatggtcatgggcaggggacggggccagccagatgctgcaccggagcgtgcggcgacgtgcagtcgacggcaaggcactccgttctaaggcggccggcagtcagcaagacactgtgacagcgccgccgacgggtcctgtcagacttgccttgtcaaagcaggnnnnnnnnnntgggatggtcacgggcaggggatggggccagccagatgctgcaccggagcgtgcggcaacgtgcagtcgacggcaaggcacttcggtccaaggcggccggcagtcagcaagacacggtgacagagccgccgacgagtcctgtcagacttgccttgtcaaagcaggcgtcggcgtcaatcccctgccagccacatgccgtgtttgccagggtgaccatggccttgccggcagtgatggtgtaggcaatgtcaatcagcacgatgttgagcagctggaaggtggagaccccataggcccacttcttgccctggcagggaattgcaaggaagggggaatcagtcggtgtccaggaccaggacactgcaggagggaagactctctctgggcagcactgtgcgagatgtcatgagcggtcagtccccgcatggacaggcaagcggacgggggctcaccatgatgtgattgacgatgtcatnnnnnnnnnncgcaaggaaggggggatcagtcggtgtccaggaccaggaggacactgcaggagggaatactctgtccgggcagcactgtgcgagatgtcatgagcggtcggtccccacatcgacaggcaagcggacggtggctcaccatgatgtgattgacgatgtcatgataccgcccgttctccacgccatccacctcgtaacagtcggcgagcagcctgttggttgacattcggggaggagcgagaagctgagctgacaggaagggcaagcctctgtcagacatacaagtgttttgtgtgtcattcctgagcacatctggcatctctcaccaggcagcagtcaatgacatgaagtagaatgcaatgatgagcagcggaccagctacccatcctagccagcccagtgaccggggaagggccagcactccggcgcctgcgggagggtccggacacctgaggtcgagcacttgcgtccagcacaacatgcacgcgcagcttggcagaacaataagcttaccaacgataccacaaaaaatgtggattgctccagtgtacagggtgcctgcgaggcgagggaaaatttgtgagtgaggaggcgcgggggaaagtagcccaccagagcatcgtcctgccgaccgggagacctcaacgccttggggcaggttccgagcacagcaaaaatcacatgtacgcagctgaggcattcatgtgggaccttgcagggtctgccgcgccaccccacccgcctccctcaccctttttcaggtttggaatgccgttggggtgggcgttcaccacagaagcgtccttgaacctttcgaacattatgacaggcnnnnnnnnnntccttcctcaccctttttcaggtttggaatgccatcggggtgggcgttcaccacagaagcatccttgaacctttcgaacattatgacaggctaacagccttcaaggttatcaacgaaagttattggaatatttgtgtcatttagggatggcaatacgtcctaccatctgcctttatagtgcgtttctggtcggacagccctgagggtgatggcgcggcccgcggcacaaaccatcagccctcttccaagggcgcgcgggcccaaaccccatcccatcgaaccaacgtgcctgcaggatgcaaactatttcatnnnnnnnnnnnnnnnnnnnnnnnnnnnnnnnnnnnnnnnnnnnnnnnnnnnnnntaacaatctcgaccgaggggccgggtatcttgggtgccgatctggacaaagacctgcccgggaatcgaagagcacaacgtgaaacgaaagaccgcggggacttaaaccgcatcaggatcctagggggatacactcctacaaatgagggtcctttccaacacaaagaatatataannnnnnnnnntccgcatcaggatcctagggggatggactcctacaatttagggtcctttccaacacaaagaatatataaggaggacggagcggtatttcatttcatgccgtcccgagcgagcatccttcgcagtgtagcgtcatcgatactccaaggcggacgccatcgagctcgcagaggagggaccacacgcaacactaaataatgtcattaagactgagactatagtcgttgtatttgtagttggtaagagaatacttttggtcattagggtttgcttcctccggctcacgcactggtagacgttacctaaccacaccttcgatcgaggccgtccgtaaccggccgacaaggggaaacccaccaacaatggtgggaactcatctcgtatgccttgtgtatttctggaaatatctgtctgatgcgactcccaaatggatattattagtgctaagcttgctgcgtattcatcatattatgcaagagtgtggaacagtgagcaatggcatacagatcttggcagggggaacagttgacgcctattagaaagatctttgggatcgaaatcccagagagagtggtggcatggtccaacaaggtggaaaatgatgcacggagatgcnnnnnnnnnngcacgcaatacttaatgaatgtcattaagactgagactatattcgttgtatttgtagttgataagagaatactttcggtcattagggtttgcttcctccggctcacacgcactggtagacgttacctaaccgcaccttcgattgaggccgtccgtaaccggccgacaagggggaacccaccaagaataatggaaatacatgtcttatgccttgtctctttcagggaatatctgtctgatacgactcccaaatggatattactagtgcttagcttcctgcgtatgcatcatattatgcaagagtgtggaacagtgagcaatggcaaacagatctcggcagggggaacagttgacgcctatcagaaagttctttgggattgaaatcccagagagagtggtggcatggtcgaacaaggtggaaaatgatgcacggagatgcttcatcccttgggtttgggggtaaatctcagatgaccaggacagccacttgtgcggcaaaggatctacagggtgccagcgccctggaaaattttgactgcacggggtgccaaagggttgggggatggggtgtggatggcattggaaacgctcaatgatcttggcagcagacttcagcatgctagatgtagcttcaaaatagactaacaccatggctgcatgccatcaatcgctcaatgctcagcggtatgatcgtacaacggtgtccatcctctgccccttagccactgcacggcctcccagtgacaccctggctctggagcacggtcggtcatgcagcctcccttgtcgccgcttcaagcgcacaaacacccctctccacccaccccccccagccactcacaggtagaccannnnnnnnnnaaaaggatcaggggatgggatgtggatggcattggagacgctcaatgatcttgggggcagacttcagtatgcttgatgtaacttcagaatagacaatcagcatggctgcatgccatcaatcgctcaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgacaccccggctgtggaacacggttgctcaggcagtctcccttcttgcagcttcaagcgcccaaacaccccccccaccccccacccccgccactcacaggtagaccaggagacaatgatgttgcggaaggaggcgatggtagcagcgatgcacaccagcgccatgccaaattcgatgacatacaacatggtgttaaaccatccactgggcatgtacacggtgcgcctgtcggtgtgtggggtaaggaatatgtgggggcgccaagggcggatgaggaatgggatgagcgacattctgatgggtgtccagtggctggcgtggcatcgtgcaggacaccacacactgggccatgaccaaccatgcatgctagagtggaagtgatggtcacggtacgtcactgcaggcacacaagtattatgcagcccctccccctcccacaatccccttcccttgaagaaacaacaaagtgctcaatccctttccccttcaagcaccagcagcggaaggggaagaagacggtgnnnnnnnnnncggcagctcggcgtcgcccttggcccttgcctggcggagcctagcgagtggagggggtgtggtgagaggatgagatgagtacttgccatgcaaaccttggaaggctggggcggtgcccatcgcccagcacatctacacccacttgaaggccttgatgtgggactccagggtgtcaaacatgggttgggcatagatttggtaagcagaccacatgtgcagcaggacgcctgtgggtgcgagcgaggtgggaaaagggaagtatcaggacggagacagggagcgctgggtggagcgaagacggcagctattcaatatcatgtgaagatgatggtttcctgaaccattgacaaactcgccctctgtcctcatctgcagcatataacagcccagaggcacgcagactcacagaaattcgcaacgaagatgacccaatcggggccttcgaggcctccgaggatatacgagggaacatctgtggggttgcgtggcatggtatgtggagtgatcgcccaggatatggggtgtacactggatcttgcctgtgccgcatggtggtttgcccaccgaatcctctcctcgtccacaacccagacataatgacccaacagcctaccattgccgagactggagtacccgccgatggccacgaggaagtaaaaactggagtgagtgatgggttgaacgggctcatcactgggctgcaggggttttgatgcttgagggcgcaccacgaaggcagataaaggccacagcagaaagggccttgagatcctggccaggctctttgggccgccaggcttcagagcagcgtccccatcaacagcatcaccactctccacatccccctgactcacgcaaatgaggcagtcactgcgaaggtggtggccttgcccatggtcttggcagccnnnnnnnnnntgccaggctcttcgggccaccaggcttcagggcagcgtccccagaaacagcattgccaccctccacatcctaatgactcacgcaaatgaggcagtcaccgcgaaagtggtggccttgcccatggtcttggcagccttgggcggctgcacagagggtgaatgggcagggcaggcgcgtcaagggtgccggtctgtgacatgggatatgcactggcactagattccacactacatctctgcaagtgcaggaggtcacccaggcgtgcttgcctgggcgagcgtgtcctggatttccacgaggatactggagaaggagtaggcaaagccgatggcgcccaggnnnnnnnnnnnnnnnnnnnnnnnnnnnnnnnnnnnnnnnnnnnnnnnnnnngggttggaggggatgcccccgatggtgcccaggccattggaggctgtatgggttcaaggtgggaggtgactcggactcgcttgcacacaggctcacggcagggctgtggaggtcagcgctgcgagcggccgccttgagacaccagaggcctccctctggcagattctcaccgtgaatcatgcccaggaccagcgccaccgacgcatagaagatggaggtgagggtaccgatggctgacacccaccaggccgactccaggttgggcaccagggaggacacgacttgaactgccccaaaaatgacagtcaaggcccaggactgcatgggtggtgaggaatgtgggatcgatttgggcagggagggccacccccaaagtatgacagcatgcagctcgagtcggggtaagcagccgtgaagcggccagcgatttattggagcacatcacaccaaagaccaacttcatcaaatacgtactgtgttgaagcagtcagcggattcgatgccctgccacccacaggccgtgtttgccagggtacccattgcctcagaggcggtgatggcataagcgatgtcgatcagcacgatgttgagcgtctggaagacagacacgccgtaagcggactttatgccctgcacattgatgcatcagagggtggagcagcgaggagctgggtgacccattggaggaacgccgggatgtcaatctgcacactcctagtgccgcctgtgcatcgagtggatgctcatctcaaggtacaggaggtaacttgttggagtcaagggtttattctcttttctgccaatccaccgtttaactcaccatgatgtgcttcacgatgtcatnnnnnnnnnnctacaggaggtagcttgttggagtcaagggggtaatatcttttctgacaatccaccgttaaactcaccatgatgtgcttcacgatgtcatgatatcgtccattctctacgccctccacttggtaacagtcggccaacagcctgatgcaaagagggagggggaaaggggatgagaacgccactggggggtggcgccgctgcaacccttgccnnnnnnnnnnaatgaggtagaacatgaagatgaggatggggccagccacccaacccagccatccaagggagcgggggagggcgagcacgccggcacnnnnnnnnnngcgtccattttctacgccctccacttggtaacagtcgtccaacagcctgatgcaaagaaggaggggaatggggatgagaacgccgctggggggtggcgccgctgcaacccttgccacctgctctcccgccagttacccacaccccctcgggtgtgctgggcgggcctcgaaatatgagcccaggccagcctaaaacacaagactgattcaccagctggacagcagggcgatgaggtagaacacgaagatgagggtggggccagccacccaacccagccatccaggggagcgggggagggcgagcacgccggcacctgcagccacacggtgcatctggggctgggaatgcggtgagtgacatatgacaccactcccatatccattgcactgcactcaccgatgataccgcagaagatgtgtatggcggccgtgaagagggtgcctgtggcgaggggaggggacacaacctgtgctacacgagaagccgcagaagaaagctatcgacgttctgtcccccggacggcgccctgccggcaaagcacaccgtgttgaagcgagcaataacgagcacggcagcggaagttataccttttttaaatttcggcatgccttcggggtgggtatccaaccatgtaggcgacttgaacccatcgcagaccatggttatctcttgctctccacgactttatattcgatgctgtgtatgccacaggcccgaccaagggagttcgtgattgtttgcagtcgtgtgacatagcttccctgggagcagcggcttctcaaatcagacatatcttgcggtcttgagtctgccacctggagaatagaaaccgcgataccagacccaagggaggacatacgagtttccagtccacgatccgtgtctttcaccactacaaaagtcttcgacacctaaaaataaccgagtacgaggacagtctctatccgcctccattcccttgactggtcggcagtnnnnnnnnnntactttccagtccattatccgtgtctttcacccctgcagaaatcttcgacacctaaaagtaaccgagtacgaggacagtatctacccgcctccattcccttgactggtcggcagtctgggtgcctgtcgggccgaccgaccgccggggaaaaggcattccgacggacccctgtgcctcgaggacagaggagttggtgatcgcggaaaagctgcgnnnnnnnnnntgaccgaccgccggggaagaggcattccgaccgacccctgtgcctcgaggatagaggagttggtgatcgcggaaaagctgcggactgtgactggatattgattatgataccgtgttctcattgcgggttgtttttcttctctgcaacgtcctgcagggtgtgtggggttcgggatctcgccgtgggagatccagggatctcggggtagaacgatgcaatgtccgacgcagatccagccaccacccatcctcgttgcatccacagcagcctggtggcacgatcgctccccgtcgcgccgccacacgtatgcgcttcccaacgccgcaggctcgtgctccgtcatcttgacgttcttcaggcccgggttgcaccccaccacgcttaccccccctccttatcttcagccgcagccgcattgctgctttgtttgtgaagcactcagctcgtatgcccatgcgtctcaccgagaagatctatctaaaggggattcggtaaggctttttatttgggctcagcgtgctgtgtgtatgcaccacttcatgtaggtcggtcttgggaatgatgcgacgtggcaaacagaacatggcagagggaagagttgacgtccatcgaggaagaaattttgggtgtacttatcaaagagtgccgttgaagtttaacaaggcgtggaaatggtaannnnnnnnnnatgtatgcaccatttcatgcaggtcggtcttgggaatgatgcgatgtggcaaacagaacatggccgagagaaaagttgacgtccatcgaggaagaaattttggctgaactttccaaagagtgccattgaagtttaacaaggcgtggaaatggtaaagcgagatgcttcatcccttgggtttgggtcattttccagatgacaggtggcgtccttacgcatgagctaaaggatcttacagagtgccggcgccctcgaagattttgactgcacgaggtggaagtggaggagcccgtgaaacgctttggaagagggatgcagacttccgcatgctagagaggagcgatcgatgcatggaatcagcatggctgcacgccgaccatcgccccatgcattacagcgtgatgctgcttcagcaccaattctatgggtccccccgcacggcctcccggtgacaccctggctgtggaacacggtnnnnnnnnnntgaggtggatgtggaggagcccatgaaacgctttgagaagagggatgcagacttcagcatgctagagaggagccatcgatgcatggaatcagcatggctgcatgccgaccatcgccccacgcattgcagcatgacgctgcttcagcaccaattctatgggtccctgcacggccacccggtgacaccctggctgtggaacacggtcgctcatgcagcctcccttgctgcagcttcaagcgcccaaacacccctcccaccccccaagccactcacaggtagaccaggagacaatgatgttgcggaaggaggcgatggtagcagctacgcacaccagcgccatgccgaactcgatgacgtacagcatgtaattgaaccacccagtgggcttgtacacggtgcgcctgtcggtgggtggggtgaggagagaggtgtgtgggcgcagcagggggccaagaaacgtgaaaggcaggcatgtgatggatttccagggcatggcagcatccaatcaacatgcacagacctggaaagtgaggattgatcagcacagggtaagtcaactggtcatcctgtctcaacacgcgcgtgcacacaccatcccatgccatgaaccccccacactccctttgcctggcaacaatgggccagccccctcaccagcagcggaaggggaagaagacggtgnnnnnnnnnntccccctcccacaatccccttccctttaagatacaacaaagtgctcgatcccttttcccttcaagcaccagcagcggaaagggaagaagacggagagggggaagaaggacaccgcgcccaccagcccagccatggccccaaagaagggcatgatggcggcgatgagcgtggtcagcacgacgtagatgccgcgcgtgatcaggcgctgccaccagggcaggacaaagtggtcgtcgttgctgggcaccgaggtgtctgcgaagccggtgctgacgcggtacatggccgcgttctgggacaggcgctgcaacttctcgcccgccatggccgacacacgggacaggcggcggagggggttggcggcgggcggggcggcgggggctgtgtcgtccatggtcttggtcccagcagcagaaccctgtctggccgccagcgacatgcgcttaagctcctccaccttagcggggagctcggcgtcccccttggccttggcctggcggagcctggcgatgggtggggacgtggcagggggatggaataaggatctcctggtcaaaataagacagcttgcaaggtcttcacacagccctgcagccaggcactcacttgaaggccttgacgtgggactccagggtgtcaaacaggggttgggcatagatttggtaagcagaccacatgtgcagcaggacgcctgtgggtgtgggggggacggaggaagggggggttttggtccaagggcaaggagcggaagtggagggtggaggggtggcagcgtttctggagaatctgcagaagctattcttccgaacgactgacccacccgccctctcccctcnnnnnnnnnntgggtggcagcgttttcggaaaatctgcagaagctattcttctgaacgactgacccacccgccctctcccctcatcctgcagcatgcaacagcccacaggtatgcagactcacagaggttggccacgaagataacccattcgggaccctggaggccaccaagaatgtaggagggaacatctgtggggttgtgggcagagatggcagacactctgtgcaagggaggccctggggcttgcttgtgctgcatggnnnnnnnnnnagttgtgggcagaggtgacagacactctgtgcaaaagaggccctggggcttgcttgtgctgcatggtgaatggctgccacaaactgaaccctcaggaacccagccagacgttctggaaacctaccattgccaagactggcgtacccgccaatggctacgacaaagtagaatctgcagggaggaaggggagcgtcctcgcatcctcagagtcgcagagagttcactgcttgcataaacacacacatccagaccgaggctgcaccagcacggggcacgagatccttnnnnnnnnnnggtcgcaaaaagttcactgcttgcagaaaacacacaaactcaaaccgcggctgcaccagcacggggcacgagatccttgattgaagagaaaaatcgccatgctcaaaggtggcatgcccaggacagcaattttcactctccactccccctgactcacgcaaaagannnnnnnnnntcgccatgctctaaggtggcaagcccaggacagcgattttccctctccactccccctgactcacgcaaaagannnnnnnnnnnnnnnnnnnnnnnnnnnnnnnnnnnnnnnnnnnnnnnnnnnnnnnnnnnnnnnnnnnnnnnnaggctgcacaaagagtggatgggcagggcagggggctcagagagtcgctgtcttgggcatgactaatgcagcaccagagcccattgcacatccccgcgcttggggacacccagccatagatgcttgcctggcgcagggtgtcctgaatctccaccaggatactggaaaaggagtaggcaaagccgatggcgcccaggnnnnnnnnnnggcagtcaccgaaacgttggtggccttgctcatggtctttgctgccttgggcggctgcacaaagagagggtgggcagggcagggggctcagagggtcgctgtcttgggcatgactaatgcggcattagagcccattgcgcatccccgcgcttggggacnnnnnnnnnntggttggcagggatgccaccaacggtgccgaggcggttggaggctgccaggaggggagaggtgggggagaagtcgtaagatccccacatgcagatttcatatgatgcgctggcagagtcatcatgcacaaagtgacgacccaatcacaaccacaaccttcttcagacatccccctcaccagacttcaggcccagagcaagcgcgacggaggagtagaagagggaggtgatgacgccaatgaaggacacccaccaggcagactcgaggttggggacgagggaagatacgatctggacacccccaaagatgacagtcatgatccaggactacatgagtgtgaggtgattgggagaagtttgggcaggggagacagccccgacaaacaccagagacatatatgcgctgatatgcagctggtgttgaggagcttcaatacaatgcatgcagcaaccagtcaggcacagctgacgagatgccaacaaatgtggcgcatactcaccgtgttgaagcagtcgccagagtcannnnnnnnnncgacgagatgccagcacatgtggcgcatcctcaccgtgttgaagcagtcgccagagtcaatgccctgccagccacaggccgtgtttgccagtgtgaccatggccttggcagcggtgatggtgtaagcgatgtcgatcagcacgatgttgagcatctggaagacagacacgccgtaagcgtacctaatcccctgcacaatcatgaagcaaagatgcattgaagaatgggtggcagtcccatcggacaacgccagaatagacagagacaccatctcagtgcaggtcatgcaacgcatggacgctcatgtctagccacatgtggtgtttccctgaacatagagaagttccctggtttcccatgaaagcaccgacagctcaccatgatgtgcttgacgatgtcatggtaacgtccattctctacaccctcgacttcgtaacagtcggccaagagcctggtgacgaggagccaggagtgaagggaaggaggttggtcccaggtggtggtgcgtcgttgaaacccttgcccaccccgcggccccatcaatgacctacaccgctccggattcgacagcgggcctcgacacacgggccgagtccagcccacactccgaaacataactcaccagctggaaagtagagagacaaggtaaaagactatgatgaggatgggacctgcaacccaacccagccatccgagggagcgggggagtgcgagtacgccggcacctgcggcaaggcagcgcctctggatttataagagcgatgcgtaccagaatgcaatcctgcgtatcacatgcactgtgctctcaccgacgattccacagaagatgtggatggcggccgtgaaaagggtgcctgtggcgaggggagggggccaaaaactccattacgcgagaagccgaaggacgaagcgttcgacatcctgtaccgccgacagcaccgtcccggctcgaagcatggtatttgagcgaacaaaatggaacacgatagcgcatggtgtacctttcttgagattagggatgccttcgggatgggtatcgacccatgcgggtgtcttgaatctgtcgcagaccatgattgtgtcttgtcgtcaagaactgttgaatcaatattatatctcacacaagtgtgatgaagggggttccgaggatgtatgcagccatttgacctaccccacaagtgatatcttccgttgggcagcggctccagcggctccacagatcccctagggcagatcttcgggtcgccggcttgaaaaagaaaccacgatacgagacccaacggatagtaaggtaggcacatgtccgtgaatggtatcctttagcccctgcatcaacatgcaaatcattgcaaacgtatgaagtgctgccaatcgcctgtcgtttcgtgggtcgtgacagctcggcagcctgcgtgctcgtcgtcgggccgaggacnnnnnnnnnntagggcagatcttcgggtcgccggcttaaaaaagaaaccacgatacaagacccaacgggtaataaggtgggcacttgtccgtgaatgatatcctttagcccctgcaccaacatgcaaattattgcaaacgtatcaagtgctgccaatcgcctgtccttccgtgggttgtgacagctcggtagcctgcgtgctcgtcgtcgggccgaggaccgccccggaggaggcgcttccacggaccccggtttcttatcgaccgaggaggttatgttcgagaaaaagctgcaaaattgggagatcgatcggagcattcacgccgattcgatcgcctctgtaatttgtctctgttgtaagtcccccaccgaggaagatggcttgaaatgtccccccgattcttggagattttgagaccttnnnnnnnnnngatttgtctctgttttaagtcccccaccgaggaggatggcttgaaatgtcccccccgattcttggagattttgagaccttggggtgaggaggttcaaaacgggccagggacgtggtgctagatactctacacacagcccgacccccttcagccgtacatccgaccatacaagggtcacgaaatgcccgaataaatctgtggtcggcctcaggttacaggcgtgcactgtcgtgcagacccgcgacacaaaggtcgcccctgcacaatcgccaatcttccctgtattcatggccgcccaggggcatgatcctgccttctcgcaccctctcgatcatacgctgcccagcacgtccagcaccgnnnnnnnnnnattacatgcgtgcactgttgtgcagacctgcgacacaaaggtcgcccctgcacaatcgccgatcttccctgtatccatggccgcccaggggcatgaccctgccttctcacatcctcacaatcatacgctgcccagcacgtccagcaccgctgcctcgtattccgccttcttggcattcttcaggcccagactgtacaccgtggcgccctcccccgcgtccgtcagccactgctgcatcgccaccttggtcatcttcttgacctccaccgcgctgggcgtactgggcacggtgcgcgcgcccgcaaagcgtcccgcgcctcctgcagccggcggcggggaggggggaatgggcgaggcaaaggcatgtgcctgagcctgcgtggcggccacggcggctgcggccgagcgcgcgcgctcggcttgcagcgccgcctcggcgccggccgcctgcgcctccagctcctgggtttggaggttggggattgaaagggtggtggagctcgagccggggtggttgatgtgtcgtgaaggctcagaagctactttgccttgtgctgccacatacagggagtaggaactgtggggcagcctcaagagccagacctccccggcatcccggacgcccattgcccagcagatgccgcctcttcccatgcacggtgaggtagtgacagccctctttcctccaccctccgcactacaagcgcttctttcccacccaaaaatacacacgcaagagcacgcacctgcaccctgcgccggagatcggccgcctccgtcgccctggcctgcgccnnnnnnnnnnaggcatcacggacgcccattgcccaacagatgccgcctcttcccctgcacggtgaggtggtgacagccctctttcccccaccctccgtgatacaagcgcttccttcccgcccaaaaatacacacgcgcaagcaggcacctgcaccctgcgccggaggtcggccgcctccgtcgccctggcctgcgcctcggcccgggccgcgccgacggccgcctccgcctcgcggcgcatggcctccgcctcgccgcgcgcgcg

SEQ ID NO: 41684 - DNA, 61 bp, Chlorella protothecoides
gcgcctttgccgacctgtacggcgggctggtgcctgacacctggcatgtcgtcaacggcga

SEQ ID NO: 41685 - DNA, 63 bp, Chlorella protothecoides
ggcggtgagcttgacaggcagaaatcaccactgcggactgtcagcagaagccagagcggcagg

SEQ ID NO: 41686 - DNA, 215 bp, Chlorella protothecoides
ccgccgcggccgccgtcgcctcctccgcggcgcagcggccggccgcctcgcaccgcgcccgcgcctcgtcggcgtcgcgcagcgactgcagcgcgggccggggagttggggcaagcgtgttggggtgtggatgtggtgtggggcaggggggggctgggtgcaagcggaccccgggcaggatgacgaccccgagccttcgccgcggtcgccccccg

SEQ ID NO: 41687 - DNA, 12504 bp, Chlorella protothecoides
  modified_base (179)..(188): a, c, t, g, unknown or other
  modified_base (540)..(549): a, c, t, g, unknown or other
  modified_base (748)..(757): a, c, t, g, unknown or other
  modified_base (1221)..(1283): a, c, t, g, unknown or other
  modified_base (2015)..(2024): a, c, t, g, unknown or other
  modified_base (2243)..(2252): a, c, t, g, unknown or other
  modified_base (2442)..(2451): a, c, t, g, unknown or other
  modified_base (2673)..(2682): a, c, t, g, unknown or other
  modified_base (3054)..(3063): a, c, t, g, unknown or other
  modified_base (3332)..(3341): a, c, t, g, unknown or other
  modified_base (3911)..(3920): a, c, t, g, unknown or other
  modified_base (4716)..(4725): a, c, t, g, unknown or other
  modified_base (5541)..(5550): a, c, t, g, unknown or other
  modified_base (5741)..(5750): a, c, t, g, unknown or other
  modified_base (6603)..(6612): a, c, t, g, unknown or other
  modified_base (7348)..(7357): a, c, t, g, unknown or other
  modified_base (7504)..(7513): a, c, t, g, unknown or other
  modified_base (7845)..(7854): a, c, t, g, unknown or other
  modified_base (7908)..(7917): a, c, t, g, unknown or other
  modified_base (7990)..(7999): a, c, t, g, unknown or other
  modified_base (8130)..(8139): a, c, t, g, unknown or other
  modified_base (8535)..(8544): a, c, t, g, unknown or other
  modified_base (9150)..(9159): a, c, t, g, unknown or other
  modified_base (10015)..(10024): a, c, t, g, unknown or other
  modified_base (10262)..(10271): a, c, t, g, unknown or other
  modified_base (10379)..(10388): a, c, t, g, unknown or other
  modified_base (10928)..(10937): a, c, t, g, unknown or other
  modified_base (11785)..(11794): a, c, t, g, unknown or other
cccttcacccaagcgccccccgcccccatcacccaagcgccacccaccctcaccgccaaagcgccacccaccctcaccgccaaagcgtcctccgcccctatcagccaatcgtcacatgtctccactgccaaagcaccctcccccccgccgctctccgcccacatctaccaaacgcctcnnnnnnnnnngttgcagggtccaacccgcccccacaacaccaacgctctccgcccacatctaccaaacgcctccaacccacaacgcccaaataatcgtcatcaacatgggctttgttgctcgcttccatttgcactacatggtcgttgcacaggggaatctgaatccctgccagatctgtcccacccaagtgcattccaagggggatgccttcggcgaggtcactgtccgagtgcacccttgccccgcccctgcttgccaaacccttgttgtaatgccatgctcctcaaaagctggaatctcgtcccagcctggcagtgatgccctgacaaaacaacacgagggcatgcctgcacgctctcnnnnnnnnnnaccttgttgtaatgccatgctcctctcaagctggaatctcgtcccagcctggcagtgctgccctgacataacaacacgagggcatgcctgcacgctctcgttggcagggtgcaggcaggttgacgcacacttgtcgtcgcaacctctgcagccgtcagacgacactctctcgatctgcggcccggctgggcaaggaagnnnnnnnnnntaggttgacgcacacttgtcgtcgcaaccactgcagccgtcagacgccactcgctcgatctgcggcccggctgggcaaggaagagtcgccttgcaccaggctgcatgggcggccgagttacagtccggcccaggcactcccagcgctggagccatgccgagctcacgctgcgacgcctgcgtgcggcgggtgtggcgtctcccagccactctccagggtcaccagcccgccgagctcctgcaccaggccccgcagcctttggaacagctccatctcgcacagggtctgcaggtcgccgatgagcaccagcttgctgcgcgcccgcgtcagagcgacattcatgcgacgccagtcgcggaggagggtgcctgcagggaaggggtgtgcacgggctctggtctgccctctggcgcgaggaccctgggcgggcagcgaggggccgggaggccggcggcccccccccnnnnnnnnnnnnnnnnnnnnnnnnnnnnnnnnnnnnnnnnnnnnnnnnnnnnnnnnnnnnnnntgcgcacacgggccctgcatcggagcgcggcccggcaagcgcagtgcgcgcacgaggtactccctgccctccccgcaccggcgcgccctcacccgcttgccgtgcctcgttgctcctgacaaaggatatgaggatggcgggcttgtcccgtccctggcacctgtccaccgtcagcgcctccaccgccggcagcgcggcgaggcccagcgcgccctgcagcgccgccacctggcggcggtacggggagatgacgcccagggaggcctgcgccaggcccgccgccacgcccgcccgcgccagggccacgaccatgcgcacctctccctcgttgctcagcgcgtcccccgccgcactctcccgcaggcccgccgcggaggtgtccaggaacaccacgtgccggtcggggtcccaggcctggagggcgtgtgaggggtgagacgcgtggtggccacgacattcacgaccagcctgggttcaagctgaaggtccccctgctttcgatcggtgaggacggtcgcgagcccatcagcgccaggccacaggggcagcagggagggcaccatgcggcgaagagggcaggcgagggcggcaaccgcgcccaggccgcccatggccgggtgcctggtcaggtcccacgccgcccgctcgcgatgtgagtgtacgaggggcggcctgggaccccccacctgcgcaagcattccccccctgcctccccccccccccccggggggnnnnnnnnnnggtcgagggcggcaaccgcgcccaggcgtccatggccgggtgcctggtcaggttccgcgccgcccgctcgcgatgtgagtgcacgagggctggcctgggaccccccacctgcgcaaacattccccccctgcccccaccccccccggcggggccggcacgacgagacgacgcacctcccggatccagcgcggttggctggccaggctcgccctgcgctcnnnnnnnnnnggggccggcaccacgagacgacgcacctcccggatccagcacggttggctggccaggctcgccctgcgctccagccccaggctgctgcaggcggtgcgctggtcgccgcagcgcaggctgccaccgtatatgagggagttggagagggccatgatgggagcggccatgcggtactgggccgccaggcttnnnnnnnnnntaggctgccgccgtatattagggagttggagagggccatgataggggcggccatgcggtactgggccgccaggcttatcaccgcctgcgagtagggacaggggctcgtggcaaggtgtcgggggggaggggcgggggcgaggcacgcccactggagcaccggcaacccctgcaacagggtcatcgcacgcccagcaccccctccccttccgaagcacaaccnnnnnnnnnnaaggcacgtccactggagcaccggcaacccctggaacagggtgatcacacgccacagcaccccctccccttccgaagcacaaccccgcgtgcctgcgggtgggccgtggccaggcgctcgaagaggctgacgcccagccccgcctcctgcgccgccttgctggccaccaggggcggcagctggttgttgtcccccaccagggcaaagcgccgggccttgagcagcgggcctgcggcaggggtccggggctcaccggattctggctcggcatgcgagcgagtggcccggcagacccaggcacacccccgcggtgggcctgacccggggcaccccgaccctccctgaacccatccactcgcacccagggaggannnnnnnnnntccgcggcgggcctgacccgtggcacccccaccctcactgaacccatccactcgcacccagggaggaggggagggttagctggcctgcctcgtccaggatgcacaggtcgaagacgcggtggcggaggagcgggtgggccaccccaaggcaggtcacccccacctggggaacgggagacgtgttggggtgaaggggtccagggattgcgggggggggactgggggccgggcgggggtccgagagtgcgcgtgggtgcggggagcggcgnnnnnnnnnntgggtgggccactccaaggcaggtcacccccacctgggggacggggggcgtgttggggggaaggggtccaaggattgcgggggggggactgggggccgggccaggggtcgagagtgcgcgtgggtgcggggagcggcggccatacccctccacgccccagacattgtggtgtcacgccgcagcgccgcggactcaccactggaacctcggcggcgaggcggtgcaggcctgcgacgctggtgtccgggtagcgctccccgccggggaggaaagcgcggatgcccacgtgcaccccgctggccctgcccagcctcaggaggggggtgcccaggtcagccagcttcaggaggatgttgtccaccgcactgcggggggagggagggcagggggttcgggatgtgacagggctctgagaagaggcgcagcagctcgtacagtgttgcagggggctggggcgctcgggtgggcacggtcaagagcacgggagcgcgccacgggaagggcgggccgccagactcgcggtgcagctcccctcccatccgcgcctgggctgccgctccctgttgctgnnnnnnnnnngtggggcgctcgggtgggcacggtccagagcacggtagcgcgccacgggaagggcgggccgcaagactcgcggtgcagctctcctcccacccgcgcctgggctgccgctccctgttgctgccatgcgccgccatggacgcgcgcatgtgctgcaatcgggacgcatgcgcacccgcatgctgcagccgacgccctcctcccttcccgtccccgcacccaccccagtctcaggaccaccaaacaatccacccgccttccgtccccactcatggtcacagacctgttggtataggacgacaccagcacgctgtgccctccggccaccatcgctcggaccatgcccacgatggcgctggtcttgccagaccccggcacacccaggaccagcgtgcactccgccccggcgcgcacactggccaccgccgcccgctgctcggcattcaggcccgcgctcgccgcgtccgcggcgagcgcctcgtccgtgccctttgccggagcgccgggtgccgacccgacccgcggcggggccaggtcgaccaccaggcgtcgcaggcgcgccgcagggtcctctgctgccggcgaggcagcgccggtggaggtcctgggggcgggcgcccgcatcatgtcgaacaggtagcctcgctgccgcacaaaggagaaggagacgtcatcgcggtccagcctccagctgcggagcgacagaggagggggcgcgcgggtatgctgatgaggcaggcggcaagcgcacgcacgccggcgatatgacgcccatgcatgggctccggtgcagccgccnnnnnnnnnnggcgcacgcatgccggtgatgtgccgcccatgcatgggctccggtgcagccgccacgaccgccgtcacggatcgagtccccccattggcccccgctcccactggcataccagcttgaacccccccctcccccccgctcactcagcgcacctggccccaggccccgaccccgatccgtggaccacgcccggggccgcctgccccgaggtcagcagtccaggccgcagcagcttgtcgcaggccaccgtgatgctggaaggcgagacgctcaccacgtgcacgcgagcgactgcagggtgggcgcctggggtggtcgggggggcggaagggggtgaggtgggccgggcgctcagcgacgtgacaaagatgcgagcagcttcagagctggctgggaagtcggcgaggcccacacggtctcataccagccatgtgctacagggcagagcgtcagacctttcccccgacacgctccagagcacactgccacctcccagagcatgagccccgccagcactcgccttccaggctgaggagcaggagctctccaggggagaaggaggttcccagcagggacgggcgtccgaagcgatactccttggcgtcggcatcgatgccctgcagctgcagcccgcccacacatcgtcccagggactcgcgctcctggcctggcggggcgtatgcatgttggggggcagctgcttgaggaggaggccatgtgcattggacacgggccgggctgcacttcaatccctgggaggggatcgctcaggctcggccccgaacacgcacctgtcatgttccacacctccggcctgcnnnnnnnnnnattggggggggcagctgcttggggaggaagccatgtgtattggacatgggccgggctgcacttcaatccctgggaggagatcgctcaggctcgaccccgcacacacacctgtcatgttccacacctccggcctgcgagagacagaccccgactcctccaggtgcagcagcctgtcccagtgcttcaggaannnnnnnnnngactgtggaggcagtccctgccaccgctgaatcgtgtcgagggagatggggtgacacctgcctcccatgtgcccccgcacctgctggatcgaggtgccctgcagctccctggaatgcggcagccaggctgccgtctgggtcggacccttccacctcgccgcccgtgaaggagagggcgtcccctccatccagcgtctggtggcataggggagcgaagagtgggcatctcaaggcgtgaaggggggaggggggaagagcgcatagcgtcacatccttcgaaatccaagtcccctctgctgcgcactttgtgcgcgacggcgcaggtgtcgcgctggaagcaccaccggcagacccttttgtcggcggccaggggaggcagggcgccgggcgtcaccaggtggaaggcgagcctgcaagggagggggagcaggagggaatgttgcgaggcagcagggtctggcatgtccccaaaccgctcctccgcatcgggtcggggcgctcgcacctgttgcgcaccgccagcagggccgccagctcggcatgctgccttcggatgagggtggggtctgcctggccggtcagccagagcacgccccagtccatgcgctgcccgtacctctcctccagcagcaggaggtagagcagcacctggtgagggagtgtggtgaggaaggggcttggggttggcagtgtcgttgtgtgggaaggcgggcggggggtcagggacggccagtcatgtgcaaacacctctgcctcgccaggctcacgcccagagctgctccacgggcctcacagtcccaggctgagccccagcgcatgccgagagccagggtttacctgcgctcggtggctnnnnnnnnnnccacagtcccaggctcagccccagcacatgccaagagccagggtttacctgcgctcggtggctgccgtgcggtttcccggtcttgatctccagaggggcgaccacgcgctcctcctttccgcccgacggcccggcgttcgtctgggcgcaaggagtatgagtccgtcggtcctgcgctgtcggtccgcatcccagacccaggcactctgcaccgctcggggattgtccacaccgacgcactccctcccatgcaaactcgcatgcctctggactcgagcctcaggccgtcctcccacctgggtgaccatggccccgggctgccccggggtcatcagggtgagctggaccgtggcgtcgatcatgcccttgatcccatactttggcgcccacaccgcctcctcgatgtccaccactccctgtggtgggtcggggaggaagaaggggaaggttgtaggggtggagggttggaagcgggagcacttgctggaatttgcatttccccccacgcaagcgagtgagggagcacctggcaggcactcctggcaccacactccgattcactcacagatacggacatcgctcgccggcactccagctggctggtcgagtcgtaccctgcagagagcagggacccaggcgcgggagcgtcccggaggtagcgcgtcatccacctgcgcggagagcggatgagtgtgcagtggtgaaggagggcggtggggcctgtatggcttcgtgnnnnnnnnnngggggaaacttgtaggggtggggggttggaagcgggagcatttgctggaatttgcatttccccccacgcaagggagtgagtaagcacctggcaggcactcctgacaccacactccaattcactcacagatacggacatcgctcgccnnnnnnnnnntgcgtcccggaggtagcgcgtcatccacctgtgcagagagcggatgagtatgcagtggtgagggagggcggtggggcctgtatggcttcgtggctgcgcagcatgccagccaaacgagtgtcacttccatggccaagtaggccacagtgctcccagtcgaccgggcaagattgtcagatcgaagcacgcgcctgaggacgggggggatggcggctgtgaggtactccagcgcctcctcggctgtcatcccggcgtccagcagcgactccgtgttctcgccaacgatcttggatgccaggcgccgcagctccgccgaggttcggagcccgtcnnnnnnnnnncccgggcaagattgttagattggagcacgcgcctgaggacgggggggatggcgnnnnnnnnnncgtgaaggcaccctgagcggcgaggagagcttgtgattggtcgatgggggcggcgtcagcgcagggcgatccnnnnnnnnnntcaggagggtgccggggggacgcgggcgtgcgggggcgtcatcaggagtccgcctcctgctcagcatctggccagcacacgccgtccccgcaaagacaggtgcaccaccccccaacgcgtcaccccggccnnnnnnnnnnggtgaaggcaccctgagcgaggaggagagctcgtgattggttgatgggggcggcgtcagcgcagggcgatccacgccagggggatgcgggcgtgcgggggcgtcatcaggagtccgcctcctgctcagcatctggccagggcacgccgtcccgcaaagacagatgcaccaccccccaacgcgtcaccccggccgcgtgcctggatgaggaggtgctgcagcgtccccttgacggccttatcgttggtcccagtcccgcccacccactcctccagcaccgagcgccgcgcgcagtcgtggctcgtggtgatgcgcgtgcctgcggcgggggacggggtcccagggagctttcccttgtggactgcgccgccacacggagtgcgccggccgtagcgcnnnnnnnnnnagtcccggggagctttcccttgcggactgcaccgccacacggagtgcgccggccgcagcgcgaggggcgcaaccgcgcgtgctcactgcctcgcgctgcgcccgccttcccctcccgcccctcctccctccacacccaccctccccctctcgcagcagcacctgacaggaggacgtcggggtgcaggaccaggaagccggcgttgcagtccagcagggcgtgcagctggccctcgaactcgtccagtcgcgcgaccataaggttgcaggcgtcgcccacgcggtacacggcctcgctccagggcgggcgcaggtgggcccataccttttgctcctgggcagcagtgacgggcgagggggcttgggtgaggggggtccagggggagacgctgggagggggagcagacatcgcggatggcgggaggcgcaccagccgcagcagggggcgtgcagcctgcagcggtgtgactgggccacccacgcttcatgcatgcatgcactttgcaactcaaggggaacccgtcgccctgaccgcctggtgtcgagtgtccgagtgcagccatgccttgacatccagccactccaacgacccctgtctcctgccttnnnnnnnnnnggcctggtgcccgagtgtccgagtgcagccacgcctcgacatcccgccactccaacgacccctgtctcctgccttgtggtcgccgtacgcccccagccctcttccctgaaaccccggcccctgctcgcaccttgtccacggcggccaggagcagcacgcgctcgtccaggtcgccgtggacctccagcacagtgtaccgcatgtcccgccatgcggcgcctacatgcgctgcgggccgctcgcgcggcgcgggtccttgacgcggcacaggatgggagaggatgaggtgttcgtcgccgatgcatgctggcgggagggcaggcacgacgggcgccggtgaggtgctcttccggggtctctggcgggagcccggctgcctgcgccagtcggagtcaaaggtacacgcaacccccttctcccacgcacctgcacctgcagcagcgctgggcccccccgaggtggatgccgcgccctggacgctgcgccgcgcgcgctcctccagggccgccagggcctgcagctgctcggcgtcgtcctccccctccccccagtccacatcctgcgcaggggccggcacaggcacgccgctcgccgcggcgtgctgcggcgaggctgcggcgctgccttccgcgggccttgcaggggcgctgggatttccgcgctccacctgggtgaggagctgcagaatgaggggggggggggggggggggggggggggggttaggcaaggtgcaacaggacacttgaagttactgcataggagatagtccctcctgcacatttgactttgccagaggatcagaaacatggttggcaattgcgggtgcaagcattggcactctgccggtcatggctnnnnnnnnnnagttggcaatgtgcaacaggacacttgaagttattgcataggagatggtccctcctgcacatttcactttggcagaggatcagaaacatggttggcagttgcgggcgcaagcattggcactctgccggtcatggctgcttggcagagacaccaactatgtcgcactgcatcctctcccccgcacctcgagctcaagtgcagcggctccatcatcgccgccgcaggcctcctcctcgtnnnnnnnnnnatggcacaggctgcgccgttgcccgcccagccgcctcgtcctccaccggtcccacgacctcagcaggcagcgccccggggtgcggcgcatcaaccgtgagctcgctcnnnnnnnnnnagcagagacactatgtcgcactgcatcctctcacccgcacctcgagctcaagcgcagcggcttcatcatcgccgccgcaggcctcctcctcgtccacaagccgggcaggtggggaggcatggcaagtgatgcccaatcccagctggtcattattctgctcacagaaggctcccccagtctcggactgtgaatctagcctcgcattaattggcacaggctgcgccgctgcccgcccagccgcttcgtcctccgccggtcccacgtcctcagcaggcaacgccccagggtgcggcgcatcaaccgtgagctcgctctcaacctgctccagcagctccagcagaactcgcctcttcgccggatcgcgctgggcgctgcgatcccagcccttgcgctgcaagcgcgtgtgagtgtgcgattagggaagtcgaaaggtgccccagaagctgtcaacagacggtgccccgacaagctccctttgcgaccccggctccagcccggcatgcacgacagtgcagctgccagcacgctcgcacctgctgnnnnnnnnnnactgcgatcccagctcttgcactgcaagcgcgtgtgagtgtgcgttcagggaagtcgaaaggtgccccagaagctattaacagactgtgccccgacaagctccctttgcaaccccggctccagcccggcatgcacgatggtgcagctgccagcacgctcgcacctgctgcgtggatggcgtgtcgccagagcggcgctgtggcgtgctggcttggccccgctttcccagcaagctccgaagctgggctgcaggggtgcggctgccctggcccagggacaccttgcggcggggggtcgtctcttctgctggcccagcctgagagctgagggcatggggtaagggggaacttggggttgaatgcaatcggccgctgacagagcagggttgacgatgacattcgcaccctgacattgtgtatggtggccatgttcctcccttcaccctacaacacatgcccagccagcctggagagcattacctcttgcgactggggtccagagcctgagttggcctgccagacgcctggatgagccgtcgcttgatgctgctgtggctcatggccagattggggctcctgttctcagacggcgtgccctcttcggcctgtgcagcgctgttgccggcaggagaggcatgccagatgacctggggaagatctgcctcctgactcgctccccctgtggcggtccgtgactgggacaccagggttgcggaaggttgtgagaatatgcgggtggatgcagagcctcccttcaaaaataccacagcacgttcaagaccatgcaggatcatgcactcaccacagggacatggggtttaggcgtgatcgtggatgctggagggaggnnnnnnnnnnagcggaaggttgtgagaatatgagggtgtatgcagagcctcccttcaaaagcaccacagcacgttcaacaccatgcagggtcatgcactcaccacagggacatggggcttaggcgtgatcgtggatgctggagggaggtgtggctggttggcaggaggagggaccgctgacacaggggctggctctgctgcaggcataacgtcctttggtcccgtgatctgcgccatatgagcaatttatagtatctctgagcacaaagtgttgtgcgtctgcagatggttgcggccagaacccacactgcacctgattatcgacgtcagtgcctatggacgacttgccgccaaagaatcgggcgatgtcgggggcaccccgagcggcccgactagcatcgcgctgctgcataaacagtgatttctgtgtcgaggcgtaagcgaaggtgtagtcgcaagagcagtgggagcaaaccccgatgcccgcccccgccacacccacctggcccatagctgccgacacccggatgggcccctcacgctgctgttacaccagcccatatatcgtcagatgttacctccatacaatatacggtggtgagtgatggtgcgtcgaatgtcctcatctacgcttgtgtccttcttcaaatcggcaccaccatcacctctgtcattcgcgcagttgcaacgtatgcggcgcacgagttgaagatatgtcgc

SEQ ID NO: 41688 - DNA, 5526 bp, Chlorella protothecoides
  modified_base (678)..(687): a, c, t, g, unknown or other
  modified_base (1548)..(1557): a, c, t, g, unknown or other
  modified_base (2108)..(2117): a, c, t, g, unknown or other
  modified_base (2587)..(2596): a, c, t, g, unknown or other
  modified_base (3254)..(3263): a, c, t, g, unknown or other
  modified_base (3829)..(3838): a, c, t, g, unknown or other
  modified_base (4777)..(4786): a, c, t, g, unknown or other
  modified_base (5216)..(5317): a, c, t, g, unknown or other
cggggacgcgcgcgcatcgcgcggaggcgcgtacgcgccggcgtcgcgctgtcacacgccgccgccggacgaccaggcagggccggcgcttccgggggaggagacgccacgcggcgctgggccgcaggaagtcagcctgcagctgacgccgctggccatgccctccccgggcgtgctgcacatggccagtccggggtcgccccggggcgggcccgccaccctcaccggcgcctggcccccacgggccgccgccgccgccgccgccgggcccccacccggcggatggtgggggcaccccctctgggccctccagcccgaggaggggtacgggcgggggccgcagcgccagctggatcagcccctggccagcccctggctgcgcggcgtgcccaaggccgaggccggagacgagacggcctcgccccaggcgcccccgctcgagagtctggacctggagcccctggcgccccaggcggtgctggaggcgccctggtactacgcgcgggggctggaggagcgggcgtttggccaccctcctcccggcagctgagcaaagggactggagggagggaagacagaccctcccctttccaaagagccgcatcgccggccctgcgcagcactgagcggcgtggcagaggcagccgcccacgcaccctaccgcaagccaacccttcnnnnnnnnnngaaaacagaccctcccctttctaaagagccgcatcgccggccctgcgcactactgagcggcgtggcagaggcagccacccacgcaccctaccgcaagccaacccctcacaacaccactgccttgctctcttcccctggcaccacccgttcctctatttaccgagagaaagggcccggcagcctcagcttgatacttatctcagccattcaagcttcccggcccatgtttctacggccccggacgttgttcaccacacttgtcgccatccccagccagcacggcacgccgccgcaagccccccgccccaaggcgaggggtggctgagccctcgcggcggcggcgccatgcctggctgggccaaccccgccccgcatgtccctacccatcatcagcgagatcgcccctctttcttccctgtctcatcgctctgggccccaaccccctgtcctatgctgattcgagctggcctttaacgtcactgatttcatatttcggccgctcaagtttccagcgcccttcattttgatcaggccataccgtcacgactgcatgcccttgaggtgaaggtgagggcacgggtcaggcggcgggcaccacggtgctctgcagcgacaggaaggccagcaggtctcccaccaggcgcgggggccatcgccgcttggtcaccagccagtcgcgctccctgtatgggatgtcagagaagggggtgtggggttggatgcagcacgcggcacgagaatgcttcacaatacgtcagacagtgcagggcgccgacactcctggcagcacaaacgcagtcgctgtctttctctgcctggggttaatgcacactcccttccatcacgtgctggcttgctgcnnnnnnnnnngcctctgcctgggggtgatgcatactcccttccatcacgtgctggcttgctgcaggagctgcgacacgtgtcaaacacacgaaatgtgcccgctcacagaaatcaggcagcactagccgccaatccaagctgtgatacctccaagtccaccccggcacacacgccctcgctgtggtcctgcttccaaatccccccccctcccccaggtccctcacctgtaccgggggtcgtctacccgcagccactggtcctccgcctccgcctcctgtccggcacgccagagcgccgccgtcagcgccgcacgcacatccacaaaggacgggtagcggcgcagcagggaccgcatctcgtgcaggctcagctcgtcctgttccagctgatacagggccagcgccttgttggccgcggcaaaggagaaggcaggcgccagctgcaccgcgccgtcgtagtaggccagcgcctcggcataccgccccgcgcctgcgtcaatcgggggatacgtgtggtcgtcagggtgctactaaagggggggggggggggggggggccccnnnnnnnnnnacgtcaatcgggggataggtgcggtcgtcagggtgctgctacagggggggggagtatgatgtcctcgtcctggggtgtccccctcgggtcaacccccctcccccactctgctcatccacccagccacatacctgcgtgcgcattgcccatgttgttccaggcggcggggtcgcgcggcgccacggccagcacctcggtgaagtcggcgatggcgtcgtcccagcgccccagcgcctccagaaccacgccgcggttcagcacggggtctacggcccaagggcacttgtccgccgcggcgtccaggtcggccagcgcgccctccatgtcgccctggcgcgcgcgggcgttgccgcggttgcccagcgcccggccggccacctctgcggcccagggctcgttggacagcgagtagcggtccaccacctcactccaggcagcaatctcctgctccagggtgggggcgttcaggnnnnnnnnnncgcggcccagggctcattagacagcgagtagcggtccaccacctcgctccaggcagcgatctcctgctccagggtgggggcgttcaggcccttctgcaccatgtttgtggcctcctgcaggccctgccgagcggagggtgggtagctgctggggtcgggcgtcagctcggggcggatggcccggctccgcggctctggcgctgcccaggccccggggggaaccagggccgcactgccggccgcgagcgccgcaccgatcagcaccgctcggcgcccgcatgcctcgacctgcagctcagggccggcatgggggcccgcggcagccgcgcatgcgccgcgcggtcgcacgggggggccggcatgcccgggcgcccgaggcccggccccgaccaccgacccaggcccgcagggcgccgcggcacgggacgcagcggcgggcatcatggctgcatgtgggtcgatgaggcgatgagggtgctttcggcgacctccgccccgggcatggacgacatgcaccgggccctcccatcatgcatgtgtgcgtgtgtggctctctgccctgcagctgcctggctggtccctctggctgccctgggtgtacggtttccggggagtgggagtcacgggggcacctacaagcacatggcacgggggaaannnnnnnnnnaggctggtccctctggctgccctgggtgtccggtttccggggagtgggagtcacgaaggcacctacaagcacatggcacgggggaaagggaagttgcaggataggctcaacaatcagagctcgtccttgacctccgccgccgcgtcgacgtcgtcagatgccggcgccgcgtcgacgtcggcagccggcgccgcggcggcgtcactcgccgccgcctcgccatcctttgccgcctcgccgacccccgacgcctcgccatcctttgcctcggcatcccccgctgccttctccttcactccctcggccgcgacctcgtcctgcgtgccgacggggatggtgatggggccattcaggtcgtccaccccaagcttcaccgtggaggtgaaggtgtgcgtcttgggctcgccgtcgtcgtcctcctcctcctccttgtctgccttgggctcgtccagctggaaagcatgaaagggggcgatgaggctcgcgcgacggggcgcaccgtcccacgggcgggcggctcgtggtgcgcactcacccctgacagatctggggggaacccccccccnnnnnnnnnnatccgacgggcgggcggcacgcggtgcgcactcacccctgccagatctgggggaccccccctctcctcccctcccagcacccctcctcttcatcaccttggacttgggcggcgtcggctccaccaggtcctccagacccaggctggcgcccaggaggtgcaggacacgggagttgaaccccgtcacgtcctccaccaggtaccctgcgcgcgtggtccacagagaggcaaaggtggggcgcgtgcctgaggaggcccgccacatcagcgtaggcgaggctgccaggcgccatgcacgcatcctccccatcgcagttgccctcccaccccctgccctgcactccccctgccctgcactccccgtaccctgtggaccctgtccacccaagcccaagcccagacccagacccagacccagacccaaacccagacccacccgactccatgaggcaggtctcgtacagcaccatggcgcggttcttggtctcggcggcgtcgggcgcggccgccacgcgcgccttcagctcacgcaccagcgggtgggtggggttgatctccagcgtgcgcagcccgcgctgccacttggcttgcgacgggtcggcgcccagggcctgcgtcgggcgcagggggaggggggtttcggtgccagggtgcggggttgccagggcgattcggggccgccgggtcgccgcctggcgcgccgctcggcacccacaaccgccgcgatccccggtcgaacacccacctgggtcatggacaggcgctccatctgggcagaccagccgaactgaacgtgggagtgggccgagagggccggggggtgagtgtgaggatgagcggtgaggtctcacgggagcaggatgccgctcatgcgtcgcagcatgcagcaccgtgcgcctcacgcctgcaccgcgctcccgtgccctgctccatgcgtgannnnnnnnnnccccaccaccgccgcgatccccggccgaagacccacctgggtcatggacaggcgctccatctgggcagaccatccgaactgaacgtgggagtgggccgagtgggacggggggtgagtgcgagggtgagcgatgaggtctcgcgggagcaggatgccgctcacgcggcgcagcatgcagcaccgtgcgcctgcgccgcgctcccgtgccctgctccatgcgtggggctctcggagccaccccggccccttgcccccccagaccccgggtccccatccccaccttgttggccatgacgacgcaggggcgggaggtgaggcgctgagatatgcgcaccctctccacgggctggcccagcaccagcagcttcttccaccaccgggtcaggggcttgaactcctcctgcggcggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggccctcgttccaggccgtgcgatcaagcgctctgcacacgcgcggggcgggccacagacatcccggacaccccctccaggtcgagcgcaggttgctcgcaaccaggcttgcagcacccattcctcgttcctatcgataccccaacccacacttcccttacccaacccccctcgaacaaactcaccccccctgggaacaaactcccc

SEQ ID NO: 41689 - DNA, 78 bp, Chlorella protothecoides
tgagttgcgactgtggctaggatcctttgtgaaacccagcccccccctcccaacacaggcatcggccccgagatcgcg

SEQ ID NO: 41690 - DNA, 66 bp, Chlorella protothecoides
gaagaaaaccccgccgcctccagcaaggaggcatccaccgccccctaagaagaagtctccgccgcc

SEQ ID NO: 41691 - DNA, 61 bp, Chlorella protothecoides
gtgggcgcgggcgtcgcggcaggcgccggggttgtgttggccggcatgttggtgctggccg

SEQ ID NO: 41692 - DNA, 6634 bp, Chlorella protothecoides
  modified_base (318)..(327): a, c, t, g, unknown or other
  modified_base (443)..(611): a, c, t, g, unknown or other
  modified_base (1052)..(1061): a, c, t, g, unknown or other
  modified_base (1592)..(1601): a, c, t, g, unknown or other
  modified_base (3116)..(3125): a, c, t, g, unknown or other
  modified_base (3237)..(3246): a, c, t, g, unknown or other
  modified_base (3480)..(3489): a, c, t, g, unknown or other
  modified_base (3920)..(3966): a, c, t, g, unknown or other
  modified_base (4087)..(4096): a, c, t, g, unknown or other
  modified_base (5400)..(5409): a, c, t, g, unknown or other
  modified_base (5619)..(5628): a, c, t, g, unknown or other
  modified_base (6432)..(6497): a, c, t, g, unknown or other
ccccgtgcgcctcgcaccgggcgactacgccgcggtgcgcgtcgtggccgccacgggcggcgcgctgcgggccgtggcgctggcgcgcacgacgctgaccgagttcgtcgctgtgcacgggtccgcgctgcccctggcgcgcgcggagctgacccccgccgagctggcggcggcggcggagctgctggcggcggggcggggcgaagaggagccgggggccctgcaggccagcgcggggtagggggagggattagcccttgaggccctggataccagcggcctgtgaaagtccccgcggcctgtgagaggtcccagacnnnnnnnnnncgaagaggagtcggggaccctgcaggccagcgcggggtaggggaggtagtagccctgaaagccctggatcccagcggcctgtgagagtccccgcggcctgtgagaggtcccagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccggagcgctcaagctattcgacgcaggccacgaaggggaatggcagcggggtgaaccgtcaaacaagcatccttcaaagcctggggcagccaacatgtcaggcgcgccgcatcatcctgtgcgtcagccggttcagcctcacgtccgccagcgccttctccatggcctcctcggccgacctgcttgcggtggcgaccaccagggagcggatggcgaccgccctctcgcggtccgacaggggatgggagcccgcagcctgtgggggtgggtatgtgtggagggttgatggactgctgggaggcttgacgggacacggcccttaatgcaggcggcgctggcactgcgtttgagctgcagaatctgcatcgccaccagcactccgatgcaccgacgctggaggccctgctctccttcccagtaagcccagggcatctgaannnnnnnnnnacgtgtaagctgcagaatctgaattgcaaccagcactctgatgcaccgacgctggaggccctgccctccttcccagtaagcccagggcatctgaatctgacaagcaacctcccttgctacccaactcgccctgagcctggcgtccagactctccagcagcacccgccactccgggtccaggtcgtgcatgctgtacgagtccagctgcacggcgctcagcatctcctgcgcgattgtgggacggctgggatgtgaggcagccggcgggagtctccaacgcccggccgacaggtactacgggaaggggcggaagcgaccgttgtcgacacaggaatgcatcatttctctgctgccaaccaggcccccgaccctcctcccggcttgcctgcttatggtgctgcttggccacctccacatcctccgctccctgcccaaccgcggccggggcggggccatagggctgggcaccgagctctgcccccccgccgccgcgcccgtggacggcctctgcgtaatccacgctgggctgcnnnnnnnnnntccgcggccggggcggggccatagggccggccaccgagctctgcccccccgctgccgcgcccgtgcacggcctctgcgtaatccacgctgggctgctgcgccctctcgccgcccgggccgcccccatgttccaccatggtgacgcggcgtgcatgcggcaggcatggctccccgtcggacacacccatgggattgaacacagccgaggcgatgagctcatcctcaggtgcggccgccgctgttgcgggggctggggggctggcggccgcctgtttctggccactcagcgggccctcaatggacgcggcgactgctgggttggtcatcacattgtaggagggtacaccctggaaggggctggtggtggggcagggcttgtcttgcgctggtgattgaccctggggcgacgggctgctgcccgcccaggaggtcaggccctgccagccgcgcttcagcgggccggcggcgggggaggtgtgggtggcaccgccccccggttgtgtggaggagcaggccgcttggggaggtggggagagcacggtgcggaaggagggttttggaccatcgcggatggtcggcgtcttggctgcccggaccatggcatccacgtccgggagggaagcgagattctggggctgccaggctgactgcaaggttttggggatggaggaaaagggtttcaggggcaaccaaatcctgacggtcttcactcaggatccatcgctgtccacagtgctcctcctgccacagcaaccctcttctggactcacagaacgctcagccgcgagtcgtgccttgcgccttccccaccatagcatggagagggaggtggacaccgccccaaagatgcaccccacgagaagtaatatgaagatcgaggctcccacattcgcggagcccagcagggtgtcgctcccactacagtgataatcgtcctgcatgtatcaggattggagctgtgttgtggatatgtaaacgtcgggggcgcctttcccagcttccatgaggatggcgatacctggaggaggcgccggacgaccatgctgggccagcgggttggagcagatcggagtcctgatcgcacgacggaagacctgtgaattttgaatgctgttctcacgagtaacgaggaaaagccatgcgctgcgcagtgcctggagactcgtgtctgtccctcgtaaatttgtaagtcatgctgcgcgcccatcactcgccgctccctggaagcttcatggatgcccttcattgacacaacccccctcgagagtaagagaccgaggctggtggagccagcattatcttcgaaataaaattccaatacccaaggttacaatccctgtctgctccttgggactgtactctacatgcctgattggaaagccattgcgcactcacacccaccccactgaatcctgccaagtctatgctgcttcaccctcaagctccttggatgacaggaatggctccctgtctcgttattcggtcatctttgttactagctccagcttgcactcnnnnnnnnnntgctgaatcctgccaagtttatgctgcttcgccctcaagctccttgaatgacaggattggctccctgtctcgttattcgggcatctttgttactagctccagcttgcactcnnnnnnnnnnttctgcttcgaatagcctgagcgctccggcacggttcttgtactttcttgcgctcgcagagaggggtacactgttgttacatggtggtggggggtgttacagtcgcacagcacatgcaaaggcacgatcaggaggctcagctgctgtccctgccgtgttgagtcagaggaggctgcgccaggccgccgtcgaggggcacatgcgtctgggacctctcacaggccgcggggactnnnnnnnnnncagttccagcaacctggacttggattatggcttgttagggggcttacggcctaggcaagggccgcaggaggccagccttacgtcccttgttgggcttgctgcgctgacaggcatttaagtgcagacgaaatcgtggacgtcatgctccatgccatgccaggctggggtacctcccacaagccaccagggggccctttccggttgccacagggctcctgtgctgcagattttggtgatatggcaatgctctggctcactttttccaagacttcgctgctttatgtcgcacatgaacccattcgttccaaaggtggttcactaaaacttaagactggaagtggaccatccgtgtcacttccggcaccacgtcaaggcgctcggttgactcctgtgagtttccctgcaaggcgggcaaggtcagggcccaagannnnnnnnnnnnnnnnnnnnnnnnnnnnnnnnnnnnnnnnnnnnnnngggtgcgctgactgggcccttcctcctttccacctgtgaccctgcactgcgttgtgcccgtggcatccgacactgattgcgaaactcaactcccacactgcattttgggggcttggcttgnnnnnnnnnntggtatgctgactgggcccttccccctttccacctgtgaccctgcactgcgttgtgcccatgccatctgacactgattgcgaaactcaattcccacactgcattttgggggcttggcttgtaaggggcctgacagcccggtgatgggtaacccatggcgcacacacgaatgaggaatgacataccagattcctgtcaccccgttctacaaggacctcacgctggtaggaaggagcactcttattgtgcagctggcagggcactacttcattctctagccctgtataccagatacgctagctccttcctccacgtgtgggtcattgttacacgtgcaaggatgcctgcacgacgcaaaacttggactgcaagcaggcgacatgcatgtgatccccgtccagggacgctatgctgcaggttgtgcggcattgtcttacgaggggttgctagtctccaagggcttggtcgtcacatgtgtccacccaccaccctcctcgtctgacgaaaaactgaacaagggtggagggtgtcctcgactcaagatcagcctctgcagatgtctaaggggcattaagccgatgggacaaccgggagcagctgcccgcccagatccagcccccctgcctcccctgccagtacctgtagtcgacctctggcatcccgggttcagcctgcacggcttctcttggcgccctggtggcggtgaaccaccctcgctttgtcgcccgggggtctggctgcccgccagacccctcctggctccccaggtcgggccgcctcttgttcgtcccgctgcgtccgaagagacgggggaggagcctcccgctcccacgcagctcccgtcctttttttgacccggggatgacctggccatcctgcagggactcggcgcagggcgtgaggagcgtgggaaaccggggtgcaggggcacgatcccgtgcaccaagcgcatgcagcgccttcctgcgccgagcccctcaccgcgtcaccgccgggggcgggctcctcgcgccccgccggaccggcggcctccaaggacatgacggcgccagtggccagagccacgtcgtccgccgccccagcctcctgcgtcggcgggtcccactcgtgcagctggcgccgccacttcttgatctggccgtcaaaggccctcttgctgcaggccttgtgcacgtcgggggtgctggggtccttgttacgccggcgctgagacctgtgtgggccggggcggggggcgtcatgcgagtggcaagatatggatcgcagctcactcatgcgctgtggatcgcaggtctcaactcaggnnnnnnnnnntcgggggcggggtgcgtcatgcgactggcaagacatggatcgcagctcactcgtgcgctgtggatcgcaggtctcaactcaggtgcattgcgccaatgacgcctgtagaagccaccaatcctgggtcatgtgcatcgtgcagcatcccagccgactcgcggacgatgagcgcgaagaagtggcccctgctctccggtcagccccagtgcnnnnnnnnnnatgcagcatcccagccaactcgcggacgacgagcgcgaagaattggcccctgctctccggtcagccccagtgcacgccaaactcctgacctgtacgctgggcttacctggggatcgcctccctgtaccgctggtagccaagggtgttcttcccaaagtccacctgcttctgccgctgggccaggcggtgagggtctgtctcgtgctcaagcacagctggtcgctcaggagctgcggggccggagggggaagggtcaggacgaccgccgatgaatgtggtgggagacagcatgtcaagccatcatcggtgatgccccgttgcggatcccatcgtctcccggtcagccccactgacctacgacatcttccacgagaaagtcatctgtggtgtctctgccctggcccgaggcagtcatggtgatctattcgacagtatcaggtgacaacgacaaggttctcccggcgtgaggtctggtgatgatcagacggtgccgggttcccccctctcttcgtgccctggtcgctgctgtctcactcgctcgcgactctctccgtgcgtaactgcgagatttaagggcacgtcaactttgtcagggacaagacccggcagggctcagcacacgttatgcgcggggcagctgttgcacggggattgggttgttcgtcggcgttttgaaatcgcgctccgtcagttcccccgccgaggcgcggccgtggcggccagctggctccagctcagcccgctggcccccggcctcctgggctcgggctcctccgcccgcgcctcgccgggggctgccgagtnnnnnnnnnnnnnnnnnnnnnnnnnnnnnnnnnnnnnnnnnnnnnnnnnnnnnnnnnnnnnnnnnnccgggcacggcctcgtggccgccgtttggcagcgggtcggcgcggcccgcgtcctggccggcgtggccgtggccgtcgggctgcgcgccgggcgcccctcccaggccctcggatccgcccgtggccacgcccgcggc

SEQ ID NO: 41693 - DNA, 61 bp, Chlorella protothecoides
gcatgggaagcagtgagtgcatgcaagtcgcgcacaccggccccactcagtatgagtatct

SEQ ID NO: 41694 - DNA, 80 bp, Chlorella protothecoides
cccgcagcgatgcaggtcaacctgcccttgacagggagccacccctcgagaaaagaactacagcgtcagaaaggtcactg

SEQ ID NO: 41695 - DNA, 61 bp, Chlorella protothecoides
ttgatctggacgccagcttgtgtcactgcgacgcccttccttcgcctggggacggacggct

SEQ ID NO: 41696 - DNA, 101 bp, Chlorella protothecoides
cagggtgccgggcagccgcctgcagcgtcggacgctctgtcgctccagcccctcgatccgccgcgcccatgtggacgcacccgggtccattccccctgaca

SEQ ID NO: 41697 - DNA, 5078 bp, Chlorella protothecoides
  modified_base (119)..(259): a, c, t, g, unknown or other
  modified_base (661)..(670): a, c, t, g, unknown or other
  modified_base (1319)..(1328): a, c, t, g, unknown or other
  modified_base (1572)..(1581): a, c, t, g, unknown or other
  modified_base (2451)..(2460): a, c, t, g, unknown or other
  modified_base (2587)..(2596): a, c, t, g, unknown or other
  modified_base (2827)..(2836): a, c, t, g, unknown or other
  modified_base (2996)..(3005): a, c, t, g, unknown or other
  modified_base (3112)..(3121): a, c, t, g, unknown or other
  modified_base (3390)..(3399): a, c, t, g, unknown or other
  modified_base (3828)..(3837): a, c, t, g, unknown or other
  modified_base (4195)..(4204): a, c, t, g, unknown or other
  modified_base (4607)..(4616): a, c, t, g, unknown or other
tcctcgatggccgccagggcggcgcgctcgcgcgcgcggcgctcatgcgccaggcgcttgtagtggttgtgcaccgccaccgccagcaccttcttggcctgggcctggcccacaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgtaggagggcaccgcgcccgcgggggtggggccggggtccggcgcgccgctcgcggggggtggcaggtgggggaaggtggcggagacggcgcggacgttgcgccggaactcggggttgtactgcgagacagagcggcgggggggcggggccgcagcgggggcgctgctgcagatgccgcgcgtccggccaagcgctggggcctgtggaagtggaggggggcccgagggatggtgggcaggtgagtgggcgtatgtgttgagagccgaaaggaagcgcattggggcaggaatgccctggtggaccccatgccagctggtaacaagggaacaaagaggcaaccgacgggatgctccgaccacacaacacgtttgagccaccagcgcgcagctgtggtgcnnnnnnnnnnggccgaaaggaagcgcattgggccaggaatgccctgggagaccccatgccagctggtaacaaggaaacaaagaggccaccgacaggatgctcctaccacacaacatgtttgagccaccagcgcgcagctgtggtgcacgtggcggtgatgtatgccaggcatccacccatccaccccagagagcacacctgggtggaccggcacgcagcgcaggggcaatcaccggggtgcatcgagccgacgcaggcgtacccacgtgtgctatgaggggtatcgacctgaattgcggggaggaaaggacgctggggtacgtgggtgctgccaccgggaagcccgcagatcacatcgcagagggtttccgcgcagctgccctgcctcgagtagacccagagtaccacacctggtcgctcaggtaactttgcagccatgcaggtgattgatgggcgtctacgtacatccggggagcacgcgccaggcgtcctcccagtgtcaacgcctggcggaccatggtagtccaccggaggtacgatggccagtcaaaatgcgctgtacaccttcgagggcgcttaaaatacacttttaaagggcgagcgccttaagaagtatcgtgttggcgtgaaaatcgcttcgtgtgcaacattgaaggggnnnnnnnnnnaaaaatgcgctgtacaccttcgagggcgctttaaatacacttttaaagagtgagcgcctcacgaagtatcttgttggcgtaaaaatcgcttcgtgtgcaacattgaaggggaccatgcccatccagtacccagttttcagtcagtggtgcagtaccagccgaggaggggccggaccacactgctccgcctcctttatagtccgacggtcgcgcgctgattctctcacacttgcatcccttactnnnnnnnnnngcggaccacactgctgcgcctcctttatagtccgacggtcgggtgctgattctctcacacttgcatcccttactactctatgtctccccttgacaccattcatcgtgctataaccgctgcagtcgctctcctgtctgacgtttcctctctcatcagtgccggctcccctcccgttctccctaaacgcgcagcttggcgtgacagccgcaacctactccgccgcaagctctggtgagacatcgcgaagagcgtcttggtgcttgcgtgtatcatatcaccaatagttttggttggccaacacattctgacggcttgtctgtctccccccgaatggattactatccgattcccctcctgtgtgtgaaaatattccatactaccaaagatggtctggtcggtgattctatccattgttacacacactgagcaaggggtccctcgggtccccacccctgctgagaaaaattagcggatttctctgagacctcccatcatcatgtttcctgtccccttcccatcatcatgtttcctgtccccttccactcatcccggcgtcctgacccgtgaggatttccaatacacgcatagttcatccgagcagctactactgcactgcggatacactagcattgtctttcgctcctatctgatggtcaagacgcccctgccttttgtgagctgtgcactagtttcgcatccgcattgccaaattgctcccggtggacggtgatgttcttccttaatgacaagcatatatccgatcaccaatgacgttactaaattttaaggctgagtccaccttccttcggtcactgttctctgttgtcactttgcctctgtgcagccccgcaaagcccgacataccacaannnnnnnnnntttctctgttgtcactttgcctctatgcagccccgcaaagcccgacataccacaacaagctcgtctacacgtcctcctcccactgcagatcacttcgctttggcgagcatcgctgtgcttcatcgcnnnnnnnnnncaagctcgtctacacgtcctcccactgcagatcacttggctttggcgagcatcgctgtgcttcatcgcacttctgctgtctatgccatgcggccattatctttgattgtaagaagtcataacatatgagcaaagtgggcagcatagagcaagatacaaggagcgggaacttatgcagcagcagggacaggagcttgtcgcccctcccacaccttttggctgcatcgcacgnnnnnnnnnncctgctgtctatgccatgcggctatcatctttggttgtaagaagtcataacacatgagcaaagtgggcagcatggaacaagatacaaggagcagggagttatgcggcagcagggacaggagcttgtcgtccctcccacaccttttggctgcatcgcacgnnnnnnnnnnagtaggcagcagattatacagcaggaacgctacgactgaatgccagcacagacaccttgctctcccttgcagcccaagtgctcctgccctcaactcacttgtactcnnnnnnnnnntatgcctccaccgcgggcgcacatgccaagggatcagcggtctttgcctcgtagcatgcggtggcagctgcagccgcctccttgcacggctggggccttgagggcgcgctgtgatgcgagggggagggatgctgggcgtcaaggtgaggggaatggacactggaaggacggttcagacagcttggtacatgagatggtagagaactcaggcaggcaggcccgtagtatgacactgctgtgcctcctcgtgcttgggcccggcccaaccnnnnnnnnnnccttggtacatgagatggtagaaaactcaggcaggcaggcccgtagtataacactgctttgcctcctcgtgcttgggcccggcccaacctcctgtgccctgctccaggtaggcagcagagcatacagcaggaacgctacgactacatgccagcacagacaccttgctcccccttgcagcccgagtgctcctgccctcaactcacttgtactcgctggcaaggagctcgtcagccagtcgggtgatggaccccagctcagcctcttccgtcttcagaagcaggcgccccacacgccggctacgctccagggcatgtgccagctgctgatcgtgcttggcctcccgctccactgccctgacatcctcggcaggtggcctgcgatgaaggcgaggcatgagaaggtggtggcgacggtgggagacggtggtnnnnnnnnnntttcagaagcatgcgccccacacgccggcttcgctccagggcatgtgccagctgctgatcatgcttggcctcccgctccattgccctgacatcctcagcaggtggcctacgatgaaggcgaggcatgacaaggtggtggcgacggtgggagacggtggtcgaggtgggatggtagtggatccagatttggtcatagtcgatgtatcaccacaacagaggcagcaaagaccaaaccacaagcaatgtgcatagcccagcaacacacctgacggcaagagacgcgctggggcgaggcggggcctgcacgggcaccaccttgccatctagttggtcgaggagctccttggtgatctgcgcnnnnnnnnnncgggtggggcttgcacgggcaccaccttgccatctaattggtcgaggagctccttggtgatctgcgcgcaggccacagatggtggtgaagccaggacatggtccaggccactccagaaccaacattgcctcggacatgtggtttgtaacatacccgaacaccagatgtcagttcctcgccatcgtcgctgtccctgctccaccgctggcccatggcgccctgccctccccagccagcagtaccggtgcgacaaccggccaaaatctgtgaccaaaggcgatttaaaccgtccgatttccaaccttttatatcgtctcagccctgggcatgcacctgggtccggcactcacttgacgatgggcatagagcaaaggggggggggcagtaccgattcgtccacggnnnnnnnnnngtttaaaccgtccgatttccaaccttttatttcgtctcagccctgaacatgcacctgggtccggcactcatttgacgatgggcatagagcaaaagtggggggggggggcagtaccgattcgtccacggagtacattgttcacgcccctggatacccacagcccaagaccgcgcttgaagcaggggggatccctctctgagcaccagcgttttaagggtcttcttagatccaaccgctcttccaacgacacggctcctcctcgcggggccgccggagaggctcttcccgcccaggtgctcggccttgccaggtgcgcgggccctgtggccacggcccgcccttcctggggatctgggcccgacgagggaattgggtgcggccctctgcgtgatctcgcaagcttcctgcggtcgaaggggcctgagtgtgaagcaggggcgagggctgtgcatcccccccccc

SEQ ID NO: 41698 - DNA, 61 bp, Chlorella protothecoides
cgcttgaagtgcttgttacaggaagcctgctcgcatccaggacggggcacatgtgggatga

SEQ ID NO: 41699 - DNA, 100 bp, Chlorella protothecoides
gtctaggcacaccacctgcaacgaggcgttgcctgaggccacagcagccacacgccgcgcgtccgagtcgcccagtgccccgccgacgatgacatgggtc

SEQ ID NO: 41700 - DNA, 98 bp, Chlorella protothecoides
gctgggagggtctggaaggagcggccacgacgcggccaggccgcctgatgagcctgcgagccctgcattgggccgccatgccggccgctatcctggtg

SEQ ID NO: 41701 - DNA, 138 bp, Chlorella protothecoides
gaggggagggtgggtgtcgggtgggtgcatacggcagcagggggggagggatccgcgggactgaggcagaccatggggggaggatgtgtgtggatgcggggggtgtcaaccccctctcccacctgcttgatgaagatc

SEQ ID NO: 41702 - DNA, 66 bp, Chlorella protothecoides
atgcatgtacacatggggctggaggtcgtggttgtccgagtcagaggcggggactggaccgccaca

SEQ ID NO: 41703 - DNA, 61 bp, Chlorella protothecoides
cagcgcgaactcggtggcggccttgaagaaggcgtcctcgcgcggcccgaacgaccccgag

SEQ ID NO: 41704 - DNA, 105 bp, Chlorella protothecoides
tggtctttgtgctgggtgcactttcggagatggaggaagatgaggtcaggcgtgggttggtgccgggggggggcggggggggcagtggtggaggccctttgcctc

SEQ ID NO: 41705 - DNA, 84 bp, Chlorella protothecoides
atggtggacgtcgcggcctctggcggtgagacttgaggctgttgggtggtgaccacctcatggctggaccatgaatgcaggcaa

SEQ ID NO: 41706 - DNA, 61 bp, Chlorella protothecoides
ccatcgtctgtgtcagcaggtggctggaggggcaggaggcgcttgacggcgggcatgatca

SEQ ID NO: 41707 - DNA, 12000 bp, Chlorella protothecoides
  modified_base (272)..(431): a, c, t, g, unknown or other
  modified_base (511)..(520): a, c, t, g, unknown or other
  modified_base (1285)..(1294): a, c, t, g, unknown or other
  modified_base (1555)..(1564): a, c, t, g, unknown or other
  modified_base (2334)..(2343): a, c, t, g, unknown or other
  modified_base (2722)..(2731): a, c, t, g, unknown or other
  modified_base (4115)..(4124): a, c, t, g, unknown or other
  modified_base (4789)..(4798): a, c, t, g, unknown or other
  modified_base (5820)..(5829): a, c, t, g, unknown or other
  modified_base (6163)..(6172): a, c, t, g, unknown or other
  modified_base (6424)..(6433): a, c, t, g, unknown or other
  modified_base (7117)..(7154): a, c, t, g, unknown or other
  modified_base (7264)..(7273): a, c, t, g, unknown or other
  modified_base (7661)..(7670): a, c, t, g, unknown or other
  modified_base (8242)..(8251): a, c, t, g, unknown or other
  modified_base (9556)..(9616): a, c, t, g, unknown or other
  modified_base (9830)..(9839): a, c, t, g, unknown or other
  modified_base (10772)..(10857): a, c, t, g, unknown or other
  modified_base (10997)..(11006): a, c, t, g, unknown or other
  modified_base (11146)..(11155): a, c, t, g, unknown or other
  modified_base (11351)..(11432): a, c, t, g, unknown or other
ggggaggaggcgccggccgacgcccaggcggccgccgcttcgccgagcgccgcgagcgcgggtgagctggcgggcaccgcctggtctgccatggatgcaggcacgcgtgtcgcactgtcgtcggcatgcgacgagacgccggggggcagcctgcggccaagcgccgcgggtccgtctccagccctttccctcgcgtcgccaatcctgccccgacctcactcctgtgtgggacctgcacgacagcaagccacacgagtgctcagactgtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgatggggcatggagaccacatggaacagcgccaccgacagcccaccggggcactgcatccggaatgcccatgcggnnnnnnnnnntcgacgccagtcctgccccgacctcactcctgcgtgcacctgctcaggagcaagccacacgagtgctcagactgtttcttaccccaaccccccacacgcagcgtcaggcacccccgtgacagaggctgctgcccgtccgcccgcaaaagctgcagagtgagtctggggtccccgcgacactggcgacccgccagggaggcatggtgatggggcatggagaccacatggaatggcgccaccggcaacccatcggggcactgcatccggaatgcccatgcggtgtcgctgagtctcaggcccgcgtacgcccctccccttgccgctgcagggaggcgcaagctgcggggccgcctttccagttgcaggacccggggacaaacgtcctggggcccatggcctgcatccaggccctgcactggtcctttgcctccaggtcagcgtggccggggggtttggggggcaaacaggaaaggggaagaaggccgccggtggacggaggctccagggcgtggtgccgggggtgcgaccaaacgccccatcccgtgcctgcgcaggccgacggccgacgacgcgatgtggcgggacctgggcggcaacctgtctgggctggagcaggcgtccctggtgagccgctggaagggggggatggtggagtgggcccggcatggcgggcgggcatcatgcaggccatcatgcctcaactccgtgtgcatcaaaggccgcgggcgtgtggtcggccagggcgaagggccaccagcgcccggnnnnnnnnnnctatgcaggccatcatgcctcgactccgtgtgcatcaaaggccgcagggcgcggggccggccagggcaaagggccaccagcgcccggggccggccagggcgaaagggcacgagcgcctggggccggccagggcgaagggccaccagcgcccggggccggccagggcaaagggccaccagcgcccggggccggccagggcgaaggaccacgagcgcccagggccggccagcgcgaagggccaccagcgcccggggccggccnnnnnnnnnntgccatctccatccctgggcagcctgactgtggcccctccgcctgatcctcccgacctccccccgactcgcaggcgctgcagtccggcaccggctccgccgtgccatttgagaaagtaaaagacgacgcgctgttcttcgccttctacttccagccggtgcgaatggggcccggattcacgtggcgcagggaggggccaggaaaatgcctcggcagactgcttgagtgcgcacacgcccaaggggtctgtcatgggctcctccttctcccctccctggtgtcccctgactgacctactcccccccatctggttgccatggagcacagggcacgctgcggcaggctgcggcgatcaaggagctgcatgcgagggggtggctgtggcacaccaccctgcacacctggatgacgagagcggagcagcccaaggtgaaggaggctgcggcgcgggccggcaccaggggagatggggcaggctgcctgcctttccaaccactggaaaggtgcatgggggttgatgtttggcctctcaagtgccctagtcaatgaacccctccacatcacgcaggtcctggcgcccacatatgagcagggagtgttctgttattgggactctgaggtgggtggatctggcagcgatgggcggtctgtctggggagtgatcgggggggggggatgagtttgtggagatccctgcttgcagatctgcggctcgctgcgcgtgatccaggtgggtgagtttggggctgtacggaacaccagcccgcgcnnnnnnnnnntcagatccgcggctcgctgcgtgtgatccaggtgggtgattttggggctgtacggaacaccagcccgcgcccgatcctcgatccctcggccatgccctgcagttgagggcagggcaggaggcggggcagcccatctcaggctggtcctcgcacctcaccgccccaacctttgtgctggactactcctgcctcgacactgctgtggcatgagggtggggtcttcctctgacgctcgctgctgctgctggtggactccctggcccagtactatgtaagacctcgaatctgtggttcacaggacggggtgggaggattgtgcgggaggtagtgcagtgcgatcctcgcgcaaatgccaggctcagtgtgcgcatggtcctcnnnnnnnnnnccctctgacgctcggtgctgctgctggtggactccccggcccagtactgtgtaagacctcgaatctgtggttcacaggacggggcgggaggattgcgcgggaggtagtgcagtacgatcctcgcgctaatgccaggctcagtgtgcgcatggtcctcgcacgactgtatcacgcctggcggacagcacgctggggcagtcatgccagggcaatagggaaccgtcgcggcatggacagtactgatgaagaggccgaactcaacatgccagccctagcgctcagctgcctggccccttggtcatggtccagaaggaacatgtgtaggtgctctcaaacatgctcctgtgacgggggttgtgggaaggtgtgaacggcttgtgcagctttaaacgcacaggctctcacacagctgaccatcacacacctgtcctagctctgcagaggctttggcgtaattgcacagccatggggcgcgtcgccatgagccccccctcccagccaccctctcactcactgcctgttgctcgcaaacggtgctttgactacatccctgcgctgcataaccagtcccagccgcccagccacagcctcgatctcctccagagacagctcgatgttgggctcgtcagggccttcctggggctcggcccagtggtacagcagcggcccaagattgacccaggagccgccgggctgccgagggggatcagaagggggaagtcatgaatcttaattgcccacgcctcacgctccatgcagggagaggtcctgggccatgcaggagcggcgtcgagcagcatccatccgtcccgacttcccatcccttgacatgatgccagggatctgctgcacctcaatgcagggccagccggtatgccatccttgccttcagcacagcgacgatggtctctagatagtcgatgacgttatgtgcagtgtctatgaagaagcaggtggccaccacgtcaaagacggcctggtactctggtcgcgcaaagacctccacaaagtcgcccgccaccatgcccaattccccaggcgctggtgatgacgaggaggggtatgggaggaggaaggacaggtatgctcgttgctttttaagagagctatctgcacccgcctggcatgcccagcatcccctctgttcgattacgaaccccagtccccacaccctcaaccccctagtcccagcacctgtcaggtcttcgggcagaacgtctgggatggccagcccccgcaactggctcgccgacgtgaagtggttgcagccagagtggagccaggggtgcaccgtccactttcggtgggtgcaaagggaggttttggggggatgtgatggcgtagtggttagcaaacgcacccaggagccgccagccaggcatgnnnnnnnnnngtcggtgggtgcaaagggaggtttgtgggggatatgatggcgtattggttggccaacgcacccaggagccgccagccaggcatgcatgcagacccgccatcccgcgcacctgatgcagtcgagcgctgtgattcaggacataggctgaggccagcagcatgtagaaggaaaactcatttccaagcacatgatggcccatctgcataggtggcatactttccgaagtgaagggctaccatgatggcggcaggctggctgttgatcgctgacagcacccacaggctgcgataacactccgtacccctcagcatccctatcccgcaccgagcacaggttggcacacagcctccccagtccagccccaggcaccaggatggacagtgggacctggccaggggcctggcggctggcgatggactggacctcctgcatgatccgtccataagaggcggcccgctctgccgccccctcctctgaccaatctctcatcaggttcttcaggacgtacctggcaaagttggggatgtgacgtggcgtgatgaacagcacacactgtgtgagcagggcaggaagcggaggacggagctgaaaagattcacagcaggcagggcgtgcaagatcaggaaccatgccgtcttgtgaatccgttctgccgtgtcgccacnnnnnnnnnncggacggagctgaaaagattcacagcaagcagggcgtgcaagatcaggaatcatgccatcttgtgaatccgttctgccgtgtcgccacccgcccttataccaccgatgtccagaacaaagcaagcactctcaacctggcattgatcccacctgactttctcgacgtcctgggggagaacccggccattgacacccgctgcatactcctctgcggcgctcagagccccaggaaggaagggagaggagtcggggccctcctcgaggagctgagtcagcatagaccgcaaaaagatgtggttgtgctgcactccctgggatgcctgccgaaggtgggcatggaagtggggcagcaggtccttatgtgcctgcttcagcctgcagggtgggcgtggctcccaacgtcaatccttcaagtgcactggatcaatcaacagcagccatcttcgggccattgtgcaagaaaccccagactgcctgcacgcctcccacctggagaaatcaagtcctttgatcatcaggtcaaggtctgcggtgtgtttgtactcgctgaaggcgtggatgatcctgcgagggaggcaatcgaatcggggcttgctgtgaggaggagcacccaccggtatgtctctcctatatcccctcttcccatcagagcgagcccacagactctcggtcacctgcccagggcttcacgctcgagagtagctgtgtcagcttcattgtcatgaggatccatgcctggatcccctagccttgcgtcttgtggcccctgtgccgtctcgtatcgacaaccagctaccaccacaatctgtgcgctcggtgcttacactggactatctgtacttgtcacagatagcatatcgaattggagccagcaaaatttcgacttatccacatgcttcgatgcatcgcgacagcctccatgagttcgtaatgatccccgccgggcttgcaaaggggcgcgcgctgttacacaaggccaaaaattctgaacaatcagaattcgctgcacatgttgctatgannnnnnnnnnacgcgcgctgttaccacaagattttcccattgatcttcaggccaaaaattctgaaaaatcagaattcgctgcacatgttgctatgaggttgcatcaaacaaaggctgcaaagcaagattcaggctgggctcccggcgcctcgccaccgatgaacaagtacaccagtcgtcacagccaatgctgcaaacaccaggccactggacaccctgtgcctcgtcagcagagtggagagttgtgccagggtagattcccctgcgccattcccggtctcattctcggcgccagtaccggtctgtgaactaactccacctgaggtaccttcaggcagagaagnnnnnnnnnntggcgccagtatcggtctgtgaagtatctccacctgaggtaccttcaggcagagaagagtcctggggtgccagtgccgcctggtccaggagtgggtggatgaggtactgccgcaccatgtctaccagtgcactctcgttctgaacgatatctgagtcaacagaaaagggagagaaaggagggctgagcgagtcctgtcggatattggcgtacgtgtcttgagggaggaccagatggtgtgacccatctcccnnnnnnnnnnagtcggatattggctcacgtgttttgcgggaggaccagatggtgtgacccatctcccctccagtcttcctccctcctcgttcgaccccacctcgccagctccggtccacagtgggaccggccaccgtgtatttctgaagctggaggccaaggacctggatgttgtgggccactagggtaccatctcgcaatacctcgctggcatgggcaaacatgcggccagtcgccgcatgcaaggagcagtgcagcctgaaaccattggccatgtcatccctacgacaaaagatgggaatggggtttaagaaactggctctgtattacccacaggaaggttgccaggctgacacaatctgggtgtgtaatgtgccttgtttgcaacagcttctgcacgtatttcccccctcactgccaaccatcacgaccgttcgtgcctggtgtattggaacacccattcagtgggcagccgcgactcccattctggtggagggagccagggattgcgttgacgcttgccagcattatctagtactcgaaactttgcctctgcaaatatgcctgcagggaggggtgcgccatcgaccgacgattgtgacttgcgcagccatctagcctggggaagccttccgtagaacgaatgttgtccccaacgtactcacaatggattgcaagggagagctgagccccnnnnnnnnnnnnnnnnnnnnnnnnnnnnnnnnnnnnnngggatggccttgccgagcagggcatgcagatctgtcatcaggatcgacaatggtatataccatttctatgatataagagtgttatgcatcaccacaatgtagcatactgnnnnnnnnnnttatcatttctatgatataagaatgttatgcatcaccacaatgtagcatactgatcgggtgtaaatgtgcgacgtgatctcctgattcaagaggcggaacggactggggatgctgcgcatgctctaccacgaactcggtccgacacactgccatgcgagagcagggagatctgcattcttgctttcaaaccatttcttatggagtgtgagccatagcatccctcctgtagaacctctagaagctggggcgcacccccgctgacgacatggctgtagacggggtggagtcacaggtgcgcagcattacaattttatactataaggcgtccacgcatggctctttcatttaaacctcactgcaaatctgattcagggtatgtccttggcnnnnnnnnnncacaatgttatactattaggcgtccacgcatggctctttcatttacacctcattgcaaatctgattcagggtatgtccttggcgacggcgttcagagacatacagaccctgctcaagcgcattgacggcaccaccgagccctccagcaagctggcactccaacgagaggctctgtccctcatcaacgccacctcccagcgagtggagtcgtctgggctgttctccacaaacgaagaggtcgacgatctcgccacggcagacatccggtaccttctcctccctgcttatagagggagcattctctcttccttcattacaggttggccagggggacagtgctgcaaatcatgtagtgatgtcaacttctcaacgcgttaattattattccatgccgtattcattcttgcatagcatcctggagaagggtggcagtatgtcttacattttgtgctgttgtaatgcagcgtgaagcagcagcaacccccaaatttcgacacctctatgttatggtaatgcaatccatcactgaagcaaccccccccacacacatctactcatgctcagagtcccgnnnnnnnnnncaatttcgacacctctatcttatggcaatgcaatcaatccctgaagcaaccccccacacacacatctactcatgctcagagtcccgggaccagaggaagacggtgctcttggcggcacgggcctccttcagcgccttcctcctccgactcgtccagtataaaatgctcgctggcacagcaaacgaggctgccgctcaaatcctcgatcaggagcgcgagggagaagccctgccattggatgccgccacggtgcggcaacgcaagataaccttcttcaagaggtgggtggtgaggcaccttgcacaggtttgtgctggctttaggtgttgaccatagtggctgagtctacacaaggaggggcatttggcaagcctactccagtgcatccatctatacctccatcacattacaaacccatcccgccaaggctccttctctgccctctcaccatgctcgtacccctctcatgaacaggagaaaggagcttgctgcgctgctggagagggaggggaccatggaggatgcagatctcagggaggcatcggatgaagatgccaggcgaagagcctggctcttgcacctcgagtctgcagcgctggcagctatcgatgacgtggcaatgatcgatggggaggtgcccctcctcaagcatgcctcgtccctgccgacggcgccggggggggggcctgtgggtgtcgcagatcgccgccgcaccgagaaagcgggcgagctcttgcaaggactgcgtggggtggtccaaggcctgcagcatggtgcgctggagaccgggcttggtgcattggttgcatgggtgacatgtgctgacacagcttgaacagtttgtgtttgacatgtcgatccctcctcccggttgatcaccatactgcttccctcatgtccacctcccagcactgctttcccttgccgcaggtgagcgtcagcaggtgcgtgacaacgtgttcaagcccagtcacatcctgcccacgatgagcgttgagcagtttggggagctggaggcgcgggcggctgctcagcgtgcgcaacgtgaggaggaagcggcgagggagagggccagggcggaggctggccggcggtcagatgatgaggatgacgacgctgctgcaaagcaaaaggtactggtgtggaggtagggcgttcgagctctggtttgattgttgatgggagcgctggggtgtgtgaatgctggtgagatggcagcatattctcagcaccagcgctatgtaggcgtgcagcagcgcgtacttcaggcatgggaggagcaatcacctggacaacacgtgatannnnnnnnnnnnnnnnnnnnnnnnnnnnnnnnnnnnnnnnnnnnnnnnnnnnnnnnnnnnnatggacgactggaaggatgataatcctcgggggtggggaaatagcaagcttagaccatgtggatgaggagaggaagggcgatatcgccccatcactctaaacgttcataaacgtactcgcatgcctcaggaggaaaagtcggctcactgatcttttcaccatgtatttttgcaagtgactgagttctcgtatttgtcagattctcgcttgtacnnnnnnnnnnaaaaagtcgctcactgatcttttcaccatgtagatttgcaagtgcctgacttctcgtatttgtcagattctcgcttgtaccattcaagaagtgctcttacgagtggcaagtgatctcccgggaggccgacaacttcgtattcagcatccgtgcgcgcgatccatggcaaccccagcaagcataaagagcgtgttgatgggttcgggaaaaggggagatgaacctggctgcggtgagttttggattggggggcgcagggagggaggtgttttaccagtactcaggctggctcctgccacaacctggttaccggccaccacccccgtgcaggttcgatctcgggcggaggagctgcgccgttccattgatcagctcatgcacgcccttagtgttgctgccagccgggtgcaatggtgaggcgatggggggcagcaaacccggggacccacctgattctgttcagggaagaccctcagcatgcctccggtctcaacccccaccccccctttcacaaaaggtccgatgccctggagcggtatggggtgctcaacgtgcagtggcagcagctggaggaggagctgcgccccctgctgaagcactatgtggcgcaccccatctctgtcaaccagtccaatgcccacgtcctccccatcctcctggccagcaaggccctgccagagatggaggcacgggatgcggagctgctggaggggctgcatgcggccaccggcacctcggggctgcccccggagcagcagctggcgctgatcatggtgagaggcttgcatggaaggcgcttgcaggggctcatgaggtgggagagggggtctggctgtgtcccggcccactggcccccaatgtcccaatccctgtctggcatggaacacgccctttccactcaacccaaggtatctgcattcacagtaccctccgnnnnnnnnnnnnnnnnnnnnnnnnnnnnnnnnnnnnnnnnnnnnnnnnnnnnnnnnnnnnnnnnnnnnnnnnnnnnnnnnnnnnnntgggccgctggacccccgaggccccgtgaggtctgcgtggcagcgcagggcgcaggccacacgggcggcctcaggcaccgccgcgtccgcaccctcccaaaaccccgcaagcgggggagcctttgggcagagcaggcccnnnnnnnnnncggcccgctggatccgcgaggccctgtgaggtcggcgtggcagcgcagggcgcaggccgcacgggccgcctcaggcaccgccgcatcggcacccacccaaagccccgcgagcgggggagcctttgggcagagcaggcccnnnnnnnnnnaatgaggtgggagagggggtctggctgcgtcccggcccactggccccctatttcccaatctctgtctagcatggaacacgccctttccactcaaaccaaggtatctgcattcacagtaccctccgcgccatgtgataccatgtaggagcactccgaggcgctgtgtcgagccatagatggcgtcacggctgccggnnnnnnnnnnnnnnnnnnnnnnnnnnnnnnnnnnnnnnnnnnnnnnnnnnnnnnnnnnnnnnnnnnnnnnnnnnnnnnnnnncggagcctggagggtccggcgctcctcctggcggttgcaagctacggccatggcctgtgaaaccctgatgaaaatgaaccttccctgtcccttgctgggcccctttcaccgccctcactgtcatgccggtccctgctgccttcacacagacacctgacccttcagcagaccttctggatcacgtctgtgccttgcagtgagtgggccttgcgcgtggtctgcagtggcctgcgcttgccttgaactgcaggtcacacctggcagagtgatgattggggagaaagagaatgcactgtgcatttgggtatatgcaggggcagtatggccagccatgcttggccaatggctccgccccaagtatggttggatatcagaggtgctgtggtgcaaatggaggaagaaaaggacaccaaggatcaccgtcaggtcgagggctgctgttgagcagcgccgaggggcggcggcggcggcaacggcggcggcggctgcagcttctcgcctggctcagccttgcccgcggcgggcgggtctgccgtggcggcggccccccccgcggcctgcgccggcg

SEQ ID NO: 41708 - DNA, 121 bp, Chlorella protothecoides
accagcggtgggtcggcgggctggccggttcctgtggatatccgcccaccccttgcgcaaggtgcttgcatgggccgggacaaggggggaaggtaccttcccggccgcccagatggacgat

SEQ ID NO: 41709 - DNA, 61 bp, Chlorella protothecoides
ggacgtggtgctcaacaccctcacctcgcccggcatggtggcggcctccctggccggcctg

SEQ ID NO: 41710 - DNA, 61 bp, Chlorella protothecoides
catgcagctgtgaatggctacgaagcagggggttcgcccccatggctagcgccaggagggc

SEQ ID NO: 41711 - DNA, 72 bp, Chlorella protothecoides
ccccacgtcgtggtcagcaaccgcacgccgctggacgtgtcactgctgcactgcgcgggcctggtggagcgc

SEQ ID NO: 41712 - DNA, 62 bp, Chlorella protothecoides
atccagccccgcatcctccccatccccggcgaccagccccgcatcctccccctctccagcgg

SEQ ID NO: 41713 - DNA, 61 bp, Chlorella protothecoides
ttggcattcagggctctcgaacggcttgaggtgttcccctgtggcaggaccctggtagcag

SEQ ID NO: 41714 - DNA, 61 bp, Chlorella protothecoides
taaccctaaccctaaccctaaccctaacccgccctaaacctaaacctaaccctaaccctaa

SEQ ID NO: 41715 - DNA, 69 bp, Chlorella protothecoides
gcggtgctgtggctgggaggatgggtacaaggggggggtaccttggatgacctccatcactctgtcttg

SEQ ID NO: 41716 - DNA, 119 bp, Chlorella protothecoides
gcggatcgagtggtggaggtgtggtggaaacgtcagggaccgcgccaggcagcgaagcgaggaccaagggggaacggcgctctgccacgtcagcggcagagcgccagatcttcctggtc

SEQ ID NO: 41717 - DNA, 67 bp, Chlorella protothecoides
ctttgcccgccgctgagcttgcttgcttgcttgcccggctcccttccccctcgccagatacctcgct

SEQ ID NO: 41718 - DNA, 642 bp, Chlorella protothecoides
  modified_base (287)..(296): a, c, t, g, unknown or other
gccgcgcacgcgcgtgcggtggaggccgcggccgaggcctttgcggcgcgcgcgctggggccggacgccgtcaaggcggccaacgagcggcgctggcgcgaggccgtgcaggccaggtggggctgtggaggggggggaaatgagggggtggaagaaggatggggggcgtgccagtccggggcgcgtcgagggccgaagataaagggctgaaggttcagggctcgagcgaggcgaagcgacgctctggagtgtggtgctcatgactgctcctgcacgcgaagcaagcnnnnnnnnnncaagggctgaaggttcagggctcgagcggggcagggacgctctggagtgtggtactcatgactgctcctgcacgcgaagcaagccaggcgtcggaatgtattcgggggtctggcgagcggacccgaataagggacgtcccaccttgcgaggtcgctggatgccccgtcatgtcagggtcgcggcacccagatgcatcaacatcactgatccgccccactctgtcaggtttgccaaggcgaggaaggaggcgctggccagcgctgcgctggcggtcgagcagtgcctggcggcggccaccaagcgcgtgctggaggtggcggggcgccccgacgccgaccccggcgc

SEQ ID NO: 41719 - DNA, 80 bp, Chlorella protothecoides
cgctcccgacacacactcacacacacacacccactcacaaacactcacaaacacactcacacacacatcctcgcagctgg

SEQ ID NO: 41720 - DNA, 61 bp, Chlorella protothecoides
ctgcgtcggatggtatcacgctagcgatattccaaaggaatttctgcaaggactaagcttt

SEQ ID NO: 41721 - DNA, 413 bp, Chlorella protothecoides
  modified_base (146)..(301): a, c, t, g, unknown or other
cacccaccccaccctcccccctcaccctgcggctgattgatgatctcgggcatggcctcgggggcatgggtcatgagcgcggcgtgcagcaccaccagcggctcccccggcatggcggcatgtgtgagggcaaagacgcgccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggcgtggcctcccaggtcaggcggcgcaggtccagcatgcctgcgccgaaccaggcggccagcgcctcgcgcagcgcctcgcccagcgcgcgcagtgcgccgccgcccg

SEQ ID NO: 41722 - DNA, 65 bp, Chlorella protothecoides
ggaactccgacacgagctgcggttgaggaggacggggttgggggcgcacatgggtgcggggtgtt

SEQ ID NO: 41723 - DNA, 78 bp, Chlorella protothecoides
tgcacgccacggccgactaaaacccaaaacgagagcacgtcgcagctcccctcggccaccgatgtgctctgtgcatgg

SEQ ID NO: 41724 - DNA, 1400 bp, Chlorella protothecoides
  modified_base (386)..(395): a, c, t, g, unknown or other
  modified_base (669)..(678): a, c, t, g, unknown or other
  modified_base (1165)..(1174): a, c, t, g, unknown or other
tgcaccgcggccagcgcggccagctgctcggcggccacgcgcacatcgaaggcgagcgcgtgctcggcggcttccccgtcgtcgccgcggtcgcccggcgtgcggtccaccccctcctcgccggcctcgtccagcgcgtccagggcggcgcgcagcgcgcacagcgcggcgtccatgctccggtccagcagcgcgcgcgcgccgtccctgagcgcgcctgggccgtcgcgagcggcgtgcgccagcgctgccgcgcaggcctccaccgcctgggtggtcgtgagggtgggaggggaggggcgtcgaggtggtagaggatggcagggccgcggggggggcagagttgccagcatgactcggcatgtcagccctgcttgcagcgtggnnnnnnnnnncggtggtgaggggtggaggggagggggcgtcgaggtggtagaggatggaagggccacgaggggggcggagttgccagcatgcctcggcatgtcagccctgcttgcagcgtggcacccgcgatggggacatgggccttccagacctccccgctgcgcatccatggcaagcggcctgaaagcgacccgcagcggggcgtacccctctgaccccctctacacccaccgacacccacctcaacagatgcgtgctgcgtgatgagaccctgcacgatgnnnnnnnnnnaacggggccatgggccttccagacccccccgctgcgcatccatggcgagcggcctgaaagcgacccgcagcggggcatacccctctgacccccgttacacccacccctacacccaccgacacccacctcaacagacgcgtgctgcgtgatgagaccctgcacgatgcccagcaggtcggcagcctccttctccttgcgcagcagcacgtacacctccagccgcatttcgggcaccagcgccaccagctcggccgtcttttggttttgtccccgggggggagggagtgcgtgaggggtgcgtcagagtgtgagcggagggtctggggggaagtgcgtgtgggcggaaatctgtggcatccgcccaggagaatgacgggggaccgaggtgttcttcctcgggcatcaaaggacgcactgcacagcccgagccgccctgcctcgcccagtcccttcacgcgcccctcacgactccccaccctacccctgnnnnnnnnnncggatttgtttcgggggggggagggggcgtgaggggttcgtcagagtgtgagcggagtgtctgggggggagtgcgagtgggtggaactctgtggcatccgcccaggagaatgacgggggaccgaggtgttcttcctcgggcatcaaaggtcgcactgcacagcccgagccacactgcctcgcccagacccttcacacgcccctcacgactccccaccctacccctg

SEQ ID NO: 41725 - DNA, 61 bp, Chlorella protothecoides
gttccccaccaccctggagaaggggctggggaagctgatgagcctgaaggagtcatttggg

SEQ ID NO: 41726 - DNA, 114 bp, Chlorella protothecoides
gaggaggagagtgccgagatcgtcagatcataccgggtgagaaccgccattttgaagttacttcctattttcaattcatttaccacacttgcgcggcacatccctgccacatcg

SEQ ID NO: 41727 - DNA, 61 bp, Chlorella protothecoides
accagagagcaccaggcatcatcgaacggcacccgaaggcaccatggccctggacctcggc

SEQ ID NO: 41728 - DNA, 75 bp, Chlorella protothecoides
gagcgagtgggctgggcagggggtgcgcttcgtcacccgcgcgggagacttgtcggacttcgatgccgcgtgcgg

SEQ ID NO: 41729 - DNA, 131 bp, Chlorella protothecoides
gaatgttgggcgaacgatgcatggtgtggcacccccggggcatcacctcagcatccatcatcgagcctctgtacggcttttgcgcaccgatgttcctgcccctattcccggcctgtcgctgacatgtgctg

SEQ ID NO: 41730 - DNA, 67 bp, Chlorella protothecoides
gggcaccgactttcatgccaggggaggggtggaggcagtgctcgacttcctgcacgccgcgtttgcc

SEQ ID NO: 41731 - DNA, 61 bp, Chlorella protothecoides
ctgcttgaattccaccaccattcccccccctccccccccccttgtccctgcgcaccatgag

SEQ ID NO: 41732 - DNA, 75 bp, Chlorella protothecoides
tcgcggcatgtggaatgcgctggtgatcacagccaggcgtctgtggcggcaggggtggaaagggcgccatatgcc

SEQ ID NO: 41733 - DNA, 864 bp, Chlorella protothecoides
  modified_base (124)..(133): a, c, t, g, unknown or other
  modified_base (473)..(482): a, c, t, g, unknown or other
aacgcagacgaggtgcggtgtcggtgtgtggggggagggcgttggaagtgggtattgcagcggggagagtagtggggtgtcaagggtggggcggtgctgcaggctggagcgaggtcggcgttcnnnnnnnnnntgcgggcggggagctgccgcccgccccactgcccacctgggagaacgcagacgaggtgcggtgtcggtgtgtgtggggtgggcgtcggaagtgggtattgcagcggggagagtgttggggtgtcgagggtggggcagtgctgcaggctggagcgaggtcggcgttcgggctggagggagtgcgtgctggcgcacagcggggccgggcggctggagcccgaggcggcggcgctggccgccgggcccgctccatgtgctgttgggccccgcgcgcggatgtgcggacccagccccacttctccatgcgcacgcacgcttgcacgagcactcacacgagcacnnnnnnnnnngtgtgctgttgggccccccacgcagatgtgcggccccagccccacttctccatgcgcatgcacgcttgcacgagcactcacacgagcactcacagtcagaggctcgatcccacccccccaggccgaggccgcgctgcgcacgacgggggccatggagcaggtgctcaaggcggtggccaagcagctggagggcgccgtggacggcgtggacggcgaggtttggtccgcgctgcagtcggcgctggcggcggtggccgccaagcgcgagcgcgacgcgcgcgcgctgcgcgcgctgcgctacaacatccccgtccacgccgaggtgggtccggtgagcggcccgcagtcgggcggcgcgcgacgcggcgcggagggggcgcgg

SEQ ID NO: 41734 - DNA, 61 bp, Chlorella protothecoides
gggtacctgttgttggtttatggaagggggtggggggggtggagcccgcgctgcatgtcca

SEQ ID NO: 41735 - DNA, 73 bp, Chlorella protothecoides
agcaggcgcagctgcagcagcaggcgcagcagcagcagcaggtgcagctgcagcaacaacagcagctgcagca

SEQ ID NO: 41736 - DNA, 68 bp, Chlorella protothecoides
gcgccatagtccacgccgctgaagcccttgtctggcttgaaccggcgctcgccggccgcatcgtcgcc

SEQ ID NO: 41737 - DNA, 88 bp, Chlorella protothecoides
ccgggggtgaggaagtgtgaggttgcagcgctctacgacacactccccgggccaggccggcagcaaagcccctcagacaacacctgcc

SEQ ID NO: 41738 - DNA, 70 bp, Chlorella protothecoides
ccgtccctgcccaccaatcacaggccccgcgcgtgcccagatcgcctcgctgtccgaccccctgggcctg

SEQ ID NO: 41739 - DNA, 407 bp, Chlorella protothecoides
  modified_base (101)..(334): a, c, t, g, unknown or other
gtccgcggccggggcccggcggtggtcggccgccgccgccccgcgcccccgcacggcatcccgaccgccagtcccgcgccgcagcgtggtcaggtagtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagcggaagaggcgccgcgccagggcctgcgtgccgggcgaggcggcgggtcccaggcggctgggcccggc

SEQ ID NO: 41740 - DNA, 79 bp, Chlorella protothecoides
tattcacagtctgatcgaggatgccctggtatgaattcgcactagcgcatagggcttgggaagctgggacatacaaata

SEQ ID NO: 41741 - DNA, 80 bp, Chlorella protothecoides
aataatcggacatggattcccatgcaggggccccagagtttcggcccgcaaattctctgtctggttgccattttcccctg

SEQ ID NO: 41742 - DNA, 3204 bp, Chlorella protothecoides
  modified_base (164)..(268): a, c, t, g, unknown or other
  modified_base (885)..(894): a, c, t, g, unknown or other
  modified_base (1181)..(1190): a, c, t, g, unknown or other
  modified_base (1740)..(1749): a, c, t, g, unknown or other
caccgcctcggcggggaaggcgtcggggtcggccaggcagtcgcccagcgccgccatcacggcgcgcactccgccgggcacggcgacggggtccagcccgtgcagcgcgaccagcagctcggagggcgggaccaggcggtcggtcgccgcgccgcgcagcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgggcaggcccaggagcaggggcagacgggccagcaggccttcacgccccagaccccgcagcagcgggaccagcgggcgcgcgtcgcacgaggcctgcgccaggtcggccgcggcgcggaccaggccctcgggcagggcgggcagggccgaggccagcgcgcgcagcatgcccagcgccaggtccatgcagttcttgttgagatggaggggatggagggagcaggggtgagggtgtgggaggggagtcgcgacctcaggcatcagggtgccggggccaggagctcgaggcatgacgggctgcatgccgacggccatgggacccaaccaggcgtggccgagcacagggactggctcggcccgctgataaccctgcgcacctccggcaggtccgccagggcgcccagcaggtcccgggaggcgggccccagcgtcgtggccaggccgcccgcgtacttcaggatgccctctcggccagaagctgccgggatgtgggggggaagcttggtcatgtggtgtcgctcctgcgcatcgacacgcgcaggcacaggtcgcgtgaggtgtcctcacaaccctgcccccccccttttcacacccaccagatgcgctgccaaannnnnnnnnnggcgtgaggtgtcctcacaaccctgtcccccccctttcttttcacacccaccagatgcgctgccaaaggcctcgaacaggcgtggcagcaggcccggctgccgggtgcagagggcgcagaacagggcgcaggccgcggcggggtcgacgacggaccccgtgccctcgactgacggcgccgcgccctcgccgagctcccgcttcaccgcagtagcctcggtgtccgcccttgcctcgacccccgcgtcctctgacgtcgtcgccgcgccatcggtggcctccgctttnnnnnnnnnnatcgggccccacgtcccctgacgccgtcgccgcgccatcggtggcctccgctttcacacgcgccgccgccgcgccatcggcttcctgcttcaccgccgcgccgtcctcgcggaccacgagctggcgcaggctacgctccgcctcacgcaagatcttgggttgcagccggccgcccaggcatccccacagccggttggtgagcaggcgcaccgcgcggtccctaacccccgcgtcctcgctgtgggccgcggccagcaccgccgccagggccacttctcgcgccggcggccgcgccaggatcaagtcgcgcgccgccagcaggcccagcgtggcgtgatcaaggtcggtctgcatcaggccctcgagggtgtcgcgcaggagctccgccggcagcgcaggagcagacaggaggacactgtacaggttggcatgtggagagtgcttgctggagatggaatgcccagagagacgcagggagcagggttgggtacccccaacaaagtgaactccccattgccaggcgtgcttgtaatcgaccaaaccccctcgnnnnnnnnnnacagagagacgcagggagcaggattgggtacccccaacaaagtgaactccgcattgccgggcgtgcttgtaatcgaccaaaccccctcgtcacctgatcagggagcggtcggtgggtggcagcgcgcggcgcaccaggtccagggccttggaaaggacggcacgatagccgtcgccctgctgccgctctgtgaccgcctcgtcctcaccacccaagtcctgtcggccctcggcggcaaacgcggcgtgcaggaagtcgagcactgcctccacccctcccctggcatgaaagtcggtgcccagctcctccaggaagggcccagcgaggtcggcctgcgtggcggcgagtcgcggcgcgagccagtgcccgaagccccccgcggccgccgccagccgccgcatggtgagcgcccggagcctggccgcctccccggcactcaagggtaggggatcggtggtgaacctggccgctaggcccgccgtgccggcggggagagggggcgtgggcgtcgcagcagtggcccccgcaaccaggggtgatggcgagggagctgccgacctgcccggctgcctgctcgcatctgtgacagggggaggtaccaccgcgctggcgtctcctggagcagccatgcgccgaagcaggtcctcctgccaggccggcaggggggcgccgtcggcggccagcgacgccggcgcccccccgggcgggtgcagcctcgccagcaccagctcggcggctgactcggcgtccagagacgcgtacagcgccgccaggccggcactgtcgccccgcgcgaccagctcgtcgaccctcgttgccagctctgcaccgtcttcctgtgggctctcgataggcaaggcgggccctgcagcccccgtggcccggtcttcggtgcagggacgcttggccggtggggggcgggggtcctctgccgaccgacccggcaccgcctggcttggcttggatgccgccgccccgtctctcccgccggcaaccacacacgcctcgccagcaccgtcctgcgtccccccaccccccgccaggtcggccagggcccgatccaccttcctggcccaagccgccgccagcgggtgcgtgcaacggcgcacctgcgccagggccgcggtcagcgccttcctggcggcgggcggcagggccactgacatgccgtcatccctggccgctggcgtgccactttcagtggtcgctgccgtgccgccgtcccccgatgttgttgccgtctcgcccaccatcgttgcctgccgcgcggcgactgataataatgcgggcaccaggcgcggcatgaagtgcgggcgctgcgtcgccagcgtgcccgcagcgcgcagcgcggcctcggccatggggccgggcgccgcatcgcaggcgcgcaccaccgccgccacctcgcgcgccgcggcgtctgcctcctgtgccagccccgcacgcgtcagcacc

SEQ ID NO: 41743 - DNA, 68 bp, Chlorella protothecoides
gacctcagtgagtgcagacttgcccagcgcagagggtcggagtcgttgctgagtggagctctgagcgc

SEQ ID NO: 41744 - DNA, 73 bp, Chlorella protothecoides
gccagccttcccccaagccagcccttcccccgccctgtccgcgcagtcgtacagcaagaacctgggcctctat

SEQ ID NO: 41745 - DNA, 61 bp, Chlorella protothecoides
ctccgcagcgccagccccggccgccgcgcctggccagccggccccagtcccgggccccgca

SEQ ID NO: 41746 - DNA, 69 bp, Chlorella protothecoides
gggcggtgggagggcaggcgggggaggggacccccctggggcgccagcctcagcgggtggaggagaggc

SEQ ID NO: 41747 - DNA, 61 bp, Chlorella protothecoides
cgtcctgccctcgctgtcgttgctgccccgtgaccccgcgccggcagtccaggtagatggt

SEQ ID NO: 41748 - DNA, 6469 bp, Chlorella protothecoides
  modified_base (157)..(264): a, c, t, g, unknown or other
  modified_base (1620)..(1629): a, c, t, g, unknown or other
  modified_base (2129)..(2138): a, c, t, g, unknown or other
  modified_base (3361)..(3370): a, c, t, g, unknown or other
  modified_base (3456)..(3465): a, c, t, g, unknown or other
  modified_base (3551)..(3560): a, c, t, g, unknown or other
  modified_base (3714)..(3764): a, c, t, g, unknown or other
  modified_base (5432)..(5441): a, c, t, g, unknown or other
  modified_base (5933)..(5942): a, c, t, g, unknown or other
  modified_base (6031)..(6040): a, c, t, g, unknown or other
gccggggcgccgccgccgcgcacgcgcagggcctcgacgcgctccagcacctgggtgctggtgggcctcagcgcgggctcgtggcgccagcactcgcgcagcagcttggccagtgcgggcggcgtgcccaggggcatggcggggcggcgccgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctccgcccagggctgccgcccccccagcatctcgtgcaccaccagcgcccaggcccagacgtcggccggcgcggcgacggggccgccggaaaaggcctcgggcgccatgtacgccgccgtgcccagccccggctccggggcggcgtcggcggcgtcggcgccgcacgccgtgtcgcgcggcagcgctcgcgccaggccaaagtcggcgatgcgcgccgccggggtgggggaggaggtcgcgggtccgatcgcgccaccacccccggcaccgtctccttcccccgccagcagcacgttgtgggacttgaggtcgcggtggaccaccggcgggtgcgcggcgtggcagtgcgccatgccccgcgccaggtcagcggccagcgccagcagcaggccgtactgcgggcggcgaccctggtcgtgcagcttggcgtgcagcgagccccccgccgccagctcctggaccaggcacaggtgcccgggggcgaggcaggccgccaggttgggcacgatgcaggggtggggcgccaggccggacagcacgcccacctcgcgggccagcgcgagcgccgcgccgggggcggccgccagcgcggggtggatgcgcttgaccgccaccggcgcgccgcgccaggtgccggcgtagacgctgccggtgctgccggagcccagcagggagagcacgcgcacctcggccgccagctgctcggcgctcagcagctccgtcggcgcgccggggcggggcggcggcgggggcgccgggcgtgacggtgaggctggcggtgtcgagccaggcatcccgggcacagcccccaccggctcggccacatcctcacttgctccaccctgccccagcgtctcagcctcgccccccactcctgcagcccctgccggatcgggcgctggcggtgagccagggcgcggccaggcctcgccgtcggccgccagcacggcgtgcgcggccgccacctcgtgcggctggatggaggccgcggggtgcagcgtggccacgctttcctggcttgcaggggaggcgggcgcgccgctgtcggcgcgcgacaccgtcgtgcccagggcaaagtcgtgcgaggccttgcgcagcggcgaggctgcggggctgctgtcctccgagaacaccccggtgcccgggctgtcgcccgaccccaaggacgcctctgcgcgtttttgagggtcacgcaagaagggtgaaacggcggcgggtgtggtcgaggaagatgcctccctaaggcttgtcgctgggttagactgtcaccctgtattgccacgcagcgacaccaaagtttcccctccccagccctcaccacaacccaccgtcgaagaggctgctgcccgccnnnnnnnnnnctgtcactgggtaataccaccaccctgtattgccacgcagcgacaccagagattcccctccccagccctcaccaaaacccaccgtcgaagaggctgctgcccgcctggaaggtggggttgtgaaaggcggcggagtcggaggctgaggggttgatggcccaccccatggcgctcaggtccctccggcgcacagagatgtctaccgtggggatggagggcatcgccagcctgcggtgaggatgtgtgtgtgttgtgaggggaggaggtcgacgggagggcaggggggcgacagctgggtgcggtagaggcggggatcgtgcacatgaggaagccggcattgtggacgccagggtggagagcaggaggcccgggcgacgatgcccagagagtcaggagcctgcacactcccacatcaaatccagcaggccagacacctcccacctgagacccatgggtgacacagcagagtgcatggacggggggctgctgtatggcgaggnnnnnnnnnntgatgcccagaaagtcaggagcctgcacaatcccacatcaaatccggcaggccacacacctcccacctgagacccgtgggtgacacagcagagcgcatggacggggggctgctgtatggcgagggtaagtcctgggggtgttgcccccaagctcctgggtggttggcgccctgctgcggccaggtctgcaggacccccttttgtgggccggggggtggcgccgccgcggcgctgacaggcgcctccggggggggcccaacccggatcaggaattgctcgcctggggccgtgtggccggcctccgggtcgcccttccccttccccagctgctcgggctggggctgcgggcacagcatgctcagcgtgcagtggaccagatgcaccagcaggacgaggaggccggaggagccgatgaggacgtagagccagaggggggcccgggccagccagggctgctgcgggggcgcctcatcaatcaccaccgtcggctccttgtcagcgtgggcttcagggggcactggggggtctggcgatggcggtgggatggccaggggaggggcttggacctccgacggctccgggtcaaggcttcccgcctccctcccctcgtctgcagcgtcaagctgggcccctgctgctgccaggcccacctcagcaggctgtgctcctgctgcaggggtcactgctcccagggtcccagagccgtcgtcaccctcgagcccaaccgacgcggcggcctccagcaggaagcgcgtccctggccccacgtcgtaccagccaggaagcgcctgtgagagccggcgcgcgcgcgggccgatgccgcgcgccgccaagctttcctccaccatctccttgactcgctcctccaggagcgcgcgctgcgacccgtgctgctcctccatcagctgttgtgcggcagcctccacaggggactggcgagggaagacgggctgggaaatgatcacgtccagcagccgggcgcgggggccgtccttgcacctttggaaaccgtaggagcaccagacgtccgacatggagtctgcatgggggtgacacagggtgagctatggctggctggactgtcaatcatgtctgctcaacaggaaagtcggggtggttccatgcatcatatgggacaccagccactggtaactccagagaaaaattcaagagataaaagtgtcccaacaatggtatgctcatgaaataaacaggaatcattnnnnnnnnnnggcgccaactcgatgcatgcaccctcccagactcgtcatcaacgtatcgaacgtttatacctagctctgatgaggcttgtaccatnnnnnnnnnntgccccaactcgatgcatgcacccgcccagactcgtcatcaacgtatcgaacgtctatacctagctctgatgaggcttgtaccatnnnnnnnnnncaagagacagaagtgtcctaacaacggtatgctcatgaaataaacaggaatcattgtcttccaggtattgctgccggtcacagcaagaagtggacctggcttgccaagccaacccatgctccccacccgcaacaattgtggagcgaggagcgtnnnnnnnnnnnnnnnnnnnnnnnnnnnnnnnnnnnnnnnnnnnnnnnnnnncgcaagcggccccatccgagccagcaccaaagctaggcagagcgtgccgaccaacatgttgactaggtgaacgactagcgtaagccctttcgggacgctggaggtctcttgctcctcatcatatatgtcgagtatactatacaaactgtgaaatggcgatgtgagagctcgtgggcgctccctggaggtatgagtgggggggggggttaagctgcacagcatgcaatccatgcatggggcaaccacgaaggcggaagccgggaccacaatcggctgccacctgaattccccatccagccttgcgcccaatcgagtgcttctcacttcgatgtgccagacggcgattgtgtctgagacgaagcaggacgacatgagattcacacagcatgcgctgacaagcaccacctttgcagggcgccgggaaaacaacatcatgtacggggctatccagtcaaaacaagcggtcgaccaggcagcgtgggatcactttggcccattctcaggcccaaattcacatctcaggctgggcgccgaggagacgacgtccctgggtggactgactcttcaccatgcactttgccatgcactcatcggcctcggcgatgaagttggtggtcggcgcacccagaaccagctccgcgtatgccatctcgctgatattcaggctcgccatgaccaccgcctgatgggcggttgcacacagattgcagagggtgaggacatgggaacagtgaaactgggggaggccccctcatgtggacagtccccattccatggcaagcagcagcaagatcatgtgcctgccggctccacatctgctcctccccacgatgaaacactcatacctgaggaagattgacgagcgccggcacaatattgactgtggcgccctgcgcatcgttgtaggtgatggtataggtggcggggctgcacccagtgttgtactggtagtgtacaaggccctggggaaagacggcagaggtgcctgaggtgatggtgttctccactgctgtcccattctcctggacgaacccaaccatgagggactcggctgcaggagggtggctggtggtaggcttgagtcggcgacatttaggggggggtgccagaattatgcgtatccaggtgccatcagggcacacagaaggttgatcatgcaaggcagcaccctcccccggcgcaccattgatggcgtacaagaggcccgctgcgttctggtggatgtgagggctgcgcaccgcacagggctccagtgtgaagcttgtttgcgagataccaagtccctgagatgggtaattttgtagcacctcggcatgagagtcggggaacctccaggttggagggggtttcaatccaggtcattgccggagcgggggcattcgagatcgtggactcacctcgagtgcgggccactcgcgcgcggtacgccgctgcgacacgccccctaccgacagtgcattgggggagggtgttggtggggtgtacacgaattgggacgcagggatggcctccaggttttcgctggtgacggcagcctgggctccggcgcaggacaccgcaagagccaggaacacgagggcgatcttgtcattcattgtagagtatatgaatgcttggatgttgaaagggtttgaggctggaaggctgggtttggcattgttagggtcnnnnnnnnnnatagagtatatgaatgcttggatgttgagagggtttgatgttggaaggctgggtttggcattgttagggtcatgatgagggcagcaaggtgcgcgcgtcagcagcccctccgctctggcacctgtccccggtcggtccccggtgcagcgaatcggcagggtggagcggcagcaacctggaccggtccgctgtacggcaggactcccagccggcgtaaaatttctagaaacatgtcttttggttacacacactgagaaagtacagaggcaggcctggaaaaaaccttgaatgaccggcttgggagccagggccggtggtgttctgacacagggaggaggcggtggtggtacatggcgccatcgttggccgagtgtgcacgggcaaggaagccgcgcggtgcctctgggaaggggtggggtgggcgtccgccccgtcatccgccccggctcgctcaggcggcggcggcatgcgcgcgggggcgcagcgcctccnnnnnnnnnntggcagcaaaatggaccggtccgctgtacggcaggaatcccagccggcgtaagatttttagaaacatgtcttttggttacacacactgnnnnnnnnnngatcgtcggccgagtgtgcacgggcaaggaagccgcgtggtgcctctgggaaggggttgggggggcgtctgccccgtcatccgccccagctcgctcaggcggcagcggcatgcgcgcgggggcgcagcgcctcccaccagcccgaggtgtctggcaggtggcgggtggcgtccaccttgtcgatcatgggctgggacccctctagcacgcccgcggcggccaggcagcgccccgccaacgtgtcgcagaccggcaggttctgggggcagcagtgctggtggtcgtcgcagcagatggcgccgtccagagggcagcaggcccaggtgaagcagtagccgaagaactcgcgcatgcagcagcaggtggaggaggcggggcaggcggtggtggggtcgcagaccacgggctgcggcgcgggcgggcccggcg

SEQ ID NO: 41749 - DNA, 61 bp, Chlorella protothecoides
gtgggtgggcgtgacatcatgtctgcagggggtcgcgtcttgcaagggctaccagactgac

SEQ ID NO: 41750 - DNA, 61 bp, Chlorella protothecoides
gggcacgcgggcaaagggcagcggaaggaggggaggggagacgcgacacgccggccacatg

SEQ ID NO: 41751 - DNA, 74 bp, Chlorella protothecoides
cgccgcgccgtcgccgatgtcatgccagctcaggcaggtgggtttgccggcggcgccgctgcaccgtaggctgt

SEQ ID NO: 41752 - DNA, 14376 bp, Chlorella protothecoides
  modified_base (399)..(408): a, c, t, g, unknown or other
  modified_base (1009)..(1018): a, c, t, g, unknown or other
  modified_base (1518)..(1527): a, c, t, g, unknown or other
  modified_base (1783)..(1899): a, c, t, g, unknown or other
  modified_base (3146)..(3155): a, c, t, g, unknown or other
  modified_base (3486)..(3495): a, c, t, g, unknown or other
  modified_base (3756)..(3765): a, c, t, g, unknown or other
  modified_base (4225)..(4234): a, c, t, g, unknown or other
  modified_base (5409)..(5418): a, c, t, g, unknown or other
  modified_base (6385)..(6394): a, c, t, g, unknown or other
  modified_base (6537)..(6546): a, c, t, g, unknown or other
  modified_base (6805)..(6814): a, c, t, g, unknown or other
  modified_base (7825)..(7834): a, c, t, g, unknown or other
  modified_base (9053)..(9062): a, c, t, g, unknown or other
  modified_base (9526)..(9535): a, c, t, g, unknown or other
  modified_base (10308)..(10335): a, c, t, g, unknown or other
  modified_base (10399)..(10408): a, c, t, g, unknown or other
  modified_base (11253)..(11262): a, c, t, g, unknown or other
  modified_base (12086)..(12095): a, c, t, g, unknown or other
  modified_base (13036)..(13045): a, c, t, g, unknown or other
  modified_base (13633)..(13642): a, c, t, g, unknown or other
ccattgtgagttgaagaggggtggggtggctcggggcatgttctgtgcagagctcatggactcgtggcaaggcctcccacacggcaggccagcagctcgacatgcagcacggccgcccactcccagatcccagcccctgaagcgcagcccagcctgaagcacagcccagcctgaagcgcagcccagcctgaagcacagcccagcctgaagcgcagcccagcctgaagcgcagccccaaccctcagcaccccccaggcttgcctgtcctgcgtctgggcccccacgcagactccgccccctgggcactgcagctcggaggcggccgagcagggccggccccgaggcacgtacccctctgcctcgggccggatgccggcggcggcgtacgccaggtagccnnnnnnnnnncgctggaccccgcccgccccgcgcgcctgctggaggtggggcgcgtgggctgcgtccccggcgcgctgcacgtgcatggcgcagaccggggcacgctgggcacgctgcgcgcagcggcggcggccgtgccaggactgcgcctggccgaggcgtcggtgggaggtggggcgaagggaggcgcagggggggtgtggatcggaggactgcagcctccgtcggggccaggggctcgactgggaggctgggggcgggggctcctgtgcgcgatgccgcaccattggctacctctccctcctcccgacgcctccgcgcaggcctgcccccggggagcgcggcgcactcctaccgccgcgtccaccccgacctcccgctggccgtgctcaccgactacgacgcggcgtggccgagcgatgccggcacgccgaccgacggcctggaccgcctggacgtgcgcgcgctcgcggtcgcggcggagctcgtcgcgcgcgccgcacacgcatgggcctccagcggcggcggcgacggcgacgacactccgggcctgagcgtggacgcagactcgctggagcacgacgtggcccagctgctggcctgctttggnnnnnnnnnntgcggccgcggcggagctcgtcgcgcgcgctgcgcacgcatgggcctccagcgccggcggcgacggcgacggcgctccgggcctgggcgtggacgcggactcgctggagcgcgacgtggcccagctgctggcctgctttgggccgcaagggctggcctgcccactggccgccgcggtgctgcggggcggggcggggccccgcgcggggccgccgagctcctacgtcggcatcctgcgctccctcaccaagggtggggagtgtgcgtgtgtgggctgaggcgagggggaggggagagccgtttgccatggcgtcggcactgcagggcggggctgaaggcaggctggacttcctggtgccgcagcgtgtgcaccggcaactgcgtcggtgctcgctggggcggaggggtgcgcgcctcgcacccctcagaggctgtgtgcaccgaccccctgagccatcgaccccaccccccgcctcagactcccaggccagcgacccgctnnnnnnnnnnaggcaactgtgtcggtgctggctggggctgaggggtgcgcgccttgcaccccaaggaggctgtgtgcgccgaccctctgagtcatcgaccccacccctcgcctcagactcccaggccagcgacccgcttgtcaagggcgccagggagcgcttcctgctgggctacctggcgtacgccgccgccggcatctggcccgaggccgaggggtacgtgccgcggggccgaccctgctcggccgcctccgagctgcagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggctgcgcttcaggctgggctgcgcttctggggctgggatctgggattgagcggccgtgctgcatgtccgggctgctggcctgccgtgtgggaagccttgccatgagtccatgagttctgcacaggacatgccccgggccaccccacccctcttcaactcacaatggcaggtcttcggagtgcctgaacgtcaccgccaagtatgtgcccgcctacccaaccgccctggagtgccgggcctgcgacgggcagagggccggcggcgagggctggcacttcacggaggcagcggcgacctggtgcgggatcgggatgggcgcatgcgtcagtgcatggctcgatcgcatccatgcgagcaagcgtgcatgcggtggatgttgaggagcgctgagagggcttgccagcgccggttggcggatatgggcgagtgcacaggagacaggcacgacaccccggaacaccctgcaccaccctgcatcccatgccagggaggccagcttcgggtggccagaggaggacgtgtgggccgagagcaactggcccacggggacccccagcctgagcctgctgctgcgagaatctgcggcccgcgagcgacaggtcctgctggccggggttggcgtcgccctgctttgcgtcgccggcgtggctttgctgcagaagcaggcccgaggctggctgcccggagcggcaggcggggacggttgactcgggtggtaacgctaataccaacagattgccttgcgctgccccacacggtgtacatgacatgtgcagtgggcgcgaggaacaaaggatcgcattatggacaaatcggggacagcaagctccagccaagggcacaaacagcgtacagggaagaagatgaagagtgtgcaggttcgttgcgtcgagcagctttgcctcaaaacatgctggagccgctccttttcttgcccaccagcatatccttggcctcattgaccttggtggcaatgtagctgctgcccccggcatcggggtggttggcgatcatgatgcggcgatgcgcctctttgaccttggcctctgccgcgctttcccggatacctagaggtgacgtgagcgacagatcggacacatttttgtcaggaggggggtggattgaggggcaggccgagaggatgctgaatacctgccctgcgcaggtacacacaaaccccacccacctagaatgagggcagcctctcgtcgggtcatctcgggaaggaagcctcccttgtagnnnnnnnnnnccaggaggggggcgggctgaggggcaggccgagaggacgctgagtacctgccctgcacaagtacacacaaacccctcccacctaggatgagtgcagcctctcgtcgtgtcatctcgggaaggaagcctcccttgtagaattgcctcatgcgcggcgttgtcttgctaaatgactgccaagcagtgagtgccgtcttgccggcatatgccgctgctcccacggccaacccggccagcaggggggtggtctgcaagggcgagcgtgttaatccatgtcagcctcggcacgcttgcaaggggttctttaatttacaatgccatcggctcccccnnnnnnnnnnctagttctgagacccaccatgccgacgacaggagaccacacagagggcccacgcgtccgcaagccttggcgtcaatgaccaggacgaggatggctgcgtaccagcccacaggcagcgagatattcgtatggggactgagaatgtgcaatggaccactttctacatgttgggatgtcagtcatgcttagttttactctgccgagtctggaaacactctacaccgcacgcatagcagcaccgacaccccagacgaggaggtgnnnnnnnnnntcaatttctacatgttgggatgtcagtcatgcttggttttactctgccgagtctggaaacactctgcaccgcacgcacagcagcaccgacaccccagacgaggaggtgaggtgtgacgcacctcctcggtatcgagaggggtacggtgcaacattgattctgaagagctgactgtgacgagattaaatacttggcgatacctctctggagtctcagcttcgtgtgtgcgggtcccctacactgcacaggaattgctgggtcccgtgagggtgccctgaacgcgtctcagcaacgatcagccggcttacacccatcccagcgcatatatccaccctatggcaactctggacgttcccaagaagacggaagagggtgagcaggtgtgcgtggtggagactggaaagggagggcagcatggtccctccaaaatccagccggtctgtgtgatccacccaacacnnnnnnnnnnttgcgttgtgcagactggaaagggagggcagcgtggtccctccaaagtccagccggtctgtgtgatccacccaacacccgttcctatccatgcagccctcttctaccgattgaagagcaaggggttcaatcagtgcaaggaggtgggcgaggcatacgcggcctgctgtaaggatcgcacgatctccatagcatgggcctgcaggtctgagatggcggccctcaatacatgcatggctcagcagtgagtgctgggctggtgcgcagtggaactgggcagggccagagctggggatgacgatcggcaacgaatcacggctggtgcatgcatactcgtgtgctcggctgccccgggatgaccacagtctctgctcaattggtcgacgaactcatgcatacagtgccctatcctgttcgcctccaccctcatcccccatgatgcagcacacagcacttggaggtgctgaagcagagatgggtggaggcagggcgcccgcaaaagccagactgggacgctctgctttcaggactatgacctgacccatcccggcttccacacctttcagcagaggacacgtccaccaaacgcctgggcacgtctgcaatccacaaggcatggatgggtccaggactttgcattcctgctcaaactccgggaccaagcccttgggctagctggccttgggcagcatccgctctgcccagggcgccccaggaggcagcctgctcctgctcccccgtgtaaccccttggagatgctcgctggcatgcatgcttctcttaccacagggtggtgcatcgcatggcagaattgtatcactccgtcagagggacgttccacaaaattatactgtgtcaagaccgggtgcgtcagcaagtgtcagcaacgatgtttctttcttctcccccctcctcattgcgcacacttggagggggtgttcttcttcctccgattggggggcctggcgcccggggtcggagggggcgtggtggtggtctggggactgtcctcgccggtgccgttggcagagggctcctgggagggaggggttgaccatagacttgatgaggatcaggcgcacacccatgtcatgtgacggggcgcggcccctctaccactgcaatttcacagttgtgcagtaaccaacatcagaaatgcagatggtacttgcctgnnnnnnnnnnaccctccaccactgcaatctcacagttgtgcggtaactaacatcagaaatgcagatggtacttgcctggtctatgaccttggcctttgccgccttctgatgcttgcccgtgcctgtgccagtacggcaggggggtgggtgcatgacgggctagccaggaaccgcattgccgatggcctgcgcagtggaagacctataacatccatcgcacctggtggcctcccgggcttgcgctttgttggatatgagggcgctgagacctcgaaggccgacgccggatgagggtgctttcgcggccgtccacgtttgcgctgctcgggcggtggggccgtgaaggggccgtctgaaccattgccctccccctccacatctggttgcaggatgtgtggggtggtgtggccattgctgaccagcagctcggggagggggtgtttgcgaggacgaccaggaccccgcttcactgcgggttctacaaacatgagaatcaggctgactggatatgcattgcgggtcacacgcacgctaatttgtgttctgactaacggtcgaaaataaatttaattgttctacccctaagcaagtgcattgaggtgtgtgagccacggattgcggcttacgacagggatagatctggctccgccagagcaaatgatccgcaggaagaaaacgggaagcccctctccaaaccaagctgcgccaggcccgatacattcgagacatgcaccctagcagcgaaggccccatcacactatcgacagagtaaaatctaaaggactggacaatggagcttgatctgggcttgccctgggttgcgcccctcgtgtcggtcgtgctcgccatcacctttcttggggtgtggcgacgaggacgcgacattcctgcgctggacgtcagattggaaggcacgtctattattgtatgggttcaccgttgcgtgtattgatgcgtggaaacgaaatactgccgcnnnnnnnnnncattgaatgggttcaccattgcgtttattgatgcgtggaaacgaaatactgccgctcatatcgccgcagatgccgtgcgagacttgccacgcaaggcgtccagctcgcatcagatccggtgctacgaccctgccacactcgannnnnnnnnngcatgccatgagcgctgctgaggtgaggggtagcatgtattgagcaggaggctcacgcagaggtggggcaccttgaatgcagtgactgccgagggcccttgagcatcatgctttgtcaccatcactgacatgttatcactccaggtgcgagacatcatagcaaagacacgattggccagcaaggtgaggagcggtgtctgtcaagggtgcactacagcaattggagtctgagccaggccgtgctttggtactgcaacgnnnnnnnnnncgtctgtcaagggtacaatacagcaattggaatgtgagccaggccgtgctttggtactgcaacgcactaaatcatctgctcccctcccccaacgctttccaggattggaaaaagtccagctttgcacagcgccggatgctgctcaagatactgctcaagttcaccgtcgagaaccaggccgacatctgcaggtgccttgatgagcgagggaggggtttggatagtgtggagtcaaagtgatgccctgagactcagcaccgctgcagctccttgcactgccgtcgctcggtgatccagcgggggactgcacccgtcccgagtcacttgctcccccgcacgatctcagagtgtctgccctggactcgggcaagccactggtggatgcatcctttggggaggtcctgggtacctgcgaaaagatctggtggctcgtggcagagggcgagagatatctcaggcccgagcgtcgctcctctggctacatggtgaggaggttgaggaggggaggatgattgcgagaagaccagggattgcggggttctgcttgggggacccacggctggcaggcatgtggtgcctgctccccccacgcaatctcagcctgcacggtccaggtatcccaaccacccccgctccaaccacgatcctcgcccagatgttctacaagaaggcgcgcgtggaataccaccccgtgggcgtggtgggcaccatcgtgccctggaactaccccttccacaacatcctgaacccgctcaccgccgcggtctttgccggaaatggcgtcgtcatcaaggtgtgcgggagtgcgaggggtgtgggcagagccctggggtattcggggcgggacatctgggttcgagggggcactccgcctgccagtgccgcgcctgctttgtgtatgctgtggaaagagcggcagaggcctgccgtcttcatcggccagcctgtcacacatccacatcctggcacacacacaagctatgcctcaagtcggcattccaacctctcttnnnnnnnnnncgtcttcctcggccagcctgtcacacatccacatcctgtcacacacacaagccatgcctcaagtcggcattccaacctctcttcctcccccaaaggtctccgagcacgccacctggtcggccctggtataccagcgcgtgatcgacgccgcgctggcggccgcgggcgcgcccccggatctggtccgcatcgtgaccggcttcggcgaggccggcggcgcactggtcaccggcggcgtggacaagctcatcttcgtgggcagcactgccatcgggcacaaggtggagctgcgtgggggggcagaggttcctcgggccgttgacaaactcgcggccctcgtgatcctcttgtgcatctgccgaagcgccgaatgtcgcccccaccattcactcaggtgctggaggcggcggccaccaccctgacgccggtggtgctggagctgggcggaaaggacgccttcatcgtgctggaggacgccgaccttgccacggtgggtgaacaggaaggggggcccctccctagtccacgacaaacagtgggctgcgggtgcagggacggtggccgaccagccgagcccagccccaaggtcctctcttcacccagctgctcccccttccatcaggcatgctgggcccgtacatcccattgcacctccatctcaatgaaacaccggtggcccatcacacctgccctccctgccatgcaggtcacagccaccgccctgcgcggcgctttccagagctgcgggcagaactgcgcgggcgcggagcgcttcatcgtcgccgagcgggtgagcagtgagggggaggagaagtgtggagtgattgcgcaggttcacctgagtttggcgtctcggctaggtgtgttgggcagtcgtggcctgcataacaacggcttgcacagcaggaacccactccgtcgctctcctgccccccctcctcctgcagctgtttgaagagtttgtccagcgatgtgtggcagtcgctgggaagctgcgtcaaggccctgccgccggagagggtgtggtggactgcgggtccatgtgcatgccgggccaggcggagaaggtgcaggagctggttgatgatgcagtcgccaagggcgccaaggtgggctttggtgtgccatgctccctctgtgccgggcaggctctgagcggagcggggctcgcagtcctgcggggggggtgggatcccggggccgccccatcctgcatgcnnnnnnnnnnagtttcgcagtcctgcggggggtgggggatcccggggccgccccatcctgcatgcccctcccatcgatcccttctcgccctcgggtcgcgtggcctggggtcacgagcacgatcgccggctttgcacgccccccaccctccccgacgccaggtgttgatcggcgggcgcctgccggccacggggaagggccacttttacccgccgaccatcatcaccggtgtcgcacagggcatgcgcatctgggaggaggaggtctttggacccgtcatgtccggtgagtctgcctgctctcccctgggaagggtgttgtgaagagggggccatggcgctgtgcagtgcctgcccccgtgcaggcgtgcagtcacggccacgcgaggcagcgctccgtgccgaagcgagcaggcgctccactcgtcccatgacgaaagcgtccccacccacctcgcacgcaccaccccaccgnnnnnnnnnnacccaggccccgagcaggcgtgcattcacggccacgcgaggcagcgctccgtggcgaagcgagcaggcgccccgctcgtccgacgacgaaagcgtgcccacccacctcgcacgcaccaccccaccgcctttcccgtcggggtcccagtggtgagcttcaggagcgatgcagaggccgtgaccctggccaatgactgccccttcggcctggggtcggcggtgttctccagagacgtggcgcgtgcgaggcgcctcggcgcccaactggaggtgggtgcgacgctcttgcggggggtgggagtagcatgggtgtggccggtggggtcgagcgcgcctgggcccgcaatggagccaggcccccagctgcaccagacaagggtgtggatatgcggcaggctgtgctttccatggcccctggtgtgaccaggtgtttgaagcccacctcttggtcacccgacccggaaggttgtgggcaggcagcaactgctcccatcaaagtcacagatgcgccctgcccagaccctgcttcatctcctcacatccccacacccacaccccctccatcaactcaggcggggatgaccagcatcaacgactttgcgacgacatacatgtgccagagcctgccctttgggggcgtcaagcactccggcttcgaccgctttgctggggtggagggcctgcgcggcctctgcgtcccaaaggtgggattccgtgggtgtcagagtgtccgtggcggcacatgccatgctgagttggtgcagcggctaggannnnnnnnnnnnnnnnnnnnnnnnnnnnatcagttcatcgtccttccatcccactcccttgtggcacgcaggctgttgcagaagacatgtgnnnnnnnnnngaactgtccaaccgatggtctgctgggcagcagctgccatcgtgtccactggccaacgcatgtcgtcaattcatcgtccttccatccctctcccttttggcacgcaggctgttgcagaagacatgtggcctttcagcacggccatcccgccgcttctccaataccccgtcagcgaccgcgcattcgagttctgctctgctctggtctggatgttctacgcgccaacgattgctggtaatttatcgcgagggggctgccgggaggctgcaagaatgggcttgtccaagggagacccacaatgtcaacatgacctccatgcagggaacctgaaagggctttggagtctggcggcgtgcttccttcccaagcggggatcgaagaagccagcgcagaagaagtcgtcctgaatgtccccccatgtgaggacaatctagttgtgcgcagctgtcggggcatgccagatgcaaggttgcgatgctgccggcattgagacatgtgttcttcgtcgcaaagtcccacacagtgattctcgacatcatcaagagtgccatacctcggtacacacatcaactcaatttgacgagtgaaaaggtctccagggagggtgataccatatcgttgaggtgcttgcagccccgagacctactgccaagaatgtatgtgatcaattgcatacatcaccgttgccccacaccattgccaactcattcccgacattccgaatcagaacatctcgtccgtcagcctatcatcaaggagacatatcatttcgtcgttggatggaggctcttgttgttgcaaatatcaagtgtttcatcttgcagaactcctgtggagttcacatnnnnnnnnnntgtacttcgatacacacatcaactcagtttgacgagtgaaaaggtctccagggagggtgataccatatcgttgaggtgcttgcagccccgagacctactgccaagaatgtatgtgatcaattgcatacatcaccgttgccccacaccattgccaactctttcccgacattccgaatcagaacatctcttccgtcagcctatcatcaaggaaagatatcatttcgtcgttggatggaggctcctgttgttgcaaacatcaagtgctgcatcttgcagaactcctgtggagttcacatttttatcccccgctttaaagaaagtagggcacgctgccccacctaccaccatgagcccgcgcttttgcactggaggaaacgcgttccagaccgtgatgtccccttaggttaccgcagcttcaatgctgagaagtgggatacgttgcatacgagcgtttacatcactgcgcccaggtagagctcctggcgcatgctaccacgtgcggctagcacgccctgacacaagaataacatccggccgggaacgccggtgtcctccagcaagaggaaaccatcgggtgtttgtggccatggcgagccccgatgcgcccgtcaacgaggtcgaagccctccgcaaacagattgctgacctccaggtactataagtctagcgactcgggcctcgccaacaagctggtagcacgcatgaattattaggatctaaacatcatccaacattgctagcttcgaggttcggaggtggtcattaatcccgatcacggccacgccgcctccatgcaccttgctctcgaccccatcacagattcnnnnnnnnnnatgatctttaatcccgatcacggccacgccgcctccacgcaccttgctctcgaccccatcacagattcagctgaagcagaagactgcggccgagtctggcctgatagctccatactccaagtcatactcccgggtacccgtgcgatccgtgctgcaagccgatggcgagggcgcgtccctggccggccagaccctccgggttggtggctgggtgaagactggccgcgaggctggagccggagccttcgcattcctggagatcaacgatggcagctgctttgccaaccttcaggtcatggtggacaaggcggttgcggagagcgtaggaggcttggggcagctgacccccacctccacctgcgttctcatcgagggcatcctgtctgagacgcctccaggcaccaagcagaaggtttgccgggggtggtgttgagtttgtacgattgcttgcgttgagcagggaaggtctctgagattatctctgagatgttctcctgcagttggcccctcacctcaatccacatcaaggtcacaaggtgtgacaccatgcctcgcattcctcatccctgacttgccacgatacacacccttttcacctttgcgacggtagagagtggcggcctagcactgtgtcaggccggcgatatgccggcttggcatggccatgatggtctcctctagttaactgttgcacatcactccatgcgaccctttttaaaacaggcgttctcaaggctgcccagccccgttttggggccgggagtttggcctgcatggaactgcctgtgtcggaggggttgcacatcgtaaagtccatcctttgatagccttcaactgtgtctctgtcattcacggctcttttttcaatgtgtgtgcgtgtctgggctctcatcaaaatccatatctggccccaagcaaccccccccccccccccccccccnnnnnnnnnngttttttcaaagtgtgtgtgtgtctgggctctcatcaacatccatatctggccccaagcaaccctcttccctgccccaccccccccggttcattcaatcactcacccacacaacacccatccacccaggtggagctgaaggccagcaagatcgtgcacctgggcaccaccgacgcggccgagtacccgctggccaagaagaagcagtcctttgagttcctgcgcgagaaggcgcacctgcgcccgcgcaccaacaccatcggcgcggtggcgcgcatccgcaatgcgctggccactgccacgcacaccttcttccagtcgcacggcttcctgtacgtcaactgccccatcatcaccgcctccgactgcgagggcgcgggcgagatgttccaggtgaccacgctcctgtccggcgccgacggcgcggcggcctcccccgctgcgaccccggaagagctggaggcgttgagggcggaggtggcggcccagggcgaggccgtgaaggccgccaaggcggcggctgcggcagacaaggtgggttgggtgctggatttgggtggggggcctgaaatgggagggcagggttgannnnnnnnnnaggtcgggtgccggttatttgggggggcctgaaatgggagggcagggttgacgggacagtggctcccacagctttgtctccccaccaaggttgcagcaaacctcgacatgcaccaagcaacccccgaccctgcaggcggacaagtcgctggcggccgagtccaaggcccaggtcagcgccttgctggcgctgaagcagcggctggcgggcgcggaggagcgcgcgcggctggtgggcggcgtgccgcacacgccctccggcggcatcgactactccaaggactttttcggccgcgccgccttcctcaccgtctcctcccagctgaacgcggagtactacgcctgcgcgctgacgagcgtgtacaccttcggccccaccttccgcgcggagaacagccacaccgcgcgccacctggccgagttctggatgatcgagccggagctggccttcgccgacctggccgacgacatgcgctgcgcggaggactacgtccgcttctgctgccgctggctgctggaccacgccgcggaggacatggccttcatcgacgccgtgatcgacaagggcgcctccgagcggctgcgcgccgtggccgccgcgccgtttgcccgcgtgtcctacaccgaggccgtgcgggtgctggaggaggtggtggcgagcaagaagaagaagttcgagttccctgtgtcctggggcgtggacctgcaggtgtgtgtgtgtgtgggggggggggg

SEQ ID NO: 41753 - DNA, 61 bp, Chlorella protothecoides
cgagcacatcccattcccccgcccaaaccgcccccctcccaccttggaggacatgcggccg

SEQ ID NO: 41754 - DNA, 72 bp, Chlorella protothecoides
gttgggggtgtttgggtggcgaggccgaggtaggtccgaaagggggcagacgtagtcagacccagtatccca

SEQ ID NO: 41755 - DNA, 72 bp, Chlorella protothecoides
ggcggatgttcagcacgtactgcgcatgctaggccaggcgctggaggaactctgtcttgatgtagttcttgg

SEQ ID NO: 41756 - DNA, 84 bp, Chlorella protothecoides
gaagctggaccccgcccctcagccgctgccttcacccctttccccccccaaaaaaaccctccaccacaacctagggtgctgcct

SEQ ID NO: 41757 - DNA, 6787 bp, Chlorella protothecoides
  modified_base (87)..(96): a, c, t, g, unknown or other
  modified_base (436)..(445): a, c, t, g, unknown or other
  modified_base (1267)..(1276): a, c, t, g, unknown or other
  modified_base (2798)..(2807): a, c, t, g, unknown or other
  modified_base (3060)..(3069): a, c, t, g, unknown or other
  modified_base (3340)..(3349): a, c, t, g, unknown or other
  modified_base (3768)..(3777): a, c, t, g, unknown or other
  modified_base (4076)..(4085): a, c, t, g, unknown or other
  modified_base (4594)..(4603): a, c, t, g, unknown or other
  modified_base (4773)..(4782): a, c, t, g, unknown or other
  modified_base (5154)..(5163): a, c, t, g, unknown or other
  modified_base (5507)..(5516): a, c, t, g, unknown or other
  modified_base (5934)..(5943): a, c, t, g, unknown or other
  modified_base (6410)..(6419): a, c, t, g, unknown or other
acgagggtcgccggggcggggtggggctgaccggggggcgcgcgtgcgccgtctgattgggcggagggcgcccgtgcgccgccggcnnnnnnnnnncggagcgcgcctcgccgtgcggggccttggcgggcggggcctcgccgtgacgtgtccgctccagggtggcctgaacgagggtcgccggggcggggtggggctgatgggggggcgcgcgcgcgccgtctggttgggcggagggcgcccgtgcgccgccggctccgacggggggcgcacctgcgtgatggacccatgcggctgccgcgcccgcgtcctctgcccacgcgtccgctgccgctgagtcttctgctcgcgcacgcgcaaatcgatgcgacggcacgggcaccgagtgaggcggggcgggcttcccgacggcctcctcctccttcagaggcggcgnnnnnnnnnntgccgctgccgctgggccctctgctcgcgcatgcgcagatcgatgcgacggcacgggcaccgagcgaggcggggcgggcttctcgacggcctcctcctccttcagaggcggcgagcaggtggctaggcccagggccaggcgctgagcgcaggcgtggacgttggcggcgcaggcgaagccggagatgagggcgccgtgcatcgtggcggggtacttgcggttggtcgcctcgcccgagaagaacaccttcgggtatcaagccaggcgggagggagggatggtgagcaggggggagagagatgagattgcgcagccgtggcggctggaagactctgtgcccagtgcagcggggctgggcctggcgctggaggtggccctccgcggtagctaacaagctgctgtgcagccgcctctacccccatcagatgaccaaaccagctccgcacccgccttcccctccccctccccgcccaccgcccactgccccagtctcaccctgccccccaggttctccgccaggatgtcatagtcggcaccgcccagcgcgccgacagagagggaggagtaggagccgcggcacatggggtcggagccccagcgcgtgaccccggcctggaggggcgccgggacgcgaatgccccgcggctcaaacagcgcgcgcagcgtgcccatgactcgcgaggtggccaccgtggcggtcagcgtctcgtactcagctgcggcggcacctgtgggggagggatttggagtggggatttgaggcgcgagaacagggctggggtggagggattccgggcgacgtcagggagtgcttgatatttnnnnnnnnnnggctgcggcggcgcctgtgggggagggatttggagtggggatgtgaggcgcgaaaacagggctggagtggagggatgccgggcgacgtcagggagtgcttgatatttagaaccctgggcaccctcttgatgatcagccagggccccatgtaggtggggccacctcccttgggtggccccatcgatgcacctgccacgagggcgaccaggacggcgccgccggacagcacgtcggcggagtagaagaggaaggagtcgccgcggtggtcgggggagggcgtggcgcggccaaacatgtccagctccccgccccagaacgcgtgggggaagaggaggaccaccttgttcagcgtcccaaagttgatgcgcgccaccgcgcccagcttgcgcggcgtcagcgccggcctgaactccacatccccggccttcaggcagcccaggggcacggtgaccacggcggcatccgcccggaaggtgttccgcggcgtgtgcacctccaccccccgcgccccgtagtgcacggcgcgggcgggggagttatagtagatcaccaggtcgcgggccagctcgcgcacccagcgcgcgttgccgccggggacaaaggtgtgcgccccgggcagctcgttcgggtcgtcctggtcccagtggcgcagggacaggctgtccagccgctccgagttggcaaactccaggttggccaggtgccactcgaacagctgccgcgcctgggccaggtctgcggccgaggccagtcccaggcggggcaggtgctcggtccacagggcctccagggtctggcccaggggctggtcgccgccggcggcgcccagccgctcccggatctggtggcactcgtccagcaggaagttgtggtgggcctccaccttgggggttgacaaggtatgggggtccgagtgagggtggaagagggaatgcatgtcccacgtcgcatgcgtggaaggcatggagagctgtcttcccacccgcctgtcctctcgaggaacagagacccatcaccagtccggcctcgaggatggtcccaggcatgccgggcaggggtgaatctccatccgatgaaagtctctggctgtccccactgaccttttcgtcgagggttttattggcctccacccccccttcgaggtagatcggtgtgtgcgtgcggatggtcgccatggggatgcccagctgcgtggcgatgatggccgctgggttgccatccacccccgtgatgatggaggcgcccagctccccaaccgccgccacaccgccgggaccctgcaagcaggcggaagaggggggctcgccctccgtcgggaggtagcagggcggtacgccgcgccatcgcccatgctccagagcagtgggaccccaggcgtggatggaaacaaaggcagatgtcaccgtccaggtccactccatccgccagcctttgcactttcagcgtggacaccaggaacttgccactccggcgcccaccctcctgcaccaccgaccccgctcacctccaggcgcagagtatnnnnnnnnnncacagtccaggtcgactccattcgctagcctttgcactttcagcatggacaccaggaacatgccactccggcgcccaccctcctgcaccaacgaccccgctcacctccaggcgcagagtatgcacgcggccgccgggcctgttgcggccctccagaaccaccacccggtagccaaaggtgcgcagctgccgggcagctgccagccctgcacaccccgcgccaatcaccaccacggacccgcgcgcgtcggtgnnnnnnnnnncgcgcagctgccgggcagctgccagccccgcgcaccccgcgccgatcaccaccacggacccgcgcgcgtcggtggtggcccgcatgcgcgcagacaccgccggcgacacgccaaagttgatgtagcccttgactgcgatgaccgtgggaaaggtgacagaaggcattggttgtttggggttgtcaggccatggagagagacaggggaatgtcccctatgtcaatcagtcgcaatggcaaagaggtgttttccagccatcacccctccagannnnnnnnnnagaatgtcccctttgtcaatcagtcgcaatggcgaggaggtgttttccagccatcacccctccagagttccaccatccctcccccaccccctgggcctcttcagcctcatgaacacagtcactacaatcgccaaagcctacgtgtgaggaatttccaggctagcagggccgctgctcgctcaggttctgcaacgctggccaccaccgattcctggtcacagtagcgccccacatttttcctccagcgattgaggatgcggttgcgcaggcgcacatacagcgtcctgttcatgccgggggccaggatcccttgctcctcctccgacagcccagtggcattcagcccagcctggcatggcacagaggttaaagaagggatggaactgggatggctcaggctcggcagaggactgccaaannnnnnnnnnatcatgccggggggcaggatcccttgctcctcctctgacagcccagtggcattcagtccggcctggcatggcacagaggatggagaagggatgaaactggaatggctcaggctcggcagaggactgccaaatggcctatgctgcacatgatttgagccttgcaccgtggctctgctgcacacccttcactcgatcgcctcccagtgagcacaccataccaaacattcagtcatatacccccctgtgggccagggtatcacccagccatcctcgatcactgcaacaccactccgccaccnnnnnnnnnnacctatgctgcatatgattcgagccttgcgtcgtggctctgctgcacacccttcgctcgatcgcctcccagggagcacaacataccaaacattcagtcatatacccccttgtgggccaggatatcacccagccaccctcgatcactgcaacaccactccgccacccagcaccagacactcaccgaccaggccgtgtctccccgccgcccgctgggcccctcccccatgcgctccgagtcggagtccacctccgtgctgcccccgctgctgctgctgctggcggactccgacccgctgctgctgctctcgctggaggaggaggaggacagcgtgctcaggtgcagcaccgccagcgactgggcggcggcggtgcgtcgccgcttggggcgatcgtcggactccggcccgggcagggttcccatgcccaggcgcgagggcgtgcgtttggactgggcgacggccgcgggcgccatagagcctgagcaccgccggcctggagccgcagcagnnnnnnnnnngctgggcgccggccgagggcgccatagggtctgagcaccgccggcctggagccgcagcaggaagctggattggccgctctaaggacggagggaagggttctgggaccggaggacggcagacgggggtggatcggtatttcgacggtccccggtgacaagcgggcgggtcnnnnnnnnnngggacggagggaagggttctgggaccggagaatggcagacgggggtggatcggtattccgacggtccccggtgacaagcgggcgggtcgagtgtatgggaagtaatgaagtgatttcaagtttccgagaaaggccggaactcggcagagcgaggcatgttgagcttccctgtgattgaggggtgaagatagtgatgaaatgcagactgtggagggggaggcattgtgtccttgtgcaatgaatgcaggagccgaagtgggcgaaagcctggccctcggtagattcaggactcggaatggcagcctcttgaatgaagcgcaatgagcaagcagctcccacacccgaccaagcgctccctatactctcaacatnnnnnnnnnnttcggtagattcaggactcggaatgtgagcctcttgaatgaagcgcagtgagcaagcagctcccacatccgaccaagcgctccctatactctcaacatggccaacattcgatagcttggcctcgttctgccggcgctgaggagtattcggcccgaatcgtcaagacacccacaattataactcacccagcaccccagtcctcttctcagctcctttcctggggtcttgcacggcatgcacgagtccgaggggttgatcttggcttcaaatggaaactcggcccgacctccaagcaatcacagaaccgtatcgattgtctgtgtttggaatgaagggggtggcannnnnnnnnnagcatgcacgagtccgaggggttgatctcggcttcaaatgaaaactcggtccaacctccaagcaatcacagaaccgtgtcgtttgtctgtgtttggaatgaagggggtggcaacataccttggaaagcacgaagatccaccgtacgcgcgcccagacgaccaggcgccattcggcttgcacttctgccaccagggtgtaggaagcccttgcatgtacattcatacctctggtatatgtggcacaaaagtatatagcgaagtgttcttctcgcctgctcctggaatgctatcactgcatttcaccgttacatatcggcttgcccccgcgaggcttctgagcttgctgccgaaggataagcgaatttagaggctcatcggtctgaattccgacctggcgtccgctacctgctcctcgtgnnnnnnnnnngcccgcgaggcttctgagcttgctgccaaaggataaacgaatttagaggcttatcggtctgaatttcgacctggcgtccgctacctgctcctcgtgacgcgcagcagtcgggccgtcgaggaggagaccccagggcgtgcggcaggcgatgaaggtgaaggtaatcaacaggagcgaggaggcgtgcacccgcacccggtcgcaggatgtgctcaaggtgcaccgcaacctcgacccggccctgcacccctttgagaaagccaaggagtacacgagggccctgaatgccggtgaggaccttcgtggggtggtgttggaggaggatgctgagactggaatgtggacttcccatcacctttgccttcccaaggtcactccccatgagcgtctacgcaccctggctgacctctgtcccccccccattccgaaacaacactcgacatcaccaccccgaccctgcagccaannnnnnnnnntttcccatcacctttgcctttccaaggtcgctccccatgagcatctacgcaccctggccgacctatgttcccccccattccgaaacaacaatcgacatcaccaccccgaccctgcagccaagctggaccggctgtttgcgcgccccttcctggcggccttcccccacaccgacggcatcacctgcctcgcccgctcccccgcccgcctcaactgcctgctgtccggcaccgccgacggcgaggtccggctctgggacgtggccgcgcggcgctgcctgcgccgcctggtgggccacgccggcgccgtcaccggtgtggcggtggccccctccggcgacgtcgccgtgtccgccggcgccgacggcacc

SEQ ID NO: 41758 - DNA, 63 bp, Chlorella protothecoides
atttggcgacctcgcgaggcagccagcagaaaagcgggcaccgatgcaagggcagcgttcgcg

SEQ ID NO: 41759 - DNA, 61 bp, Chlorella protothecoides
aaacacacggacggcaggaagaggggcaggggcccaccacgagggaagacagccaggggta

SEQ ID NO: 41760 - DNA, 79 bp, Chlorella protothecoides
ctggatccccagcgggaagcaggcggaggaagtgtatgcgcggtcgcccacctgctccgactcgtcctcggcgtcccac

SEQ ID NO: 41761 - DNA, 539 bp, Chlorella protothecoides
  modified_base (237)..(246): a, c, t, g, unknown or other
ggagggggggggaggggttaggggagggccactgcgggcgccccgtgctgccaggcagggcctggggcctcctctgcgtccctgcacccggcgccgggaaccccggattcaggtccacctccttccacccagcaccccgcgccccggagggcgtgggggcccgggtccctgccccgatgcaagcgcacgggagacgtccgcctcatccccatgccccccgctccccactcccagggnnnnnnnnnncgtgggcccgggtccctgccccgatgccagcgcacgggtgacgcccgcctcaaccccatgccccccgctccccactcccagggtggcgtgctgcagcggcccgggcacaccgaggcgggcgtggacctgaccctcctggcgggctgcttccccgccggcgcgctggcggaggtggtgaacgacgacgaggatgggaccatggcccgcgcgccgcagctggcggagtttgccgcgcgccacggcctgctgcgcatcaccatcgccgacctggtgcggtaccgcctgcgccacgg

SEQ ID NO: 41762 - DNA, 61 bp, Chlorella protothecoides
tgctggggtcagggcaggagtggtgggaggtgcaggcccaggctccaaagcgtcaggaggc

SEQ ID NO: 41763 - DNA, 76 bp, Chlorella protothecoides
ttgcaaacaatgcgcggcgtgcccccgctattcgaacccccagagggccccttcaccagggccgacatagtagttg

SEQ ID NO: 41764 - DNA, 1033 bp, Chlorella protothecoides
  modified_base (213)..(222): a, c, t, g, unknown or other
  modified_base (379)..(388): a, c, t, g, unknown or other
cccgcccccccccgccctccatccttgccctctcagggagggctgcgccccgcaccgcgtccccgatcaggcgcagtacaggcccttctcgatggcgggggggatgggcttgatttccgtccccagctcctgctcgatgcggtacctgcacgggcgggtgggtgagtggcagcggggggggggggcgcggggggggggggggggggggggggnnnnnnnnnncgagcatcccccagtgcagtccaggactgtcagagggacaacccgagctcttgcactgtcatggttaccagacgcccggcctctgttacccccaattctcccgggacccctccatcttcccgaacaccccccccccccccccgggcccccccccccnnnnnnnnnntgagcatcccccagcgcagtccgggactgtcagggggacaatccgagctcttgcactgtcatggataccagacgcccggcctctgttacccccaatcctcccgggacccctccatctacccgacccaccccccctcccccggttcctctccacgcacaggctgaagcggtcgtcgtaggtgatgaggttgatggccaggcccaggtggccaaagcgcccgctgcgccccacgcgatgcaggtaggtctccgcgttcttggggaagtcaaagttgatgacgacgttgacggcctggatgtcaatgccgcgggtgaagaggtcggaggagaccaggttgcgacagttgccattgcggaagtcgtggaacacgcggttgcggtggctctgcagcatcttggcgtggatgtagaagcaggagtagcccagctccgtgatcttcttggccagcagctccaccctgggagagggagagggaggggtgggcgggggcaaggtgggtctgtcagggcggtcaagaatgctgttcctcacctcacagtggagagcatacaacacgggaaagcccaggtcgcctgctcccaaaaggcgcccgcactctcactatcgccaactctcccccgccctcccccccccagccctcccttc

SEQ ID NO: 41765 - DNA, 61 bp, Chlorella protothecoides
ccggcgcccacagcatgatgtctggcctcgtcagcgtccccaacgcgcccagcatgatgta

SEQ ID NO: 41766 - DNA, 70 bp, Chlorella protothecoides
tgagcgcctggtctcagcccagcggtcacccctgcctccccagcgtacggccgtggcgccgagccaggaa

SEQ ID NO: 41767 - DNA, 18139 bp, Chlorella protothecoides
  modified_base (653)..(662): a, c, t, g, unknown or other
  modified_base (1438)..(1447): a, c, t, g, unknown or other
  modified_base (1771)..(1780): a, c, t, g, unknown or other
  modified_base (4519)..(4528): a, c, t, g, unknown or other
  modified_base (5032)..(5041): a, c, t, g, unknown or other
  modified_base (5614)..(5623): a, c, t, g, unknown or other
  modified_base (6083)..(6092): a, c, t, g, unknown or other
  modified_base (7069)..(7078): a, c, t, g, unknown or other
  modified_base (7261)..(7270): a, c, t, g, unknown or other
  modified_base (9962)..(9971): a, c, t, g, unknown or other
  modified_base (10327)..(10336): a, c, t, g, unknown or other
  modified_base (11866)..(11875): a, c, t, g, unknown or other
  modified_base (13865)..(13874): a, c, t, g, unknown or other
  modified_base (15128)..(15137): a, c, t, g, unknown or other
  modified_base (16823)..(16967): a, c, t, g, unknown or other
  modified_base (17194)..(17228): a, c, t, g, unknown or other
  modified_base (17820)..(17829): a, c, t, g, unknown or other
gcgcagggcgtgctggccgcgctggcgccgcacctggcggccatcgcagcctcgcccgcggcggagctgccggggccgaaagccgcgccggggagggggccgggcggcgccgcgctcaccgccgtggacgacaggctgtacgcctttgaggcggccgggctgctcctgggccaggaggagatggaggcgggggagcaggccgcctggctggccgccgtgctgcagcccctcacgcggcaggtgagatctgtagattctgggtttatgcttttgggagggagggtgtagtttgtggaagggaaaagaggactgtggttcagtctgaggcttagatgccggtttgggggggagttggtccttcatggactcctccttgtcagcggggttttgccgggaggggacccacccccacgttcgcttcacaacctgtacccgcgaaaatctggaatttccatcaagacgcacgagatgcggcgcgagtttgtcagctgcaggtcaacggttcgagcccgtttggggccaggcacaatgtttccggccccatagctcagttggttagagcggcagtctaatacttcttctttttgttttttctttgtataagcctctcatcatttcccccgttcaaacccacagatcgaggaggcgctggnnnnnnnnnnattttcctttttcctttgtataagcgtctcatcattacccctgttcaaacccacagatcgaggaggcgctgggggagggccagggcccgagcaacgggtcagctgccctggtgccaccggcgctcatggtgcagcaggcgctggagggcatcacccgcgtggccaagggattctccttgcgcctctgcaccgagctgcgccccgccctgggtgctgagttcacgagtgagcgccaacaggggggtgggaagggaagtagacggggttgcgcagggctgttatgtctatgcgccctgacaaggataccctggcagggccccttcactcggcttgggaacgccgtccctagccccaccgatcctattcatccaggcccatctcagccctcctcacaccccgccctcccactcgcacaggggctctgcgctgcgccatccaggtgccgcgccggctgcccggccaccgcgcgctgcgcgcgcgcctgctttcctttctccaccgcatggtggagacgctggggcccgcctccctgcccttcatgcccgaggtgctgcaggcgttggtgcgcgagggagctgacgcctgcgagctggccgacgccctgatcctcctgaaccagctcatgtcgcggttccgggacggcatggcgcccctgattcgggtgagcgcggctggtgcctttcgtattttgtgtggggaggactgcgttttcccgagggggggatattttgtggggaggcctggcctggggtatgtcacacaggctgtggctgggnnnnnnnnnnctgtgtggggaggactgcatttccccagggggggggatttgtgcggaggcctggcctggggtatggcgcacaggctgtggctgggggggctgtggggtggctggatgcagctgccattccgcggccagcagctcctgatgatgcgaggagggtggggaggaagtggtgcagggaatgaccttgatgttggcctgcatgctccccatgatgtggccccgcttgcactcctagccatcccttgaatgctctccgatcagcgtccccaccccccccaccatccctccaaccccactacattctttccaggacatcctgccggtcctnnnnnnnnnncccccccgtgatgtggccccgcttgcactcctagtcatcccttgaatgctctccgaccagcgtccccatcccccccaccatccctgcaaccccaccacattctttccaggacatcctgccggtcctgctttcttgtgtgcatgccgtgctggggcccgactgggactggtctggtgcggctgtccccggctcgccccccgccgcgtctgccgagacggcccgggagaaggaggagctgcagcgcgccttcttcgcctgcctgctctgcgtcgccacgatgggcctggcggaccagctgctcgcggctgggtctgccacactggacggcgcgctggggcccctccttcaggtgaggtggacgaggaggggtgttgttggggataggaggaaagcgtgggaaagctggcgatgcaccatgggcaaccttcccctggactgtggggcctgagttgccaaagttccatgggcttcaaataaagttggaatcctccgatagatatcggcacatgcaacggaccccctttaaaaaccttgcaggctggtggaggccacacggacgtcaccgtcaggaagacctgcatacaggaaagccgggaaggagcctgtcgttgccagctgtgcagcgtcctgtgcaccttgacccccgcagagatgggcacctgttgttgctgtgagcctgagtctggccttattctcatgcagaaactaccacaccctcgcagaccctgcatcgcctgctgagcgtctggatggagcccagcaaggagtccggcgccgccatcaccacctttgccgtcgagaaggtgaggcacgggcctgagcgtggacagacctggctcgcactgcgtgcctctagactgacccgctgcactccttcctggttccaagcttgcacccaggcccccctttctctacaccctgctctgcagtttgctggggaggtatgcctgcggtgcatgcttggggggcagtctcgacttgaccctggagacgcatcctccatcggactgctggccgaggcggcggcaggcctgcgactggtggacgagcacgcgcgggaggaactagcccggcacctcctcaggcatgggctggatagcgggagtgttttcctgggttggacagtggtggatgttcacggtctggcctccgagcgccgctcgccatgttctccgggagccagaccgcccccgctctcagtgcccgctgcagcgcgcctgggtccattctgcagcatgctgcagcccacagcactttcattcgatcatcatatgggagcaataccttcatcatcccccacacacaccgcagttcggtccttccaaaccagctgggctggccggcggcggcttccacccagctcctgcagctcatcgccgacggcgaccataaggtcctacgcgatttcctgaggcaggcgctgcagcagcagccccggcctgcggccgccaagctggactgagcggcatggatggtgcaagtctggcactggacccacacgctgcttcccactttggtctactctgtttgctgagtgcctctttcgtcaccgtgctgtcagttgcaatgtacactgcgcaatgcactcccaacaccaccgaggccccatacgtagtgccttgggtgcctccaaaatatgggaggagctccctgcagtgcgccgagcaccccgcctgcaaatgcgcagacggtggctcgggggccgcgtgatgtcagcccggcacggccggactgatgacgaagctcgacgcacccatccaccagctgcatcaggccggggcgtcgtccaggtagctctgaacgggcgccgggtcgtagcggcagatgcagtcgtacaccttcccgccgaacagccgctccgcgaggtgagcgtttttgagcatggccagcttcagggcggcgcagcggaagcgggtgtggtagttggtgtgcagcgccctccccatgccctcgatcaccaccaggtctgcgcccaccgccgcctcggccacttcggccgacacgcggcgcagatccaggcagggcgagccatgcccgctgctcacgatgtacaacctggaaagggggggagggaagaggcgaagggtttggggatgttggacgatcagcgagagacggtgctcaccatgtgacgcgggtcgcaggatcagtcaccaacggtgtcctctgtcccctccttctctaccaaacgcggccccagcgagcagttaaggaagagcacatcgacacggccatcacccaccgcggatccttccacagggaagggtatgactccccaaacatgcccttgcgcgccgcagtggtgggggtctccggctggtcctcaaaatccgtggcgtgaggcagcagccggcgcgggctagggttggtacggaccacgggccgcgccacggtggcgtgccccgactggcccctggccaccggcagctcctgcgccatggaggactccgggagggcgccggcgacgggtgggatgtggccgccggcggccgccagggtggacaccgcggcgtccctggccgcccgaatgatggggcaggtctcggcagcccgggccaccacgcccctcagctctgcggcagtgatgtcgttgatggcaggcagcgcattggccaccatgatgacctggcagcgggggggaaagtgagggagaagcgagatcgtcgtgcgcgtgagaaagtgaaacctggggcatgacacacgttgcacgtgtcgcgaatgcacggtgcacccctggcnnnnnnnnnnaaagtgaaggagaagcgaggtcgtcgtgcgcgtgagaaagtgggacctggggcatgacacacgttgctcgtgtcgcgaatgcacggtgcacccctggcaccgccggggatgctccccacctctgcgcccagacgcaggaactcccgtgccaggggaatcatgccgaggacgatgtcggcgccagcgttgtccacaaacatcagcacacgcttgaaagggggtgagctcttgggggctgcaggtgtggcaatggggtgcaaaggttgaggaggggaagtggtggtagcacagatgccttcttgctgctgctgctcctgcatgcgcgggagcgccatgtttcgatgatgacagtgctttgtgtactccagtagacccacccctgacgaggcctgcttcatctgaccttgatgcagccaggtaagaaccaaaccaggcccttgccgcacccctagctcaccggctcccccctggtcgccgtctccgacgtcggaggccgcgctggtnnnnnnnnnncaccaggcccttgccgcaccccagctcaccggctcccccccagtggccgtctccgacgtcggaggccgcgctggtgctgaaccaggcggcagcaaaggcgtcatagttgtccacgtgccacggccgctgactcagcttagtgcgggcctggaagggcagatggggcgtgaagaagatcgatgggctacggcccccagagggctgccgtgccagtcagagccgggcatcgacggcatgactctgtgttgtagtcccgatgcatgacatcgtcttgcatgcacttccatacacaccatcacagctcaatgcatgctttcgattccgatggacccaagcctctgacctgtcggtacatctccaggatcgtggcattctggtacaggtcgacgcaggccttggctccccagtcaaagatgttggccgccagggatccctgggaggggtgggggggcgaacgagtttgtgtgagggccgcatgcatgctcgcatcttcaccatgaagatgagatggttgtgtacagagcatgacataaaaacatccctgcaatgcgtcataccaaggaagcgccctgnnnnnnnnnnatcatcatgaagatgagatgattgtgtacagagcatgacataaaaacatccttgcaatgcgtcataccaaggaagcgccctgatgagaaagctcctcaccctcagcatcctcgacaccctgctacccacctgaatcagggccaggagtcgctcagggccgtccagcttgtccacctcatccaggaggtctggcagggcctccagggctgcagcattctcccgctccttatccatcctgttggccagagttcatgaggttgtgttcggagtgggacttggttgcgcctcggcaagacactacatgcgtggattacactttaagcgctgacgctatatgatatccatcaaaatgttgcccccctcgcccccaagacatctccccaacccacatttcctcaaaaccccaaccccaggcaaaaagtcgccgcaaccctgcccgcacacctgtagacgtcctcgnnnnnnnnnnatcctcaaaccccaaccccaggcaaaaagccgtcgcgaccctgcccgcacacctgtagacgtcctcgaacccaaactctcgcaggcactcctcccgcagctcaaacaggtcggccagtcccagttggccgtatgcccccggctcggcgctcagccgccggaggtgcatgtccagcacccgtccaaaggtcgaagcccttcgcagagagtctgggttagaggcgtggatgggaagggttgctccgggaccgtcgttgtttttgtggccgggacctgccagcccatctgtaggcctgaccagggtcgcacatgtagattccgtagcaggtgtccacggtcaccaccccaccacccacctgaggtgttgccctcgctggcggcagccttctcgacgacggtggggatgccctgcatcaggacctcgatccagtacgacatttcctcagggtcattgttgatgtctgtggtgctgggatcatactgcagcggagagggacagaggaggacttggctgcatgaaaggaagtctgtcaagggcaagggtattcctcatcttgggttcacgagctcatgctcaggatgctgggccaggtctggagaaatcctgaccagctgtgagttgcacgcaggctgagaagggcaatgtcgagctgccactcagccacagccctgtaaccccccccgggtgacccacccattcaccttgatccgggggtccagcagggggaaaggctgggaggagggggtgtactgcagcacgcccacattcaggctgatgtggggctgactccccagccgcgacagcagtgcctcgctgttttggggactctcccgtgacagcagcttgttggaagaacggccggagcgatacaggcgaggctgttggagggccctggaagagagacattgagaggttgtactcagttgatggtgggagggagcacacgtggctgcttgcaatggagatgcatgcgcacnnnnnnnnnncaagaggttgtattcagttgatggtgggagggagcacacctggctgcttgcaatggagatgcatgcgcactgtgagccatgatgtcagcgcaaacaacctccagccccctccacccctcggccgcaaagagttccccatcttgtgcccgactcgccggcagaaatccctcgctcccccccccnnnnnnnnnntccccctccacccctcggccgcaaagtgttccccattttgtgcccggctcgccggcagaaatccctcgctcccccactccccctcccccgccgcctcactgctcatgctctgttttggcggtttccgtgatgggctgtgcggccgcaatgaacttctccacccatgtgaccttgtcagataggctgccgatggccggacctcgaacctcgccgcccgtgacgggcgcacccaccgtgaatctctcaacgaagcaggcctgggcctgcatgggcgggcacatgagtgcggattctggaggttgaaaggtggaatcaccgacccacacacagccacaagagacgacgtagggtgtgcctgtgtgtgcacatggcaatggggcatggcaagagcatcccaagagtgcaaattccatggccagccaggatgagcccctgtaccacactgtcaaactcccaacccccctctcactcccaccctttcctcacctcgctcgcgctggcggagccgtcgaaaatctgcaggctggggaccttcaggtaggcgcccacggcccccaggaagccctcgtgacgcaggaacttggcgctcatctcgcccttggaccagaactggatggcaaaggagattgtgtccatcgtgtaggggtggccccggatgaagaagccgccaaaatagatgcgcggcaggttgtacctgggtggggcggggtggaggagagggagagagtgagggaaagcggcttgggcagttgctggtgacatgcagtgaacgtatagagtggtattcgagtgaggaaagagtggaggtgaacctagacaaaggcacgccagctgccggcaagacacatgaagccttgcatcctctagagtgtattaccccacccacccagtgtgacgcaccgcttggcgttcagataagccagctgccctatgttgtaggagatcatgcgacacagggacatggctatgtctgctgggttatagtcggatggctcctgcaagcaaaaggggcagcacagaggacggaaacggctgggtcactaatgcaggtgcatgacaggccatctaggggtgcccacctcagtcattcaggcagagcacaccagcacatagctagggagggaaccagcacaaagtcacggacgtgaggcttcctgctcttgcaagctcagcagagtacacgagcagcggtggtcctgcagcccgcagcagaagaatgcaggaacccccactcaccatgctggtgttgatgactttgccaaaggacgatgcaatcgtgttggccgacaggccgatgccagtgtagtcccgccccccgtagatgtcgcccaccagcatgtccacctgtcgcagtgtttcgagccggaggggtgggtcgtgctgattgttcccacgctggtttgggcatgactaccccaccttgggcctgaggggggccaaacaccttggatggcaggcaacaggcccccagcaccctgtgcaatggctggctcagcagcatcgatcacagtcctcacattggagttgtcgccctggctggaaagggtgaggatgtcgtcgaaattgttgaccccagtcagcaaccggcacaggccccagaaggtacctcccccgacgtttgtccctgggcaggggtcggggacaagcaatgggggacccgcaaaggtgggcagctggagggagatgcgcacctgggacgcagcatgtgcaggcattcgctggtgctggaatatccttccctctcaacataatgaaactgcaagcagccgctgaagccgccctcagcagcaccttgagcgcctgtgctcacctgacactcgggtgtacttgccctcgccatccactttgaccatgctcacgccactcccgatgttgacgaggaggtagggatacaggtctgcggcacgttgtgtgagttctgtgtcgaaaactgcagtgcacatgcaagcatggccaaggcggcacccaacccattgacccgtactcatcacctgggccggtctcctcaaagatcatctgctggttttcgtacatgaacgcctcgtgccgcactgcggagtggagtggagagctcggaacggtcttggcgccgatggggcatactcataggctgcagactgatcaatggcgggtcctctcgaaccccatgcaccgatgcatgcagacttgaggctcaacagcgagctgtgtcacctgctttcagtagaaagttgcagccctccaccaggcagctcatctcgtcttctcgctccaggatcaaacccagtcgctccttgaatctctgtaggagaagaatagcttggaggtatctgagaaggtgctgccacgcataagcatcacatgctgggaatctattagggttgatagtccatgcatgcccaaccagaagccagcagcctcaacttccaggatccaggtttgctccatcctcaatgcaccctctgaatgaacactctacctctgcatacttgaaggccccccctcctgtggccttcaccctcatgggctcattgccgccattggagcggtgcaggcgtttggcctccatgaagtccatgcactcctcaatctttgagctttcaaattttacgaagtgcagcttgcctggggtggggattgagcaggctttgttataggccaccaggatcagaagaaggcaggaaatgcagccagttgctgcatatccctcgannnnnnnnnngttgagcaggctttgtcacaggccaccaggatcagaagaaggcagaaaatgcagccagttgctgcatatccctcgactcctgccatgccgagggcgcagttgccgactcagcgtgcaaattgcataacaccatcccacatctgtgtccatgtcgcctggaatgcatccaatcatggttctcacccccagcgctactgctggcgtctgagctccctttggtgaagtagacaagcttgatgagggagccgcctgcgatcagagcaccgcaggatcgaggtttattcgactggcctgccgaataccctcttggagtggcacaccagctagcaaggccatgcacctgcaagaagaaaccnnnnnnnnnnatcgcctggcctgccaaacaccccttttggagtcgcgcaccagcgagcaaggccatgcacctgcaagaagaaacccttgaaatacacaatgatgagtcaaaatcgcaggggccctacctatgtccagcgcaatgtggcccacatactcattctgatgaggcaggaggatcaggggagcgtcccgtcgcctttgggtccctgatatggtatgggttcccaggtgggaaggaggcacggatgggtactccagcagcagggatccaaggtcaaggcgcaggcagcatgcattgcgcatgtgcctggcagcctcgtccgcaggctggatgatattaattcgcagcacacctgactcagcgctgggcgcttcctggctgatgcaagcatccgtgaggtccagggtggaaggggaggcagtcttcatgccaacctgggcctcgtgcccttcctccacaagcgcagactgcagggacatagcaccactcggtcccgagattcccacgatagtgtggaagattgctggtaggatcacggtcgttatgtgcccggcagctatgttgagctcgtggccatccgcagggcgtggcctcgctgacacggaagacaaataattaatcgacaatttaatgggcgttcgtgatagatgtcttacggtcgtggatccacccaaaccggtttcccaggcatggtgcgcttgcgttggagtggagtccacgtcggacattctgtgtccgggagtgttcataattcctttccacggcagagattgagcaccttcacaggaccattccctgggttaagaacacccactgggatcccaatacatttgctcatcgcgcacttggagaaatatctcagccgggcctgctttccgggaccctgtcaccctcgacgggtaagggttgcgacccagcctcttcctcacacaactgcctccaagaggaagtaaataagataacttgaacctcaaaagcttgttcccgcttcgctcgagccctgaggctgttcgggaggcagtggcgttaccagcggagccacaatgacaggcaaggagtcggtctacgacgacctgggtggtgctcatccgcatgcggcgtcgaaattcacgctctttcgtcaccaccccttccgtctactcctgcctcagtgcgaccacctccaccgaaaccgtgggagcgaaaggctggcgtgacctcggctgagggcggggctcccaagccttgggacaagcccctcggcgccgagaccacggtcgtctccgcttccggtgaggtgtctactgcagctccgggcagcagcacactccccggcgtgggcgcccctcccgcccgaccttgggaagccccgtcctcgggacccgtgtccaccagctatggcgctccaggcaatgccatgacagggtatggcagtgggagcatgtacagccggtgagtgatcgagccccacggattagttgttgttcgggtaccactctcctagatgcatgcttactgattggccacggtatgtatcgtactgacatggtccaagcgnnnnnnnnnngggtattcgggtaccactctcctatatgcatgcttactgattggccagggtatgtatcgtactgacatggtccaagcgggcatggctgtgctcgcagggtgacgaagcgaggacaacccctctgacaaacatacataccaatctccctccctcagacctgcctacggtggcgtcaattccggcggcatgtacggcagcggcggcgcctacggcacgacaggcggcatgtatggcgcctcgccctacggcggggcgggcatgggctcctacggtggctcctacggctcaggcggcatgtatggcagctcctatggcgctggcagcatgtacggccgccccgccggcgccggcatgtacggcgcgggcggcggcatgtacggtgcgggcggcggcatgtatggcggcggtatgtatggccagggcggcggcatgtacggccagccgggcctgctgggcggcggccctgtggaccccaacaacccgcacgccccgccccagcccccctccggctggcaggccatgctggcggggctgggcggcctcatgcacttcttcggccgcctctccttcctcgtggacgagaacgcgcacgccgtccacttcttcgtctcggccctgctccagctgctggaccgcgcggggtcgctgtacggcgagctggcgcgcttcatcctccgcatcctgggcgtacggcgcgccaagaaggcgggccaggccctggtggctgcggcggggccgggccagccaccgctgccgctcggggcaccgactgcgcccaagcccctgcccgccgccgcctctgcagcaggcggcgctccctgggacagcgtgtggaagaagcaggactgaggtggggtgcgttgatgccccccattcgagtcgcacctgctgcaccatctgcagccggtttgtgtccggcgccttttggctacatgttcaggaaattaaagtagtcgtgcctgcaagtggcattgtggacttgcatcctgtagcaatctcaagactgcgcaatctgaatgagcatcagtgggtttgcaaagcgtctgtcaaaggactgtaggacaggtgccatgcacacttgaacagatggtcaactgtcagaacggagggaccagagggtatctcttgcttgtctaccatatgtgcgaatatgtgttgaatcaaagtcgcttcaaatgggccagttctgggactcccgagatggacgttattctgatctcagcccacccacacctctcggctggcagacgcaaatccggattccgtgcggaagttgcaaagtggggtttctgaggagcaggcgcccgcacctcgagactcaaaggatggtgtgcgtttggcacagatcagggctccggtgcagtgatagaaccatctccgaccaggcatgctgtgatcaggggcccaacagccatgtcccccatgacttgccgtcatgggctgtcccagcgaccacccagccacgccttcccactctgcggcaccagcccagtgcctcacctcgcctcgaatcccagaccatatataatgcggattaaatgccatcaccaccgcccgcctgcggcgttgaggggccaggacgagggagcggccggcagcgtccggtccccacccaccccaaggcctgcacgcagctcgcgccactcccccgccctgcagcgcgtgctgtccgagcccgggctggaggtacccggcggcggagacccatccaagtacctggccacccaggaggccttctggaaggcaatgcggcggcggggccccaagcccagggcgcccaccgtcgtcaggaccacgcagatgcagtaccgcgcccccgttgactacgacgtggcggtggcggggggcaccctcggcatcttcctggcaaccgccctgcaggtacatgtgttgtggacttttcttttctgagggtgggggagggggctcgtctgccaggcgtgcctgccaggcagcgcagggggtcccactcaatccatcgcctaccacnnnnnnnnnnggggggaggggctcgtctgccaagcgtgcctgccaggcagcgcggggggtcccactcaatccatcgcctaccacacgccacgctggtgctggccccccggccatgctcttggggctctgcgcaccttatgcgccctgtgaaggaccatcgtccacagcccccctcgccccacctccctcctcgaccctcagctgcgtggcctgcgggtggcggtggtggagcgcggccgcgtccagggccggacgcaggagtggaacatcagccgcgcggaggtcgcgacgctggtgggcacaggggttttgacacgggaggagctggaggaggccatcgcgtcggagttcaacccgacgcgcgtggcgctgcacggcgcggcgcccatcgaggtgcgcgatgtgctcaacgtcggcgtctgccccgccacggccgtggaccgcgcgcggcgccgcttcgaggcggcgggcggcgtcgtgctggagggggccaccgtgcgtggcgcagtcgtgcaccccaacgcagtggtgctggagactgcggcgacgcggagtgggactgtggccgcgagcagtgggggcggggacccgggcagcgaccacggccggggcgccccgagcggcgcgcagacggcgtcagatgggcgcccagctgacgccgtcgagacatcggtccggcgcccacccgctcccgccgccggcgcccccggcagctccccaccccgccccgtggccgcgtcgctcctcatagacacgatggggcactggagccccatcgtggcgcagctgcgccgcggcgcgcgccccgaccgcgtggtcatggtggtgggcggctgcgtggatggcgtgcccgccgccgccaacgtttcgggggacctgctggccacgctgggcgacgccgcggacgacatgcagctgttctgggaggccttccccgcgcgcgacggcggccgtacgctctacgcctttgcctacctggacgcgcaccccgaccgccccagctttgaggccatgctggaccgctacctggacggcatccctgcctaccagggcgtggcgctggaggagctgcgcttcaagcgcctcctcctcgccgcattcccctgctaccccgacgccagccccctcaagccaggcttcgaccgtatcctccaggtggggggggagtgagatactagatgtaaaaagggttgtaggtatcgcgagtggcaccttgctgcccgttatcgttcgatggccctgctgaaggtctgcgagccgggannnnnnnnnnatgggggcgggggagtgagatacgagatgtcgaatgggttgtgggtatcacgagtggcaccttgctgcccgttatcgttcaatggccctgctgaaggtctgcgagccgggagcacgccttcctggagcacgacttcctggagcagctgacgctcgtaaccgccgccctgcggggccttgcatgctgtacacatgcatacatgaatatatatgtatggatgtccacggagaacacctcccatccccaaccccattcaaaggcagaaactgatcccccaccccctcaccaacaaaaaaaccacactccctcgcactctgcccaggtgggagacgcggcggcgtcccagtcgcccctctcgttcggtggctttggcagcatgctgcgccacctgccccgcctgacccagggcgtggagcaggcggtgcgcagcgacagcctctcccgcggcgcgctgggctggttgcagccctcctcccccaccctatccagcgcctggttgttccagggggccatggccccccgcatcggccagctggcgcggtcggggtcgcgtcccggcgcgccccttcggggccccggctggctgcccccggaccacgtcaatcgcctgctgcgctgcgcctttggtgtgctgcagtggctggggccctgggcgctgcgccccttcctccaggacacgctgctcttcctgccgctgtcggcgaccatggcgggcatggccctgcgcgaccccggcaccatcctgcgcgtcgtgcgccagctggggccctgggaggtggtgagctgggcgcggcactacctcgccctgggcctggccactctgctggatgccctgctctggcccctgcgtgggcagctgcagagcagctaccgctggaggcgcgtgctggacgcggtgcactgggggtcgggggccgactaccacgaccactgacgcagggagggagagggctgtgcgggtgggcaggccactgtcacaaccgcaatctgctgtaaaggcaggaatcggcaggcggtcattacacaaaggcaatgtaacatgggagagccttgttgggcagcccgcggcggtcctgccaagttggggactggctttgcttgggactaataccccgcatgccggactgccacgtgcccacctcaatccaatgacacagcagtgccgcagaccctgcaaattgtgaagcgggatccctgtcgctcaacaggttggagacgcctcctccctccgcccgccctaaataactcttgcgtgcactgcaccggatacttgctgttcaatgtgagcatacagaggaaaactcggtgtcgaccaagcatggggctctcctcgcccaggaggggcctccagagcagcaaccggcaggggcagagggcgggtcctggtggcagggctgccgcgataattgagcaggtgttccgccgctccatcttttacgtgctgccagggatggatgtgacgttgggctcgttccctcggctgcctgccagcgtctggtctaccagctttgcggcgacctcctccgcatgccgggtgtgagccgccggtccgcccgccgcagccgcctcctcctcctcgcgcacgtcctggatctccccatgccgtagctgccccacgatgatgcgcacgatgaggtacgacctggcataatgaattgtgttgcggtgagtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacacctcccgtgctggatcctgccaatcccagacacttcatccactcggccatatgccccgcctcatgctcaccagtacatgtggaggaccaggaggaagatgaggaacccgttgaggatggaatagtgcggctcgatgttgacgtcaaacacccttccatagtgctgcagagatgggagaaatggggtaagaagggggggggggggggggccccccccccgccnnnnnnnnnnnnnnnnnnnnnnnnnnnnnnnnnnntcccaacaccagggtgggtggtgaaggatcgtgcgggagcacaatgggtgcctcaccaggcattgcgcgtgcttcgaactgccctgcaagacccctcctctgcccttccaccctggccaaccagtcgcttcccaccaccccgcccaccttggcgtcgatgagcgtgctgcggatgacgtagacggggaagacatagatgcgggacacgaaccaggagagcgcaaaggtggcgaagaagacggtggtgctggtctcgtgccgcgcgtagcgcgccatcttggccgactccaggaagacgtcgttgagctcgtggcaggccagcaccatgatgcccacccgcgtcaggttgaggtagtaggagtaggctatgagcaggatggtggccacgtggtgcgcggccacctccagccggtccttgcgcttggtctcccacacgaacaggatgggcagcgcctggagggcaggggtcgagggtttgggcgggggtcagcagagcaggtgccgctgggaccccgcctggcacaggcccgggcttgcagagtgagcccacgagcctcagaccaggcagccctggccagatgctgcctgtcannnnnnnnnntcagggtttgggcgggggtcagcagagcgggtgcggctgggaccccgcctggcaaaggcccgggcttgcagagtgagcccgggagctcagatcaggcagccctggccagatgctgcctgtcaagcgcacagacctgcagatagaatcccagctcgaggcagtagatgaagcgctcgcccagggaaatgggggccaggcacggcagctggtagcactccgaccagaacaggcgtgtgtcgaaggcccacctgcgcaattgaatccggtgcggcacatctcgagaagggtggggatgtcgcgggggggggtg

SEQ ID NO: 41768 - DNA, 61 bp, Chlorella protothecoides
gcaagggaccttgctcaccctcacaccaaatttcggcaccccagtgacaacggcgagccag

SEQ ID NO: 41769 - DNA, 85 bp, Chlorella protothecoides
acagcgcccgcggcacactcttcactcccgtcttcccccccttccctgcatctagatcacatggcactgccccacccatgccccc

SEQ ID NO: 41770 - DNA, 68 bp, Chlorella protothecoides
tctggagttgtgcttcaggggaggtgcgtgaccgcaggggtcaggggtggacagtgagtggatgaatg

SEQ ID NO: 41771 - DNA, 61 bp, Chlorella protothecoides
gagctggggaagggagttcgagggggggggggaggcagcatattgcttggttcattgattg

SEQ ID NO: 41772 - DNA, 98 bp, Chlorella protothecoides
agctggacagggttggcggaagggggggggtgtaggggttaggtattgtatgaatgagtgcaggcagatcgagtgcaggcaggcgggcggtcacaggc

SEQ ID NO: 41773 - DNA, 82 bp, Chlorella protothecoides
ggtcctccgcccactgatggattttgttttggggggtggggtacgtgtgtgctttgtaacgatggcccacagacgcatccct

SEQ ID NO: 41774 - DNA, 115 bp, Chlorella protothecoides
caaggtctcctgctactctgcaaaggtgggccggatgtgtgggtttgtggcggggacacattctgtcttggggcaatgggctgtgggttgggggttcaaggagggatccccggtg

SEQ ID NO: 41775 - DNA, 73 bp, Chlorella protothecoides
cccccccccccccccccccccttcccccccaacatcgaagatcaacatcaacgtgctgacgcacctggtactg

SEQ ID NO: 41776 - DNA, 65 bp, Chlorella protothecoides
gctgtcgggcacgctggcggtgtggatgcagctggctgcctgatcacgcccattcctcccacaac

SEQ ID NO: 41777 - DNA, 61 bp, Chlorella protothecoides
agcgcaacagtcccacgctgagtgggggggtggctcagaagaagggcctcaacagaggagt

SEQ ID NO: 41778 - DNA, 93 bp, Chlorella protothecoides
gggtgggtgatgctgcggcgcctgctcaagcgccaatgacaagtgggcggcagcgtggaagcctgacatgggacggctgaaccaccgctcgca

SEQ ID NO: 41779 - DNA, 136 bp, Chlorella protothecoides
ggaggggggcggtggtgatggatgggaggaagtggagcacactgtgcaatttggagcgggtggatgtccatgcagcgggagacgcctacttctgcggcacctcaccatcagcgtcactcacaaattcccggaaccc

SEQ ID NO: 41780 - DNA, 96 bp, Chlorella protothecoides
acttcgggcccccgaggccctggccaccccacccaggcacccccacccccgacacgcagaacccttacccggcgtggggagtggccgccgcgaggg

SEQ ID NO: 41781 - DNA, 1947 bp, Chlorella protothecoides
  modified_base (973)..(982): a, c, t, g, unknown or other
  modified_base (1169)..(1241): a, c, t, g, unknown or other
  modified_base (1707)..(1716): a, c, t, g, unknown or other
tgtcggtcgccgccgcgctggcgggcgcgtgcctgcccgccggcgccggctccgcccgcctgctcctgctggtgggcggcccgggcacgctgggcgccggcgcggtggtcacccccgacctctccgaccccatccgcagccacaaggacctggccaaggacgcggcgccgctgtccgcgcccgcgcgccgcttctacgacggcgtcgccgcgcagctggtggccgcgggccacgcgctggacgtctacgcctgctccctggaccaggttgggctgtacgagatgaaggccgcggtggagctgaccggcgggctcaccgtgcagaccgactccttcgccaaccccgtgttccgcgaggccctgcgccgcgcctttgcgccgccgggcgagccggggcacctgggcctgggttccaacgccaccctggaggtgcgctgctccaaggacatcaaggtgtgcgggctgctgggcccggcggccgcggtgccgggcgaccgcaagtcgccctggctctccgacacccaggtgggccagggcggggccaccgcctggcgcacctccaccctggccgccgggaccacggtcgccgtggtgtacgacatcgtggcgccgcacggcgccgcgggcgacgccgggtcgccccagctcttcctccagttcatcacgcggtacacgcacgagtgcggcgcgccacgcacgcgcgtgaccaccgtcagccgccgctggaccgatggcgccaacgtgggggagctcatgcagggcttcgaccaggaggccgccgccgtgctgctggcgcgcctggcagcccacaagatggaggccgaggacgactttgacgtcacgcgctggctggaccgctccctcatccgcctgtgcgcgcgcttcggcgactacaggtgggtcccggccgggcaggagcgccgagcgtcccggggcgacggcagggggggcggggcgcctggcctgggccgcgnnnnnnnnnnaggcgggcaggagcgccgagccccgtgcgtgccggggcgggggcggggggggcggggcgcctggcctgggccgcgctccgaccggcgctgcgaggtcccgggtctcgcgcctcggcctgccgctgcggccagcccccccgctgtgcagcctgccctgcatgcacaccccttccccctgaccccacannnnnnnnnnnnnnnnnnnnnnnnnnnnnnnnnnnnnnnnnnnnnnnnnnnnnnnnnnnnnnnnnnnnnnnnnagccggagtcattccagctgcgcccgcagctggcctacttcccgcagttcgtcttcaacttccggcgctcccagttctgccaggtgtttggaaacagccccgacgagaccgcctttgcgcgcctggcgctgcagcgcgagaccgtgggggagggcgtgaccatgctgcagcccctgctctactcctacgccatgggcgccgcgccggagccggtgctgctggacgtctcctccatcgcccccgaccgggtgctcctgctggacgcctacttctacgtcgtcgtcttccacggcaccaccgtggcacagtggcgcaaggcggggtacgccgagcagcccgagtatgccgccttcaaggcgctgctggaggtgagaggtgttgcataaggctttgtgggggggaaaggaggggctgagaggggagtgggaagggggaggaggacgcagggcgaggcggcggtgagctnnnnnnnnnngggtgctgcatggggctttgtgggggggaaaggaggggctgggaggggagtgggaagggggtggaggacgcagggcgaggcggcggtgagctagcggcagctcgaccgtgccatgacagcctgcggcgtggccacgttgggtcatgccggtttggcttgagacgcctgcatgggagcgtgcagtgccgtctttacacacacacacacacacctgtccccccacccacccac

SEQ ID NO: 41782 - DNA, 61 bp, Chlorella protothecoides
caccgtctctgcatcctcctgggcgtactcgatctcgtcccgtgcctctgcaaacttctca

SEQ ID NO: 41783 - DNA, 91 bp, Chlorella protothecoides
ggcggcacctttgtgttgttgtggggttgaaggggggagggtggaaggggggtcagctttcagaagaggcagagccgagggccagggcttg

SEQ ID NO: 41784 - DNA, 63 bp, Chlorella protothecoides
gctacggtgacaccgctgccatcacccttgaaaaagtatcccaggtgtgcaggtcatagtgat

SEQ ID NO: 41785 - DNA, 61 bp, Chlorella protothecoides
cggtcttcttgatggggcaatggcagggggggtgggagggggtcatgggcggatgtgggag

SEQ ID NO: 41786 - DNA, 74 bp, Chlorella protothecoides
caagcacgacacattgcatgacccaaccccatccctgacatgctctgagcgctctggctttgctggcacactcc

SEQ ID NO: 41787 - DNA, 61 bp, Chlorella protothecoides
ctgctggctggggccgttgggcgcggtgagcgtggacgacctgccaccctgattcacggcg

SEQ ID NO: 41788 - DNA, 73 bp, Chlorella protothecoides
gcaggggtcagagctggcccagttgtggcaaactatgctgtcaccggtgttgttcgaccccacattgtagtcg

SEQ ID NO: 41789 - DNA, 97 bp, Chlorella protothecoides
ggggcctggggaaggctggacctcgcaagcatctggacccctgtgctcgggcgctgggcagcgcttcgacgcctggagcccggtcaccacccctctg

SEQ ID NO: 41790 - DNA, 21332 bp, Chlorella protothecoides
  modified_base (116)..(125): a, c, t, g, unknown or other
  modified_base (226)..(235): a, c, t, g, unknown or other
  modified_base (359)..(368): a, c, t, g, unknown or other
  modified_base (525)..(534): a, c, t, g, unknown or other
  modified_base (604)..(613): a, c, t, g, unknown or other
  modified_base (1511)..(1520): a, c, t, g, unknown or other
  modified_base (1922)..(1931): a, c, t, g, unknown or other
  modified_base (2566)..(2575): a, c, t, g, unknown or other
  modified_base (3291)..(3300): a, c, t, g, unknown or other
  modified_base (4217)..(4295): a, c, t, g, unknown or other
  modified_base (6374)..(6399): a, c, t, g, unknown or other
  modified_base (6630)..(6639): a, c, t, g, unknown or other
  modified_base (6728)..(6737): a, c, t, g, unknown or other
  modified_base (6826)..(6947): a, c, t, g, unknown or other
  modified_base (7518)..(7527): a, c, t, g, unknown or other
  modified_base (8735)..(8744): a, c, t, g, unknown or other
  modified_base (9795)..(9804): a, c, t, g, unknown or other
  modified_base (10412)..(10421): a, c, t, g, unknown or other
  modified_base (11391)..(11400): a, c, t, g, unknown or other
  modified_base (13939)..(13948): a, c, t, g, unknown or other
  modified_base (14451)..(14460): a, c, t, g, unknown or other
  modified_base (14534)..(14543): a, c, t, g, unknown or other
  modified_base (14617)..(14626): a, c, t, g, unknown or other
  modified_base (14872)..(14881): a, c, t, g, unknown or other
  modified_base (15122)..(15131): a, c, t, g, unknown or other
  modified_base (16787)..(16796): a, c, t, g, unknown or other
  modified_base (17036)..(17045): a, c, t, g, unknown or other
  modified_base (18051)..(18060): a, c, t, g, unknown or other
  modified_base (18655)..(18664): a, c, t, g, unknown or other
  modified_base (20121)..(20130): a, c, t, g, unknown or other
  modified_base (20802)..(20811): a, c, t, g, unknown or other
  modified_base (21193)..(21202): a, c, t, g, unknown or other
gggggggggggggggggatgtggggttggggtttggggggagctgcgggggccaaaggggaggaaggtgtgtgggagtgatgagagaggcatctttgcttcatggtggccatgcannnnnnnnnntttgtcgtgcgcagagagcatgcaattgcctcctcctcccagaacagggtaggccgtcactctccatcccaacctgtctaccccaccgcaccctgcaggtnnnnnnnnnngcgggggccgaaggggaggaaggtgtgtggcagtgatgagggaggcatctttgcttcatggtggccatgcattcgctgcacccggcatggacagcaggctggggggcttgcgatcgggatgcannnnnnnnnntatcagcgttggggccccggcggtggggccccggcggtggggcaagagacctgcttattggcgtgcgcagggagcatgcaattgcctcctcctcccataacagggtaggccgtcactctccatccaaacctgtctaccccaccgcaccctgcaggtnnnnnnnnnnaaattcgatagcgggcaatgtttatcgtcaattgcagcgccagccccggggatgctgttcctatataggnnnnnnnnnncacgtatccggagagggtggggatgctgcgcaagctgctgactcccctgtcgccgcgctggaccatcagcctcgtacacttccgcaagacaggtggggtttgatgaaggggggggtgaaatttgatagctggcaatgtctatcgtcaattgcagcaccagccccggggatgctgttcctatataggacagatgatgcacgcgcagctgctagacgccaagccgcaggcacctcgcgccgaggcgtggcagcaaatacaacctagacaccctcccttgcctccaccttggcaggcaatcggtcgtccaccctgatgctgggtgtccagctcaagccggaggagatggcagagttcctggaagccactgagagcctgtctggggagtttgtgtttgagccgctgctgggaagggctaagcaggtgtttgacctgttcctcgagaagtgatgggtgtgaggagatagaggctcccatgctgtaccttcacggcaaggggcgtgggagtcctctaggaaaatgcatgtctcatttcagacactcagcatcctcttgcacccgcctgatgaatgaaattcgttgaaagaaccggacgaagcctgttttacaatgtacacgcattgaagaagtggtgtgcaaacatcctcccatgccagccctcgtctcgccttgtaacctcccctcgtcctcgcatttccctggaacattccatgcagcaaagtgcctgaactatgacagggagctgtcagactggcaagcatccacacgattatagtttgccgagggctgcaccttgccttgccgcgcctcgacgcaatgcacgacagcaggcactgccttccgcaagacgagtgatgccatgcttccccggggactgtgcaagggcccagtcagctttgtnnnnnnnnnnggccactgccgtccgcaagacgagtgatccagctgttgccatgctttccccgggactgtgcaagggcccagtcagctttgtggcaggggatgacctgcaaggtccactcccccatcaacgttcctcaatgttgagggtgaaggagacatacgggaacagatcgctgtctgctccgctctcattgctgaagaactggcctcccacgccagagtacttggaagccagcagctgttggttgggggttgagagggaaatgggcttgacaaaacactttggagccggtagagcaattgaacgagagtcatgctcaagctgcccttcagggccacataccccatgtgcattcttggtggaccaatctggtatcagcaccagaccttctccccgcagagcatccctccnnnnnnnnnntggtagagcgattgaacgagagtcatgctcaagctgccctccagacgcacataccccgtgtgcgttcttggtggaagaatctggtctcagcacccagaccttctccccgcagagcatccctcccacatcctctggacaagtccagctcccctcccaccttgcgcagcttggacactgccttggggttgggcctcatgaggacgggcaggaactgtgggggtaggccgtatcgcaggatgctctccacaaacaggcggacggcaaggatgtggatccaggcgctgaaggcctcggagtaggaggtcaggcaccaggcctcgaactccgaccgcttcacctccaccgcggcacgcagcttttccagaccctcctcgttggccttctgggactctgcatccgatgtgatctccttggcctgggggggagggggggtgtgggatggggttggggtggaggagacgcaggggccttgtcaacgtgggtcaattgtcctgcgggccgtactcaaacgcacagcgggcccttgcacagcttccttagggtttgctggttcgttaacaccggcaggaatcttccgctgaaggggagtgggcacagccctcctcctgcagtggaacatgcctccatcaagctcnnnnnnnnnntgcaggggccttgtcaatgtgggtcactcgtcctgcgggccgtactcaaagcacagcgggcccttgcacagcttccttagggtttgctgacttgttaacaccggcaggaatcttccactgaaggggagtgggcacagccctccccctgcagtggaacatgcctccatcaagctcaaatacgatgtgtgtgttcttaccctccgtcccctctgatcagccccccccccctcacaatgtccatctccctccctccactctgcacctggtaacccttggcgcgggcagctgccttgaagtcgtccaccactcgccggaagaggaccacgctgaccacactgtactctgagtcctcggtgacgaggcgcgcggagcgcgggaccacccactccgtcagcccctcgtagctcttcatgaactcgggggtgttggaccgcgcgatcaccaccaccagcgtcaccaggttctcggtctccaccagctcgccgggcggcaccaggtccgacaggtcccgcaccgccagcgaacccgtgcgctttcgcagctgggcctggagcagcgtccgctgctgggtgtactcagtggtgcggagctacaaaagagagtggggggggttggagtggcggatgtgggtgtggtagatggccatcaggccatggccaagggagggccacggccccgcccggccccccgcaccttcaggtcgtcgtccagcttcnnnnnnnnnnatggagcggcggatgtgggtgtagtagatggccaccaggccatggccaagggagggccacggtcccacccattccccgcaccttcaggtcgtcgtccagcttctgagtgacctccgtgatggctgccacggtgtccttgagggggcgcttggaggggtacttagcctcctgccactcaaagtgctgcaggtagtcgggcggggaggtgccctccaccctcacctcgcccccttcctcctcctcgctccggtccgtgggggcggcggactgcagctcgaagagctggcgtcggaccttgttgaccgacccctccaccgcaccgttcaccttcaccaggtcgtcgctgaggcccagcagggagtccagggtccccaccttgaactcgggcaccgcgaacttgaagttgacgctgaggtcggaggaataggtggtgtcctcctgcaggctggcccatgcaccctccatgccggtgctgggcgccgggagggcgaccagccagtacaccatcgcgtggattcggggggtggaccaacagaggtaggggctcccgctgcgtcaggccactgaacacaagcgatcaagagacgtgtcgaggacgaatcgggtcgtatgctgggcaagggtctggggttgtgggtgccccgagctatccgacgtcctgggcgcgatccctcgccgcgaggtacacagccctctgctaggcttctcgggtagattggtggttgtgagaatagttcaatggagtctgagcgagactgtgccaatgcgccaggctgtaaacggtgtcagcggaggatgggtttcctggcgggatctcggtgcggacaggggtttgcgagggacgtccatggtccttgcacatctgcacagcatctcccaccgctgctggtagggaacccagaacgctccatcacacnnnnnnnnnnnnnnnnnnnnnnnnnnnnnnnnnnnnnnnnnnnnnnnnnnnnnnnnnnnnnnnnnnnnnnnnnnnnnnnagaatccagcaaaactccagggtcatgccggggtgccacgcaagccgggccctgctcccagcctcagtcgctccaccacagccgtcacatccagcggcgcagccggccccaaccccagcctctcccgctcttcaggtggcaggctcgaggcgttctgcaccagcacctggcccgctgccagcgccagtgcagcgttcgcgagggcggtgctctcctcccacacgcccgaggggcggtctgggaagtaccgcgcggcgctggccgtgtccagagcctgcctggcagcctcggcggcctcagggcagcgctgccccagctcccgccacacgtcgggtggggggtggggcaggggcggggccccgctcgtccccggaccagacccctctgccccacctgcgctctccaacatgcgcaccaggtgcttgctgagctggcgccagttcatgcgaggtggcgcatcctcctcgctggagtccgcatagtacatgtcttggtccgtcccggagggcccagcagcctccggtcctgtccccagaccaggcgcctcctcccacttgacacgaggctgcctggcccggggcttcccagcactgcctcgtctgtggaagtagggaaggaactgggtttggaggggcaggcatgcctggtgtctcacatattgcaggccattaccccatacaagacgggagtgccgagggaaaagtcgcactggccagatgtttcgaccccttcctggcaggagacccaccccttggctcctctctttgtgcccgtcttcgcatggacgtctactccaagttcctgcctcaaatgcgccgcctgtgctgagtcgtcgctgttgaggccctctgggattacaaattcattatgctcatcatactcctgtaagacaggggcgtggtatgggagggctcaattgacagagcgcaaggggaacttcgagcatgagggcctcgagctggagcacatggactgacttcaacttcgacctgcacagagcagtgcctgcccgtcacaacactctccccggccagccaacccaaatatctagcccttcagcatccccactcacagcttcatcggcgctgcagctgttgcgttgagcatccggattcatgtaacagtaccatggcgcattctcgtcgaccacagttccaggtggtagcctccgccatttctgacaatttgcattctcacactgggcccaatgctctgctacaggggccagggctgctgcaagtgcagaaaccatcgcccctgtgcacgaattgtgtgggcaaccttccgctggaagcgggggccgatggcggagttcagatgagaccgctgcaatgatcttccacaccctcgcgtcgtgaatttctaaggaacaagcaatgactaatagacaacattgcgtcggccatgtatatgcaatctaaatcacccttggtcgcatcacttccgtgtgcacacctttgcgcgcgctctgtcggagatcgttcaggagcatacgaacgtcagtcgccacacccgccaggacaggaagacaacaaaggaggaatatattgtataacatcataggagtgttcttgagttgttgtcgcgatgcctcgctttgaaggctgctgctcccacgatcacgactgcgaagaggaggactgcagcacttcctactcactgtacaagaatatcgatacacccagggtaggtgggcagatacggcaccgaccgcgaggagtacccccgccttctcatggtgtcctggtcattacgggtgccttactcctgagccttggactccccgcaggtgcggtgtctgaacgagctggaggagggatcatgccaggcagtcttcaagccctggcacgcccggctagactcatcaggacccaacctccgaagtcaggaggacgaccctgagctgctgctctacgtcccctttgacggagcggtgtccctcaaagccatctgcgtgattggcggaccagatgggagggggcctgcaaagctcagggtgaacaggaggatgggtgggctacatggagctaggtctgctgcgaatggggctgcgagcgccactcatgatcgcaacattgnnnnnnnnnnnnnnnnnnnnnnnnnngtgtatgtcaacagagaggatctggattttgggatggtggcagacctgcagcccatccaggagtgggatctcgttgacaacacagccggtgttgtggactatcccacacagtgagtgaggagggtataggcgttgccataaagggacaagccaaggatcacagattgttgatccgtgctatccaaccctgcagggcctccaaattcaatggcgtgcatagtctgacgctgnnnnnnnnnncgcagatttttcgggatgacttggctgctatcattcacaatgagatgatagagatcactctatgcccgcctcccgccttggcccccagnnnnnnnnnntgcagatttttcgggatgacttggctgccatcattcacaatgagattgtagagatcattctatgcccgcctcccgccttggcccccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggcgttgccctaagtggacaagccaaggatcacatatttttcagtcgtgctatccaaccctgcagggcctcaaaattcaatggcgtgcatagtctgacgctgcactttccagagacgctgggcgggggcgacgccacccagatcaactttgtgggtttcaagggcacctgtgtgtcgcgggatcggagggctgtggaggcggtgtacgagaccaagcccatgccatcggatcacaaggtagccgaccttgctggggcagcatggagactcgggtagcccttgtggtcctggcactgtgactggtggcactggacgcacatggtcttgaaattctgtttgtcaggcgagcgattggtgagctcttgccaaaccgaggtgtacaatgtaggccatcgaagaggcacgccgcagttacatgcaggacataggcttcgaacacgacctattcacattctgggatcataaagttcaccatcacccatcaaatgtacggctaaaggacgtggaattgtattttttaacaatgctggtgtgttgtctgtgatgtgatggaaggctggcttggcannnnnnnnnntgttgaagaggcacgccgcagttacatataggacataggcttcgaacacgacctatttacatgccgggatcataaagttcgccatcacccatcaaatgcacggctaaaggacgtgggattgtatttattaacaatgctggtgtgttttctgtgatgtgatggaaggctggcttggcatgccatagctgaacgaggaggagggttgacgtgagctggggcgccctgccggagaatctttccgatccagccttgtcgcaatgccaatcatcagcgtgaattgacaatacatcgcatttgatttgttatccaccactcttgtcctcacgatgtcgctcagcgtggctagcctgcatgtgtaccccgtgaagagctgtggtggcgtgactgtcgagcagggtgtgatcacccccataggtatgcatgaagggcgacgattggatcttttgaaggtgttttaatgcactcaccgtctcctgcaccccctttcgacgtcctgggccgtggcctttgagaatgatatcatctccattccgtgacactagcaacccttcctggactcccccacgcacttctcggaaaacccgcaggattccgctatgaccgcaactgggtggtgatcaatgaaaagggtcggttcgtcacccagcgccagaaaccggagatggccctggtctccgtgagcctgcagcctcaggcactgctggaggacgcgagtgcagaggagggccagtatccggacgccacgctggtcctgcaggcccccggcatgcccaccctgcaggttcccctgaaccccggtcgccggcaaggcccctccaccaaggtcaccgtgtgggagtggacggggctgggggccgacgagggtgccgaggcggccgcctggtggagccagtacctgggccatgaagcccgcctggttcgatatgcaggtgagggatctgggtcgggccgggggccgcacgtctgcgccgcctcgctgggagatgggtgaatgcagctgggtcctgtcgcgctgcagggcagcgccgtgcctggggggccactccagcgcccctcaccgccctcccgcgccccctccaccaacaggggagccaggccagccgggggagatcaaagctggacaggaggactccacgcgccgccaggtggacccggagtggaccgaggccgtcgaggggaccgccttctccgacggcttccccttcctnnnnnnnnnnaggggagatcaaagctggaaaggaggactccacgcgccgccacgtggacccggagtggaccgaggccggcgaggagaccgccttctccgacggcttccccttcctggtggccaacgaggcttcgctgacagacctgaacgcccacctccctcccgacgagggcccgctcaagctcaaccgctttcgccccaacgtcgtggtggcgggcgcccccgcctgggcggaggacggctggctgcgcctgcgcctcggcgcctcggccacgctgcacctggtcaagccctgcgatcggtgtgcggtgacgaccaccgagcaggagaccggggtcgtggggtacgagcctctgcgcaccctgcgcgtcgtgcgctccggcaaggtgctgggctggagcgaggcggtcccgtgcttcaagggcgcggtgttcttcgcctggaacgccgtcagcgaggggcccggggggagcatcatgcggggggacggggtggaggtggtccaggcgcgggaggggccggccgtcccgcagaaggtggaccagcccgccccggcgcaggcgcaggcgcagccgcaggcgcagcgtgagctgggggcggggctgaccaccctgcagaaggtggccctgctcctggcagcgatactcgtgcgatacctcttccagtactatgcagcgaagtgatatgggagctggcgcactcactggctgtgcgccgccctgggctttgttgtcgagcttggtcacgacaagttctgtgtgattcctggaatgttcagtgctggtccatgccatgcactgctgaatttatgccatcgaacaaagcattgtgccgctcaaaaaccctgcggcgtgtcacttctctctcccatgcagcagatggtatagtgtctccctgcagagtgtgcacccgggctgccatgaaacatgaccatgtactcccccacactatagacagatggcttacatattggcaagagctaaacgctttgtgcatcattatggatgtttgtgttggagtgtcaggaatatgagtttggtggtggaggtagtggtgggttnnnnnnnnnnacacatattaacaagctccaaacgctttgtgcatccgtatggatgtttgtgttggagtgtcaggaatgtgagtttggtggtggaggtagtggtgggttgtggggatcccgaggcggcgcgaacgccagcaacgggcttgaaaaattatgaccttcatgaccccgaagagccatgaacccagagccgcaaagcgaagtgcaaggcctgcagctgctggatgttgcacgaccttcttgagcaccgtgcaaccggtccaggtaagtatgatgaggccggcctgatttgcccacatgaccatcgccttcgcaccgcgggaccgccagcgattatgggtcgtgcggcagtcccgtgatggccgcgcagtgcgctcgaccgatatgtcgatcgtgtcatggtgtacttgagctcaatgagactgtttatgttgttcaggaccgtcaaagctcggtgaaacgtcgatcttgcggagagcgtgggcagtcgcccccttcaccaccacccaccaaacatgcaacacagaccccaaaccccctgaattcgtctcggccggttctttacaccaatttacagtcacaaactggcttcaaccgtctccagatgcctgtttnnnnnnnnnnattcagggccgtcaaagctcagtgaaacgtcgatcttgcggagagcgcgggcagtgggtcccctgaccaccacccaccaaacatggaacacagaccccaaaccccctgaaatcgtgtcggccggttctttacaccaattcacagtcaatccctggcttcaaccgtctccagatgcctgtttctgcgaggatcgcttcctcttcccactgcgctgcctgcctggtctgaggggcagcagccttcgcagccgttccttctcaacttcatcccccaacagccccaccaccaggtccgggtcgaagggctgcgaacagagcccgcacaccccagccatgtgcgagatggccttgttcgagaagatgtgaccgcacccaggaatcgccgagaagggctggaggaggcatgacgctgatgtgatggggcaggagagaggtgctgcctcggcggcgccgccctcgcctcggggcatggcatcgccctgggtccccggtagcctgacctcgaacacgtccctgatgtgggggagacggggcgatgaaggtgaggaacgaaaggatacgccactcttttccaagccggtctccagacgaggcaattccctgctgtgcaagggccatgatgccacaggagcagcagaaacacatgccacctccccacctgacacaatcgaggtggtcccactggctcagtccagtgcgcagctggttggagtagcggtgcacgtccccttccgtctcaaagtgcccggcacgtgccagcaggaaccccaggacagccgccttgttgtacaggcttcccagccagtcagccacgatgggggcctgcaagggctcaccgctcagggcgcaggtggtccatcccacgaccctgaggattcgtggtcggcgtggagtgacgatgtggacgactggactccggcgtgcaaacgggcaaggtctcatgaaacaagctgtgcactgcagtagacagnnnnnnnnnngttcgtggtcggcgtggagtggcgatgtggacgactagactccggcgtgcaaacgggcaaaatcttatgaaacaagctgtgcactgcagtaggcagggtgtgacactgccaagtcccagcaccctgcccatgcccacctgaccgccaccttgtcgagcttgggctttttgaaggtcccggctttgctcactgctccacctcgtgtgctcctggtgccatcggcctgcgacagctcccaggatgcccctctgagcacgtcgctgcgagagatgacggtcccaccatccagacccatgcccagaggccggggtgccggtctagaatattgatgatactgtttgcatgatacagatgatcactgtatgaagaccaccagccaatgcatttcatgtcgcttctctcttgcgcgcacgtgcgcgcaagggctccgatctggggcatgcggtggcacctccctgcctcgccacggctcctcccacatccctccgtgatacgtaaacccataatctgtcattcacgcgcggccccccttcatcctgcggtgcaaaggcatgctcaagggtttggcccccaagccccccctgcgctccacccccacgcaccaaccccgggcggtcatggcaggcgctgccacccatcgctcccacggcgagaaccctgcatcggaagcatcccagcccgaggcttccacgcagcgggaccttgcggcctccgagggcgcaacccgtgctagcgcccccctcaagtccaaccccagcatccccgtcactgtccggtcggatggcctgcgtgagtgtatttgggggggtgtacgtcgccatgcatgctgttgtggggccgatctgaatgctgtgctgcaggcatggcctgctgaaggctgatggcttgtgccaggaagcacatggctgtgtagtgctcaacagcatgcactcaggcccactgtgggtggtgggcctgctgcccccggcgacacctcccacccatcacccctgaccatgcagagtatcttgaggtgaaggacctgcgctctgtgctgaagccacgcaagtcccccttctgcgccaccaacaatgccggcgccggttttggtgagccgccctttggggaggtggggtcaccgtgttgccctgggatgggtgggctggctgttattattacgtgacactcagcctgggtcggtgcgtccctgtattgtactgcatgtgcgggggttggcgggaggtgctactcctcgcctccttagggcctttgtccctgggcatgaaggtgcattgcgtcggggcttgcttgtgtggctctttggtgctcaaccattgcatcctctgcaccctacccccctcccaccgccgcgggtgtggcttatatacctctgatcccctgctgtcaagttccttgacgtgccccataagaaatcccctctcaccctccctcctccttcctccactccaccccaaaccccagtgggcgacaccgacctggtgcgcattggcatcatggagtatgagtccagccactcctccggcgcgcagggctcaggcctctacgacgcggcggacaacagctgggtggacatcccgccctacgccatccgctccggcccgcgcgaatccatctaccacgaccccaagcaggtcactgcggcgctggtcacctgcggcgggctctgccccgggctgaacgacgtggtgcagaacatcgtctacacgctggaggaccacggcgtgccggaggaccagatcttcggcatccgcttcggcctgcgcggcttcctggaccggcacaccaagcccatcatgctcagccgcgcggcggtggagggcatccagctcaagggcggcacggtgctgggcacctcgcgtggcaacgccaagatgcacgagatcgtggaccggctgcgcctgtggggtgtgaacatgctgttcgtcatcggcggcaacggcggcaacgctgccgcgcacgccatcgcgcgcgagtgcgagcgccagggcgtcgtctgcaacgtcgtgggcgtgcccaagtccatcgacaacgacatccagctcatcgaccgctgcttcggcttcgacaccgcggtggaggaggcgcagcgctccctcatctgcgcgcgcaccgaggcgcgctccgcctcgggcatctccatcgtcaagctgatgggccgctcctcgggcttcatctccctcaatgcctccatggcctcaggcgtggtggatgtctgcctcatcccggagatccccttctccgtcccgcgcctcgtggcgcacgtgcagaccatcctggcggccaaggactactgcgtcatttgcgtggcggaaggcgcggggcaagacgtggtgcaggagggcggggcggggggcaccgacgcctcgggcaaccccatcctcaaggacatcggcaccttcctccgcgaccgcttcgaggaggccatcgaggcgagcgaggggggggccaaaggggacggagatggggctgcgatccattcaggagggtcctcgaggagcacacttttcgcacaaccctctcaccccagaacccctgaccnnnnnnnnnnggtcaggagggtcctcgaggagcacactcttcacacaaccctctcaccccagaacccctgaccccctcccacagggcatcgatgtgcggtacatcgacccctcctacatgatccgctccatccccaccatcaccaccgaccgcatctactgcaaggtgctgagccagggggccgtgcacggtgcctttgccggctacaccgacttcacggtgggcctggtcaacacccactacgtctacctgcccacgaccaccatcatccagtcggcgcgcaccgtggaccccgccgggcgccagtggaaccggctgaagacggccatcaaccagccggacctggcgtgaggctgaccaggtgccgagtgccgggggaggggcacctcgtggccaggacaggggtgccgccgctgcggcctgctcccatggcgagggagcaagccatgttcctggctgatgctggagaaccatgggggcctcctctccgccagaatgcccccctcctccccnnnnnnnnnngccctcgaaaccgggaacccaacaaagtctggctctttgctgccatggtccgtaattggtgaactgacaggggnnnnnnnnnnaccctcgaagccgggaacccaacaaagtctggctctttgttggcatggtccgtaattggtgaactgacaggggnnnnnnnnnngccaggtgccgagtgccgggggagggggacctcgcggccaggacaggggtgccgccgccgcggcctgctcccatggcgagcgagcaagccatgttcatggctgatgctggagaaccatgggggccacctctccgccagaatgcccccctcctcccccacacactcccttgcacatgttgcatggacgatgcaacagaggctgcgctgtgccagtccccagatcatttatacggtgtctcctcctcnnnnnnnnnnctggagtagcttgtacacgccttgttaatattgagcacttgccgtcctgctcaggttgaaagttcgaacgccatcccacagcttgcttggggccgcattcctctcattgtcaactggggcatctcgttcatactggaaggcatgcatggcaggggtacctgcctctccgccctcttgatcctgggcccccccttggtggcgacaaacattcaatgtagaaagtgctcctctcccgccatannnnnnnnnnagggcatctcgttcatactggaagtcatgcatggccggggtgcctgcctctccgccctcgtgttcctggatttccccttgggtggcgacaaacatccaatgtagaaagtgctcctctcccgccataccaggaagagcaaggtatggcattcataccagccactgttcagcacacattcgtgcacattctttacatgccccaggatcatggaggggcgcaggagacgcatttcccctggcaacctgtaccctgtccccacctttttcgatttcatgtcaagggacggttgcatgctggatgttgggaaatagttttgctactatatggagtgactaaatatcctgttgacatctctcctgtctctgacatcccctctgaactcctcccactctctgacagccaagcctgaagggagtactttgatacagtgtgttcaacatgaccgcaattggcggcccagcgagcatctggtgtgtgggtggcttgtcaagatgggtcgcatggcacagggactgaaacagagcggaaagggagcacgcagcaaaacgtcaggggcggagataagcctctagggggagggggcgggggccgcggcggtcaggcacgaggggacggtagcacagttctgcagagaggccaggccgaccacgtccacgcccgcggaggacagggggccgtagatgacgttgatgcaggcggagatggcgtcggtggcagtggaccggtcaactccctccaggttcacgcccgccctccgcaggacggggccgaaggcatcagccagggcgcacccgcacgcctcgcactcggtggcactaggggagctggggaggttcctctgcgggatgcgtaggtcaggatagaacacaatgagcattggaggccggtccgagccctgattcatgtcgtaatgggtcagactcccagtcggtcaccaccgcgttatcaaagtgcaccacagaaccccggcaaatccatgcatgcatatcggatatccttctaatgcaccacccggcctgagcgccaccgcccggctcactcatgcaaaagagatgtgtgcaccggccaactcacgcatttgacggcgacctggctgtagtctcccgtgcgaacatcggcggccgtcagctcacatgtctgggcagaggctgcctggaaggttacggccagcaccagaaggacagcggcgaaagactgcagacgggccatcgtgcgtatgtgggtgtgaagatggagaggagatgggtaaggctgaggctgggggtgtcggaacgaaggctgtaatggagcggggtcggctgggagactttatatatgggttataatgacgtgtggaagcatggtctctccctattaacacgccaagggagtgcactcggacactcccgtgccgaccgtcagctactaccctttcggcacgtgggaaattcagagaacatcatgagtgggcgccctttctaccggcccgaccagagtgccggcgctcgcatgtcgcgcgggggacccagtctgcaaaccacaacaaagagagccatttgacagtgacattgtagtgaggggagcacgcaccagtcgcgtgtaaaggaacgctgctccctcatccaaggaaacatgtgccgtttgagaagtcggcttctcatcattctcggacctggnnnnnnnnnnagggagcatgcaccagtcgcgtgtaaagggcgctgcaccctcatccaaggaaacatgtgccgattgaaaagtcggcttctcatcattctcggacctgggatttgtgccatgtcatgaagtgggagacgaggaaccaaacccggactcccccgatcggacctccataatggtacacccttatttccagcactttgtcatgtgtcccgagagcgacatcacgggattcggggcattctgtcnnnnnnnnnnccccggaccccccgaccggacctccataatggtacacccttattaccagcactttgtcatgtgtcccgatggcgacatcacgggattcggggcattctgtcgccatggtggcggggcaaggtgcatggaaggagagggggtgaggtgactacatgttgcggccttggagtgggacgccgccaccctgcaagccaggcctggcctccttctcctcccgtccacccggagcgttctcggtggcatgcggcagggcctgggcattggaggaggacaccgagcggtactgccggtgggaggatggccgtggctccccatgcatccccgctgttgtgattggttggtgttgggcaaagggttgagttggtgcttgccagacgtctctgtcgactgaaaacaaagtgtccatgaaagagcttccactgcctgtggccctgtcgcaccgcaactctgatcatccagtgcagcacgcatacgcccacgccaccgagcgacgctgcaaatgtttactcccttcaaacataagcgtctggggcagatctcctgccccaaaggaatgagtaagaaacctgtgactgacgtggcagcgaacccccctcctcccccccctgcacctgagaaggggttgtagaagtccaggtcctccgtgttccggaacacggccgcgatgtggtcccgcgggttgaccccgggcctggcccccttccaccgcgccatgccctccagcgtggggctgaggaaggtgcccagcggcagcgggtgggagtcctgcgccccttcctggggccctggcgccggcgcatcgcatgcccacatggcccccgcctttgcgaagcccggggacgccaggctggcccccgtcctgaccagagaggtcgtcgccttgccgcgcaggctccccgccccgaccggggcggggacgtcgcccgggagcagcagcggcgccgggcgctgcgcggcggcggtttgagagtgcgccccccgcccctcgccgccggccggccccacnnnnnnnnnntgcggcggcggcagcttgagagtgcgtcccccgcccctcgccgccggccggccccaccggggtccaggccggggcgagcggcgtgtcctgcagaccctgcccgggatcgatggagcggtggcccccggccccgccctgcacgctggagcgcagagcggaggcaatgccgcgccagccctggctggagcgcggggcttccgcctcgggcggggcgttctcgcctggggcgcgtgcccgcggtgagggcgagccgtcgtcgagcgaaaatggttccgctctggtgccacgagacgatggcgccccgggcgccaggtcattggtgtggacggtgaagccgctgaagtggctcctggaggcatccagcgcgggcgcctcctcctcctccgtcggcgcctcggcgccgtctgggtgcaggccgcgggccagcgaggccaggctgccctctagagaagcccggagcgcctggtgccgggcggagcgcgcccgcccgccgccgctgccatcctcctgcgcagtcgtgccttgctgaggctgcgccgccgccgcctcagcttggcgccgagggtccagggacgcatccagcagccccgccagnnnnnnnnnngtgccttgctgcggctgcgccgccgccgcctcagcttgacgccgagtgtccagggacgcatccagcagccccgccagggtcaacccagccgcggacccctccaccccggcccggctctcccccaggctggccctcgctccagggcgcgtgggggtggggctgggggcgcaccccaggtgctccagcgtcgtctgcagcagggcggagagctggagctgctgcgcctccgcgtcgcgcgtggcagcctgcgcgtgcatcagagcctcgcccctgcacggcacgggagggggagagggatttgagtctgcgatggtgtctgtctggatggggaagggcacccataaaccaccactttccccgtacctggcggtggcgagcgcctcggcgcgggcgcgggcaaactccgagcggcgatgggcgagctccagggcctgcagcgtctccagcaactccacctggtcctgcatgggcagcagggaacatagtggggtgaagaggctgcagcaatcctgcacacgcactactgacaaggacggtgttgcatgtctcccgagccattcggaagcctgcgccacgccgtgatgcaatccaatcgacccatcgttccagccctccgctccctggcaccgacttgttggcagatctggcaggtgcgggccagcgcgcctatcttgcccaggaggtcacgcgccaggaagaggaaggaaggggacaggtcctgggcagacaggcgggtgtaggccagggactgctccccggctggggccacggggtgtgggatgcgggagaaggcatccgtcaggtcctgttccaccgccgccaggatcttggatcgggcggagtcggcctgaggtgtggtaggtgagcaaggggtgggcccaggtgagaagcactgccctcaccacctttaaattgcagcacttcggtgcaactggtcgttcagctctctccgcggtgctcctcgaggtgaaattatggacacctatataattcttgcaagaaatggtacatcttccacgacagccatgactcacgtaggcgttgcggagtgattgtggactccgctgcggggagccagcgtccccggccaggcagaagaagcgctgcacgaagcccaccatcacgggcagtctccgaccgcctcacaagaatgtgtgaattctcacgggtgcatgtgtggattctcattcccagatcagcactccgagtggcgtctgaacacctctccgacagctgcccggattcatagacgcatcatcctcagcacgcacacacgctacccccccacggccgctgtggcaaatcatcatgcccattcacgcttgggatctgcttaaatttaactgcacaggttcgagttccactagagaaggtgataagatgggtattatcgcggcatgcgtcgggtccaaaaccatgccgcaaagctggcgcaccaggcactcaggcagacgtgnnnnnnnnnngtgctttaaatttaactgcacaggttcgggttccactagagaaggtgatagatgggtattatcgcggcatgcgccaggtccaaaaccatgccgcaatgctggcgcaccaggcactcaggcagacgtgatcgctccggctgcgcctctcgcgcccggccccagcatcaggcccacgagcgcacgcaggcaccagaggacccagtacagcacaaggacgcccacaggggtccagcccaggttcctcacgtccgccagcggccttaagttcaccctccaaccccgtgccgccgccgcagcgacggcttcctgccaccgcgtctccggcgcctcccctgcccccccacccgccgtccggtccagtcccaaggcccgattgctggccacgctgagcgcgaccagcgccctgaccagcaaggcgacctcggtgctggccactgggcccagcatcgggtcgcccttgtaccgcacgtcccgccagctgctccgcggcaggcgctgcggggtggcgtatgggggtggggaggttgtgtgctaatgcaagaaaggaactgtgagggagggaggatgctgttctcgcatcggcgtcgtgaacccctttccctgtgccgcacagatcttacgagggctcccttaacatctcaagacacacacacctgccagccgtcgtttgannnnnnnnnntatcggcgtcgtgaccccctttccctgtgccgcacagatttcacgggggctccctcaacatctcgagacacacacacctgccagccgtcgtttgatacctccctagggtcaccatcccgtgtcccgtcccccgtcccagctgttcgatccggcgcagggccagaagctcccgtccctgccgccctttccaggtcaaacaccgtggcgaggcaggcccgcagcgcggcggcgccttcttgcggcagcacctgatcgcccgcgctggccaggtccagtgccgccgcggcggcgctggacaccccgcccgcccccgccgggtcgaacaggctgggcgcggagggcgcggtccccggctgcggcgcgtgccaggacgcggcggccnnnnnnnnnngtcgcccgcgctggccaggtccagcgccgccgcggcggcgctggacaccccacccgctgtcgccgggtcgaacaggctgggcgcggacggcgcggtccctggctgcggcgcgtgccaggacgcggcggcc

SEQ ID NO: 41791 - DNA, 69 bp, Chlorella protothecoides
ggcgcagttggttgcctcgatcggcgaaccggaggggtggggggggcgggagaaggggaagcagggggg

SEQ ID NO: 41792 - DNA, 126 bp, Chlorella protothecoides
agcttggcgcgcctctccccgtgtccagccgacgcgccgcttcttcattttccccccaccccaagaacagagacgacccgcggctggcgcgggcactgctggccgccctcaaccccctgctgctgg

SEQ ID NO: 41793 - DNA, 61 bp, Chlorella protothecoides
ccccgccccgttggcgccctcccctgggcgaccagccgggcctgggcccaacatgggtgga

SEQ ID NO: 41794 - DNA, 127 bp, Chlorella protothecoides
tggggcgggggcatccacatgtgcgcggggggtggggtggtggccttcctttcttcggagccggggaagggaggaaggggctgcgtggacgtttgtgatggagctgtaggtcccctgctggagcgag

SEQ ID NO: 41795 - DNA, 61 bp, Chlorella protothecoides
gagctcgcgaccctcatacgaaacggctggggtgcatccatgctcttgatcagatctcaat

SEQ ID NO: 41796 - DNA, 151 bp, Chlorella protothecoides
cgattcttgtgggctgtcgttggagtggggaactcgagccccagccacaaggctggtgcactgcaatgccggcacgagatctccgcattggagcaacccatgccctgccggccacatgcccggcccccctcccccctccctcgactgctca

SEQ ID NO: 41797 - DNA, 7599 bp, Chlorella protothecoides
  modified_base (119)..(128): a, c, t, g, unknown or other
  modified_base (472)..(543): a, c, t, g, unknown or other
  modified_base (854)..(863): a, c, t, g, unknown or other
  modified_base (941)..(950): a, c, t, g, unknown or other
  modified_base (2765)..(2774): a, c, t, g, unknown or other
  modified_base (4300)..(4309): a, c, t, g, unknown or other
  modified_base (5077)..(5086): a, c, t, g, unknown or other
  modified_base (5267)..(5276): a, c, t, g, unknown or other
  modified_base (5457)..(5466): a, c, t, g, unknown or other
  modified_base (5594)..(5603): a, c, t, g, unknown or other
  modified_base (6731)..(6740): a, c, t, g, unknown or other
  modified_base (6919)..(6928): a, c, t, g, unknown or other
  modified_base (7448)..(7457): a, c, t, g, unknown or other
cggcgcgggggccggcggggacgcgcgcggcgagggcggcgcaggcgcgggcgagcgggaggaggacggagcgcccgccccgcccgtcctggtctgcaccgacctggcggccaggggcnnnnnnnnnntgagggcggcgcaggtgcgggcgagcgggaggaagacggagcgcccgccccgcccgtgctggtctgcaccgacctggcggccaggggcctggacatcccgggacgtgtggaccatgtgatcaacttcgacttccccctcaaccccgtcgactacctccaccggacgggacgaaccgcccgggcggggtccacaggtattttgagggggacaaagctgttgagtatgggttctggcgccagccatgcgcggtctgattcttgggcaccacagccgacgccggcgacgccggcaccctccactccatccaaccccctcctcccaatggacttcagggcgcatcacnnnnnnnnnnnnnnnnnnnnnnnnnnnnnnnnnnnnnnnnnnnnnnnnnnnnnnnnnnnnnnnnnnnnnnnngcggcgcggatcgaggaggcgctgcagcgcggcctgcccctggacggcctgtcggcggaccggcgcgtgctgcccgaccacgcccggcccaagcctgagacgctggcccggcgggccaaggagcggctggtggcaaagcacgagcggcgcgggcggcggggcggggcgcgcgacgaggtgcggggcggctggaaggtgcggggcggggagccgcgcgctggggagccgcgcgccggggagccgcgcgcaggaccccgggcggggtctagcgaggaaggggccgggcccaagaggtacggcggggggggggnnnnnnnnnncaaatggaaggcccccacgggcaggaagccctttgccgcggcgcgcagcccgagccagcagccgaagcggggcagcgnnnnnnnnnncaaatggaaggcccccacgggcagggagccctttgccacagcgcgcggcccgagccagcagccgaagcggggcagcggggcgagggcgaggccagggaagacgactggcggaggcagcaggcacgccagcacgaaacgatgaagcaggagaacgggtgacggagattgcgctgcagtacgagcagcctgcagacacgcatcggcatgtcccccaccctttgcaacaccgtttctctcagtgtcataaacagcattctgacacgcacatcaagagctttgcgacaccatccaaagagcatggagtccatcagtgccatcataatcagaatgtcagggtgtgtgccaccttgatggtccgtgtattacaccacaggctgggacagtgggaacggcctgcacatcctgaatttgtcaagcgctcaagggcccccgaaggggggctgtgctcatgcaccgatctccaccagcgtcttgccgcccgccggcgtcgtccgccgcgcatgccgcctcgccgctcgctcggcggccatggggatgacgcgcgtgcgcacctccatctccgcgtcttcccgcatcatgatctgcaaggccggtgtcacgttcaggtgagcaaggaggctcgacctttcctcgtggagctggccctctgcgaagattgcccagtgctcaggttgacttcccacaaggccgcacttcccatcctcaccgtgaggtgggagcggtacttgtgcagaactccggaccgcccgcgcgcatgcatggagttgcgcttcaggtactggcccttcccgacccacatctcgtctttggagcgacgagggggttggacggggggaatagatgggtgatgacccttgaacaactgtggtttgtgccctccagcgcacatcagcagtgtggtgctgaggagtgcccccctggactcctccagattgactgcggccaagggctgcactcacaacatgatgcggcacagctacactccctgcaggctggcaggtgccataaccttcacctgctttcgctccccaaaacatggatccaatgaccagctcacctataagaagcttctgtgggtccacgccattctggtcaatggccttcttccggcactcgacgatggcctcctcgcagagcttggccgccttcttcaccgacatctgagggcggggaggcatgcgcagcacggcagtgagaagtggaatgtcttggggagaggtcagggcagcctcccagtgaacagtccagtggtcagggctgccccgcagtgtgcattacattgcctgaccttggaggccctgtgcatccctttgagcccaaagcatctcccccccttcaccagctgggcgctgcacgcacagccctagcaccctccacgcctgcacccaggcatgggcctctggcatccaggcagcccgcacctggcactggatgatggcatcgtggatgctctggccgcgcagcaccttgaccatgtcgttgagcttgtggggggatatgtgcaggttctcgctgaagcccttggtgtacaggttctccccgaagacacccttctcctggaacttgaagcgcgggtccttcttcttcttcttgtactgctgcgagccttgtggcgtggtctccggctctgggatcgccacctgatccagaggattcagcgtgggcgcggcagtcgcatagcaggcgcgccaccgtggctgtagggtggggaggaagggtgggtgctggtgtgaccaatgcacaagctggcctgggcacatagaaatgctataaatgcatggaatatatcaaacatcagtggcatgtaacccctcnnnnnnnnnngatggacatgccataaacgcatggaacatatcaaacatcagtggcatgtaacccctctcggggatggttcgatgcctccctacctgaggtgcaacacacagcggggaaggggaggcgctccaactgggcactgcagcgacgattggctcgccccggcgtaacgcacacccggccaggccagtggtcagccgacggagataggcaccgcaacctgacattatatatttgcgtgcccacctcctgcgccgatcgccgattgccttttacacacaggctggagggagttgccggcccgctcagaggtgtgcagcgtcggcaacgggcttgtattataagccgatttgataagaatcaactttcgcttaatacttcaattgtcacgctcctattccgcacgacgagcgtgtcaccgaatgctcctctgtgtgtccggcaggtctctccttttctttcttcagggaggggcggggggttaaagtggaggaggagctactgttcacggctacctttacagatcggcgacagcgtgttgagctcgtcaagcaactaatatatcccagaatcgacatacataggattccaaagtttcgacgagacacaagaagacctcgactctcaaacgttgattcggtttgctccccagcccttcgtacaagtatacccatgccgtcgtctcaagggctcatgccctgcgacaccaaggaaccaagctcatgccctcctacacctccactccggctgctgacgctgcatgacttgccccatggggatggcgtcagcgccaggagcctgcagagcctcttccgagaacagcaggagtgagtggcagcgcccctgccgcgacaggggcattctgcatgggaattctatcttcaggagaacctggcctggcgccacctgggtgatggctggagtgccctacgcgcaggctgcgtgtgcgcacgcgctcgctgcgcagccccgccgctgcgtttgaatcagtacccaccggctggacccccgacgttgagcaccaggtccccccgtcctgcaggtacctcaactacttcttcaccaacctcgactatgagcagatggaaagcttcgtcaaggtaatctgtcgttgcctcctgtgtgatgttgggcgctgacgcctgtgcctgggaatgtcctgcggggactccaaggattcaccagttcgctcacctctgccattctgcgcggcacaggcctgcctggcctgcaccgggaccatcgtgtgcactggggtggggaagagcggcttcatcgcgcagaagatatgccagaccctggtgtccaccggcaccaaggcgctgtacttgtcccccaccgacgccttacacggcgacatcggcatcctcaccgcccacgacctgctggtctgcttctccaagagcggcggcacggacgagctgctgcgcctcatcccgtatgccaaggtgagaggacatgcgccacggctggcttgcagtgctcgcgccggtggacgggtgtttgctccaagcttcagtcgagttgcagggctnnnnnnnnnnactggcttgcagtgcacgcgccggtggaagggtgtgtgctccaagcttcagtcgagttgcagggctggcgcatcctcccttacagcctcgctcaccctactcctccctcctcaaacaggcaaaaggggccaagattgtctccgtggcatccatctccggctgcaagatggagacagtgtgcgacctatccattaacctccccctcaagcgcgagctgtgccccttcgacctggcccccgtcacctccactgtcatccaaatgctgtttggcgacacggtggccattgcgctgatgcaggtgggacaggaaatggttgggaaggaagggcagcgctggggccatgtttggcgtatagtagggacccggcagggtgatacatagttgatagccgtgtcaggcgaccagcgggatgcgagaccgctacctgtgctacacccaatccttgcggtcgagaatgccccaactggcggcgcaccttaccctctaagccacccttgctgtccgcccacaagtatctcacactccgctccacacaggccaagcacctcacgcgggacgagtacgcaatgaaccatccggcggggcgcatcgggcgccgcctcatcctccgcgtgtcggacgtcatgctctccaatggcgacatccccattgtctccgccgacacggtggtggcggacgcgctgtctgagctatccagcaaggggtaagttgggattggaggggagtagtgggtgttacgtggttggagtatggtgtgtagcggcggnnnnnnnnnngatggtaagtatgaccccctccttgctgccagttgctaagcagacccaggttgagttctcagaacagtgtttggtggcgtactagccaatcaaatgcgctgaggcatgccctgcaataatcccaacccacactaccatccgtgtaggtgcggctgcgtgctgatcgccggcgccgacctgnnnnnnnnnncatgatgagtatgaccccctccttgctgccagttgccaggcagacccaggttgagttctcagaacagtgtttggtggcgtattagccaatcaaatgggctgaggcatgccctgcgatgatcccaacccacaccaccatccgtgtaggtgtggctgcgtgctgatcgccggcgccgacctgnnnnnnnnnnagtttggcaggtgtgatctggttaccatgttcagatgaggcaggcatggagggcagtgctgcagagcacacgagcggctgccgacccctatcccaacccccccattctgcacgcagaccatgggctannnnnnnnnnaagctgcagggtgtttttacggatggagacttgcgacgtgccctccaggtgggttggatgatgggagggatccgcatttggcaggtgtgatctggttaccttttccagatgaggccggcatggagggcagtgctgcagagcacgcgagcggctgccgacccctattccaaaccccccattctgcacgcagaccatgggctactcgggcaacctcatgggcacgcgtgtgggcgacatcatgaccacctcgccccgcaccgtgctcctctcccagaaggccgcccaggccatggatgtgagtgtgcttggacgaggatatgggagggaggggggggggcggtaatggagcatccagcgcctgcgcaatgtttttatgacgggctgtctggccttcacctgtcactacaatccctttgtcaaccaatccatgcctcaataccataggacatggagaccagccccaaagtggcggtgctccccgtgctggatgaccagggccgggtgtcaggactggtcaccctgcacggcctcatcagcgccgggctgtagaagctttttcggaggaccccctcaagtggagggcttcatgcattctttcacgcagaatggccggcaaagcatcgccaggagcgtcacgcccttcccatacctttgtaggggccgcgtccccaatcatctggtgcagcaccctctcgccatcactctgcgagcgtgatgctgtcgagctccctcttgacgccgtcatgttgggaggtatccctggtgagcccacgcccccatccccccatgcgtgcaccctgccgggcaccgtccgatggtattgcactacaccttctatggcccgcacacgttggcccctctatcgtacatgcttgcctttggcaccctcctgatagcctcttcagctgcccctcccatgccaagaatctccggccattggccagtctttgcacccctggtgccaacgtcctccagcgcttgccccgatgctgtgcgcatgcatgcgcctgactccttgccgccactgaactcccttcattcctgcacctcacgcctgcccatgccccgccgcgtagtacgccttggaatgcccattcaaacacacatgccggtgatagacatggggannnnnnnnnncaaactcccttcattcgtgtacctcacgcctgcccatgccccgctgcgtagtacgtctcggaatgcccatttaaacacacatgccggtgatagacatggggaagggggctggtgcgcagtgccccacaccctccatgccccttctcaagcaccctcgtcgctgctcccagagtcgatgnnnnnnnnnnatgccacactccctccacgcccattctcaggcaccctcgtcgctgctcccagagtcgatgtccggcagggagccgtcgtcactgtcgctggcaggctccagggggagggtcttgggagcagacagcccgcgcggcgcgggctctgctgctcgctgcggcgccgaggccgccggaccagtcgttccccccgtggctgggcgcttggcggccacctcctccgccgcgccactctcctcgggcggccctcgcttctcggcctcacgcacctcccgggcagcgacggtcaccgcaaagtcccccggccctcccaggacctgctgcgcctgccgcgccagcgcgtgtgcccccgctgcagggccctcgagcccctggccgtctccgaactcgctgctgccgtcggggtgcgccagctccatcggcgcacctcccgaaccgccctcggtcgcccccgctctgtccgccgtggagttcggcctcgcctcgccctcgggcgacaccagcggcgaccagaaggaggggnnnnnnnnnngccaaactcgctgctgccgtcggggtgcgcctgctccgtcggcgcaactcccgaacaaccctcggtcgcccccgctctgtctgccgtggggttcggcctcgcctcgccctcaggcgacaccagcggcgaccagaaggagggg

SEQ ID NO: 41798 - DNA, 61 bp, Chlorella protothecoides
ggtgcagcagctgggcgccatgctggcgcccgactcgccgggcggcgcgctgcccgcggag

SEQ ID NO: 41799 - DNA, 2625 bp, Chlorella protothecoides
  modified_base (706)..(715): a, c, t, g, unknown or other
  modified_base (962)..(971): a, c, t, g, unknown or other
  modified_base (1628)..(1637): a, c, t, g, unknown or other
  modified_base (1726)..(1735): a, c, t, g, unknown or other
  modified_base (1998)..(2007): a, c, t, g, unknown or other
ccccccgcgccgcggacgccgaggcgcgctgcgcgcgcttccgcctcgccggcaccgcggcggccaaggcgctgcaggacgggcgcctgctggacctgcccctgtcgccgctgatgtggcgcatggtggccgctgtcgacggcgccgccgcggagggcctggccccagacctcgtggatctggagactgtggacccgggcctggcgcatggcctgcgccggctggaaagcgcggcccgcgccccgggccccgcgcgcggcctggtggacggtgtcccgctcgccgacctctacctgcccgcagaccggctgccggggtaccccggataccgcctggccggcgtggatgacgcgccgggtgcgttggtgggcgtcgcctcggcgccgcgctacatcgcggcggtgctggacgcgacgctgggcgccggcgtggcgcgccaggtagccgctttccgggctgggttcgccgccgtcctgtcgccggacgtgctcctccggtttcagcccgaggagctggagctcctgctctgcggtgggttgagcaatggggcagggggaggatctgtggacatgaatggtggggggtggtgaggagggtcgtgggggtgggcggcggtggtttgggccggattcaacagcagcaaagggtcgaccttccccggactgttggaagaacaggtcctcctccagacatgggaaggaggtcnnnnnnnnnnctttcgacagcagcaaagggtcgaccttctccggactgttggaagaagaggtcctcctccagacatgggaaggaggtcatatttttatggctctgtctggcggcagtaccctgtggcaccaggaggggctctgaggcataggccggccaccagccgcatgcagtcccaaacctctgtaccgagacagcagggtgccttcccagtcagaacccagctccaccccctcctcctcctcccttccttcgtnnnnnnnnnnccaccgagacagcagggtgcctccccagtcagaacccagccccaccccctcctcctcctcccttccttcgtcccgctcccagggtcgggcgaggcgtggacggcggaggagctgcgatccgccatccactgcgaccacgggtacaccccggcctccgcccctgtgcgctggctggtggaggtgctggccggcctgggccacgcccagcgccgcgccttcctttccttcaccactggcgcaccgcggctgccgcccggcggcctggccgcgctgcgcccgcgcctgaccgtcgtgcgcaagagcgcgcggtcgtggcgagaggagggcacgggggcgcgcccggcgccacccagccccgcgtcctcgtatggcacgcccggtgcggtttcttcgccgggacagggggctgcactagacgcggatgccgacctgccctccgtcatgacctgcgccaactacatcaagctgccgccctactcgtgcaaggccgtgctggaggcgcggctgatgtacgtgcttgcggagggccagggctcattcgacctctcctaggctggttggacggtttctgcgtgttctcagggccgccgctgtggggagggtcctcagaggccactgacatgtcaattccatggacgaggcgacccagcctgggannnnnnnnnncggcacgcccggcgcggtttcttcgccggggcagggggctgcactggacgcggacgctgacctgccctccgtcatgacctgcgccaacnnnnnnnnnntcggtctctgcgtgttctcaggaccgccactgtggggagggtcctcggaggccactgacatgtcgattccatggacgaggcgacccagcctgggatgcacccagcaatgtcttcgcggggagattctttcccccacccactttctctcgactcactttgccatgctggggctcttgcagctgcatgtgcagccgcccgaattcccacatccatttccaaccccccccctccgccgtcacaacgaactcttctcccctggcagnnnnnnnnnnaggaaattctccctcccaccccctttttctcgactcactttgccatgctggggctcttgcagctgcatgcgcagccgcccgaattcccacagccattcccccccccaccccgtcacaacgaactcttctcccctggcagcttgcacgccgtgtaccaagccctgcgctgtcgagccctgtacatttcaacagtctgtacataccgcgcaagcctggttggcaagctgcaatgtctggagggcccagaatgtggaggcacacagacaagggccatgtgggtgccacaggtaccacgcatcaacacccctcacacctcggaggagggtccgttgccgagcgccgagggcgggcgggcgcgcaggatacgtgccaggcggtccaggccctggtgcgcgttcaggtgggcaagggtggccagcgcgtccacccagcactcggcctcctcctcgccgtccagcacgaggaaagcgccgcgcggtcgccccgtcagcgccagccagagcgcgtggccctcggcggggagggaggggtcccgtgcacggcacgcgccgcgcagctcggctgcgcccaggcgtagcgcggcgcccggccccaggctgcgcacgcccgccgcgtcca

SEQ ID NO: 41800 - DNA, 3351 bp, Chlorella protothecoides
  modified_base (439)..(448): a, c, t, g, unknown or other
  modified_base (628)..(637): a, c, t, g, unknown or other
  modified_base (813)..(854): a, c, t, g, unknown or other
  modified_base (1908)..(1917): a, c, t, g, unknown or other
  modified_base (2096)..(2105): a, c, t, g, unknown or other
  modified_base (2512)..(2521): a, c, t, g, unknown or other
  modified_base (3062)..(3071): a, c, t, g, unknown or other
  modified_base (3158)..(3167): a, c, t, g, unknown or other
cgccgccgccgcggcccgtgccggccagctcatcgctctgtcacgcgcgcggcgggccctgggcgcctggcgccgttgcgtcgccgactccgcgagcctggaggtcgaggcggcggcccatgccgcgcgaagccgcgcccagctggcactgcgagcctggagggccgagacccagcaggccgccaccaggcgctcccgcctcgtccagtgagtggagggcgggcatgcgttggcggtggcattcatgagcgagagaggggcttcggctgcgattgtggcagggggacgtggcgtggcgccggtcctggtgctgcaagacggctgccttgactccctgtgcctgcagtgctctggatgacgtaggcatggacaccgctggcatggagctgaatcgcagggcatgcgtcgcatccccgactccattggcacaccatcgcannnnnnnnnntcatgggcaccgctggcatggagctgaatcgcagagcatgcgtcccatccccgactccattggcacaccatcgcacctcccccccccttccccccccctcagaacttttgagtgacctgacccccccacatcctttccttccccctcccacccaggttggtggaaggcagggcccgcgcnnnnnnnnnnttttgagtgacctggacccccccattctttccttccccctcctacccaggttggtggaaggcagggcccgcgcgctgcagcacgcggcgctggccgcctggcgcgaccacaccaagggcctgaggctcgcctgcgccacggtggcgcgctgcctggagggcagggccgccagcctnnnnnnnnnnnnnnnnnnnnnnnnnnnnnnnnnnnnnnnnnngccgccgcgcgcgccgccgcgctgcgccgcaggggcgacggcgcatgcgagcgacgcgcgcgcaggagccaggcggcctgcctcgcggtctggagggagtggatggtcgggaggcggcgcgagcgggcgctgatggccctggccctggcccgcgccgatcggcagaggtgtgttctggtggagctgtttgtgtgcggggtgtgtgtggtcggggaggaggggagacccaactcggattcgggcgaggggtaatccaggtcgcagactgccagggattcaggtgggaattcggtggacgagggcagaggaatgtggggacctccgagactgcacctgcctgagcaggatgtcgatcttgctgggggtcccgggcgtgcaaggtgcggaaccaaggaacgcgcacgctagacccgccaccttcttcacacacccgcctcctggtgacccgctgccgcctcgccccgcccccccggcagggcgcacggggtgctgcaggcgctcgccagcaacgcggaggcggcacggtcggagcgggcgatggcccgccaggccgatcgcttcgggcgccgtgtcctggtcggcaaggcgctgggcgcctggctgggcgcccgcgacgccagggccgcgctggcagccaccctggcacgcgtcgggctgcggcggcaggtgagctgcgctgcctggaggcacggccgtgacgtgcccatcgccgtgtgcacctgagctgcggcaccacgtcggcgaacgagcctgcaggcactcctccaaccccctcgccacccccacacgccccaggcggtgctcgagtccgaggtgctggcggcgtggcgcggctgggtgggcgaggtgcgggccgagcgaggcaccgtggccctggtgcaggcctggcagcgccgacggcgcgcggcgctggtctggcaggcctggcgcgaggcccatgccgcgggccgactggcggaggtgcaccgaggatgaggggcggggagggggaagcttgatcgggtgtcggacagggggcgccgcgagggcatcatgcgagcctggtgggccgacnnnnnnnnnntgaggatgaggggcggggaggagcaagtttgatcgggtgtcggacacggggagccgtgagggcatcatgcgagcctggtgggccgacccttggggggtgccgtgtttcctcctcctggcacctccccgtaagatctttggacatccgacacccgtccagccgcaacccctccatcacannnnnnnnnnaaaagatctctggacatccggcacccgtccagccgcaacccctccatcacacctgcaggatcgggcagaggccctggccgcccaggtgagagccaacactgcgcgtgaggcgctgctcggctggcacgcctgggtggcggcgcagcgcgcgcaacgcgccaagatgatgcaggccgtcatgcgcgtgtccgacctgcgcttatgctgggcctttgggaagtggcgtgcgcgcgccgccgagaagggactggagcaggagcgcctgcagcgcgccaaaaggtgaggggcgcgattgagtggggtggagaggggaagggggtcgtgcgaggagtggaatcagttgagtacgtgagtactcgagaagaaatgctgcgaccgaggtgggacacccgtcgccggtgccagannnnnnnnnngtgctgggcctttggggagtggcgtgcgcgcgccaccgagaaggggctggagcaggagcgcctgcagcgcgccataaggtgagggccgcgattgagtggggtggagagaggagggggtccgtgcgaggagtggaatcggtcgagtacgtgagtactcgagagaaaatgctgcggacgaggtgggacacccgtcgccggtgccagaagctcagctgtacgtcgtccagtggggtcttgaggccgccaggccggccgcgcacataccctcactggctacttcctagtcgccagcgtcatccggcatgacccaccctccccatcgcacacccggcccttccaggtgcctgcaccgccagcagtgcgccagggtgctgggcgcctggcgcggcgccgccgaccgagcggtccgccagcgccttggcgtggcggagatggtggagggcgcccgccggcgcagcctcgcagccgtcctggacggctggcgtcaggtcaactctgagcgcgcggcgtgtctcgcagccgctcggcgtggcgcggagannnnnnnnnncggggccttgaggccgccaggctggccgcgcaggtacccttactggctacttcctggtcgccagcgtcatccggcatgacccacccnnnnnnnnnnatcctggacggctggcgtcaggtcaaatctgagcgcgcggcgcgtctcgcagccgctcggcgtggcgcggagagtctgagtgctcgccgtagagcaacaaacctgcgcgccgcgctctgcgcctggcggctgcacgccggcgaggcggcctccacgcgccgcgcggtgacggcggcggccgacg

SEQ ID NO: 41801 - DNA, 77 bp, Chlorella protothecoides
ctctacccgctcctcttcctgctgcaggtgcgtgtgtggaggggggttgaatgggggcaggatttgtggatctcgat

SEQ ID NO: 41802 - DNA, 74 bp, Chlorella protothecoides
tggctgcagcacccctcggggcgacaggggccagcttcacactgtcacactgtcagcagcagcagtcgcaccac

SEQ ID NO: 41803 - DNA, 67 bp, Chlorella protothecoides
gccggttgtatcagaggggtatggaacagtgcagggcctcctggtgctcttcgtcagtctgagtgtc

SEQ ID NO: 41804 - DNA, 61 bp, Chlorella protothecoides
tcagcagggcagcgtgggcctggagctgctaaccaagtgcatgaaccgctacttcacgcag

SEQ ID NO: 41805 - DNA, 5260 bp, Chlorella protothecoides
  modified_base (2805)..(2814): a, c, t, g, unknown or other
  modified_base (3734)..(3743): a, c, t, g, unknown or other
  modified_base (5029)..(5038): a, c, t, g, unknown or other
ggcaggcgctgccggcgcggcggccgccatgggcgcgctgcgggatgcgacgacggccctgctctccgacgcggcgggcgacgcggccgacctggccgccaaggctgcgctgctggaggcgctagccaccgacctggaggcgctggcggccacggctgggacgctgggcgacgtggcggcggcgctggacgcgctgggccccgcagccacgcgtctgctgaacgagacgctgccggcgctggtggcggcgttccagggcgtgcaggaggggtacaggggcgtggagccctgcgtgaacgcgctgctggccgccgcggagcgcgtggagacgcgcgtgctggcgctgccggccgcgctgcgcggccaactggcactgctgggcgaggtgcactccgccctgcgcacgctgagcaacgtgactgccgactggggtgctgaggtggacggcctggccgaccgcctggacgtggatgcggtgctgggcgggctgcggtcgccgctgcagagcatgcagggccggctggcggggctgggcaacctgaccgccacggcccagaccctgcgcgacacggcggcgaccatggaggcgggggagggcgcgctgcgcacgctgcgcacgctggccgccgcggcggtagccctcagccccgacgccacctcgtacgacctggcgcgcgccgccgccggcgccgtggccgaccagctggcgggcgacgtggggagcctgggcgagggcgtgggtgccctgtttgacgccgccgacagcgcgagtgccgaggcccaggcgctggctgccgacccgagtccgctgacctcggtgctggccagcccggacggcaccatccccgccgcgctcgccctcattgccgaggtgccagagcccgccagctacgcggacgaggcggcacagctggcccaggggtacgcggagctgccgtccccgccagggggactggtggaccaggcaaaggcggagatcgccagcatgctctcgggcgtggaccaggtggcggttgctgggaggaagggcgtgaggaggggcctacttttctcgcagctgtagggttggggtggctggatgtggggtgcaggccgtccctcccaccgggcagaccctgtgtagcttgttgaggcaccctctccaagaccgtggaacgactgggcgccaggatggatgcagcttttccgctgcatctttgaatgctggactccggccctgtgtccccaaacgcttcacacaacaccctcccacccacttctgaaatcccgcagtcgctgacgtcggctcgctctgtcatctcctctgcgctgagcgacgtggcggcacctctccaggaggcgcacacggaggtcctgggacgcatcgactccaccgtgcgcgacgtacgccccaccgcagaccgctgggacactgtgtgagtggaatggaccaggcttgggcctgttgcttgcaggagcaggaggggggcctgacgggactggagtgaagtggtgtctctgggccatacacactgtgctcggccggcggggtgcaagggcagccgcatcactgtggtcgaatcagtagaggcgcccaatccccgctcaccctccccaccaacgccgctacctctgcaggcgcctggtcgtcatgtatgtcatcctcatcctgatcggcctgctggctgtacagactgccgcagccatctggctgaggtggccggcaggcgtcaagctgggggctgcgttgatcgccatcttcctcctcctggtcggcgtggctgtgctggcgctgacggcagggttgaagattgggaatgacgggtgagaggcggcgggcgttgtctttgtgttttgtgtgggaactcctggccggtacatgtgcatgtcctggtggtgcgccatagagcccaagcatcgcagtgaagtgagggccagatgctgcgagcaggtgggcctgtgccgccgccctcactgcggccggtaggacgagctatcgtgcgccctcttgcaccaagctctgtgccgccttgcagcaaagaggcgtcatcagtacctgacaggcaatgtcgaccaaagggtctcaataccaacgccccacccacacctcattcgaatgatcaacgcgcaggtgcttcaacctggaggatcaggtgctgctgaggctgagcaggctggagagccccggcgccgccttgacactcgccaagtactggctcttgaacgagggcaccgtgggcgaggtgatgcacgtagctggtgatggttagggagctgcagcatgaacggggtggcagggcgaatggcggcacggcctgccaatggaggatgcagccatgcagagggtgaagcggcgtgctggacatcgtctgaccatgtccgcgcaggcgccctgagccccatctcccccgtactacccgcccacatgcatacaggtggccaagcaggtgttcagcctggatgtggagggcgtgctggaccagatctcgaacagccgggaggacctgctggaagccatccagaacctgaccctgcgcgcgccgctgcagagcttggtggacgccgcgctggacgcgacgcaaaacatcagctccggcatcctgctcctccaggaccggctggactacgccaacgtgcacccaggtgggtgtgatggaggggggtggaggggttcgagactctgagcggcgcagggcctgagccgagggagcggtggcgcccgcccgattctggtgcacgggcgggcgtggagcgggattggtcgagaccgccatccgcacggcggcagaacgtggatcgcgcgcatgctagacccaactcctcacnnnnnnnnnnaagactctgagcggcgcagtgcctgagccgagggagcggcggcgcccgcccgattctggtgcatgtgcgggcgtggagtgggattggtcgacaccgccatccgcacggcggcagagcgtgaatcgcgcgcatgctagacccaactcctcacagacgaacggctcttggcgctgaagccgtgacccaccccacgccaccacctcaaaccacctacagagtacatgtctctgaagagctacgcctgctgcagcatcctcaacacagctgggcacctgtggtttgccctgctgctggttgcagggtttggcatcacgctgtgcgtgctgtgcctgccctgcatacacagcatggacgacgtgcccaagcagggctggggcatgcgcatcagcaacgcctgcctcgcccgcctggcccggcccctcgccagccagggcctggaggctggggtagggggcgtgctggtgtcagcgtctgccgcgtcgccggcgggggccattgtgcgcaagaagtcgaccctgccggaggcgccggcgctgcacaggcgcagcgacaccattggggcatggtgaggaggtgggggggttgggagggaaggaggatggccccaggagacaggcacctcacagcatgtgccagccgcctgctgcactgaggtggcaatggggcatgggactctgaagtctttcctatgtgtgcctgggcattgtaattgaagtggcatgccggaccctgtggctgcctccacccagctgacatgtaaccacaccaccccaggtctcatgctggcgagctgccagaggatgtgcacaccctctccgactggcacccgccccctaaccccgcacacaacctgcacaaccggacattgccagacgcgagacacctgccaggaagccggccaggaccggaatcgccgtgannnnnnnnnngttgccagacgcgagacacctgccgggaagccggccaggaccggaatcgccgtgattcgtgatcaccccagggcttaccagtgaccatcacgctgtttggctgcatcccatatttcaacatattcttgagctgtacccccatgtactcccaggataccatccgtttgccgcgcgccattcgccggccctttgccttgacccagctccaccaccttcccaggcctatgctgaggcctcgacttcaggggtgctttgacatcgtcaccatcccctggactctgccttggagtgcgtgtaacatcgcacgtcatgacacgcaaggatgcgactgcagcgcgtcacattggcgatggcggactgatgccacccgcccttcgaccgccgacacacccgggacctcagcccagcatctgccggagcttgatgagccgtttgagggccgagagccaggccgccgactcatcccagtcgtcgcgcgtgagcgcggcctgggcgcgcgcggcgccctgcacgtccccggcgtccagcgccgcgcacagcgtgcccagcttgcccgccaccgagtccgacacgccgccctgggccaggcgccaggccagcaggcccagccgccggccggcgtcgtccagctcgcgggcccgccccggctgggccgcaaaggcggcctcgcaggcgcggaagaggttggtcagggacaggacgacggggcggagggcgggggagatgccgctggtgtccgcgctgagcagcgtggtgccgggcggcgggccccctgctcggcccaggggggaggcaggcgtggaggacgctgaggacgctggcgctgggatcaaagggtggggtgtgggaggagtgtattcgtttcagggggggaggggggggaggggttggagtgtggaggccctgtcaagcatgcaggggacatgccatgccaggcagtccactcgtcccacacagctgcctggggaccgcacccgacgaccgcaccaaccaacccatccaatcacctgcggggggtgcatacgtctgctggctgggctgaggggtgtacgttggttgcggcgcaaacgtggccggggcagcagggggcgcgggtccgggcgggggtgcgtacgtggcggggccaggccccgcgctcggggcgggcgcaaaggtctgcggtgccgcggggggcgcatagccgccccgcggcgcatgcgtggcggggggtgcttgaggagcctggagaggcggcgcgtaggtggcgggggtcggcgggggcggcgcatacgcgctggggggtgctnnnnnnnnnnacgccccgcggcgcatacgtgctggggggtgcttggggagccgggaggggcggagcatacgtgctcgggggccccggcgcgtagctgccgggcgccgcgtgggccggcggcccctgcggcgcaaagtaggcgcccgggctctgctgcgaggcgtaccccgtggggctgggcgcctgcgcgggcggcggcgcaaacaccgcgggcggcggcgcgccgtacgcc

SEQ ID NO: 41806 - DNA, 124 bp, Chlorella protothecoides
atccatgcggtgaatgtgcagggtgaggcgttgtagggatgggtgtggttgccgtgttggagggtgctatgggtgcggggcgatccatgacgaatgggtgcactcctctgggtttggacataga

SEQ ID NO: 41807 - DNA, 119 bp, Chlorella protothecoides
ggcgtcgggcagctggcgccacacctctgcggccgcggccctggccagctgtgagagtgaggggcgtttgtgggtgtggaaggagtgtgaggggccgtgcgcggagaggcgtaaggaag

SEQ ID NO: 41808 - DNA, 146 bp, Chlorella protothecoides
cgcccgctcgtgctgcaggcgcccgaggtgggctgaatgcgtggggctgggagccgggggcgtttggttgcggcggggaggagcgtcgggcatgagcgtgctcctgtgtcggaccggggacggccaacgccgccggccgccagcat

SEQ ID NO: 41809 - DNA, 77 bp, Chlorella protothecoides
cgtctctccaggcggtcccggtgagcaggggccattctgatatatggaggcactcccgggtgcaccggccatcggtc

SEQ ID NO: 41810 - DNA, 61 bp, Chlorella protothecoides
gaaaacatagtgcaccaatctcaggactcgggcagcgctcaccttggcccagcccaaggtg

SEQ ID NO: 41811 - DNA, 61 bp, Chlorella protothecoides
ggaggggtttggatgttgtggatgtggcgggggaggaggggaatctcgggctgtggtgctc

SEQ ID NO: 41812 - DNA, 162 bp, Chlorella protothecoides
aggggcgcgggtgcttgacccctgctgaggtaccgtggggctgcccctgagcatgatgcaggggctgactttgaaaagcgggggtttcctattcaagcttcctccacatccatccatccatcacccccctcgtcctcctccccccgccgcgccctcgcaggc

SEQ ID NO: 41813 - DNA, 61 bp, Chlorella protothecoides
ctggcctcccattgcccacgtgcgacacggaggggattcggcgcataaacacagggaacaa

SEQ ID NO: 41814 - DNA, 61 bp, Chlorella protothecoides
cgcgtcctgcatttcgctatgcctctcctcacccccccccgccctcacactccaggcatgg

SEQ ID NO: 41815 - DNA, 67 bp, Chlorella protothecoides
ttgtcgtgacagggtggtagatgtgaggccagggtgggggggggcaggtacacaggggaggaatgct

SEQ ID NO: 41816 - DNA, 61 bp, Chlorella protothecoides
cgcgtgtccggcagccgagtcaacggcggggacgacgcagcgcatggagcctcagacccct

SEQ ID NO: 41817 - DNA, 75 bp, Chlorella protothecoides
ccagttccgggcccgggcgtccccacagccgcggcgcccgtcccagacgccgcgcccgcccagctgcccccagcc

SEQ ID NO: 41818 - DNA, 61 bp, Chlorella protothecoides
tggccatgatctgtcggcgatgggggggggcgggggggcatgggtatccgattgcgaagat

SEQ ID NO: 41819 - DNA, 10506 bp, Chlorella protothecoides
  modified_base (349)..(358): a, c, t, g, unknown or other
  modified_base (1997)..(2006): a, c, t, g, unknown or other
  modified_base (2699)..(2708): a, c, t, g, unknown or other
  modified_base (3172)..(3181): a, c, t, g, unknown or other
  modified_base (3590)..(3599): a, c, t, g, unknown or other
  modified_base (3971)..(3980): a, c, t, g, unknown or other
  modified_base (4276)..(4285): a, c, t, g, unknown or other
  modified_base (5323)..(5332): a, c, t, g, unknown or other
  modified_base (6052)..(6061): a, c, t, g, unknown or other
  modified_base (6657)..(6666): a, c, t, g, unknown or other
  modified_base (7158)..(7167): a, c, t, g, unknown or other
  modified_base (9911)..(9920): a, c, t, g, unknown or other
cgccgcacgcgcgtcgccgggcagggccgcgtcggcgagcagcgccgcatgcagctgctccagcagggctgcagggtcgccgcgcggcgccgggcggccgtcctgcggcacatgcgccgcacgggcggcggcgggggggatcacagaggcccggcagatggggcaggtctgctgccgctcaagccatgacctgagtaatatgggggggaggggttgcggggcgtgggcggctgggttgagagcgcggcagcaccgcgggaagagagagccctcgcccctgcgccagcgtcaatgaccttccaaaactccctccagcccaagacacacacccatctcgccccctctcctnnnnnnnnnnggcgggaagcgagagccctcgcccctgcgccagcgccaatgaccttccaaaactcccttcagcccaaagacacacacccatctcgccccctctcctcagggggaaaccccaagatatacgcctggcacccacctaaggcagtgcaggtggaagacatggccgcagggcaggcgcttggtccggccaccaacgaccatttcctccctgcagatgatgcaggtgtggtccgcccggaccaggtcctcggccgtggcgtcgggaaagcgcgcgtccatgttggtggtgatgcggcggtaccgcaggaagtccagcatgcgctggtggaaattgcggaacgtccagtacaggtcacggatctgttgaggagaaaggggggggggggtaaaggctcaaagtgtgtaatagagggtccgtgacgagctgtgtcgagatggcatgatagaaaggcacgcggcaggatccccatgggccacctcgtcagggcaccgtatcctccaaggtctccatggctctttccccccagaatggggccgacatgcgcatgcatgccccccgcgcctcaccaggtacagggggatgccgtgggtgctgaacactacggcgaagaaggctgcatacacgatgaggtgcagcaggtccagcgtcagctccaggaagaaggtggcggtgcccttgccctcccacctgcctcccatggccacatccgtcattgacctgaggatggatggggtgcgtatcatggggtcagcgacaggaagaccaatagttcaacgtttggtgcgcacatcagagcagcggatgcatgcccagcgtccggaggggagggcggcatgctgagcatgcacagcggggaatggcaagctgtcagcatgcaaagaattagacacacattgagtgcaaactgcaaacacagcctcagacttgaaccactccctgagagcatttcccgcacgaagagaaacccctcacagctcccctcaacgctcacatgcagtacttgatgaaggtgacgaggcaagtggagctggccaccgcactctcgaaagcgaaaagaaagtgtagcgagatgccctgctccatcgtccggcccaaggtgtactgcagcaggcagacgtcagctgcctgcttgggatgtgccatggaggcgacagcggtgaccaggacacaataaagggcaaaaacaacagatgaaggcaccagccagagcattctgtcccaaacacatcccacagccccctgaccatcaccacacaacactcgccagcaggaggagattaaaggacaccagccggaaatgggtgagcatgggcacggaggggttggtgtcgatgaagtccaccctgtctgccaccagccagtggaagatcttgaggaaggataccacgacaaacatggccataaagaggggggacacatcctcccggaaaatggtcatggccaggcaggtctccaccaccgcctgcgagacgcgctcgctgatgcgctccagctccgcatcgcgcagctgtcccaggaaaatctggtgcagaggagggaaagaaagtgagggaatggtgggtatgaccgacggcaacgctaacgccagcccacaccccacgctccactccaccccacgcacacctactcctgcatgggccannnnnnnnnnctatgaccgacggcagcgctaacgccagcccacaccctacgctccactcctccccacgcacacctactcctgcatgggccactcacccgcgtcaggcacttgtatgtgagcagcgtggcagcgaatcccaggttcccgaggacggcgatgcagacttttgaagtcgatagatgcaccacggcagggtaaaacctggtgagggattggtggcctgggtgatcgccggggggcacgtcacaaattggaaaagcgctcgtgctcagagatgacactttcactcactcttcgcgcgtggagaagccgtgccagatcaccaggcctgccagcagtgcggacaggccgacgtagcggcccgtcgagaggagggccatctcagcaagaccctcaagatgccatcgagccgcacatccaccgtgctataaaagtataccagtcgaatggaggattcgattttggggatgcttgttcagcgtagctgtccagactcgggggaaattgtgcatctcctctccccatggtggttgtttcggggggacgctgtgcatgcagggatcggaaaggtagaagatcgacaagccaatcagattgccatgcgcggactgagctgcatgcaagccgctattctgatatctaaactgaccacagacatatagtaaaccgactcgcgagtgctgggagtgcagtgcattgccnnnnnnnnnnttgacctgaccacagacatatagtaaaccgaatcgcgagtgctgggagtgcagtgcattgcccatgaaccccattatccactgaggagtggcatttgcgagacccgactcacgcatgtttttaagccagcaccggtaaacagagcatcaattggattctcggtgtattctaccgttcattataccctcccgctgcctccccgtcgtggcgatgaggcctgtcaacatgtgcaccagacctgcacgcatgacgacggtgggagccgtcaaggtggcgagctgcagcaggctgagacaagcattcccagccttccagctctcgagaccgagatcaaattcctcagggccgctggtgagagttttgcatgtgtgcacactgctctctttgtgcctctgtttttctggagagatcgttgggctgaacaacgatcttttcccctcccctagcccacccctcatccctannnnnnnnnnctttctggagagatcggtgggctgaataatgagcgtatcccctcccctagcccacccctcatccctattcctgctcctagcagtaccacagacgcagtcagctcgtcactcgggctgccatgtttgacaccctgtcccagtccctgaataaggcatggggcatggtgcaaaaggatgctcgattaaccccagaaaacatgaaggcacccctgcgagagatccgacgagccctccttgaggcagacgtgagtttgtttatcattctggtttgcgtgtcatgcatgctttgattacaagtgcacttgttgtgctcaattgaagctgtacaggatgggatcaccttatgtgctactgatgccgcctcatcacgacatttcgtcttccaggtccccctcatggtggtccggcnnnnnnnnnngttgaagctgcacaggatgggatcaccttatgtgttactgatgccgcctcattatgacctttcatcttccaggtccccctcatggtggtccggcccttcatcgcaagggtggagggcagggcgctgggcgctgctgtgaccaagggcgtgtcaccccagcagcagcttgtcaaggtatggagttggattgatggttcatgcagaaattgcttcttgctattgtttgcagttttgcttgctgcagtggtgcagcctggcaacaaggccatctccttgtcttgtccttatctctcgtcccaataaatataccgtaccagattgtgtatgatgagctggtgacgctgatgggcgggaaacaggtatccctcaatnnnnnnnnnncgccatctccttgtcttgtcctcatctctcgtcccgattaatataccataccagattgtgtatgatgagctggtgatactgatgggcgggaaacaggtatccctcaatgtcccagagggcggcgatccgcaggtgggtgaggaagagcctgagggaccatgcaccctggtgtgaaatctgcatggaagatctggtctgtagccttccagcgcccgattcagtctcctatttgttgcattcagcgtgatgcaatcaattcactgagcctaatgttgaaattcaagtagctgaacagnnnnnnnnnnacaggtgggtgaggaagaccctgaaggaccatgcaccccgatatgaatcttgcatggaagatctggtctgtagccttccagcgcccaattcagtctcctatgtgttgcattcagtgtgacgcaatcaattcactgaacctaatgttgaaattcaagtagctgaacaggcaagtctgtgtcatgtcactcaggtcatcctgatggcgggactgcaaggcactggcaagacgaccactgctgccaagctggcggccttccttaagaacaagggcgggcgagtcatgctggtggccactgacgtgtaccgtcctgcagccattgagcagctcgtggtgcttggaggccaagtgggtgtgcctgtgtttgagcgagggctgaatgtcccacctgcggacattgcgaggtatggatgggaggcggagaggatggggccgacatgcagatgtccttggccatgtggagcacgtgtagtttcctcgcagcgcgcaagctctgggaggacttcacatggcccccctttcctctgccagggagggagtggccctggccaaagaggagggcatggatactgtcatcatcgacaccgcaggacgactgcaaattgatgcgacgctcatgcaggagctgcaggaggtgagggtcgtgcctcacatggtgggctgcaatgcatgccacccgtccaggccctcccttggggatgctgtctgatgcggtgatgcatcattgcttttttgtctctgctattcttcctgtgtcagacttgtgccccttgaaagtgctcctgaagatgcctgtcagtgaaaccatcatggcctgtactgtcagaaaccatgcccctgctctctccctcaaaccactacagatctcctccgctgtcaggcccacagacactctccttgtcgtggatgcgatgactggccaggaggcggcggggctggtgaagaccttcaacaccaccgtgcccctcacaggttggacgagctgcggaggagagggggagggctcgccttgcatggcagggaccagaactctctcctnnnnnnnnnntaacaccaccgtgcccctcacaggtggggcgggctgcggaggcgagggggagggctcgtcttgcatggcagggaccagaactctctcctcgaataccacattagagaccccaagccatgtctactcgccatgcaggcgccatagtgaccaagctggatggcgatgccaggggcggcgcggcgcttgctgtgaaggaggtgtctggctgcccgattaagtttgtggggatgggggagaagacggatgccctggagctcttctacccagatcgcatggcctccaggatcctaggtggggtgggattgatgaatggttgtttgttggatcatggtacctccctgggaaaggcaagagggagggcgaaaggtgctcatcagaatgtgccagacggcctcagcgtgtgacgatcagggaatgtacttccatctcagccctacaacctctcgcttgcctcttcctcggtgcaggcatgggtgatgtgctcacgctcgtagaaaaggcagagtcaatggtgaaggaggaggaggccgcggccctcaccaagaagatgctcacaggcaggagcttttggcagttgtgatgaagctgtggatcctgggtggcctgcgttggcacatctgctgcactagctgactgatgcacaccttgcattgtcctccagcgcattgcagctgcagtaactcagctccctacagacaccaacaagaaaccttgcttccnnnnnnnnnntggcgcattgcagctgcagtacctcagctctctacagacaccaacaagaaaccttgcttccccacccaccctcactctcgcagcgaagtttgacctcaacgacttcctaaagcagtataaaatgatctctggcatgggcaacctcacgtctgtgctcaagatgctgccaggtaggcgcaaggggcgtgacagcgactcaggaatgggacagaggcagtacaggcaccaaggtgctgcaggaattgtctgccgctcgtgcgatgccaagcccaaggatggccccttcccaatcacacaggcatgagcggcgtctcagacaagcagctgcaggcagtggaggcgcagtacaaggtgtacgagtccatgatccaatccatgactcgacaggaaagggcaaatccagacctcctggccaagatgccgtcgcggaggtaggacgtcaggctgagtttccagactggatggcaaatgcctgcccctctcaagtgcccggcctgggcctcaggcaggatacgcttgcaggcacgggcctggctacctcggaagaccacctgccagcccatgtccccaccctccaatcacacccaaccctgacnnnnnnnnnnatgcttgcaggcatgggcctggctacctcggaaggccacctgccagcccatgtcccccaccctccaatcacacccaaccctgaccaggcgccgcgtggctcgggggtcagggcgggaggaggcccaagtggcggagctgattgccgtgtacacatccatgcgggcccagatgcaaaccatgacgcggatgatggcgctgagcggcggggcgtcaggtgcgaggaccgtgcgcttggggggatggtggggatcccatttctacatcagccaggacttggagcctctccacgccacttcccccaggtctgggcggcatgccttccatgagcgacgaggagatgatggcggcggcgctaggcagcgccgggccgcgccaggtgccccccgggaaagtgaggaggaagaagaagagggacgtcgcgccaaggcaggaagcggtggccgtggccagcgtatgaccagctgtcgtgcgccgcagcatctgcatccacnnnnnnnnnnggagggacatcgcgccaaggcaggaagcggaggccgtggccagcgtatgaccggctgtcgtgcgccgcagcatctgcatccaccctgcacatttgcagcttgcagtctggtccctgctcccaacaatttgccctgctgtcccagacgagggcagacggctgttacagtatcgttcgatcagagcaggagcagctactcaactatgtgcaaggggagggaagggagggaggtgcgcctgcggaatgcactggacccacactcgtgtcggggccaaagcgccgcgtgggacccatgcctctccccccggcccgcgaagcagcgaaattacaggttggcggtgccgccctggcgaatgaggcggggcagcattcttctcggcgactgggctcagagcctacacagccctcagtaggactcggcccaggacttctcgacctcattggccgacaggtagtactgcgcaagggaagaggtgggaagggcgtcacttcggatcctcagggatggcacgcgccccatgcacatgcaagggagtccacgaccccgacccctcgatgccacgagaagtgcaacacatgcgagcagggcgcacctggagggagttgaccacgagctggcacatgggcgggggcagaggctcgccgtggtaggtgatctggaagatatcgaacgcgttgcgacctggacggatgcaggaggagattttgggggtctcctacatcaaagcgggaaacccaggccgatgcagtaacgagagcctgtagagaagttaaatgaaggtccctccctaccccagctgcagtgacagccatgcggccaaatgaagctccgcctgcccatttgacactcccatccctcgagccacggctcctcccaacgcaccaatggtgtccacctcggctgagatgacgttcaggttgatgtccttcaggatgtggacgatgtctgtgggaagggggcggagagtggggtactcaatgtggaggtaggccaactccgtgctgcatcactcaaggccgaagcccccctccgggcctcaggctccgagggccacctcgtgcccatgcccagccggacaacacccccttccctggccttctcaccggtgagcaggcccggtcggtccagggtgttgaccaggagcttgctggtcagcccgttcttgtcctccctgacctccacctgggtcttgatgccgtagttcctcacgcccaggggggaggagtcgtcggcggcgttcatgccactgtaagcagacggggagccccatgccagctgctggctggtctccgggtggtactgcattggtgccagaggtcgttagaggaggtgcatggagtccaggggtccagcctgtcctcggcatggcaaagacgggagttcatccctaggatgccgatctccatcctcaatcttctccctcctcccccaacctgacatgctcaccctcagcatgttgttcaggatggtcaatcggatctcctcaagcctggatgacctcactaccttctcactcgtctctgcagtgagagtgagggtgcaggggcggtggtggtgggacaatggggaacacatggcttcacaggttgatgtggaggagcctttggcacattggaaggaggctgacctcaagtactgaaccaggctgcgcctgaaccagacccgaagagaagtatcaatcacggtacgagggcctcaccgaggccagtagcaatcccaacatccccctccatctacttctcacccgcatccgtgatgtagaatttgtgggtcccagtggacctcagctttgcacgtgtgatgttcaagcccaagcttttcagggcggcaacctgtggtgaacaggtgacaaggatacttcgtatgcaccagcatattctgcagcgacctgggtgagttacaggtgcccattcatgtcagcactagcatccagggtcctgccgccaaaacacctccacccaggcctttatcacgtccacctcaccgtgtccaggagctctcccagcttgtttccgtagttgatggtcacgagagtggcaaagggctcggagtggttgtcgatcttcccctccacaacatctgagacctcgttctcctggacctgcttggcctccttggccaaatcctctgccccattcaggcccttgttcccagtcacagcggccctgcgatggccaatgattgcaaagaaggtcagggcgtgactcggaccggaatgctgtccagtggccagtgacagatgtaacaagggtacccaccaggccaggcctttgccctggccccaccctgtggcacgcgaattcagaggcagtggccagctgcatcctcgggagttattacctcgggacaactgggcgggggttgcttggaaatccagttggcgcccaggccttgcgagacaccaggccggttcgcctgtggcacggcgggtaaggaatgagggtcaggtctgatcatggtaccggtgtccaggaacccagtgccatctgggatgcttcccggatgaagtgggcacactcctcacctcactccacaggcaggagcgcagaccgtgcggccggccagcccccctgtcgcgggcgctgcggtgtgggatgccagcatggtgcctcccagctcagaacggaagcagtgcagggaaagcggtcgtggcacgaatggtataatactgctggataaaagtatgatctcaggtctcgcaatacgaggctcgggcacggccagtttgggggtgcgtgtcgatnnnnnnnnnngtgatctcaggtctcgcaatacgaggctcaggcacggccagtttgggggtgcgtgtcgatatgagccctgggacacacacgtgacggaaatacgggattggatgaggaggggtgggcatcatgtcaaccccccggtcccaccgttcctctggtaaactcttatgtcgagactggctgtacaacaggccggccatgcacttgggtcgggcacctttctcatgcacgggcttcgccctcaccccctccccgcccgcttcttctccattttgagccccgggaagtaggatgccagggtgcgggcctccgcgctgggcggcagcagggtcaccctggtcttcttcgcgccgtgcgcccccgtcgtgctggtggtggcgcccagctcgcgacagcgctccgccagcgccggcaagcgcagctgcagcgtggccgccagcgcctccgcctccgcgccgtccagcgaggccgacggctcggcgcgcagcgcggcggccaccatccagctgagcatgaggtcgcgctgccccggcgcctgcacccagcgctcggcggcgcccgcctccgcgccggccgcgtggtggatgtagaa

SEQ ID NO: 41820 - DNA, 61 bp, Chlorella protothecoides
atccccggcccctgtcgtgagtccaccgcccccctcccccaagccatccccgccgcctccc

SEQ ID NO: 41821 - DNA, 61 bp, Chlorella protothecoides
aggaaaggagtggccgtgctcacggtgtagttctccaagacacctctgcaccacccacacc

SEQ ID NO: 41822 - DNA, 61 bp, Chlorella protothecoides
tcatgaatgcaacaggcgcgggagggagcctttcctctgaaacacggtgtcacccggtcac

SEQ ID NO: 41823 - DNA, 80 bp, Chlorella protothecoides
aagggggagggcacagctacagatagctggcggtgtatgctcaagcacgaccggctggacgcccgtaccatcccagccgc

SEQ ID NO: 41824 - DNA, 68 bp, Chlorella protothecoides
cccccccccccccccccccccccaaaccccattcctcttccctcccccctcgcgctctcacatgtgcc

SEQ ID NO: 41825 - DNA, 61 bp, Chlorella protothecoides
tggaggtaattgtgagtatcggttgatggggggaatcctgcacccatgacagcatggtaaa

SEQ ID NO: 41826 - DNA, 61 bp, Chlorella protothecoides
agcccaggaccgctccaccgccctgcgcgttgagcgcatgggcatgggcatggtcgacccc

SEQ ID NO: 41827 - DNA, 61 bp, Chlorella protothecoides
gacgtaccgcccctcccggtgccggtggggtcgccacctggtgtgccaccgtgaagacatg

SEQ ID NO: 41828 - DNA, 127 bp, Chlorella protothecoides
tgatgtcgatgtcttcggcgggcagacccacggccagcgctacggcgacctggacccccccccgcaagatggcggcgtccgacccaccgcccgtcacggtcactctggaggtgacggcctggatcag

SEQ ID NO: 41829 - DNA, 61 bp, Chlorella protothecoides
ggtcactctggaggtgacggcctggatcagcgtgaagttgatctggccggggatgagggag

SEQ ID NO: 41830 - DNA, 61 bp, Chlorella protothecoides
cttcccccttgtcaaaggcccaccggctgccgggccgcatgctgacgccaggcggctccag

SEQ ID NO: 41831 - DNA, 5095 bp, Chlorella protothecoides
  modified_base (351)..(360): a, c, t, g, unknown or other
  modified_base (1972)..(1981): a, c, t, g, unknown or other
  modified_base (2468)..(2586): a, c, t, g, unknown or other
  modified_base (2692)..(2701): a, c, t, g, unknown or other
  modified_base (2807)..(2816): a, c, t, g, unknown or other
  modified_base (2965)..(3050): a, c, t, g, unknown or other
  modified_base (3619)..(3683): a, c, t, g, unknown or other
  modified_base (4293)..(4302): a, c, t, g, unknown or other
  modified_base (4598)..(4607): a, c, t, g, unknown or other
tgacggggatttcttcggcgaggaagagggcgacttcgaggggggaggagtgccggaatcagttgttggaggcgaactcatgggagagccggagttggtgggcgttgagggactcgtcacactgatgacgttggagcctgaattcctggcatccgtcagttgctgcacgaagtcgttcagtgaagtagctgcttcagtcggaccggctactgccgtcgccatgagcgacctacaggaaaaggaacatggatgcgaattcgccgcaggcataaaggtgaacaaacacatgaacaaaacaatgtatgacgtgaatgtgcattacggttcgaaggggtgggctgggttgaggannnnnnnnnngctgccgtcgccatgagcgacctacgggaaaaggaacatggatgcgaattcgacgcaggtacaaaggtgaacaaacacatgaacgaagcaatgtatgacgtggatgtgcatcacggttcgaaggggtgggctgggttgaggatgtgacgaccgcttaccgtgcgtaaccgggacgagcgccggcacattgttgcaggatcaggaaggcagtgaagagcactagagtactttggaggcgcgacattgctgcaaattgtgtgaatgtttggaatgaaataaaagtgcgttttgttgacccgctgccgccgtcctcggtatatatacaccccgtcgggctagctgtctggctgccacacgtgggctgtcagacagaagtgcagtgcgacgggggggcagtcttcatccccgcccgggcatgcccagtcgctgctgacgctgcgtacgctgggcagctggatgagcgggagtgcagacaaggactcgaaggtttgggatgtgggtatttggcgttctgttgcagtcaatcttgtccacgagagagttccaggcccagtgattcaagggattcttaaaggcctaagggccattcaatcctctactcctctgaccagtcacaaacaatggccacatacctttaaaaggccacggaagtgcacagcctttgacacggaagcctggatccaaaatgtattcaaacaaatcacatcctgattgcacaaccacgcagctccttaactcggaatgagtaggcctgcagcttggagccctccctgccagacttgctcttcaatgttacccatcatgtatccatgaactaagggtctggcgccccctctggcactgatgtaacggtgtggaatgtggcaaccttggacgtcatttttacagtcagtgcgcaccctgccagagtagaatgcgccaggcttttggcagtgatgggttcaacattaacgatttgagtgacttgctgaagtctcatctgcgtctgcgggctattgcgttgctaagaatcgtctgtatggtggtttggcggtgtgtggcaccgacactgacgagtatgcacggggagagcggacgctgtgcatttcgacaccgcctgcgtgttgtacaattggtcttacacaaatgatctggcaaggtgtgtggcagctctttcctgcccctgagttgtgtacggagctgccgacatgcgcagtcttcccatcctgcgtccgggtttcgcacggtccggacgattcagcccccccgccgtcgccctccggcccgcccgctgcctgagttcgagtcggtccgcgatgtagccgggaagactcgaagcctgacacgggggcagtaatttgcgcagccacctagatagttagtacagacttccggcgggaggacacccgcgtacgatgaagcttgtcgtacagcgcgcggtgtgcattcaacgtgcgatttcaaaaaggggcgccgttgtctaccctcctttgaagcaccgaccttgttaccaaaaccagaagggtgagaagtgatcttcattgagtaaaggcttcgcacatggggaccgagtcttctctataacagcagcgttacacctatggtgttgccccacgtggcaattcaagtgtcnnnnnnnnnngctcctttgaagcaccgaccttgataccaacaccagaagggtgagaagtgatcttaattgagtaaaggcttcgcacagggggaccgagtcttctctatagcagcagcgttacacctacggtgttgccccacgtggcaattcaagtgtcgcagtgtccttgacatcgttaggaaacagggcagggcggaaatcaccaacatgtctggcgccatgtccctgactttcagctaaatgagtggaacttcttcctgacctgagtacaacaggcacagctgctgagaggctgtgctcttcagagcaaagcatgccctcatacagaggaatgcaggcctctggctacgaggtgccaacaagaataagtccatcaatatttaatgctacagactggatcttccagggtctatggacgagatgggtgcattctggtagttcttgttgtgccattccataaacttgtttttatgtgggggtcccagtgcgaagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttacgattatgccccgtcctgcagtcccgcctcgggattgcctggcaagtcgggcagctagcagcagaacgctggcgcgtgagtcaaggaatccctgctcctannnnnnnnnngcttacaattatgccccgtcctgcagtcctgcctcgggattgcctggcgagtcgggcagctagtagcagaacgcgggcgcgtgagtcaaggaatccctgctcctannnnnnnnnngagtgcttgttgtgccattccttagccttatttttatgtgggggtcccagtgcgaagtggcaaggagccgtgtattctaagagcccgctttgggagtatgtaccagtccccagattgcccaacaagacgagcccattgggggttggcgnnnnnnnnnnnnnnnnnnnnnnnnnnnnnnnnnnnnnnnnnnnnnnnnnnnnnnnnnnnnnnnnnnnnnnnnnnnnnnnnnnnnnncccagattatggcatgacggatcaatatttatggacaatgggtcgttcctgcgctatatcgagggttcagctggaagagccaaggctggcgcaggccccacctctccgcacagcgacccggcaacctggaccagagtgagaacataccaccctcccagacgttgcacttcgcgcaatatcccgtagcgatacacgagaaagcgccggtagaaccacgctgagtattgtgcgcgatggccggtactcaccttggggtgtagatcgcaccgatttctttcaactacgtggtgggggctctccccctgcccccggtaatcgcgcgtcctcccgacaatatttagcaccccctcgcgctgccccccgtcctgacatgccgtgcatgtgaagagactgactgcgttccgcttcggtacaccggttaaagagcgccttcaaccctagaatctgcggagcactggccgcctgcgccaacccccgtcacctctgcgctagctgttgggcaacgggcgagtcccgggggcctcactaaaatcgatcttaggggcgttggatagtctggacagggcgcnnnnnnnnnnnnnnnnnnnnnnnnnnnnnnnnnnnnnnnnnnnnnnnnnnnnnnnnnnnnnnnnnaggggtccctactctcgggtggtggacgagggttgtatggcctcggccgtgggctgggcgagcctgttcgtagacccgcagcccccttcatccgccatgacatggtagtaatcttggatcaaattgcacccagagcgtcgtccctggcctgccaccccccaacacacggccccctcgacccctggtgcagctgggagtctccagcgacctccgcctcggggatcctcccggtaaacatgcctccccaatctgcttccccctgaccatggatgagctggatcacaaggtccatggcagcagggtgttccccctcatccactccatgccctcgctggacctgtcccaggccgggagcagtgaccccggctcaggcgcctcggtgcactcccccagcgtggccggcggggcgggcggcagcgggcacggcgggcgcttcaagtccatcctgtcgtgcataggtgggccttgtgcagcaaggaggatggggaagggtgttgtagaggacagcctatcttgcagggtgagaggccggctgtgggtggcccctgtgttcgactggctcggcatgggtcccctgccttcctcctggcacttgatcttgcctgcggtnnnnnnnnnnggttgtagaggacagcctgtcttgcagggtgggaggccggctgtgggtggcccctgtgatcgactggctcggcatgggtcccctgcattcctcctggcacttgatcttgcctgcggtcaagccctcaatgtttttccagtctggggtccatgggcgcctgatcccatcaggctggttgtcctgtacatccgccggcgggagtcccccgggccgtgccgcgctgggtggatgacaggcggcacaccgccatttgcagggcccccttcccccaccagacccacccccctctttcacannnnnnnnnncgtcctgtacatccgccggcgggagtccccctggccgtgccgcgctgggaggatgacaggcggcacaccgccatcggcaaggccccttccccccaccagacccacccccctctttcacacccgcacacaagcaggcctgcagatggggcaggacgcgggcggcgaggaggaggtggcccctgcccggcgccctgccgacgtcgcgatccggcccgccttctactgggtggcgggcgccgcggggcaggaggccaaccccagtcagcgcgcagcggccgcggcggcctctcgctggctcaaggccgactgccaggacgaggcggtggtgttagacggcttcgccggcgtgcccggccaggtcttcgcaggcgtgtttgacgggcacggtccctacggtcgcgcggcagcaacgcatgccgcgcgcgcgctgccgcgcgcgctggcggcctcccgcgcggtgcgcacccccgggccgggtggcgcggggc

SEQ ID NO: 41832 - DNA, 61 bp, Chlorella protothecoides
cggagtcctccaaggactggctccgcaaggggtgatctaggtttggatgcaacaccattca

SEQ ID NO: 41833 - DNA, 126 bp, Chlorella protothecoides
tgaggagaattcaggggcgggatgggagctattgtgggggaggttgaagcatccacaaaggttcaggtttccaaaggtcagacccagattcccaaaatcccagcgcgccaaatgtgtatccccccc

SEQ ID NO: 41834 - DNA, 67 bp, Chlorella protothecoides
agaaagcctctccgcctcctcccaagaaaggctctctgcctcctcccaagaaggcgtctccgcctcc

SEQ ID NO: 41835 - DNA, 86 bp, Chlorella protothecoides
ccccccccgccgagggctgggagggcgacgatggctcagcacacagcgccggcccgccctacccggccgcacatcccatgcccgcc

SEQ ID NO: 41836 - DNA, 497 bp, Chlorella protothecoides
  modified_base (157)..(166): a, c, t, g, unknown or other
  modified_base (231)..(403): a, c, t, g, unknown or other
cgccgacacaggcccctctcccccagcccgccactcgccgccgccgccgccgcacgacggctgtgcggggcatggcgaggaggcgctgcgcttcgacgagctccagcgcctgctgggcgaggtggcctcctgcgcgcggcggcgctgctcgcgcagnnnnnnnnnngcaccgcctcggccgacctggtggccagcgccgacgcgctggcggcggccatggcgggacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcgcgccctgctctgggccatggtccgcgccatgccgctgcgcctgctggagcgcgtcatgccctggatcgcggcgcggctggcccccgcc

SEQ ID NO: 41837 - DNA, 61 bp, Chlorella protothecoides
tgatgggcgggtcaggtgccggccggggcttggtcatacccaccagcaggctggcgaggat

SEQ ID NO: 41838 - DNA, 76 bp, Chlorella protothecoides
ccaacgcggtgcgtctggtggccgagcgcgcggtggggggcgcggcgcggcgcctgcgctgcatcacggccggcga

SEQ ID NO: 41839 - DNA, 149 bp, Chlorella protothecoides
cccccctcccccaccccaccctgacccgcctcctccgaatccccagagacaacctcctccaccagcaccacctccccccgtccctcccttgcccacaatctcgctccctcctccaacatccccgatgaccccgccgtcgccaacaggcg

SEQ ID NO: 41840 - DNA, 61 bp, Chlorella protothecoides
cgcgcaggccttcatccgcgagcgtgtggcggggcacgccgcggtgcccaccgactttgac

SEQ ID NO: 41841 - DNA, 93 bp, Chlorella protothecoides
tgcgagcggtggttcagccgtcccatgtcaagcttctacgctgccgcccacttgtcgttggcacttgagcaggcgccgcagcatcacccaccc

SEQ ID NO: 41842 - DNA, 62 bp, Chlorella protothecoides
ggccgtcgtcgcagcgggggatgtgcggggcaccgtggcggcggccgcggtggactcgctga

SEQ ID NO: 41843 - DNA, 66 bp, Chlorella protothecoides
tccttctaggacccccaggcccccatccccaccgagacacaccttgagggagaggcccgagtcggc

SEQ ID NO: 41844 - DNA, 61 bp, Chlorella protothecoides
catctgggagaggaaggatgccaggcgtgtaaggctcgcgctgctcacctggcgtggcgag

SEQ ID NO: 41845 - DNA, 67 bp, Chlorella protothecoides
acctgcaaagaagtcgcctcccccacctgtgaagaaatcgcctcccccacctgtgaagaagtcgcct

SEQ ID NO: 41846 - DNA, 149 bp, Chlorella protothecoides
tccgtgctcgccatctgggcctgaggcggcagagcgtgggggggcgggaccggggggagcgaggaggggggcgagccgccgctggacgaggcaaggggccgtcgccgggaggggctggaaagccgccccccagtcagcggtcctgagtc

SEQ ID NO: 41847 - DNA, 6537 bp, Chlorella protothecoides
  modified_base (231)..(313): a, c, t, g, unknown or other
gtggcggagctcggcgccgcggtggccgcgcgcctgggcgtcggcgggccccatggcgggacgaggaggggcggcggcgcggtgccgcgatccagctcgacccccggccgcgccgtgccggggagcgatgccgccccggccccaaccctcgcagcgcgcctgtcgctgtacgtggacgagcgcatgctggcgcgggagcgccccgggctggtggtggtggaggacgagggnnnnnnnnnnnnnnnnnnnnnnnnnnnnnnnnnnnnnnnnnnnnnnnnnnnnnnnnnnnnnnnnnnnnnnnnnnnnnnnnnnncgaggcgctgtgcgacgcgctggtggcggtgggcctgcaggccggcacggccgtggtgtgcctgcgccggcgctgcctggccgacgtgctggaggccatgctggaggtgggcgccgcggcgggcgtggccgaggaggccgcgcgcgtcgtcgaccgcctgcgggcgcgcctgcgctccgcggcgagcctgcgcgcgcctctgcgagcgctaggtggtggtaccttgggcggcgctggcgctggcaacgccactccccaccccccgcgaatactaatcctgcgctcggcaagcccagcactgcccgcagcggggccctggctcccggagatggccgcgctggtgggcggggccagcgccgcgcagcacgcagacggcgcgcgcgcgctgtcggcggccgagctggcggctggcgcaccgggaatcctcgtcgtgctgcatgggccgggggcgggcgggctgcaggccgcgctggccggcctggccgaggccgcaggcagcggcgcctggtggcagctccccgccgcgcgcgcgggggaggtgtacctggcccctgccccgctcttctcgcgcccggggccgcgcctggccgatggtgtggcgctgctggcgcgggcgctgcacggcggcgctgcgccgcccctacccacgcccgtgcttaagctggcgctgcgcccggggcagcgctgccgcccgcccctcctctccaactacttcctgccctggagctgaggcgtgtggatactgtgagaggtagagacttcattgcctgccccagccctatcgcccgcagaccctccgaccacaacctcccggaccttgctgaccgcatgaccccgcagcgcaccccgacagtactgtgaacccacttcccccgactcctttcgttgatgtgacatgcgtcccatggttgaagcggggggctggctcttctttagggagcctgcagggtgggaaggatctccatgagggagcctgctgggtgggaaggatcactgcatgggcgaggcgcgatgcaccgcacacaagacaggcgtgacggtggagctggaccaaggtacctcttgatcgagcattggttcaccctacaaatcagcgataccatcacaaagattcacaagaaagctaagcacactgattctggcacgaatagtgaccacagtccctcgccatgcagcgctggcgttcgaggtggcggagtgtgtcgagggtgctgggccagttccgggatctcaatgtcgggcatggcccagcgggggcctgcccacaactgctgagcctgcaagtactggatctcaaatctgtgtggccagcggactcacctggccgtccccgatgcatagctgggacgggggccggcctccatgcatccattggtccagagtgggttggagctattctggattgtgggggattggtgagtatgatccgtattggatattcctggcataaaccatcatgctttcaccaccccgaccactcaaagggcggtgactgagctgacggaaaaggacttccatgtcgtctgtgaatcaactctggaggaactgcaagacaagctagacgtgaggcttgagggtgtttgagcatctgtttgtgcatttcgactgcaccttggaccaaattctgacttcttgtcgctgggtacctgtgaaggcattcgtggaggacaatgatcttgatggcgatgtcgagtatagcgtgagtgttgctggactgtatttggcaagctgtggagtgtggtgcaagtgttattgctgatataaattcatggattgggtctggtcacttcctatgctttgggggaaatgcatgtcgtgctattcatcaggataccgtgacgcaattctgcctcagcaactcctgccaacattctcatgtcgccgcagcaaggtgtcctcacgctcagacttgggaccaagggtacttacgtaatcaataagcaggcgccaaaccaccagatatggtcgtcctccccagtaaggtgactgagatatgcaagtggggtgcttgggcactggctccaatgccttgtataatctgcggagccctgtagcaatgtatgggaagattggcacacagctgtgctattggatgttgagaaatgaggcttctggagttgtgcactggacaatcgaatcgtacgctaacacagattctcattgcccccttatctgcacagcggacctgtgcgctatgactatatagatggtcgctgggtgtacaggcgtgatggccatgatctactggagcgcttggagacagaggtcaaggagctgacaggactgaccatacatctgagttgaagaatgtccaagtaacacatactgaagatgtagaatgaatgttgtaatcacaacaatccagacccggccctttggcgcgcgctcccctgtgtcgttgtctgagtcatgagagttttgcaaaacgggcttcgaaacatttgcgaagagtcccgtgattcgacacgatagatacataatttttgaagtttccgaggtagcatattcagcttgatggtgtgacggagtttcaaggtcatggcacagggtgcgggagagggtgttgctggcccctccacagttggccctcccgacacctcgactcttgtgattcctgacctcaatctcaccgatgagagcgtttcaaagaggtataatgatctcttagcaaaacgtaatgacctcaccaggtgcggcgtggatgcgtcggccccccttgtctcgtccctaatgacatgaagaacaacatgcttgaggagcccatctgccgctgttccacgccataatgagccttgatttggcttccacactcccatggtcaggctcctggctgcgccaggctcggcggacgtcatgcggtccagccaggtggacgcctcccgtctggacgaggaattgagcctgatgctgcgtgagcagttcctgggagccttctccctctttccacgggtatgcagcgatgcgtgctgacaaataggatccaaggggaccctggcggacaggaatccttggcaattgtttgcagacagtcgcactctctgccgtgtcttcccgttcatgccagaggccacccttccccttgcgacaattcctgtactcatctcttttccccagggcacagtgaccgcacacctgcccgagatccagctggcgttggatgccctgatcttctacctgtctgtctggaaggacgcccccctccccggcatggccctcatgaacctacgcttccgggacgagcgcgccgtgccccactccgcctctggagtcgggggacccggcctggccaggtcccagaaggcgatgtacggcctgggagcggtactcctgcggtacgcctgggcccgcaccggtcacgccgcggcgtcgggcggctcggacggggacggcggctggcgggcgacagcctggcaggtgatgcgccgcgccgagaccgcataccgcctcgcagccctcgtcaacgccattgcgttcctgagggcgggcaaatacaggtacagggtttgtggtacgtcattgtggttgggttgagggacttgctgggcctgggcacagaggatcaaaggcttgtatctgtacacttgtcgctcctgcatctctggatgtgctcgattgaaccttcatgtgtttgtgctctgttgcagagtatgagcatcttcttcttctgcttgatcatccttgagccgcctacaaagaaatcaccctatccttcaactcaatgtcttccactgaaccccccccttcacaactcaggacgttgctggagaggctgatcggtgcccggccggtgtatgtgcagacccatgccccccgcgccatctcctacgagtacttgaaccggcagctggtgtggggggagctgtccgagctcctgctcttcgtgctccccctgttcaacctggccagcgtcaagcgctcgctgcggcgcctgctcccgcagcccgcggcgcagggcggcgcgtcggggcggcagaccgcctgcgggacctgcggcgcggccttccccctgctcacgcccgccgccgcgctgccctgcggccatgtgcactgctactactgcctgcgcgcccggacgcaggcggacgccctgtgcgagtgcggcgtctgcggccggcgcgtgcaggccctgtgcaggttgggccgggggcaggtggccaccgcccctgctggcctgggtggtgtgaccaaggcaatccccactggcatgcagagtgcgttgcttgctggcctgcccgggccgctgcgatgatttagagagccaggggcataccgctgtctttgttatctgatcctgagtcttgactgtcactcccttgctctggggctaatgctaagaaggctgcacagggacctcgacaatgcaggaacgtgtttgcctggggtgcacatgcagggggagttgaggaggagggccaacagattggtgtccaggcagagggtcatgtcctgccgtgggccttctcctcctgctccacaggcctgcccaacctcactgccctgagacggcaatgcccgctcagggcgagatcttggcctcgttcatcgccgacgtggtggccgccgcaatggacttgtcggaggcattgggcaggtagtagtacttggcccccgccgccttggcaatctcctcagcaaacccggtggacacgaacttgttctcggtgtcgatcagcagcatctgcaggttgctgaccagcacacgccgcgccatcagcagcacctcctccttcagttgctcctggggggcgacaagggggttatggggatgaggaaaggggtgagttgggccatggtgcacgaagctcactggcaccagcagacaacatgtgcagagtctgggtgtgaaagcaaagcttcacaggaagcacgcgctgggagcgcacgtccttcatacactgccggtcgtgcacggccccacgctcctcaacagatgaatgtcagctgcctgaccctgagcccaacaatatgcgccccaaggtagcgcgcctcccaagtcagcccactccccaccgtggtaggcttgacagcatccggtcccatggcgtccggctcctcgttggaccgcgccagcccgatgttggcccgaccgtcggtgatgagcaccagcatcaccctgcccacctccccccgctgccgggcctgcagggcggtccgcacggccagggacatgcctgcaaggaggagggggttggggcttgggggttgggaaggataaactccaagtgtttgagtggctggagatacattccacccagcaactcccaagatatcagtatgttccagctgccaagcagaaaacagagccctgcatcacccatttccctctgcacagatcacacatcaccacccagcgccgcaccgtgcgccagaggcgagccgccgccgcatggcagcgagtccagccgcctcttggccatggcgatggacttggacggcgggagcaggacctgggcctggtcaccatagaaggggatgaggcacacttggtcacgcgacgcatacgactccgacagcagccgcatcaccgcgccctgcatagggggtgtgatttgggatgagtgagctggtgagggcggaagtagcgattggatgattgttgttgagagggggctgctcgctcggtgcccaggaagaagcagcatggcttcttggcttttaggcagggattgtgcagcactgatctcagtcatcaggagtaaaccttacaccacctcccagggtcgtctcccacctcccaaatcacccacacccacacgcaccttggcggcggccatacggttgagagccatggatccgcttgcatcgaccacaaagaccagcagcgcgccggccttgcgcgccatgcgcttggcccgcatgtcggtgcgctccacgaacacgggcctgatggcggcccccggcgcggcggcggccttggcccgcgcgcggcgcgacagctggtagggcgccgcggatcgcagcgtggcgtccaccgccaggcgccgcaccttgtcgcccttgggcagcatgggcttgatgtaccgcccccggtcctcgctgaagatgagggtcttggcgcgcccggaccggccctgcgcgcgctgctgcgcctgggccagcgccaggagggccgggtccaggatcacgccctccgcctcaaacatgaactcctggggcagctcatcctcctgctcctgctcctcctcctccttttgggggggtgtggggtgagcaggggggggtgg

SEQ ID NO: 41848 - DNA, 101 bp, Chlorella protothecoides
gccgcctgaccagtccctggagatagcggtggcggtcaaggagaggcactgctttgtcgcggcctcgggcccgggccctggagcagcgccagcagcaacca

SEQ ID NO: 41849 - DNA, 61 bp, Chlorella protothecoides
cctcgaagcggcggaagttgaagaggagggggaagaaggcccagccgatgtggacaaacca

SEQ ID NO: 41850 - DNA, 71 bp, Chlorella protothecoides
gctgtgcaagcagcgcttccggcacctcacagtgagcggatacttgtttgtgtgtgtttgtgtgggggggg

SEQ ID NO: 41851 - DNA, 61 bp, Chlorella protothecoides
acttgtttgtgtgtgtttgtgtggggggggggtttagggtggaaagtaccattgtggtgct

SEQ ID NO: 41852 - DNA, 61 bp, Chlorella protothecoides
tacatactacgcaccatcactgaaggcacgccgaagttgcagagcttgtctgctctgagct

SEQ ID NO: 41853 - DNA, 61 bp, Chlorella protothecoides
gcagctgcagcaacaacagcagctgcagcaacaggcgcagctgcagcaacaacagcagctg

SEQ ID NO: 41854 - DNA, 2882 bp, Chlorella protothecoides
  modified_base (165)..(217): a, c, t, g, unknown or other
  modified_base (1032)..(1183): a, c, t, g, unknown or other
  modified_base (2647)..(2728): a, c, t, g, unknown or other
gcggccgaggcgcgggcggcagctaccgcgccaacttcctggccgagcccgggttcggcggcggcgtgtacggccgggggcggcccgcgcggccccagcagcgcgacgactccaacttcaagcagctgggcaactggtacggcgggggggggggggggggggggnnnnnnnnnnnnnnnnnnnnnnnnnnnnnnnnnnnnnnnnnnnnnnnnnnnnngggcagccccggtttgtgtctgcgcgagcgtgccccgcggcacgcggtgcgcggccgacgctcagcccctccctcccccctctccccctgctctatacccctgtcctgctgcgacactgccccctgaaaccggaacggcgatgctggaggttgaagcgtgggacaggaagttgtggtttttcagcttggcgccgatacgtcaggggaggaacagaaggagaatggtgtacttatacaaagggggggggggcctgccacaaggacagtgtcgagtcgtgcaggcgcaccagcgcacacacacatgcagggttcatgtacgtccacggccgacaatcccctcagggctccagggcgggtgagccggggtccgaccaggccacgcccagcaggtcgaacacgctgcgccaggtggcggccagctggccgctgaggggccgcacgccgtcgccccaggccaccgacacccgccccgcccgcgccaggctgccgtcctgcagcagctgcgccagcagctccagctccgcgcccgccacgtccaggcgcagccagaggcggtcgccggggcgcagcgtgcgcagcagccaggcgccaaaatcgagggccggcacggactcgcgcggcgcgccgggcgcctcgcgcccgaacagcgaggcggggtggggcggcgcaccccaggcggcgagccacgcgcccgccagccagccgggtgacggcccctgcgcggcgggcagtgggttcagcgcaacctcgccgtcccgcacccaggccgccgcaccatgggtctgcacgcccagcggcaggccgtcgcgcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggaaggcgcgcacgccagccccggccccggcccccacctccacgaacaccgagcgcgggggcaggggggtgggatgcgacgtcacgcccgccacggtgccggcggcgtcgccgtcgccgggatcgtcgccccgcccgacccccgaggcgacgtacacctgccagcccccgcccgagtgcggcgaagcgaaggcggcgctgcgcccgtcggggctccagaaggcggcgggggcagggggctgcgtggtcgaaggggctgggctgccctccctgtccaggggtcccccgccgaggcccacgccggccgagtactcgccgacgaggcgcaggcggcctgtgcccaggtccagcgtcgcgtagcgtcgccgctcctgtgccacatccctggtctcagcgtcggtgctggccaggaggagccggtctgtggtcgggtctggggacatggcacaggaggccgggctcgcgccagccgctgcggcctctgaccccgccagcctacgggtcgggggcaggccgtcggcgaagttggccggcagcctcacctgccaggcgcctgttgctgtccacacgatcagcagattcctggggcggggagttttggttgagggaggcctgctcagtcacatgcacgccaggcataggtgctgagctggagcatacatggtgggcattgctgccatgctctcactagaatcggtggtcttgcagctggacccaactgtgccgtgccagcacaaagtgcatcctgggatggtaagtagatcaaaggcagcccatccccacaggctgacactcaacctttctcagatagacccttgccccaccgccgccctgataagcaccccgctcactctgcacggtaggccagggccaggggaggctcgggcaagcgcagagctaccagctggcgggtcggcggcgagccccacaccgcccctgccccagcgtcccgccacgcccggggcacccgcgcaacaaaggccgtggcggcctcggggccgctgtcgcagccgccggcgtccgccaggaacgccagcgacgccgcgcccggcgcaaaccgcacctctcgcggcctcatcggccctgcgcaggcgcggtcggcgccgtccaagcccatcgctgctcccgcggcggcggccagggacgcagggctggcgaactgcacgctgcggcgcccggcagcgcgcgccagccacaggccaccttcgagggggtgcggggcggcgagcgcgagcagcgtgccgcaggccgacagcgccagcggcaagcccggcaggctgtggctgcgcgccagctggcgccggtcgtacagtatcgcgcacatggccagcagcggcgcggcaccgccggcggcatcgtcgtccgcgcccgccgcgccatccgtcgtcgcgtgcccgctgcgctcccctccggccccacccctggccgttccagcgcaggcatcggcgaagacgagcagccnnnnnnnnnnnnnnnnnnnnnnnnnnnnnnnnnnnnnnnnnnnnnnnnnnnnnnnnnnnnnnnnnnnnnnnnnnnnnnnnnnccagcccagcagcacgctggccgccggcaccccgcggtgcagggtgtccagatgctgccacgcccagccggcgtcgggcgccgcgccgccggcgccgtcccgcgccgtcccagcgggccgctgcaggacgcccaccgccggggcgccgtcacct

SEQ ID NO: 41855 - DNA, 93 bp, Chlorella protothecoides
acgccgaggcggggacgacctgctttattccgggaagtgcgagagacaaagggtaatgtgaattggtcatgtgaagcaggtatgcagcgtcct

SEQ ID NO: 41856 - DNA, 78 bp, Chlorella protothecoides
ggggccgctgccggctcggcagccgactcacttctcccctcctcatgggcgccgcctggggtctcaccgtcaccgact

SEQ ID NO: 41857 - DNA, 72 bp, Chlorella protothecoides
tggaccacctggcaaacgggtggggtgcacgcagctcctactgaccagcggggctggtggtcgagctgggac

SEQ ID NO: 41858 - DNA, 72 bp, Chlorella protothecoides
gatcgtacagacttagggtggagctgtcaagccggctcagggcgtccaccacctccccgcactccgaggtca

SEQ ID NO: 41859 - DNA, 145 bp, Chlorella protothecoides
gtgagtgcttttggtgggggtgggtgcttacggtctctggaagattccatcgtgcaggggtgggtggaagcacagtgcaggcagtggggcgggtgtttgcctgacgtgtcatcccccatcacctcatgccaatccaatcaccccg

SEQ ID NO: 41860 - DNA, 161 bp, Chlorella protothecoides
gtggccagggaagagcgggagagcgtgggcgttacgaaaggaggggtggcgggcggggtttgctgcgcctggggacggccctgctgggtgcagattgtacatcggccctgggtctgctcggttctttccccacactgcatcagagcaggggattctgggac

SEQ ID NO: 41861 - DNA, 61 bp, Chlorella protothecoides
ctggcctcccccggcctgctggaggcggggtggaactttggggcggggacgatgttcgaga

SEQ ID NO: 41862 - DNA, 67 bp, Chlorella protothecoides
cgcacggttgttgaagggtacaccgcagcatgtctcaccaccagggttcatcctcaacctcacaggt

SEQ ID NO: 41863 - DNA, 109 bp, Chlorella protothecoides
ggggtggcgcgtcgcgccggagggcagcagtgaggacgccgggggtgtcgcagggtcggccgccggtttgccagcctcgccggaagactcggccgcctgcggagcccct

SEQ ID NO: 41864 - DNA, 662 bp, Chlorella protothecoides
  modified_base (152)..(161): a, c, t, g, unknown or other
  modified_base (456)..(465): a, c, t, g, unknown or other
gtgggtttgggggggtgggtttggggggtggggttcagaggtaggagggcgatgtgcagcgaggtggccaggggggtggcaaccgagacaggcagaaattacgtacgtatgtgcaggaactcccccccccccccccccccacccccggcccnnnnnnnnnnggctcccgggcccagttcgcacctcgtagctgagcatggcacgctcagtgcgcctggccaccatggccatgacgtccagggacttgaaggggaaggagccgtgcgcggtctcgcccgacagcatgaccgcgtcagcaccttcacgcaccgcaatggcgatgtcgctcacctccgccctgcggggtgtgggtgattgcaggatgagttgagaggacggaagaggtgagccaggagcctggggatctcagggtttgggagatcaaatggtaagggaagggggagctgcctgcctccnnnnnnnnnntttgcaggatgagttgagaggacgggggaggtgagccaggcgcctgggatctcagggtttgggagagcaagtggtaagggaagggggagctgcctgcctccagtttctgcccctcgttcctctataccagagcagcacttccaccgctcgatgcaccccccttccgaccacccccaccctaaccccacccctccccc

SEQ ID NO: 41865 - DNA, 71 bp, Chlorella protothecoides
gacgcgcagtcggtgtgatgcgagcgcaggcgatgcgcgatctgtttcctgctgagacgcaggggaggcgg

SEQ ID NO: 41866 - DNA, 92 bp, Chlorella protothecoides
catgagcatcatgatcgggggtgagagggggtagggaggggaggaaggcggatgaaagaggcacacatggaccgtctggcggctgggcaggg

SEQ ID NO: 41867 - DNA, 61 bp, Chlorella protothecoides
gcgcctccaccagggctgtggagggcaggaaggggggggggggaatatgagtcgtgggctg

SEQ ID NO: 41868 - DNA, 64 bp, Chlorella protothecoides
caccatggcgtgccctgcacgctgtcttgcatctctgcagatggcagcgacgacgcagaacgcg

SEQ ID NO: 41869 - DNA, 61 bp, Chlorella protothecoides
ctccagcggctactggatcgtgagcatcgcgtgccgcgaccgtcccaagctcctgttcgac

SEQ ID NO: 41870 - DNA, 69 bp, Chlorella protothecoides
gggccctggtgtgaccccggccacttcatgcttaacggcatgtcaggggggcagcactgaaagcattca

SEQ ID NO: 41871 - DNA, 1423 bp, Chlorella protothecoides
  modified_base (408)..(417): a, c, t, g, unknown or other
  modified_base (911)..(920): a, c, t, g, unknown or other
  modified_base (1290)..(1299): a, c, t, g, unknown or other
cctctgcgcaggcaatcccggggtggtggatctggtgctactacatcaaccccgtgtcctggacgctgtatgccctcatcgtctcccagctgggtgacctggatgacgagtacattgttaacttcaccaaccaatcggtgagtgggagggggggacgaaagccagaccgggccggcaggctccaccctgggcggggtcggcggcagcacccccacgcaccgggctccctgccgtgcagacgcacccgtgtgcttgccgagggcaggccaggctgtcgcgcggggcccaacccccttgtcgcatcggctcacgccccacccgacacgtactccacagcgccccgcctcctgcatgcctgagcctccccccttccccctccaggtccccatccccgtcttcctggtggannnnnnnnnncccccctgtcgcatcggctcacgccccacccgacaaccccccacagcgccccgcttcctgtatgcctgagcctccccccttcccccccaggtccccatccccgtcttcctggtggagctgtttgactacaagtacagcatgctgtggccatccatcgccatcatcatcgccttctgcgtggtcttcaacttcgtgtccttcctgtctctgcgcatcctcaactaccagaaccgctgatggccccgtccacgagcctgccatggctgggccggagcccgcgccgtcatcaaggtgcgcggcggcgggctcctcgggcgcagccggcgagtacagggctccggtcccggcactgtgcagtcctgatggatggtcagcgctgcactccctttggtccccgtcacatgtcgggctgtaacaccacgtgttgatgtgttgcggagttgttgtgggggcgggctggtccccgcaacggtggaccgctgtatatgacctgnnnnnnnnnntggtccggacggatggtcagcgccgcactccctttggtccccgtcacatgtcgagctgtaacaccacgtgttgatgtggttgcggagtgggtgtggaagcgcggggtgtgtgggtctcggctgctgatggagggcttccagggctgctggatctgaccctcgggagctggcacagaaggggaggcatgccactcccatccaatggacaattccctacaggcagagttcctctgtgagtatctgcgagtctcttgactcacagtgagcccaagaaacgggatgggaaatcaaggcgggtcttcccaccgctgctttgacaggagctgcgatgccggagcagagcatcattcctcagggcaggttcatggcnnnnnnnnnncataggcgtcgcaaggaggtgtggactcggtgcggagcgggaacaggtagaaggcgggggaaagcgcacggtcaagggaacccccacgacaccaagcatgttacccccacgcccaccccctctc

SEQ ID NO: 41872 - DNA, 61 bp, Chlorella protothecoides
cttccatcccacttctggtttgcttaaaccaccccccccctcccccccacaacacacacac

SEQ ID NO: 41873 - DNA, 61 bp, Chlorella protothecoides
gcagaggagtgtgccaggcagggacgctgcacccgcccctctgccgtccacccatgcttgc

SEQ ID NO: 41874 - DNA, 61 bp, Chlorella protothecoides
cgacctggccttctccggccagaccctggtgcgggagaacctggcggtgctgcaggagggc

SEQ ID NO: 41875 - DNA, 61 bp, Chlorella protothecoides
cccccccaccccctctggttcgccattagaagcaaccaactgcgccagtcagatcccgctt

SEQ ID NO: 41876 - DNA, 74 bp, Chlorella protothecoides
cccctgctcatcactcattccctcctctctcacccccccccctcgcgcaggtcgggtacgtccagtcccgctgg

SEQ ID NO: 41877 - DNA, 61 bp, Chlorella protothecoides
gcgaggagaagcgggcgctggaacggctggggaaggatgtgatcaatgaggtgcgccaggc

SEQ ID NO: 41878 - DNA, 78 bp, Chlorella protothecoides
cgatgagtattggatgggaatttaggaagccgtggcgtgttttggcagtttatcttggacatccacgcgtttgggcag

SEQ ID NO: 41879 - DNA, 74 bp, Chlorella protothecoides
ttaccttgacgagtcgcctgcctgcaatcaaaactgctcccaatgtatcctacaggcccgccctttcttcccca

SEQ ID NO: 41880 - DNA, 67 bp, Chlorella protothecoides
cagcccggaggagtctccctctcccagcccggaggattctccctcccccagcccggaggagtctccc

SEQ ID NO: 41881 - DNA, 61 bp, Chlorella protothecoides
gacggagaggtcgcagggctggccgctggcaagcgtgagggcacagggctggaggtggggg

SEQ ID NO: 41882 - DNA, 62 bp, Chlorella protothecoides
cctccaatcacatacccttgccctcacccgcccgtaaacctcctgcaaccgtactcgcagcg

SEQ ID NO: 41883 - DNA, 77 bp, Chlorella protothecoides
gccaagaagtgtatgaagcacaccctggccatcacctccacttcccacccccccaattcttctccaggcaaagctgc

SEQ ID NO: 41884 - DNA, 71 bp, Chlorella protothecoides
gggggcgcgcggtcggcgggccccaggagcacgctgcgcacgtcgcaggcctccttgagcaccacggcgtc

SEQ ID NO: 41885 - DNA, 64 bp, Chlorella protothecoides
cctgatgcgcacgctgcaccaggtggcctctggcgggcgcgtggtcatcgcctcgctccaccag

SEQ ID NO: 41886 - DNA, 99 bp, Chlorella protothecoides
gccaaacaccttgggtgcatggagaggatgtggtgctgaggaagccggcggcggcggcggcggcggcgggcgggccccccctcacgcactcagccgtga

SEQ ID NO: 41887 - DNA, 89 bp, Chlorella protothecoides
ggggggaaagggggtaggtgaagggcgccagccatcacgctgccacctccaccccccctgctccctcctcgctcatcctctccggcctc

SEQ ID NO: 41888 - DNA, 67 bp, Chlorella protothecoides
gaggttgaaagggtcacgcgacacctggtccggggcatggtcaggcgctggagagcaggtcggagta

SEQ ID NO: 41889 - DNA, 75 bp, Chlorella protothecoides
tcgggccccgcaccccttcagggagttgtgttgtcgtttcccccaccccacctcgcacacagccacagcaacgcc

SEQ ID NO: 41890 - DNA, 16389 bp, Chlorella protothecoides
  modified_base (703)..(712): a, c, t, g, unknown or other
  modified_base (1547)..(1556): a, c, t, g, unknown or other
  modified_base (1610)..(1648): a, c, t, g, unknown or other
  modified_base (2372)..(2381): a, c, t, g, unknown or other
  modified_base (2734)..(2743): a, c, t, g, unknown or other
  modified_base (3319)..(3328): a, c, t, g, unknown or other
  modified_base (4160)..(4169): a, c, t, g, unknown or other
  modified_base (4424)..(4433): a, c, t, g, unknown or other
  modified_base (5272)..(5281): a, c, t, g, unknown or other
  modified_base (6883)..(6892): a, c, t, g, unknown or other
  modified_base (7139)..(7240): a, c, t, g, unknown or other
  modified_base (7350)..(7359): a, c, t, g, unknown or other
  modified_base (7576)..(7585): a, c, t, g, unknown or other
  modified_base (7774)..(7783): a, c, t, g, unknown or other
  modified_base (8194)..(8203): a, c, t, g, unknown or other
  modified_base (8809)..(8873): a, c, t, g, unknown or other
  modified_base (9577)..(9586): a, c, t, g, unknown or other
  modified_base (10173)..(10182): a, c, t, g, unknown or other
  modified_base (10681)..(10833): a, c, t, g, unknown or other
  modified_base (11655)..(11664): a, c, t, g, unknown or other
  modified_base (12307)..(12316): a, c, t, g, unknown or other
  modified_base (13806)..(13815): a, c, t, g, unknown or other
  modified_base (14292)..(14301): a, c, t, g, unknown or other
  modified_base (14571)..(14580): a, c, t, g, unknown or other
  modified_base (15218)..(15227): a, c, t, g, unknown or other
  modified_base (16050)..(16059): a, c, t, g, unknown or other
cctcggcggggagcgcggtactggacggccagggccgcctgctgtggaccagcctgccggagggatgcgcggaggggctggcggcctgggccggggcggagcggccggcgccggggccggccgcgctgcagcccggagcccgctgggaggcgtgtgaggtggacgcgcggggctcgggcgccgatggggcggggccagcctcggtgctcctgctccgatctgcaggcgaagcgcggctgccgaagctgcacctgggcagccccccgcggccgttcgagtgcttgcttctgagcatggctcccgccgacctgtgggtgatcgtggccctcgacagaagcgggggcggctgctccaaagcccaggctgcggcgctgcacaacctggcacgaccctggctggaacctctgatcaaggtgccccttgtgtttgaaccgggagggtcgcacggcaggggtgtcgtggcgctgggaatggggcagagaaacacgcgtgtactggtgacggcctccctggctcttgttccagatgatgtgcggggcacatgccctcagccagctgctgacattgccagcaccttctgtgtggcaaaccgatccattgcccaagcctgggcatgctttgtaggctgctgcccgacgaaccaatccacctccacctcactgacctccaaactcccacccggacgcaggaggcggcgctaccnnnnnnnnnnttaggctgctgctcaacaaaccattccacctccacgtcactgacctccaaagtcccacccggacgcaggaggcggcgctaccccccgaacgtcccgcacacctccctgggtatcggtacatggccgtgcgcgagggactcgcgggagcattggccagccctcgccccaaaataagtgccatgtcccacgtcgaccgcgccatggctgctgccgggcgggactccatggcacgccagggggcgctgggggccgcggcagactggacggacgccgatggcggggcgagtcggacgagcttccgggaggtgctggcgcgcgcagctacgggcggcagctggctgctgatgcaggagagcatgcagggtcacctgttggccgtacgacagggggccggggagaaaacggtcaaggaaatcatgcctgcggtagcggacttgcagcgccggctcgatctcaatgcgtaaccagctgcgacagcgataatgcctggatgcaattgatgaagcagctggaagtcagccatccacctgtactacagaatggagcgtgcgattcctcccgcccacccatgtgtgggggggatggatacggaccccaacagcgtcacaccgactacgcgattcgattcgcggagggctccgtgcgctccctggctggtgcatgagccatctaatgttatttttgttgaagaattgaacccagcacccaattggggacatgggagccttcagggggctagtccggcccacgtgggtatgctaaactgtatcatgggaggcatcgaggtagcgcattatcgacagactcgaccaatatatctccgagacccccagannnnnnnnnngattcttgttgaagaattgagcacagcacccaattggggacatgggagccttcnnnnnnnnnnnnnnnnnnnnnnnnnnnnnnnnnnnnnnntggattcgggacctgtgtccgcgagaatacggatgatgatggtgcgactggtcgtgctgggcctccttgccctagcattggcgccaccggtctacagtgcagacttcgtcaaggtcgacggtctgcgcttcacgtccggtaattgcacggactttaagccggttggatggaacgggtgagtccgggggtgcaccagtttgggaggaatggggagccgccgacctgcgcggcagtttagcggcctggcgcgttccatgtccagtggtggcgtgccacccctgcgcaatcctttgccagtaacataccatgatccttagagtgcagtggaatacacgcgcctcactgttcttcccttgcgcccctgcctcccgtggcaggtggtccaccctatcgtacgcggccaacaagaagtccatgccgggattcaatgatgggcgggccttcctgaccaacatgttcaaggaggcccaggcgctgaacttcaacgtctaccgcttcttcatccagggcgattactccttcctcaccaccagcgctggtgaggatgcctgggcggtttctgacccctcgcttgcagtgggcggagaacgggcggttggggatgggtgggcatcctggaataagggagtgacactgcgcgttctggttgcaatttgagtctgtcttacccttttgtcacaatgaagcaaaaacgacaccaagttcccacccgactccacgctannnnnnnnnntttttatcacaatgaagtgaaaaggacaccaagttcccacccgactccacgctacaggtcaatacgatgagcagattttccagggctttgactttgtgctggacgaggctgccaagtataacatcaagctcacccccatcctgctcaacctctggatcgacgacggcgtgccactggtgagtgcatggctttctgaaaaagggggggttccttaacttgttaatgcatcgttcatcccgttttctgttcatggtctgatccccatccatccttcaatgccgaacccccctcccccccccagtttgagaagttctgcggcagtgacagctccaactaccgccccaccccctccnnnnnnnnnncctggtgagtgtctggctttctgagaaaaggggggtttcctgaacttgttcatgcgtcgttcatcccgttttcagttcatggcctgatccccatccatcctccaataccgccgccccccgccccccgcccccacagtttgagaagttctgcggcagcgacagctccaactaccgccccaccccctccatcgacctgcgcaccgagacgacgctgaacgcctcggagcgcctgcagaccccctacaagtggtacaccgaccccgactgccggcagtatgtcaaggacttcatcaccaaggtggtcacgcgcgtcaacaccatcaacggcatcgcatacaaggacgaccccaccatcttcagttggaacatgttgaacgaggtgaggcacggcgaggggggaaacaatgctcagctcggaaggcaacaggggaccctaccccagcctgcttccattccaggctgccttggactggcccctgcatatcgcaaagcctatacaccaaatgtcgagacatgcccaagcctgtctatccgccccccttcagacccagccttctttgccctccctccacagcnnnnnnnnnntaaacaatgctcagctcggagggcaacaggggaccctaccccagcctcgcctccattccaggctgccctggactggcccctgcatatcgcaaagcctatacaccgaatgtcaagacatgcccaagcctgtgtatccgccccacttcaaacccagccttctttgccctccctccacagcctcgctgcaagtattgcggacccgaggccgtcacggagtggtaccacgacattgccgcccacctgaagtctgtggaccccaaccatctggtcaccaccggggaggaaggtgcggaacctgcctgcctgtggctgtctggaaagggcgcagtgcatgcgcccctggtggactctggcttgcgcctgcctgcggtcatgatgtcaccgctcactggaccccctccatctggctgccctgccttgccagcccccagagcccctgccccatcagtccatgccaccaacacatgcgcaggcttcttcgacgagtcctccagcttcgtcgccgcggaccccacggacggcaacaagtggggcccccgctccggccaggactttgtcgccaaccacgattcccccaacatcgactacaccgtcatccacatgtggcctgacaactggggtgtgcagcccaacgacatcgcctttggcaagacctggatcgacttccacactcaggccagcacggcactgggcaagcctctgctcatggaaggtgcggcatggccgtgggtgggaccaggcggttatgtttttgctgggatgcatgcccggggatggtgtccacagccgcggcagagcatgacgtcaagcggtggcatgttcgaggcccccnnnnnnnnnngtgtttatgctggaatgcatgcccggtgatggtgtccacagccgcggcagagcattacgtcaagcggtggcatgttcgaggcccccagtgccccattaccaaccccctcatgcccaccctgccctctgaccacccctcagagtttggcaagggcgtgacagactcgagccagatcacctcttttagggatccctggtactccctcacctacgacgccgccacccagagcattgctgcgggcggcgccctgcgtgnnnnnnnnnnctcagagtttggcaagggcgtgacggactcgagccagatcacctccgtcagggatccctggtactccctcacttacgacgccgccaccgagagcattgctgcgggcggcgccctgcgtggagccctgttctggctgtgggacgggtccacccagaatggcggcgacggcgttgtggtgggaaccgccgactccacgatttcggtgagggctttcggcgcatgagggtttccgagagggggcagaccccagcaccatggttgggctcagcgtggtatcacactgatgtgaccatcgctgtgcctgggtgcccctggaaccaccctgttgcaacaggctcagaaactggaatccctcccgcgcccctgcacagaacatcgtgggtctgtttgccgacgaggtgaagagcagctgcagggcgtctgcccctgccagcacggcagcacccggaagggcgggggcaagcccagcggcaagcaggaccggagctagcccgcctgcctccccgagctccatcgatctgttccaggtgcaggtgcccagcaccgtggcagctgctgggcgaaagctcctggcgcactgattgagcacctggatcccagatgccttagacctccacccagcaacagcattcttgattagactatccttgattcgataggttatccctatgctattcgagccacacttccaacttgtacttcatctgagtcaggagaaacccgctgtgtatttaaggcagtctccctgtcatttcactgaaaaaactgggaggaaggagcatcagtgagctcctcacgagagtgagccccttcagttgtaggcgagggatgtcgaggcnnnnnnnnnntcagtctccctgccgtttcactgagagaaattgggaggaaggagcatcagtgagctcgtctcgagagtgagtgccttcagttgtaggcgagggatgtcgaggctgccaccacaaagctgcgctcctctgtcgactcatcttcccccctcccgccccacgcagcagctcacgcctgtgccgattcacgcagggtccgattcgctggatgcttcgggacccgaccacaggtcattgtcatcagtaatcggtggaattacccaatcataaaagagaatctaatgtccgtaccaccatgcgcctgcgtcgtgtcagcgggcttcggggcaccatcctaagaggggaatcggcaggaacccagcgtgccgacacgcggaaaaccattgggatatgctcgaacagaaaccctaccagcaactgtatggggacccagcgggaggatctctgctcagaggatgggaaatgcggtgttccgtgtatgggcatcgcaggcatcggccataggtggtgtgcgcgatcgcatcgagcagcatcgaagacgcaatccgaccctcactgtgacgaagcggaacacattgacagcgcacagagggatagcgggacgcactctctggtcaagactactctctcgaactgcatgatcgtcactggtatctcttagagctgtcgaatttcatggtgttccgtccggacgcctcccagacaggcgtatcacatcggtacgggcgcacccggccatggggaggccgagagaatgtgaaaccttcccaaaagtgtttcgactcattaccagcagtcaaagtctagagatatgaaccacgacgatcaaccgagatcctctaggtcgaagaagttatgcagcgtcccaaatcttgcgcttgcaatgaatcagattgggaagaagtccgacacaggtgtgacaggcagttgccccgatctcgccggcgagtcctgggcccagtcgccatccgtacctcgccaatagtccacagaatcaagccggcttccataggaagtggactttcgccacgcgtctcgcgcaggctgctgtcacggtgtccatgatgattcagagaatctcaggctcatactgggcaccctcaagattctctctctcagcccagccatggctaccatcggctcccctccataccagcataaaagcatgagcagcgccactggagccacattctcctccacatctcctcccttacccccaaggctcccagccatccccatcaaaccgtcccctgccctccaaagtcacgacatcatggccaagtcgaccatgctcatcatgatggcctgcctggctctggccgcagcccagcacgacaacaggtatgtcgagcattgaaccatccccacagtgtcctggactgcctctttctgtcggaggatgtggggcacttggttgggcaagcagggcaatgcgatccgcacatcccgacggtcgtaccccgaggcatcgctccccactccgacatcacaccaggaagatgctgggctactcgtccggctcaggcacgagcgccgaggtttatggtacgtcaacggcttctactggtgggaatacggctacgtctgtgtaccatggcgaggccnnnnnnnnnngcatcctcactgtgtcctggactgcctctttctgtcggaagatgtggggcacttggttggagaagcagggcaatgcgatccgcacatcccaacggtcgtacccagaggcatcgctccccactccgacatcacaccaggaggatgctgggttcctcgtatacctcaggcgatggcaccgaggtttatggttcgtcaacggcttctactggtgggaacacggctacgtctgtgtaccatggcgaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttggtgacagcagattttatccgcgttttctcgactcgctcaattgccccttcatttacggttcggcaactcttccactgcgcaggccttcggcggctaccgcggnnnnnnnnnnaagggagatgatggcgcatacgtcaagggatcctcgagcgctgccaccgataagtacagcgcagaggccaaccatgaggtcgaaggcgctgtgagtggtgaattaattattctggtgacagcatattctatccccattttctcgactcgctcaattgccccttgatttacggttcggcaactctttcactgcgcaggccttcggcggctaccgcggnnnnnnnnnncaaagtttctggtggcacctgggtgtacgttcccgcgtcttactggaacccctcccagtacgccagtacctacaatggggccaaggcatccaccaccgacgggggattggctaccgcctcctcgaacagtgacagcagggccaccaagtgggatgcccaggtgagtgactgggcgcaggtttgcattgnnnnnnnnnntgatgtgtctggtggcacctgggtgtacgttcccgcatcttactggaacccctcccagttcgccaagacctacaatggggccaaggcgtccaccaaggacgggggagtggctgccggctcctcgaagagtagcagcgaggccaccaagtgggatgccaaggtgagtgactgggcgcaggtttgcattgccacatgcatggcttggacgtctacgcaatgcactgaccaataccaggaacatacatgggcaggctcatctcagcctcattcatcctgatcattctccactgcctcacagacatggggcaaggctgaggcgaaggcttggcccggtggcaagtgagtgcccggactggaagccttcatcctgtgcaggccatggactggttatttctcaacagacagcgagannnnnnnnnntgcaatgcactgagcaataccaggaacatacaagggcaggctcatttcagcctcattcatcctgattattctccactgcttcatagacctggggccaggctcaggcgaaggtttggcccggtggcaagtgagtgcccggacttgaaggcttcatcctgtgcaggccacggactggttatttctcaacagacagcgagatccatgcccctcaccccagtaccggcttgcacatgcacccaatctgaaccggcgtgtcacactgtcccctgccaacattcctacattatcgcaccttggtaccgattttggagacttgtactgcggaccttggattactggggagttgatgttcacggagtctgtaacataggctgtggctcatgagtccagggaaggcaagaagagggacggagagcatcctttcgaggggggcaccagatcgtgcccatggccacagcacgcaggccacgcatgtgggcacttggccgggccctgcaaaccactgggagggtgctcgccaacccatgtgtgggcgatacagctacctcagcgatccaggcattcctcaatctgagcctcgttgagctcacccgggtgtcggcgggnnnnnnnnnnnnnnnnnnnnnnnnnnnnnnnnnnnnnnnnnnnnnnnnnnnnnnnnnnnnnnnnnccccgctgcgcacccgtggtggggtttgcgccccagcccaccgatgctgggcagcaggtggatcgctgcagcactggtactgcttgcggcagggagcgcttgggaggcgtgcaggtgaggtctgggcagacatcgggcatgggaaccggggcggaaggttcccgcaggggggcaggaagcgggggggtgatgccgtatccggggctgccagggtgacaaccccccttcccacctggtcaccccttacctctctcccccagacccgccctcaccatcgtgggcaatgtcaccctcgacatggtgaacgggaagcccagcctgggcggggccgtggcctatgccgccgccgtggcctcggcctttggggtgcgggcctgcatcgtcaccgcggccggccccgggatggacctcagtgcgctcagcggccacgacctccacatcgtgcctgccagcgagaccctcaccttcgagcacacatacacctactggggtgggttgaagcgttgagcgtggggcgggctggggcctggtcgggcctgcgcagtggtctgactgcagcggcagcggcaggtttgacacaggccctcgcaagagcccgggcaggggtgcttcttgccctgatcctgcactgccccgcctgaggctctggaggggtggggacatgaggcccatctcgatggcaacattcccaagctccacccccnnnnnnnnnntcaggtttgacacaggccctcgcaagagctcaggcaggggtgcttcttgccctgatcccgcactgccccgcctgaggctgtggaggggtggggacatgaggcccatcacgatggcaacattcccaagccccatccccccccccacccatcctctccctcacaccaggcaacgcgcggcggctgcgagtcactgcccagcccaacgtgaccctcaccatggcccacgttcccccccgctgccggcgcgcccgcgtcatgctgctgggcccgctcatgccggccgacatggaccccgccagcttcctcccggcttcctccggcggccgcgggtcgcacgcccttgccctcatggctcagggcctgcagcggtcgctggatgccgggaagaaggtggtgcccctgcaccagcccagcccgcagctcctggtgagctggcgggcggggaggggggtggtttaagtggattgcttggacgagagctgctgggcatggtgaccctggatcgatgggcgggtggaggttttcaagcgggccaggcgctgcaggcaggaaaataaatgtcggcgcggcccgccgactcggctggnnnnnnnnnnccaagcaggccaggcgcggcgggcaagaaattcaatgtcggcgcggcccgccgactcggctgggtcctggcgaagacacttgcataatccatgcctgcacacctgcttcttgtttcctgtcgtcgcagtcacttacgccaaagcgcatctgctgcgcaacccactccgccccctcctcactgctacgctaccttccctgaactctttcccccctctcttctcctcacaggcagcgctgggcccctccaccacggtctacctgtcggacgtggagacggacgcctggccccccggcacgatcgaggggctggcggcgcggacggcgcgcttcctggtcacgcgcggcgcgctgggcgccgacgaccacgagcgcggccggcgcacgcgccgcccgcccttccccgtcgacgcggtcgtggacaccaacggcgcgggggactgcttcgccacgggccacgtgctggcgcgggcggcgctgcgccacgccgcgcccggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatcacccaggccatgcgcgcggggtgggccgtggtgccgcgcctggaggagagcggaggcgaggcgcgggtgggcacgggtgtggtgcccggcgcgctgggcgggccgcgcgccgcgctgcgcgctgcgctgcagcggctgctgcccggcacggagcgcctcgcgcagcaggccacgctctgaacagcgagtccggatcagtgggaccttggccgggcctcgaatcggccaggtgaatgaccgagtgcggggaaaggacgacccggtcgtgacagcctcccggcactgagcttcttggacatggcatgagctcatgtttgccgcgtggagctcctctgcgcgctgccgagggtcaaggcggcccctgagaaaggcctggcatggggaccgccgcagggaaaggcaggtggtgcgtccttggtcaggacgctcgcggcccaatcctcgtcccgcatcatcttcatcaggcctacaccatcgtgacacatttacaaggaatgcgcatgcctgctccatgcgatagagtagacaggcaacaggactgcggcgtggccgaatggcccatgcgtgtgagaaagtagtacaggatgaggccgtggccaagggcttgtagaccgcaagacagtctcggagggagcagtgcacggggggtctcatccaaacaggcatacattcgaggtgctcagagtcccagaaggaagcttgcaaggtccggcggggctggagcccgcagggcaggagctggaggcacgagcctgcagggcaggagctggaggcacgagcccgcagggcaggagctggaggcacctgcccggcagnnnnnnnnnngggtccggaggggctggagcccgcggggcaggagctggaggcacctgcccggcagcgccaatgcaggcccaggctggcaggcggcttgaggtgcccgtctgccgcgagggtgtgccgcagcccgcgctcgtccctcaaaagggcttcaggtcggtgtaccccagctccgcaaacgcctcattggcggcggtcttcagctcggcctccagccccgccccctcctccctcagccgctcgctgatggcctggaagagcaggatgctggggctgtgcgccacgccggcgtacccgctggccagggacaccagctcggggggggccatgtcggggatcttgtccatcaggtgccgcgccacctcgtccagcagcatgtcctcgctcacacccaggcgcccgcagtcgtagatgacctgggccagggtggccgtggggtaccgagacatgccagacagcaccatgtctgcagggggaaaggggtcattggttcagcgccgccaatgagcaagggtcctgcagacctgtgtaaaagtagcctcagcctggattggccagatgatggacctccacccaggcatacaacttgccctcccaggcccatgagtcatcatacatcccatagactcaccgatgagtacttggaagnnnnnnnnnncgccagacagcaccatgtctgcggggggggaaggggtcattggttcagcgccgccgatgacagcaagggtcccgcagacctgtgtcaaagtagcctcagcctgcattggccagatgatggacctccacccaggcatacaacttgcccctcccaggcccatgcctcatcacacaccccatagactcaccgatgagtacttggaagccggggtgcttgctgacggccgtgaagtcggccccaggcttcaaggtctcggcaaacgccctgaaggctcgggcgacgttggcctccgagaaaccgccgccctcggcatccacaagcttcgccacgccctccgcgccaccactggaagcggcctcacccagcctgcgatcgatctccccggatgcccgctcctcctcctcggtgcggggggcgggagggctgggactgcatgacgatgcccaccgccccatgccaggggcgtggaggatgcagcatgcctgtgcctccctcacgaaccccggcacgacgtccagacccgcctgcggcaccgcgcgggcaagggtctgggatcggagtgcgagcacccatgcaccacgagataccgcacgcagcatgatggcgtgatcggcgaacccacaactgtaagcttgatgtgagtatcaatcaaggtgcaggattagagggggagggttgtccaataggaagtgcatgtccctcgggaggtttcctgcctggccggacgtccatttacccattttcgtgccggatcctcatacatggaaattatccttacagcagagaaaattaggagcacccggcattctcagcacgagtttgtcatgttcagaacaggctggcagcgatggcagcaagagtcacgacagcgagcacgggggcggaggcgagcgcagagctcttggggggtggggggacggaggtcacggggacggagggaggagagggcttggtggaaggctcgggggcgtaagatggctcaggagcatcagaggggctctcgctggggcttggggaagaggctgcagtgaagttgagacaaggaggatatcgtgaacgattgtgattgctcggctaggacacagcattcaatgtttatgcagcattcaatcaggggtgcatgtagtgggcggcagaattcaagtgcattgtacacccaactcaccagggctcggggagctggcaggggagggagacgccttgggggatggggaggccatggggctgggggaggtggtaggggaaggggagctggcaggggaggggctgacagcaggggaggcggtgggcggggggggagaggaggagacgggggagacgggagggggggagtacttcacggcggcacagttggcgaagaaggtcgaagcaaggggccccacggtggcatcggtggtggtgaagatcgtcttcatggaggtggagcaggtctcgggaagctgcggggtaacaacggattgacggagtgagatcggagcgattagaccggnnnnnnnnnngggaggtggagcaagtctcggggagctgcggggtaacaacggatggacggagtgagatcggagcgattagaccggcgcacatgccgctgtatgaatgcttgagagtcatgatactccaatatagtcgacatgccaatcaggaccccatactcacagcgctcaggctggacgcgcaggcagggtcgcaggtggtaggtgcggtcttggaccccccggcgacgtccacaacgatgtccacaaggttctggcagttatccacggcagtggaaagggcgggcagggaggccgtgcaggtggtggtgaggagctgtggaatggggtgggcgatggggttgtgctgagtgggaccaacggactccgcgcacctccggcccgcatcaagcatttgcagagtgatcgcgctcgcctggagcgcttacctggttcacgtaggctgtgaagcgagggtcgttaaggatctgcttcagggtgagggtnnnnnnnnnngccgcgcacctccggcccgcatcaagcacttgcagagtgatcgcgctcgcctggagcgcatacctggttcacgtaggctgtgaagcgagagtcgttaaggatctgcttcagggtgagggttccctgcgtcgcggccaggcacgacagcagcgtgacgaagagtacggcggcacgagccattgtaagcgtttgtgaggagatgcgctgatctggaagggttttaggataccaaactgttctctgcaggatcggcaattggcgagagtacannnnnnnnnnaatgcgctggtctgtaagggttttatgataccaaactattttctgcaggatcggcaattggcgagagtacagaaaacaatggtcattgagccccgcaacgtgattttgaacagcggttgggacggggtggcatccgttggtgcacggagtttgaccccggtgccaactgtccgtgcgcgttccagcagggcaagctcgcactcctccctcattccccgcacaattgtcatagcacggtggacacactgtgatatacggttacgttatatcctttaatttaatatattgaaacaatgacgatggggaagggtgggcagggtcgtcacgcggatttggagcgccaaactggcaaggggtgccgtaggaggcgtcgggggtgttgtgaaggctcccggtatatactgccggtacccaagccgggcttctccttaaagggcatattaccctattccatgtgtggcagaaatctacaacaagaattgctcgatcccatcagcatattataaacgggccaaggggtcgattgaggtcgggttagatgtgtgtcaaggccaaccgcactggccagtactccaaggattaacctacttcttgatgctcttacccacatcctcaaccttgtctccggccttctgttnnnnnnnnnncaatctacaacaagaattgctcgatcccatcggcatattacaaacgggccaaggggtcgattgaggtccggttagatgtgagtcaaggccacccgcactgcagtattccaaggatgaacctacttcttgatgctcttccccgcatcctcaaccttgtctccggccttctgtttcgcttcgtccaccttcttgctgatgttcttcttggcatcatccacggcattggaggccttggccttggcatcgtccacagcattggaggccttggctttggcatcatttgctgcctcctgagctgcatcctttgcatctccagctgcttccttgaccttgctgccagctgattccaccttttcctgtccaatgtggatgcagtttgggagggatgtggagtgggagggggtcgatctcccattcgtgagcatgcctttcttagattctccaggatctctccaaaaactgaccgacgcaccttggccacatcagggttcgtctcgtcagactttttgatcataaagtagatggctgtagcccctgcaacagctgccaggccgatgatcctgttctgccgagcgacgctctgaggactggccttggggatgttcttgggatccattgtcgtgagggaaggacttgtattcgctgggatagaggagaatgagatactcaaatgcgcagggatggcctcgctgaaccgattgacacgcgatatgggtccgagcgatcgattctcggcattgggccagcttcgcaccaggactcgatgatcatgatcacgtggatgttaccctaagactacattgccgggccggaatctcatcannnnnnnnnnaccagcttcgcaccagaactcaatgatcatgatcacgtggatgttattctagactacattgccgggccggaatctcatcacgcagccgccccagggagtaggatcctggaaccctcaggccatgtaaaaatgttttcaaggagcatggatgtgggttagtaatacatggctgccgtggaccatgccagggtccaggatggcaggggcccccctttgtcaccccatctggtgcaggactcggaccagcacgccactggtctgctgcacgcaccgcgccgccgccggctgcgtcaggctgaccagggcacaggcatgggcggcgcccaccac

SEQ ID NO: 41891 - DNA, 71 bp, Chlorella protothecoides
cctcggagcgggtggggagcccagggggatcggggcgagcagtggcagcctgtgcgtttgccggcttctcg

SEQ ID NO: 41892 - DNA, 93 bp, Chlorella protothecoides
ctcaccactgccaccgcccaatgcagagtgccacctggctggcgctgcacctgcaacccacgacggcatcccttgacgcaggccccccccccc

SEQ ID NO: 41893 - DNA, 482 bp, Chlorella protothecoides
  modified_base (169)..(243): a, c, t, g, unknown or other
  modified_base (314)..(323): a, c, t, g, unknown or other
cccgcgcctccctcctggcccaggcgctgggggaccccgacctcgacgacgaggacgagcccggcttcgcgggcccggtctcgggatgggacggggcaggcgaggccatgggcgacgacggggagtggcctgcccggccgccggcggggccagccacactggcggcggnnnnnnnnnnnnnnnnnnnnnnnnnnnnnnnnnnnnnnnnnnnnnnnnnnnnnnnnnnnnnnnnnnnnnnnnnnntccggcccccgggccatccgcggccggacccctgtcgccgcgcgcgcaggagcgggcggtgttgcgctccnnnnnnnnnngccggccccggggccatctgcggcgggacccctgtcgccacgcgcgcaggagcgggcggtgttgcgctccgagcaggacgccgccttccacgcctcgctgcaggccgaccgggccaaggcggaggccgcgcggggcgccgcggagcgcgcggagcgcga

SEQ ID NO: 41894 - DNA, 24340 bp, Chlorella protothecoides
  modified_base (782)..(791): a, c, t, g, unknown or other
  modified_base (1714)..(1723): a, c, t, g, unknown or other
  modified_base (3943)..(3952): a, c, t, g, unknown or other
  modified_base (4344)..(4353): a, c, t, g, unknown or other
  modified_base (4780)..(4789): a, c, t, g, unknown or other
  modified_base (5176)..(5185): a, c, t, g, unknown or other
  modified_base (5366)..(5375): a, c, t, g, unknown or other
  modified_base (5822)..(5831): a, c, t, g, unknown or other
  modified_base (6124)..(6133): a, c, t, g, unknown or other
  modified_base (7614)..(7623): a, c, t, g, unknown or other
  modified_base (7848)..(7857): a, c, t, g, unknown or other
  modified_base (8264)..(8273): a, c, t, g, unknown or other
  modified_base (8796)..(8805): a, c, t, g, unknown or other
  modified_base (9052)..(9128): a, c, t, g, unknown or other
  modified_base (10457)..(10466): a, c, t, g, unknown or other
  modified_base (10785)..(10794): a, c, t, g, unknown or other
  modified_base (14554)..(14563): a, c, t, g, unknown or other
  modified_base (17344)..(17353): a, c, t, g, unknown or other
  modified_base (17641)..(17650): a, c, t, g, unknown or other
  modified_base (17889)..(17959): a, c, t, g, unknown or other
  modified_base (19798)..(19807): a, c, t, g, unknown or other
  modified_base (19901)..(19910): a, c, t, g, unknown or other
  modified_base (20004)..(20013): a, c, t, g, unknown or other
  modified_base (20206)..(20329): a, c, t, g, unknown or other
  modified_base (21508)..(21517): a, c, t, g, unknown or other
  modified_base (21855)..(21917): a, c, t, g, unknown or other
  modified_base (22091)..(22100): a, c, t, g, unknown or other
  modified_base (22181)..(22190): a, c, t, g, unknown or other
  modified_base (22271)..(22280): a, c, t, g, unknown or other
  modified_base (23212)..(23221): a, c, t, g, unknown or other
  modified_base (24013)..(24022): a, c, t, g, unknown or other
cgacgccgacgccagcgtgcgcgccgcgctgctgtgcacgctgcgcgaggcggtgctgcccgccctgggcggcgacgcgctggcgccctttctcccgcgcctgatggccgctcaggccgcggcgctgacgcacctgggcggtgctgtgcgcgccgacgcgctgcacagcctgcaggccctcgccgaggccgcgccggccgcgctgggccccgcccacctgcccggcatcctgcgccacttctgtgcgctgctctcccgctccgcgcgcggccggacgctgcaggccggatcgctggcctcgctgggcgagaccctgacctgcctggagatgctgctgggcagggtggctgctgcgagtggggatggaacggagccggaagcgcctggccccgcggtcaccactagtccgcgctgccgctgggcgcccagggtcccggacgtggctgccacggcgtggggctccttggcggacaccacgcccattgcgacgactaccgcagcctccggccgtcaaggcccgcatcgcgaggcgcggggcgaggcggtggagctcctctcgcacctcctggccgcctggagcgagtgcggggcggactcgctggccgccgaccccgccgagctccctgcgcgctgcctgggctccatctgccgctgcctgtccctggtgctggacgtctggggcctgggcctggcgtacgagaggccggcggtggacggcggcgccgccaccacgatggcgcggcgcggcccgcgccactcaccacccacgcccgccgatctcnnnnnnnnnnaccaccacgatggcgcggcgcggcgcacgccactcaccacccacgcccgccgatctcatcctgcgccggctggcccccgcgctccccgtgccgcggccgggcgtggccatgggcgcgggcacgctgtcggcgctggtagacctcaacgttgccggcgcggtgctcctcgcccgcttcctggccgcggccttcgcggactcgcggggcgcggggccggcaggccatgaggcctggtcggcgcggctgctggcctggatcgcgggcgtgctggaggcggacgccgcggtgggcccgagtcctaagaaagaaggaagtacaggccccacgctggcgccgggggcctacgccgccgtgctgcggggcgtggcccaggccctgcccctcctcccgccgcccaaccgccggaggttggtgcgcgcggcgctggcgctggccggccgctcgccgccggactcggccgcctttgcggccgtggccgccgtgtgggggcccctgctggccgccccagcccgctccttctatgtgcccctcgaggacggccaccccgtcgtcgacctggacgacgccctggcctggctgcaggtaggggtggagtgggcggcgtgggggaatgtggagtttgcgtgactgtcctaggtgcgtgcatgccagggcagggagcatggcctgtgcgtggttgtgagtatggcactctgcacattgccgtctggcagccctctgactagcctgagcatgagttgatgccgagcaaggggtaatcgcccacagcagccggctctcgtgcctcaagtctgctccgttttccagggccgtagggcaccttcactccctcccatgccatccactgggacactcaccaagggcacccacctccccctgcacacaccgcagtcactgccccgcgcgctgtggacgctgggctnnnnnnnnnnggcgcgagttgatgccgagcgaggggtaaccgctcacggcagccggctctcgtgcctcaagtctgccccgttttccagggccgtagggcaccctcactccctcccacgctatccactgggacacccaccaaatgcacccgccttcccctgcacacaccgcagacactgccccgcgcgctgtggacgctgggctccgcacaccagcagcgcagcgcgcagctcctgcgccagctgctggactcggcgcggtgcagcctgcccggcggccggctggcaagggccctggcggccctgcagccccagctcctcgtgctctggggcagcgtggcgcccgggaaagcggggcgcgggggcccccgcctgcgcgtcggcccgctggccgcgctgggcgtcgaggcccaggctgttgctgccgacacgctggcgcacctggccgcgcccacgcccctcctgctccgcaccgcagcctgggtggccgtggcggaggcctacccggtggacaccgcggagaggctggtgtccaacgtccagcgcttgctgaccggcgacgggggggggccgggtgaagcgagtgcatcgaattcccgcctgctggtcgatcgcctggtggtccccctgctgacctggcaggcggaggcgggggtgtcgcccagcgccgacgcgcgccggcgcgaggcggtgctgaccgccgcgtgtgcggcgctggtgcaggccccgggcgcggcgcgcctactgtgcaccggcgaggcgctgggccgcatcgtccagctcggcgcgcacggcgcgaccgcggcgcacggcctgctgcgcgcgctgctggccgcgcagcgggcacggccgggcagcctggctgaggaggcctgcgtcgcggcgccggccctcgtgcttgggccgctgctggcgacgagcggcgagggatcggtggacggcgataccagcgatgctggggagagtgagagcgacgatgccatgcgatgggcgatgaccagcgccgtcgagtgcgccgccatcgtccccagcgctctgtccgcactcatacatggctgcggcggtaaaagcaaggggcgcgcaactagagcggggggcgagccggcagcccctcccacccagcttcttcaccgcctgcgcctgctgcacctcctgctcgaggatggcggcctggcggagggcctgcttgccttgagtacagacctccagacctgcctggaggctgttgcagaggaaaccgcggccctgcatgaggccgacccgagcgccggcccggcgagagagtggctggcgcgctgccgggcgcgcgccgatatactccttggtcgctgaatggatttgagaccagtggcaacaatccttactgcacatttgtcccttctccctggtcgacagtaccatgtggcaggcgaaacgtcatgatgggtgcaacacaccccacacagtcagtacgcaaccgactcggcggcgatcaggcggccgccttcctccgcggccccctgctcccgcagaaccttggccaggacgcgggcggcgctgggcactgggccatcgctgcctgctgccagcgcccgcgcgcggcggccggcctccagggcccctgccctcagcgcggcctcccaccggctgccgccaaggtccctgcgctccttcagggcgtcagccaggggggcgccggtgcgcaggactccggcggccagcagcgccgcgatggtgtcggggccggagtccaaggccaggccgtcggagccgcggaaggcgaagcgcgggtcgccggcgccgaaacgcgcggccagcgcggcgaccagcgcctgcgccttgcgctggaagcgggcagagcacacgctgccctccgcgagcccggcccattcgtccctgaaaccgggcacggcacgcgccagctcgcccaccagcgccccggcctgcatgggctcgcctggggagtctcgggcggccgtgtccaccagggtgaggagccacgcgcccaggctcgggtggtcttgggaagtggggaagggaagagggggagtgtgcatttgaacacctcctcctcctcgcattacagaccgccaagggtgcacaactggcatgccttggaggtgtgctctctaaacccccgcttggagacatgcgcgcagtgtaagcaccacactcaatccagctctacacggttcccacctgcacttagcatggctttcccggcagcctgcagcacggtcacgacgttgttcnnnnnnnnnngcattagagaccgccaaggatgcaaaactatatgccttggaggtgtgctttctgaacccgcttggagacatgcgcgcagtgtaagcgccacattcaatccagctctacacagttcccacctgcacttagcatggcttttccagcagcctgcagcacggtcacgacgttgttcacccacacattcagaggcccctggagggagaggggcgggaggtggtttggtttggggcagaaacaggtgggggatctagtcccctgcaggcatggtactgcgcccggggccccacatgaatgcatctttggcagccagtgctgtgacgcaaagccccacctcaaagccatcaccaaacacccactgccccatgcacacaccgctttggagagcatgatannnnnnnnnnggaaacaggtgggggatctagtcccctgcagacatggtactgcgccggggcccccacatgaatgcatccttggcagccagtgctgagacgcaaagcgccgccgcaaagccatcaccaaactcccactgcctcatgcacacaccgctttggagagcatgataccggggcggacctcctcctcgacgcaggcatcaacgttgaagtaggtgaatacctgagacgagcagtggcaggagggggcaggtgtggggacgctgcttgaacatgctgacgcaagccatggatggtgctcctgtcagcaagcaggtccggccaggaatcatgagaaactttccttgtgcaggcatctccgccccccctaaccctccaccggcagtcccttacccaaaccatatacggtactcgcctgctgtcgtgaaaagtgcgnnnnnnnnnntggccaggaatgatgagaaactttcctcgtgcaggcttctccgccccccctaaccctccaccaacagtcccttgcccaaaccatgtgcggtactcgcctgctgtcgtgaaaagtgcgctaggaaccgtgcgtccaggcttcgcccgtccaggtgacacgccatgagaccatactccatgcattctctgctcgtgcgccccgtgctcgccagcaggcctgcatcatggctgctcccttgatccaggaggtggctcacagcaatgtaattgacctggtcgttggtgggggtgcagtggggatggaggcggtgcaggtgaagataccaggtgcacagagtaacacgggaacaatgcagccatttcattataagctgcagtgtatcgcaannnnnnnnnntggtgcagtggagatggaggcggtgcaggtgaagagaccaggtgcacagagtaacacaggaacaacgcagtcatttcattataagctgcagtgtatcgcaatcaaaacattccaccatcctcatagccagcagtttctggcaactcctgggcaccagatacctcttgggtgaggtcatcgnnnnnnnnnntagcagtttctggcagctcccgagcaccagatacctcttgggtgaggtcatcgaacttcagtgggagcctgagggttggcttctgcctcctagcttcctcagcgccttcgtcaacagcagatgagagtgctgcgtcatcgatccacacgtcattgcaggactccaacagctcggtgcatgacctgcaggtggttcacatgggtttccctgtgaggaggaggatgtactccacagcgcaagtgatcaggaccccgcacgggcacatcgagcactcaccgatgaatgtcgtccagtatgtcctccttaggtgacatggagctcgcaatgccgctgttccgatggaccaacaacgcaggccttgagttcagtctccagatgtatatgctgatgtgcactcctcacaataaaccgattgtggtgtgcatacaaaatcttgaatctgagcannnnnnnnnnaatgtatatgctgatgtgcacccctcacaataatccgattaaggtgtgcatacaaaatcttgaatctgagcaatatatgctgatttacccaaagatgaatttgtaaagcgatcacactgccaattcgaggtcgagcagcaaggcgcgacttggtccgtcgcgccttgccatgactcgtccaatgaaaacccctcccatgaagggtcgaaacattcggcactcagccgcaagtcagcgtaaacaaactcctccaacgaacgggattgcattatgggtcgaccgccttcacgatnnnnnnnnnnggccgcaagtcagcgtcaacaaactcctctaacgaacggaatattgcattatgggtcgaccgccttcacgataatctgatgcgcgagattccgtagatgaggtctggtttttctgtcccaaccaaggaccatgcccggcatgccatgccaagcccccgaggatctctggacctcgaatccccgcttatattgtcgagaaacaactctttaacggatgcattacgcaaactgttgaccatccaggcatttgacgaggagacccctggcaatgatgcattccgcatggtgatgagggaccagttctcgcgttcagccgacatgaagggagcaagagtgaaggtggtcgtccttaccatcacgatacttgccataccgtacagcaagatgtgatgtggtgcaaactttattgtaaccgatagtacctcattcccacctgaccagggcacatggctggggctgctggcagcatcatatggtacccagcgactggcgtgcagatggcatctacccgccgactgcattgtggaggtacgttgctacagcacctgacacttggtaactctttagtagattgctgtgtacaggcaaggtttggcatgacaggtgcaggtgccccagtgatccaaggacatcgggtgtttgccggttgtggagtgcctcacaccacgccgttgcagatagtcaatgtagcaccacaccatcgcaccctccaccacagatggacgctctcgagaccttcaccaatctgacggtgttgggtctcatgggcattgtgctggcttggctggttgggctggtgatgacgccaagatttgatttcctgttctcagggtaagcggcatgctggaggtggagcagcgggctgttctcgacaagtagatccccgcaaatgccaatgcctcgaaatagtggtccttggtattgcactgttgctttccatgcctcaccgcccatgcatgctatgccgcagggcgcgctggtatttttcccttctcgtgctctctgtaccactcgtatactccattctgagtgatgttccggccttccagcatgatttcagagacttgccaagctggagctggccctttatcgccctcattgctgctggtgtgttgagttgaatgtgggcatgtgatcccgggtgcggtttggatcagacgctgtgggcttcactcaacaaaccagtgtgcacccacaccgccccttgcccagtgttgctgatggtggtgggcgtgttgggcttccacctgctctgggcctaccagtcccggcatctcacgaagtacctgctcccacgctgcaccattctggggtactgcggcatgggtctcatcacgctcagcggcaaggggcatgccatccacttccaccacctgtatgttggcctggctctggcaatggtgagtgtgtcaagggtctttttgaggggtgagggtgcaggcctgttggggatgatggtatgcagtccaacttgagcagcnnnnnnnnnnattttgagggctgaggatgcaggcctgttggtgatgatggtatgcagtccaacttgagcagcttctcctgccactaccctgctcgtccatattacatgcagtgggcggatgcaaatcacatgctgtccgctgccctgctggcgattggagcgggcatcttctgccaggtgggtgactgaggagggcagggtgcgttgcgccaagatgattgcaagatcagcctgnnnnnnnnnnggccctgctggcgattggagcaggcatcttctgccaggtgggtgtctgaagagggcagggtgcattgcgccaagatgattgcaagatcagcctgtgacacccccaccttcatcacccacgggtcacaggggttgggcgcctactcctttgcccctgccatcctgccgctgggatgcttcgacacaccttccgcagcgcttctgaattgcaccttcaccggcgacaccccatttgcattgcgcttctgtccactcgcagggggagttgccatggaccactcatgccatgcagccttggaataagtgcatgggctttggtgatggaagggccacatctcttctgcaatcagcgtgcacaatttttatcatctccttttcccagttgttttgccccctagccgcattgcnnnnnnnnnntttctgcagtcagcgtgcacagtttcatcatctcttttccccagttgttttgccccctagccgcattgcctgcaggtgttgcttcctgcttggaaaccaccttgaatttcttcctgccagactatgagtaggagatgaccttacagcaccctcagcatacatactcagctcattggggatatacatcgtcacctcctttccagtaggactcgatacacggcaccaccctgcctttgcgtcagcacctccctctcagtcggcatgccctgttgtgcacagcaaggagagcgggcaaagttgaacgggtgcaagctcaagattcatcaggacaacgtcgaatgcaaacacactcgtgcgattcagttggctaaccaaagtctcacatattttcccaggcagaatgtatccacctcttccactggaaggtgcgcgcaccagtgggttttctcggagccagcccagggatgcgcggggcggttcccccagggccacgccttcctccccgccagagcagccttccttnnnnnnnnnnacgcaccagtgggttttcccggagccagcccaggggtgcacggggcggttccccccgggccaagccttcctccccgccagagcagccttccttgtcgttgcccttgagccccatgtccagttgatgcctggatcgcgcatggaacacagcgtctggcgcgtcatggccaggggcaggcgagaaggccgggtgtgcaaggaagtggtcccgcatgtcttcagcgacctggcaaatagggcgggggggnnnnnnnnnnnnnnnnnnnnnnnnnnnnnnnnnnnnnnnnnnnnnnnnnnnnnnnnnnnnnnnnnnnnnnnnnnnnnttgcgccgctctgcagcacatccccgttcccgcgggtgcaggaagggagtcagggcaactgtctactcttcagaaagcgccgctcagggccatgagtctccttgctcattcagagtgttgtcccgatgcatcgtctgtctccatcccaacggtatgtctgctggagcacagggtcggcgcccacacaccgtcctgctacccgacaggggctccggcacagtccactgaaacccatgaagatgctccccgcctttcaatcctccccccctcacctccaggacatcagactggaggaacacccggccgccgcgcggcatgagctccgccacgctgtccaccagcccccgctgcacgatcctgcgcttgcggtgccgcctcttgaactgggggtccgggaactggatggtcaccaggtccagccgcccggggtaggagcggaggacggggcccaggctgagggtggcattggccagcacgaaatgcacgctgcgcgccacgcccagcgccgctgcccagtcctgggccctggccaccacgctgccccggatctcgaatcccaggtggttgcgcaggccgcccaccgcacctgtctgggccaggcccagcaggaatcggccgtaccccgcgcccacgtccacggtcaggggcaggccggggtcggcgtacacggccgcccagtcggggggagggggaggggtggccagctccttcttcagggggttcacgtgctgccggaacttcttccccccgcccacctccttgtacagggcggcgttccggcccagtctggggaaggggctctcctccagcgcctcaggggcgctgggctgggcagccacgcacaccattacacctgtgcgccgggatatgatcgagccgaagcgctggggaccagaggtcgagaggacacgcgtggaggccgaggccagcatgagttcgtgggcgcgacgggtgctgcgtgcattcgtatcgggaaatacacaggggccccccttgcagggattcgaattatatttgctgatgtttagcacaacaattagtgttatatgcgatacctgtgtcacttgggtcgcaatgtgggtcattgcatggcgacatgtatctgtatcgcgccctagctggttagccatgcccggcatggacgtcaggtcacacccgggcaaacctgatcccttctcagatacaggacctcaatcctgcactgcctgagctcagacatgatatttatgttctcactgaaagatgtttcatggtacaagaagggtcctgcagcatctgagaggcaagcaaggggagaaggggccggcgccgtcgggcagcctcgctggnnnnnnnnnngtatgttctcactgaaagatttttcatggtacaagaagggtcctgcagcgtctgagaggcaagcaaggggagagggggccggcgccgtcgggcagcctcgctggcttctcaggtgctggtaaggttggggctgagccggtgcagcacgagctcctcctgcggcaccacccggaagggctgggccaggtccagcctgacgccagacagcctgccggccccgaagaccagctccggcagctcatcctcggcattgccttgaaagaatcgaatatgaatgagggggtatactgaggaggcaacgattgatgatcactcccannnnnnnnnnttccggcagctcatcctcggcgttgcctgggaagaattgaacatgaaggagggggtatagtgaggaggcaacgattgatgatcactcccaagctggccctgcatcgatggtctgggtgggagtgcgctaggcccctgcatctcgatcccaggcaatcattgtcacgctgtatgcctcacaaccgaccacgttggctaaccttgtactataaaggccgcatcaatgaccaagcccccaagcctgcccaggaagccatgcagtgccttgcgcgccaggtaggcgtagcagtggatgtccaggtcaatctccatatagcgtgatgtggaaaaaaagtggtgctgggggcgggacaagatgggtttgtcagcgtaactcgacaggagcttcgactcataccctgggcgggatggggggtggatgggtgagggggctgtgtatgggtgccagctgggagtttctgctgtcaaagagtgagcgtcgggtcaccagccttgggtagattgcatgccgctgcttggtgttaccagccgcagagcctggatggagtgtgcctgacatcccctgggacaggtggctctttgggcacaagctctgtcctccagcccgccttcccagcaccatgagcaaacaaacactctctgcaaacggcctgcctgtcaatccaacttgtgcccagctcacgggagaggggggcggcgctggcccactcctctgggttggcgacgtgtgggatcagtttcaggcggtcccgggtggcgcagccgtccgactccacgccgtcgtgcacaaacctctggaacagctccagggcggcgcgattgggcacctggtccggcgtccaattgtccggcagcgcaaagtaaaacaccaggctgaacccggggccatcgtggttcctgccgaatatgggcggctgcagggtgcggggatgcaggtaggaacgcgtgtgagtctgcgtacacggtacgattgccctggccaccatgtgagcctcgcccaagagcgaggccccaagccctacgccgcccaccagacagcaggcaaaaccagggaggtgcctgctctcaccacgtaggacggcagctggaggttgatgatgaggatgaggggcagccgttcctcgggtggcagcgcagagtgtgcagcgctgacgcgcggcggggcgggcaggtctatgtggtgcgctatattgtggatcttctggtcgaaggagaagaggtcggcgcccagcagcctgtagatcgcagggccgctgggctccttgaccctggacttcatgtagtcctgcccacggacctggaaggtctcgccgcccaccgacgcccaccgcacggccaggggggcagagggcagcgtgcccaggttctgacgggaggagaaagggagaaggagatgaatgcgaagcatatggatgcagggaacacgaggggggcccaggctgagcatgccccgatcccgatttctgtgtcttgacctgaaggtatgaggctcattgggtgagaggaaaggcaccgcagtggagactcatccacatgccccccattccaccactcgtctcacctgggagttcagagcgttcccggtcagggacttgatgaggatgggccgggagccggtctgcgggtgaagggggagtgatgttggaggagtgaacacatgcggaaattcctggtggtccagtgtggaggcgcaggcggtctggtaccacagtccgagtggggcaccgcggtatgcagacgcagcacgctgactcagcccggcgtaccacgcggggcgaacgaggcgaggagggtaactcctccaggttgggctgcttctgcttccgtagctcccacatgatgctcagccggtcctggcgcaggggatgggggggatggacgcttgatggacaggttcagcatgccatgacgccacattggcagcggggccactgtgcaaacttttgagggctgtgaatgcaccctctctctctaacattgtgctgcagccccatccaggtttctgcgctggggccgctcagcccctgtggagaggttgcaagcgcttgagtaccccccgtccccgaggttgttgatgtcgcccctcctcaccaggaggccaggggatgacgagtctgagaagggtgactcgtggttgttaccatctggagaccacacctccatgctctcagagcccgaaagcgcctcctcagcatcatgccagtcctggtcctcacctgttggttcatggtagggtggggtacaagaatgatgcgcagggtcacatttgcgggctatggagatactctagagagacatttgcaaggcaatttgacaggcccctcatttggattattggtaagaactgatcaaagagaagaatagcagcatcatgcctgtttgccctgcagttctccctgtaagcacaactcactcctgacagatggtgtacgggccccgctgatccggtgcagcggggctacgccaggatacattcctgtaaggtcatgggaagtgaaattcggaagcggtaggggtggactatcgcggcatggcttaaatactcagtggcgcaccattgagggaggccgctgcagcgttcaggtcccttgtatgccgcctcctccattttcgccgcttgctggcgctcggctgcttcctggggccacagcacaagaaccatcggaatggcatggcaccccaccagggctgcgggccggccgctcagcgcatttcagaggtcgagactatacccgcagctgacccgagctgtacccgacgtaaaccccggggaagataccacccagacagaattcagatggagtttatgctcttgcctaacatgctgtacggggtgcgaggcttacacaagcggaagtgttgggcatcaccgatggtcccgccgagaaatggaataaaacctggagtcggttgcgccccgggaggaggccgatgaccgtcgaagccaaaagtccagcgtgatgcatcagcttctgatattagatttcataaccgggttgaaagtaaagatcgcggatgtagggcgtggttgcaaccacaccacggcgtctagggccccatggcttatattcagcggagactctgcacagcggaggagctggaagccatgtcggtcaatcgcaagcacggcgtatctcccgctctcgagaatcgcatgaagcgctcggccatagacctcatcgcgcatgccgggaaggccctcaatatgtgagttgcggtagggcataggctcggaagagaacgacgccctgccgaggaggtgcacacctaggtcgttctcgcccatcttccattcccgttgtctgctcctcctgcgctgcagggaccatgttgcgatgggcacagcagtggtcatcttccacaggtattacgccacccactcctttctcctgaacgacaagtttgtgagttggaggggggaacggttgggactttatctctgcccctttgccagagttcacaggtgtaccagcagctcctgcaagccggctgagctggtgcatgcctctaccagggtaccgacctcatcacccactccgcaatcccctcgccagctcattgcgatggcatgtctgtacctgggaggcaagctggaggacacccccaagagcgcccgcgatgtcatcacagcatgctgcatgcggcgctatgggccagaggtcgcggggctctctctccgcaaccatgtgagtctttgatgcgtcatgcacaccctggatgctcggccccttgtgaccatcactccacccctgaatccctcnnnnnnnnnngtgtgatgcgttatgcatgccctggatgctcggccccctgtgaccatcactccacccctgaatccctctcgacgctccacaggactttctcacagcagcaagggaacggctcttcctggccgagagggctgtgctgtatgccctgcgcttcgatgtcgccatagagcacccctttggcacgatgctggccgcgctgaggaggccggcgctgacgcgagtgtggcaggagtggggccaggctcaccccggctccgtcagcttccagcagatgtgcatcaacctgctgaacgacaggtactggtgttgggtcagagttgaggcgtgggcaccgggtggggggttgtgagcacaaagaagcacgagtctgggggagctgttgtcagccatgcagatcaaatcccatgagccgcttgcttctctcagtctgccctgccgcccgacgtcaccaacccaccctcctactacccaacacgcagctacaagctgccgctgtgcctaatgttcccagcgtgccatgttgcgctggcgtgcatctggacggtgatgaaggtgctcaggatcccgacccgcctcagcgacgacggcgtcaccccctggtggcaggagcatggaatgcagcatgaggatctcaaaggtgggctgctgggtttgaggggccagaaggggggggggggaggtgtcaggatgtgagcatggacccaggggcagatgtttttgtggtacagctagatactgccaagtctgcgcgcgcattgtcctgggttcctaaaatgcgccactcagctgtgtccagccacacgactggactggaaggcaggcatgtggtagtaagtcgctgcgattcctcctcacccttacacatatgttgcagagatatcctgcatgctgctagagcggctgtaccatgcagactacggcgctggaggcactgtgggaccggcaagtgctgcctgccccactcccactcccccaaagcagcagcgtgccgtaggagtgaagcgcaaggcaggggagaccggcggcgcggaggagtacaacgacctctttgacgagctgctggcgtgacgcacgtgtctctccccgggaagatcttgcggttccgtgaggcttcctcacatgaaaatgtcccgagagaatcctcatgttgatggccagagcctcatgcccaaaacacagaagtacccccttttaccttttaaaccttgttggtatatttgcgggctcaaaaggcactgcaagggccagacctgcattcttcgaggttccccacctctcgcccggcgcgaccacacgcaaagtctcacacagggtgcgtcccagccaccgccgcggagggcaccaacaagaaattcagcgagcacgcttcattatggtgggtacatgagctttaatgcgcgtgactgcgagtgagaaggccaaaccgacgcgttcgtgggccgtacctgcaggtcccttcttccactcgtgaccatcgacccgtgcagggtgcgtgctgcggcgtccccgcgacgtcgggggagtaccgtccccagcagcagtacagtcaggggtatccccctcagaactatgaagctggctacccaccccagggctacccacctcaggggtatggccagcccggctacggccagcccggctatggccagccaggctatggcggtgagcttgacaggcagaaatcaccactgcggactgtcagcagaagccagagcggcaggaggtctgctgcgtcccatgatcgccatggctaccattgttgtgcgcatgctgaggctctccacttccctgtccattgctgctgcagggcaaggaatgtacaatcagcggccccaatcgagcggcatgggcgccggcaccggcctggcgctgggcgcgggtgcaggcttcctgggcggcgccctcatagggagcgcgctcacaccggggtgagcattgggatcgattgttgcctgctgccatcctcccaagggcttgaggagggctgaggggtgccttgtctatatttttgggcatcacagctgcagcggtgattgctcagctggcattttgattcttcaccccttgatgcacaggtatggaggaggatactatgatggtggcaacaccgagataaccaacaataatgttgttggtgagtggaccatggatccttattgtgctacacagggatgtagagtgtattaggatatttgggaggatcctcaaccagatgctggtgggggctacctttccatgacctgtgacctggaatccctttgcgcatgtttgccctctggcagtacacagtgcacccttttcaacaagagttcttacttcctccactgcagtaaacgatggcgggggaggcggtggagactacagcgggggcatgggaggaggaggggactggggaggtggtggcatgggaggcggcggcagcgattggggcggtggcatgggtggcggtggcgactttggcggcggcggcgactttggtggcggcggcggttggtagactgacatgacttcaatctcttgacaaaaggcacaccctttgtggaatctgcctgaatcacctgatattctgtgacgtttgcttttggccgattgtgtttgtgtccggaaaccggccgaccagaggtcacaacacgacgacgcagtcgagggcgccacgcacagcgcaaggacatcgcgcatacatgagaacctcagtagcctttatttgacgcacatgcgatctgatatcgttgtgattttccacatacaagctacttgtcgtctgtgtgtgaggatcagtcctcnnnnnnnnnncgcctttatatgacgcacatgcgatctgatatcgttgtgactttccacatacaagctccttgtcgtctgtgtgtgaggatcagtcctcgctgcgctgcaagcccatgccgttctgaagtgacgaggtggaaggcgagcgcgacgagcgatcccggaaattgttggccgggcgattggaggccagggacctcatacccaactacttgcatcaccttgtacttattagcattgttagttattcacccgcttgcaagtccgtgcaatagccgagcctgtgtctaggccttnnnnnnnnnncccttgtacttattagcattgctaattattcacccgcttgcaagtcagtgcaatagccgagcctgtgtctaggccttccacctcaacgggactgcgaccgagcggggcctcccgcacagggttacctccgtggagcgcccagcacaagagtttatagagcgcactggaacatggtgagcacatgtgagggagtgtgtgtctttgccaaaggatgggggcaggcggtgcatttcgtgggnnnnnnnnnnnnnnnnnnnnnnnnnnnnnnnnnnnnnnnnnnnnnnnnnnnnnnnnnnnnnnnnnnnnnnnctgtcctcctgccaatgcagggtgcgtgctgcggcgtccccgtgacgtcgggggagtattacccccagcagcagtacagtcaggggtatccccctcagaactaccaggccggctacccaccccagggctacccacctcaggggtatggccagcccggctatggccagcctggctatggcggtgagcctgcatggtggtctctccctgccttacgccgtctgcaccggagtgcatgggcggaaggaggctcacagggtcacacggatgccagagctgcctgctcccctcgcaagcgcgacctgtgatcaccgcctcgtctgctccatgccgcaggtccggtggtatacaaccaacagcctccaccctgcggaatgggcgtcggcaccggtctggtactgggcgccggtgccggcttcctgggcggggccctcatagggagcgcactcacaccagggtgagctgcacgaccggcatccctccagctgctggcttgtcagggtcctggaagggctgaagggtgccttgtgtgggctggggaccacagcatcggtggaggattcttcagcaggcattgaattccggagcgcctgtgacgcaggtacgaaggtggataccatgctggtggcaacactgagatcatcaacaataactatggaggcgggttccctgctggcggcaacactgagatagtcaataacaacattgtcggtgagttgataaaaggtgtattgctgcactttatggggtacagccagggatcgcgtgtatactctcaaaggcacgatgtcgggaagccctgtccacggcatatgactcgcgatcgtgcgcctgatcgccctcctgcatgacaacatgctcccatcagacaagaagcccacttcttttccactccagtgaacaatgattacggtggaggtggtggagactggggtggcatgggaggcggtggcaacgactggggcggtggcatgggaggcggcgaagattttggtggcggtggcagctttggcggcggcagcgatttcggcggtggcggcgttgggtagactgacatgacttagagcttttgacaacaggcccaccatgtgcactctgtctgggggtgggcgtgacacgccgccacgtatgttattgactgatgacggtttctgaatgcattatgaaacggcaagggaatgcattacgaaacgggcagggtgtcccgttgggacgagcgcggaatggatctgtgaatttcagcagcagcgcgcgccgagacgagactttacatctcgctgggagaacgtgcacttgatgtgatctcattgtgatcattcattttcaggctccttgtgctctgtgtgtggggatcagtcctcgctccgctgcaggcccatgccgttctgaagtgacagggtgactgcgtagggaggcagcatggcgagcgcgaagggcggggtgcggaggtctgtggagccgaacattaccctcttcagccccgccgagattcgcgtggtgagtgatcgaggtgcctggaccgccagggccttcgaaccgagcgcagcgcacctgtgccagcagcgggctcccccaccccctgcaggccatgatccctgtcggagaggcgccggatgcggagttccagcggtgtgcctccctgatcacccggcacaagcaggttggctacactcctttggccgcggtgatgagcagtgccctggccacgatggggtgcagaccctcacatgggccagatgcttgagattcagggcggccgaatgccaaggcagcggtagtccttgcatcagggatcgtgcctgcatcgctcatcccccccacacacacacgtgccaccaggtnnnnnnnnnncttcaagttcctcggggtgcgaggcgtttgcgcgctggagttcactgtcgggctgggtggctatttgtcgtgctcttctcgggacgccacatgnnnnnnnnnntttcaagttcctcggggtgcgaggcgtgtacgcgctgtagtttactgtcgggctgggtggctgtttgtcgtgctcttctcgggacgccacatgnnnnnnnnnntgatgcttaagatacagggcggccaaatgtcaaggcagcggtagtccttgcatcagagatcgtgcctgcatcgctcattcccccccacacacacacgtgccaccaggtgaagctgtctcacgtgcggacctttcatcacgaagcccacaagacgcccttcaagcacatcccctggaagagcgggaacatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtcggccatggtcaggggctgctgcatgctgggctttgcccgctgcacccctccatgctcctgccgggcctttgtttgacctggcagccaccgcagtgtttctccttgcaatcacccgccaccccttgtcgccatgcatcccccaaaccatgctccttctctccacaatccctttccccacacatggcaccatgccccttcctcatcctccccgccccaaaaacatcgatcacacgaacccggcaggaggaggccgccctggcccccagccctctgtccacgctgcatgcccaccgggcggtgctgggcgtgattggcatcctgcactgcgggcacacacgtgacctggccaaggcctgccgcgctttccagcagcgctgccatgcgttcaagggcgccttcaccgtgcggctcttcggcttcgaccccaccgacgcccaggtgggcggcggcctgctggccctcccgggcctcgacaccttccccccgggtgccaccccagagcacctgcagcaccacgccgaggtggtcatgcacgactacgcggcctgcatgctgggcgagctggagcgctggatgctcagcgcatcgcccgccatgctggacctgggctcgctggtggacgcgccggagttcacgggggccgggcccctggaggcggtgcagacgcggctctacagtgacgaggtctgtcgttgtcgagaatcatgaagggggaggggggttgaggtgggggggggcggcacggaggggtggtgcaaggtggcagtatgtggtggtcgaggggggggctggcgcatgaccccaacggctgcaggcagcatcctcggcacaacccctttcttcctcatgcatgcaggaggtgaagacaaagaaacggtatggccggctgcagaaggctatgggcgaccactgcctgcttgcggggtcaccgcgggacgcgctggaccacttcaacgtcgccgccgatttgtgccgcgtggtgggggactgggtcttccaggcgggggcgttggagggccaggccagcgccaaggtgaggggattggacgggaggaaggggggggaggggaggatgggatgtgtgtgtttctggcctgtgcgggatgctagctccagagggcagattgccgcttcgcggccaatctgcctcgtgctcattgactgatggttccnnnnnnnnnngggggggggagagatgggatgtgtgtgtttctggcctgcgcgggatgctagctccagagggcagactgccgcttcgcggccagtctgcctcgtgctcattgactgatggttcctgggtgcccagatggcgtgatgctggggggggacctcacgccattgataccccatccccccatccctcctttcaccgcaggcgctggaggcggcgatggacgcgggggggtacaccgtgaaccaggcctccgtcttcacagacgacaagcagtggcggcgcggccgcgacggccaggcctccggcaccgcctccgaggctggcactcccgtgtccagccgcgatnnnnnnnnnnnnnnnnnnnnnnnnnnnnnnnnnnnnnnnnnnnnnnnnnnnnnnnnnnnnnnntgcgccccaggccgcagacgacgcgctgtcccaggccggcacgggtgcgtgcgtttctctatgtggggttgtctgtagttggggtaggcaaaggtagggggccttgtctactggcattcgcactggtggatgctgtgtctgacgtggcatgacacaggtctgatgctgcggtgnnnnnnnnnnctggggtctggggaccgacaggccagcggaggggtcgttacctcagggctggaggtcgagcagtcggggtcgaatgggacnnnnnnnnnnttggggtccggggaccgacaggccagcggagaggtcgttacctcagggccggaggtcgagcagtcggggtcgaatgggacnnnnnnnnnnctttctctgtgtgtggttgtctggagttggggtgggcaaaggtagggggccttgtctaccggcattcgcacttgtggatgctgtgtctgatgtggcatgacacaggtctgatgctgcggtgttccttggaaaggggttgagtgggatctgtgaaggaacggccgccagttatctgatgaatgaccccctgttccctacacctatggcccctcctcccttccacccccttgaccaggcaccagcacggccttcggcggtcccaagttctggaaggcgctgcgcagctccggcgtggagggggaggtgcgcgcgcacatggccgaggccaaggcggcgttgcggcgcaagggcgtgctgccgctgcaggcggaagccgatttgaagctggcgcgcttcctggccggccttcacgtgagttggagttgatggtggttgtttgggcggaggggaaatgcttgggaaggggtttgtgagcaggggaaaggggggctttgtagtcgtggagagggcagataggggtgatgtaagcggcctggagagctgtcctgggctgcagcacaaagcatgccggcagctatgcgggcactgggcactcaaaagccccccctcctcctcattgattccccaaccttccatccagggcgaggcggcgcgggccgaggtgtccgacctggtcacaggcgtgctttccttggttgagggcatgcccctgcccgaggaccgtatgctggccttcgtggagggcgcgggggtgagtggagttggttatctgggatgtgaggggacagggatgcgatggtacatagagaggggagtaggtgcttaggctcctattgcgattcccaagatgcccagcgtgactgtccaggtttttaagtttcatctggtgccccgcagagcttgccgtcccttataccctctctatgtcccgnnnnnnnnnncgaatgtccaggttcttaagtttcatctggtgccccgcagagcgtgccgtcccttataccctctctatgtcccgccacccttcccccttcccccctttccccaggcgctgggactggtgggctcgctgcgcaagcgcatgctcctcctctggcaggcggtggagctgagcaagtacctaggcttccccaatctgcgcagcctggaggtcgccaggtgaggggtggggaggggttggctgctggtgtgggtgggaaaggtgtgcgtaggtggggaatgtgtgcgtgggatgggaaggctctgctgagggttgagggaggtttctggtggaatgtagtgtggggagcggtggtcgaacacgtcgcaagatgcgagagcgtcgtcaatgacaggcctcgatgccccccacccaaaccctccctctccatcaaatgctccgccaggaaggcgctggagccgccggatcgacacatggaccctgtgggcctggaggagccctggagcacgccccgctccgccctgcaccgggagagccccagcctgtggccccaggtgcgcgccggctgcctggaggccattctggggctggccatctacgccaagcagcacgccgaggtgtgggaggcggcggccgtgctcctgcgcgaccaccccgccgagctgtcgccgcaccgccagcagagcctgctggagaacatgctggccgccgcggcgcagatggcgcccgccgagcggtgagcacggagaggaagggtggggggggaaatgagcggtgcctgggcgtggaagggcgnnnnnnnnnngcggagaggaagggtgggggaaaaatgagcggtgcctgggcgtggaagggcgactgtgggacgcctgcgcttgagtgtgcctcgaagagggtactgggccgcgatgccgtgggcgtgcctgcccgcgtgtggccccggccgcacagcaaggcgccccattcacccagggtcaaaccctcctcctcctcctcccaatcccgccagggcgcgccccgggcccgggccgccgccgctgctgcgcttcctggccgcgcggcccatggcccctgcgctgcagctggtggcgctgggcgcccccgcccccgccagccccggcac

SEQ ID NO: 41895 - DNA, 61 bp, Chlorella protothecoides
agactgtttttgcccgctgttgagggaggggggagaggaaagtgatgcaccatgcatgggc

SEQ ID NO: 41896 - DNA, 127 bp, Chlorella protothecoides
caaggatcggccaggccccgcagggcgacacgtttttggcagacacagtcgccccatactcctcctgcagcctcgctggacatggcggattggaaagtccaaccttgatatagtttgtggtcgggga

SEQ ID NO: 41897 - DNA, 97 bp, Chlorella protothecoides
ccccccccccccccccccccacacacacactctcccccaaaagcataccttgaggtagttgatgctcagccccacgaacagcgtgcgccagccctgc

SEQ ID NO: 41898 - DNA, 61 bp, Chlorella protothecoides
cactccgcggcgctgaccaacaacggcttcttgttcacctggggcgccaactgccagggcc

SEQ ID NO: 41899 - DNA, 22229 bp, Chlorella protothecoides
  modified_base (415)..(424): a, c, t, g, unknown or other
  modified_base (981)..(990): a, c, t, g, unknown or other
  modified_base (1333)..(1342): a, c, t, g, unknown or other
  modified_base (1569)..(1578): a, c, t, g, unknown or other
  modified_base (1657)..(1666): a, c, t, g, unknown or other
  modified_base (1883)..(1892): a, c, t, g, unknown or other
  modified_base (2183)..(2192): a, c, t, g, unknown or other
  modified_base (2299)..(2308): a, c, t, g, unknown or other
  modified_base (2368)..(2377): a, c, t, g, unknown or other
  modified_base (2842)..(2851): a, c, t, g, unknown or other
  modified_base (3379)..(3388): a, c, t, g, unknown or other
  modified_base (4095)..(4104): a, c, t, g, unknown or other
  modified_base (4296)..(4305): a, c, t, g, unknown or other
  modified_base (4447)..(4456): a, c, t, g, unknown or other
  modified_base (4717)..(4726): a, c, t, g, unknown or other
  modified_base (4785)..(4794): a, c, t, g, unknown or other
  modified_base (5091)..(5100): a, c, t, g, unknown or other
  modified_base (6054)..(6063): a, c, t, g, unknown or other
  modified_base (6383)..(6392): a, c, t, g, unknown or other
  modified_base (6992)..(7001): a, c, t, g, unknown or other
  modified_base (7073)..(7208): a, c, t, g, unknown or other
  modified_base (7911)..(7920): a, c, t, g, unknown or other
  modified_base (8190)..(8199): a, c, t, g, unknown or other
  modified_base (9029)..(9038): a, c, t, g, unknown or other
  modified_base (9465)..(9474): a, c, t, g, unknown or other
  modified_base (9538)..(9707): a, c, t, g, unknown or other
  modified_base (9914)..(9924): a, c, t, g, unknown or other
  modified_base (10525)..(10534): a, c, t, g, unknown or other
  modified_base (10715)..(10724): a, c, t, g, unknown or other
  modified_base (11486)..(11495): a, c, t, g, unknown or other
  modified_base (11797)..(11806): a, c, t, g, unknown or other
  modified_base (13479)..(13488): a, c, t, g, unknown or other
  modified_base (13896)..(14002): a, c, t, g, unknown or other
  modified_base (14376)..(14385): a, c, t, g, unknown or other
  modified_base (14854)..(14863): a, c, t, g, unknown or other
  modified_base (15510)..(15519): a, c, t, g, unknown or other
  modified_base (15786)..(15841): a, c, t, g, unknown or other
  modified_base (15917)..(15926): a, c, t, g, unknown or other
  modified_base (16369)..(16378): a, c, t, g, unknown or other
  modified_base (16602)..(16611): a, c, t, g, unknown or other
  modified_base (16833)..(16842): a, c, t, g, unknown or other
  modified_base (17455)..(17464): a, c, t, g, unknown or other
  modified_base (18336)..(18345): a, c, t, g, unknown or other
  modified_base (18802)..(18811): a, c, t, g, unknown or other
  modified_base (19504)..(19513): a, c, t, g, unknown or other
  modified_base (20452)..(20461): a, c, t, g, unknown or other
  modified_base (20944)..(20953): a, c, t, g, unknown or other
  modified_base (21461)..(21470): a, c, t, g, unknown or other
  modified_base (22007)..(22016): a, c, t, g, unknown or other
ggcgcgcggccgcgcggctgctgccggccgcgctggcgccgcgcgaggccgccttcctgcccaccgccgcgctgcgcctgctggacacgctgcacgccatgctgccggggcacgccctgctggcagccgacttcgactcgctgccagaggtcagcatccgcggcgtcaacgcccccctggtcgccaccaccgtgagtcgggcggctggccccgcccaccccgggggggggggcgcgcaaagatgcccggcctgactgaggtggcgccgccggtctatccagggtcgagcaggcacttcatctctcccccgcccgctcctcccccttcgcctcgccgtggacgcctctcgccttccaagccccgctcactccccaaaaccccccggctcacacaggagaaggggagcacgcgcgannnnnnnnnnccaggcacttcatctctcccccgcccgcttcttcccctttgcctcgccgtggatgcctctcgccttccaagccccgctcaatccccaaaccccccccgctcacacaggagaaggggagcacgcgcgaccacggcacctacctcgtcccgcgcggcaccgcagacatcttcttccccaccgacttccggctgctggcggagctgcatgccgaggcggggtgcggcgccgccagaccccggcccacctgcagcagcgccgtcaagaccgcggagttcatgggcatctgggcggcgccgggggcgacgcgcacgcgctctgggtacgagccgctgctgtccgactacagcaacacctccgtgttcctggggggctgcccggagctgtgcgacccgccgctgggcgagagggtgtaacagtcaggcagcgcggcaggagagggagcgtagatccaggacttcttggtgtggggggctgcccttctgcccatgggagcgagctgggcattcagaggaggggcagggcattcgaaagcagggcatcacttggctgcctgcatnnnnnnnnnncctttgtgtgggggggtgcgcttctgcccagggagcgagctgggcattcagagaagggcagggcatcagaaagcagggcatcacttggctgcctgcatgagggtgatgttgtcgcccttgagcagaatgcggcccaggggcttgcgcgtctgccgcttcacggaaacctcctcgccctcgtccagcacgaggttcatgtattcatcaaagccctgcgcgggggagggacggagggcgtgtgtgaaaaggatgggaaagattcctcttggcagcacccagggcatgggatagaggctgcagggacatgcagctccctcccaggcgtgccgggctgcgggtgtgnnnnnnnnnnagggaggaacggagggcgtgtgggggaaggatgggaaaggttcctctgggtagcacccagggcatgggacagtggctgcagggacaagcagccccctcccaggcgtgccgggctgcgggtgtgccgacgttgcagcgcactcaacagccacgctccacaccgtcgatcctgtgggaaccacccattccatcagaatcaaccatccccactcacgatgatgcggcccnnnnnnnnnngcgctgtatggggcatgacgtagcacccggagacccagcctgagcaatcagaccccgttgtccgacagggctgcagccnnnnnnnnnnaacgttgcagcgctcacaacagccacgctccacaccatcgatcctgcaggaagcacccattccatcagaaacaaccatccccactcacgatgatgcggccctcgatgcgcaggtcgttgtggtcgtacagccatatttgcaccttctgccgactttgcaaaaacctgaaaatcaggttctggaggtgggggcagagggcagccggagtaagacgggnnnnnnnnnngcatgatgtagcacccgtagacccagcctgcgcaagcagaccccgttgtccgacagggctgcagccaccatcaccaacactcacaatgggctgtgtcatgatcctcttgactttcggcgccatgttggcaaaattttcgactgctaaggcccaagagggaagcgaggctcagcctctccgggtgtgcagggctcgagctgcacgagctccgctgcgatgccttccgtggcctgggtagatagtggtcgggcacaggctgttggcagcacctcaacagggtgagtggagctnnnnnnnnnntgagcctgcaaagtgtttctaactctgcagaccttcaaagatggcattattcaaagcaattgcagtgtatccaccaaaaacttaaaaggtttgggagctgaacagcnnnnnnnnnnaaatgtttcaagaggatcaagacatcccttcgcagtggtgacccaagcaccagcatgcannnnnnnnnngactgtttcaagaggatcaagacttcccgtcgcagtggtgacccaagcaccagcatgcagcacactcgggtggcagaacgcccatcacgggaggaaagctggatcccctacaagccacgagcctgcaaagtatttctagctctgcagaccttcatagatggcatttttcaaagcaattgcagtgtatccacccaaaacttaaaaggtttgggagctgaacagcctggtggtgcgcgccattacaagtcaatcatgccatcattccgtgacaactcctcccatgtcggcatcttgtgcgcttgagcgccacttcctgtcttctttccacccttcagccaacgctcccaagactaaggtgcatcattacgaggggagaggggggcgatttacttgtttatgcttccccatgtcagcaggccatggctaccggagtccccaaagttcttgcacaataaaacccggcannnnnnnnnncggtgcatcattacgaggagagaggggggcgatttagttgttcatgcttccccatgtcagcagaccatggctaccggagtcccaaagttcttgcacaataaaacccggcatcatcctcattacaccccgctccccaccttgcgatgtttgaggtagaggtacagcgcggcccgggcgtcatccactggggagtgctccccatcctgaatgctcagtcctagctcctcagcagacagctgcttgagggaccgcgacttgtacctccccccttgtgcctattcggaggtggcagccaaacgcatcattcatgagtgaaaaagggagtgggaccaggccaactctcagcctcttgacaacaatgtcaagcaatgatgatagcctgggtccggaagggctcacctgctggaacatgaagggtgggtatctggccgtgtcccgcgaccctgtcgctggatggctcatctcgagcgcctgtggacgccagaagggggagggaggtggaccttgggaaagaggcagtggcaattnnnnnnnnnngccccccttgtgcctatgagatggcggcggccaaacgcatgatccatgagtgaagaaaggtgtgggaacaggccaactcacagcctcttgacaacaatgtcaagcgataatgatggcctgggtccggaagggctcacctgctggaacatgaagggcgggtatctagctgtgtcccgcaaccctgctggtggatggctcatctcgagcgcctgtgggtagcaaaagagagatggaagtggaccttgggaaagaggcagtggcaattgcccaggagtcagcatagcacaccaaacggttccatacccatcacatatgcctgcactgcttcacgcaccattcaaatccactgctgatgccctcatacaaacaggctctgcagcccccactggcacgctgcaatcctcgcccataggcccggcccggcctcacctccagatcgttgtgcagcgcgtggccgaccaggaccctgcctgtcaccaggtctttgacccaggcctgcacaacctcccggggccaagcctggtccagatctttgggtcggatgcctggcaaggggaaaggtattgcagcagagcgactcagcacgtcaatcatggtagcaggtacttgcagaatgcatcacttgttcctgaccacgtgcatgcctagccatgcccctccacccaccgctgaacttggtgcggtagtcggtgacccgctccttctgnnnnnnnnnntagcacagcacactaaacagttctatacccatcacagatgcctgccctacttcacgcaccgttcaaatacactgctgatgccctcatacgaacaggctctgcagcccccaccggcacgctgcaatcttcgcccataggcccaaccccacctcacctccaggtcgttgtgcagcgcgtggccgaccaggaccnnnnnnnnnnggcaagggagggacacaggcagtctccttccgtccagaagctttgatacacttgcccagcagcggagtggagcggagaaggtaggaaccccgctcgcaccttgccagggaggacctctccccgtcgggcccgacgcccaccnnnnnnnnnngagaggaaaagtattgccatggagcgactcagcacatcgctcagggcagcagatactttcagagtgcatcacttgttcctgaccacatgcatgcctagccacgcccctccacccaccgctgaactgggtgcggtagtcggtgacccgctccttctgttgcacgtggacatccagcaggatgccgccttcagcattcacgatgcacaccctggggtggtgagaggcactctcatctgactgttggggatgagaacgcagcgnnnnnnnnnnctgtatccgtcgcaggcagtctgttcgttctcggcttcttcttggtcgtagccagcacnnnnnnnnnnacacaccctggggtgatttgaggcattcccatctgactgttggggatgagaacgcagcgctcgctgcaagggagggtcacaggcggccctccttccatccagaagctttgaacacttgcccagcagcggagtggagcggaaaaagtacaagcccccctcgcaccttgccagggaagacctctccccgtcgggcccgacgcccaccatctcgcagtccagagccagcacggccgtgacggggttcgtgcgggaagagggggtgacgccccggccgctgtttgtacctgcacccggcgnnnnnnnnnnggccttgagtgcagcccagttgggggctgccacaatggcaccggaggcagaggccttgggggccggcggcaccaccgtcgccggcagcgactgcactacctgttgtgctgggggggctgctgccttcaggccctttctccgccgctttccagggggtgctgtcgcgtgtggggctgctgtctttccagcagtggggacttgcgccccatgagtggtggggcgtggagtgtccgagcttccgcgaggtgctggggcagacccatcgcttgccttctcaggcacaggctgcttgccgaccggggaagggccagcgacatcgagggcgcccacctgcggcgcggcaggagctgctgctgctggtttaaatttattgcctttgacgtgaggcatgctggtgggtgcgatgcctcgcgcaccgggaacgcaccgagaccagtgctcaactagttgccgcccgtgacgcaacaagtcactttgggaggcaggccgctcgtaacgatacttgaagcagttcgaggttgatactttgagttagtatacataaactatattgcgtctgctttgtgcgctcgagttggggccgatgggcaagtggtcatgcgcccaaacgcgccggcgccctggcacctagggatctcccttagtggggtgcatgctgcactaggaacagagttgccctgtagacatactcaaaagtgatgctagatactatccagaatccatggaggccagtataggtcgatcttatgcgtgcatcttggttctgagatgctgcccatggtgatattcgcatgctgaccctatcgcatgtgcaaacaagacccaatccccatcacgccctccgttctcctcattgatcgagcttgacgagtcctccacatgggtgctttgtgaatgcagcacacacctgtgatcgttcaaaattcgatcatcagtggaccccacgtgcctccnnnnnnnnnnttccgttctcctcattgatcgagcttggcgattcctccccatgggtgctttgtgtatgcagcacacagctgtgatcgttcaaagttcgatcatcagtggaccccacgtgcctccccctcccacacacattcagtgtgggttcaatccgagtgtgaatggcacgaggacttttcgcccatgccttaagagtgtggtcgcggggtctagaggagcttgagttcctaggatccaatttacacacgcctattcgcatttttaaagtgtcggcagcatgaggaaagagatgacccccggctcagcacctccggctctgcctggcnnnnnnnnnnctaaaagtgtcggcagcatgagggaagagatgactcccggctcagcacctccggctctgcctggccgtgcgcccaaagcccctggtgacctcctgctgaccctttgtcgcttcttcaacatggtgaccataatatgcagtctggtgtgtgccgccgctttcggcatggccatcgcagtgcgggtgcacgcgccagacaaggtgagagccgggttaactaccctgagccagggcaggtcgccctgaacgtttgccatatatcgacagcttccctccgtcttaagccgacactcaatttcatttacaggacatctactacctctcgggccaagcggtacgcgtgtacggcttgctgacggccatcctggtggtatttgtggagctagaggtggccgccctggctgcctggtggcccctcctggagatctggttaggccgggcgatgctgcagagcttcgtaggagttctcacgtacaggtgtggtggggaggctgaggataggctcgtgttgtcatgcaggtgcatgactggtggtcgaggtgtcttggtgaaggttcagaatatgcaacccatcgagagtcaatccggtcaaggtccaccnnnnnnnnnngtatcgacagcttccctccgtcacaagccgacactcaattccatttacaggacatctactacctctcgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaggctgaggacaggctcgtgttatcatgcaggtgcatcactggtggtcaaggtgtcttggtgaaggtgcagaatatgcaacgcatcgagagtcaatccggtcaaggtccacccaattcgacttgcaagcctctgctagaccctgcctctcaccctccctccccgctttacatgtgcagggaggccctcccccgtggcgacaccgacttccaccgcagcctggcgctgtaccgcggcatcgccagcgtcgccctcctagtatgctcgggggtgtatgccgtgggctggataagctgcctaggtaccatcaaacacagtgagtaatgtttatacataatgttataccttgtttttagcgaggagggggaatttattgcagggtcaggactggggtgcattgtcggaatgctttgcatgcatgccatgatgttggtcctggtctgctttggattcccgggataaatgcatccaggccacagcgtaaaccttcctttgttctaccattccagtccggacacgtcgcgaccagcgactacgcaaggcacaggcagagtacgaggcactggagaagcggagggccgagctgcagcggctcctggtgactgagcccgccatctgaagcttggactttgtgaccatggtggtgatggttccagcatcccattcccgtccccttgaatccctctgtatggcaatgatnnnnnnnnnncgatggttccagcaccccattctcatccccttgaatccctctgtatggcaatgatatgcggtctggcacccaagcgatgcagtgtgacgggtcgcttgctctctttaacatttgtgcaatgcaatgtctctgtacaccaagaagtgatggcaatcaggtacatgtacaaaaatgcgtgtggaatgaaggcccttggtggcaatgtacaagctctgcatgttatattctcccgtaaaagaaagaaactgtcactcgctgggcttggcgtgnnnnnnnnnncaattcgtgtggaatgaaggcccttggtggtgatgtacaagctctgcatgttttattctcccgttaaagaagaaactgtcactcgctgggcttggcgtgtggtctttgggtggatcgcgcctcggcctgtcctaactgggagggcgcgctcaatcggactcctggccatccacattgtactacggcctatggtcgacctgcacataaaaattccatctttaaaaccaaatgtaatatagggaagcgtcgcatgccgcagcagtccccgcgatgaataacctgcagacgctggggctcacccagggccgagcggtggaaggagcctctgttgcgcacgtgtgcagggatgaggacagggacaggcttctcctgtggatgcaagatggcagcttccactggtactgccctagtacctcacaggtggatgcccgggatgagtgtctgtgagggaaggctatcagtgcaccggtcatggaggatgttgagctccatgactgagagcttcgtctcgcggcgtccctcgcagcgccaggagctcggcagggtagacacgccatgcaatggcgtcacggcgttcctctggacgccagaggcggatggagtgctggtgggcacccagggcggggacctcctgctcatcaccttcccaccgggggcgggccccggcgtggaggagattgggtacgtcgagggcggggtgaaaggcgcggcgtggagccccgacggcatgcgcctggtccttgtcagcggcaatggacagctgctcatcatgtcagaggtgcgatcagatgctggctacgtcatgggaaactggggtcgctccatggagnnnnnnnnnncatggacagctgctcatcatgtccgaggtgcggtcagatgctggctatgtcatgggaaactggggtcgctccatggaggattgaggctgaccagcgccatctgtgcgtgcacacaacttgttcaagtatggacaggctttttgtgaccaggtgtaccacctggacccagagtggttcacagccaattgtgtgggcccttttccttgtgtgacaatttcaccaggtgacaaccagcccccctcattcccactcgtcctgcatccatgccctccaaacctccacgccgccaggactggaatcccctgctggaggccgccatcgaccatgggcaacccatcggctctgccagcgtggagtggcgggccgatggggcctgctttgccacggccactgcaagcggcccctccgacacccatgccctctgcannnnnnnnnngaattgtgtggccccttttcctagtgtgacaacttcaccaggtgacaaccagcccccctcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatggggcctgcttcgccacggccactgcgggcggcccctccgacacccatgccctctgcatctgggacggcgtgagtggggaggtgacggcgcggggcgaggcggcaccgggtctcacccagctgctgagctggcagcccaacggccgccacctgtacaccgtgcagcggctgggtgcagtggcagccggcagcgaggcgcccgnnnnnnnnnnncacgtcgcggcttggaagcgcgaggcgcggcgacgcgaggccgccgcggccgccgcggccgccgagcaagggtcggcgcgccccacccaccgcgtggtcctgtgggagcgcaacgggctccagcacggcggcttcgacctggtggcgccgggcggggaaggcgctgtggtcacggggctgggctggagccccggctcggaggtgctggccgtggcatgcagcgaggaagccgggagcggcaccacgagcgccgcgctgcagctctggacgcgcagcaactggcactggtactgcaagggcgagcgcaggttcgaggggtgcggcgcgctgcgcgcgctgtggggcggcgccgccgccagtctgacgctcgacgtcgttgctacctccagcgacgttaccagggtgagtcggcggtgttgtccatgagtcggggagcagggggatgtgtttggtcgtgaagtggtgagcgctggtgtgcaccgcacatgatcgccttcgccctgcgccccaccaggagcccacctcctgcccctcccccttttcctcaattctcaaattcacagctcgaattaagccagctggaggacgtcagccggctggnnnnnnnnnnctgccttcgccctgcgccccaccagggagcccacctcctgcccctcccccttttgctccattctcaaattcacagctcgaactaagccagctggaggacgtcagccggctgggcacggcggcggtgctggacgggcggcggctggcgctgacgccgctgcgccgcgcggtggtgccgccgnnnnnnnnnntcgctcctcctgccctgccccgcgctgtgctgcgcgctgcgcgccgcgccgggggagcccgagacgctggccgcctgcctggccgacggccgcctggccctgagccgggctccatgcgacgacgcctgggagggcgaggcgcggccgccgcagctcctcctcccctgcctgggcgcgggcgaggcggcgcggctgaagcgcgcggtgtggaccggtgtgacccgcctcgtcctggtgctggcgggcgagagggaagctggtcgcgatggccagggagacggcggcgccctgcacgacgcaggcctggacctggagattcgttggggcggcgagcagctcggcggggccggcctgcgggcccgcggcgccttcgagttcccaggccgcgtgctgaccgcgcaaggccccgtcttccagctggcctgcggcggcgtggtcacgctccgccgcgactcggctggcgctggcagtgatgggactggcaatgcctgcggtgacagcagcgcgaccgacggcgtgcgcctggaccccggccccgccttcaagacgccctgccccgtcatggccgtgctgcccgaggccaggcggcatggcaccccgttggcgctgtacggcgtgtcgcggcgcggggagctatggtgtgcgggggcggcccgcccggtggccgagggcgttacctcgctggccctgcgccccggtggctccggggcgtgtgactccccacacccccctgcgccctggctgctcttcaccggccgcgannnnnnnnnngtggtgtgcgggggcggcccgcccggtcgccgagggcgtgacctcgctggccctacgccccggtggttccggggcgtgtgactccccacccccccttgcgccctggctgctcttcaccggccgcgacggccggctgcacacgcggcgggcatcggtgccggggaacacagccgcgcccgaggcatcggcccctgcaccaccagcgctggcggcgcgcgctgtggaggccggggcgcgtctggtggcggccccccccgggtcgcactgcgcagtgctgtgcctgccgcgcggcaacctggagnnnnnnnnnngctggtggcggccccccccgggtcgcaccgcgtggtgctgtgcctgccgcgcggcaacctggaggcggtgtgcccacgcgcgctggtgctggcctcgctggcagcctcgctggcggccggcgacgtcgccgctgcctgggccctggccacgcagcagcgcgtcgacctcaacctgctggtcgacgcgcgctggccgcgcgtgctgcatgacgcgccgcgctttcttgccgcgctgggcgaggaccaggccgtggcggacctgctgtccgcgctgcggccaggctcggtgctggcgccaggcggcgtctacgctggcgccgaggggtttgggggggacggcggcgacggggagggtctgaggcagggtcacgacggcggcgcatacgggcttgagggcccaccgccgtcgtctcgagccgacgcccagaccgacgaaaaggtcacgaaagtctgcgcggccttccgggacgccatcctggccggcccgggccgcgccttcctccgctccctgctggtcagccactcgcggtgcggtgacctggagggcgccatgcgcctgctccgtcaggtcaaggacgccgccatggaggtgggtagtggatgatcatgagttgaggtgagcgttgttggtaagtcgggatgacccagcatccttctacgaagattggtgatcaagatgaacgcggctgtgccgtccacacgcctgcaggaggatggagtgacactggaaggccccagccccacaccaggcaaccagctgccccggccgcccagcgcggaggacggcctgcgccacctgctgctgaccagcagcgccgatgagctttacgccacggcgctgggcatgtacgagctggacctggcctacatggtgatcgctcacagccagaaggacccaggggagtacctgcaggagctggggcggtttgctgcggagcgcgacgtggtgctccggcgcgtcgccatcgaccgccacctgcgccggcatgaggccgcgctgcgcggcctgctggaggcggggccggcgcacttcggcgccgcgctgcagctggcggcgcagcatggcctgctgcgcaagatgctgcatctgtgccgaggtgggcaggattgctgttttatgcttgaggggggagggaaggaggggtcgggggtgggtctgacaggggtcactcctctgctgcccgatgcgcagcggcgtcgagactggcccaggcgcccagccgggcaccatcagaaggaacgatggcgcctttgtccatggtcaggcccgaaacccctccaactcccctccttccctcactcgacctcccagacgaccaggagcagcggcgaacggtgctccgcgcctacgcagaggccctggagaccaggggtctgtatgaggacgcgggcctggcgttcgttacggcggggctgatgcgcgaggcgctggcggcctaccgcggcgggctccactggcgccccgccctcactctggccggtgggtgaagggggggaggaacctggtatgggggtttatgggctgctgttggctgagggaccttgggacaggatttgagtcctgtgcacgtgcagagacgaggcggtgctgaaccggcaggcaggcatcaccgatgtctccccgtggagatcttcgcggctctggagccgcatccggccctgcgcaaggctcnnnnnnnnnnaaggcggtgctgaatcggcaggcaggcatcaccgatgtctccccgcggagatcttcgcggcttggagccgcatccggccctgcgcaaggctcattcacagagcgatcgctgcctcaccctgccaaccaccgtgcatcacaacaaccacctccaaggcaagctgggcctacgggttgagggcgtgcgggagctggccatggaactggcggacgagctggtgtcggcatcgcgccccgcggaggccgccgcggtgcggctggagtactgtcgcgacgtggacgcggccgccgcgctgctggcggcggccagggagtggcgcgagggcgcgcgcgtcgccgcctcccacgcccgccccgacctgctggaccgggtgctggcccccgcggccgccgcgcgcgcagcggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgcggcgcgcgtggccaagtacgcggcgcgcctggagcacctggcggcgcggcggcgggacctggcggctgcccttgcggcggccgaggcggagcgggggcaggaggggggggatgattgggacggatccgacgcggggcgcgggcccgggtccgacgccggcgacgacgcggcgtcggaggccagcggtgtgaccgagctgagcgcgtatacggacgccagcctggcgcccagcgcgcagagcacgcgcagcgggcacagcagcgcgtccacactgggcggcaagcgcaggcagagcgccaagtcgaggcgcaaggcgtccagcctgcgcgtgcgccagggcagccccgaggaggaggaccagctggccnnnnnnnnnnacgcaggcagagcgccaaatcgaagcgcaaggcgtccagcctgcgcgtgcgccaaggcagccccgaggaggaggaccagctggccaaccacctgctgtcgcaggcgcccagcgccgccttctgcgccgaggtgaggggggggtggggatttgagtggaagggttttttcctgggagtatgcgggctcttgagaaattgcggggttggtgggcgatgccctgccaagagaaagaccggggcctcctggtggcctgttgtgcggctgttgctgggggagtgagtgcccttgcgggggattccgaggctgagcggctgtaggacctcctgcagtggccatagaccttgctgctccggagcagatcgctccctgactcgttcatgctttcccattgttgcactcgctacacccccctgcattcacgcctggccagctcgtcttctgactccctctgatcattgcagatgggcnnnnnnnnnnagcagtggccatagaccttgctggtccggagcagattgctcccagactcgttcatgctttgccattgttgcgctcgccacacccacctgcattcacgcctggccagctcatcgtctgactccctctgatcattgcagatgggccagctcgccgagttcctggtgctgctgggtcatgagtccgatgcccggcggctgcagcaggcggtgggagagctggtggcggcctgcgccgccaccggcgccgccatccttgcctcgcccccgccgggcatgctggccgaaggcgggcaggggcccagcccacagctggcgctgcgcgtggcagccgccgaggccgaggccaagagcgtgacgtggaagtgggacgtccttcgagccgtctgatgcactgcacttgactggtcccagaagacacacagtgatttcaaattcaggatagagaaagggaggtttggcaggaaacatgtactgcagcgcccagtgggctcgtttaggtgatgggcgctgggcccgacgatgctgtattgaaaattagcgcgtcctatacgcgtggctgtgcagcagctctcagttctggccagggagccctgaagcagctgggtcccaacagtcagcctgtcagggggatggtggccaccagctccnnnnnnnnnnatttaggtgatgggcgctgggccctacgatgctttattggacataagcgcgtcgcatacgcgtggctgtgcagcaggtctcagttctggccagggagccctgcagcagctaggtcccaacagtcatcctgtcagggggatggtggccaccagctcccagttcttcaggctcttgtcctctgtgggcgtgcgccacagcgacatgctgtctgccaggaacccggtgcccacgccggggtcacccttttgtaggaaaatgctgtccagnnnnnnnnnnnnnnnnnnnnnnnnnnnnnnnnnnnnnnnnnnnnnnnnnnnnnnnncgacattcccatcaaaaagcatcgagtcagcactctggtggtgaggagcctggagggtactgatagggctggcccnnnnnnnnnntgacattcccatcaaaaagcattgagtcagcactctggtggtaacgagcctggagggtactgatagggctggcccacaaaacaccagacccacaccgggtgcccaccgctgttcttgggtgatgtctgcatacaggagggacaggtgtggcatgtagacctcgtttgggtcctttccgtagctggaccgggcttcttgtgccgcttgcatgactgccggcgtctcctggcatttaatgaacacacactggaagaaagaagtgccggccttaactttatcaaacttgatcacgtagggctgcaaggtggtggtgggtcatctgggatgttggtatctcctgcgtgatagattgctggcaacaagtggcgctcggccactattacacatcaccacctgaaattgaaggatgttttgccgcgccaggcccagaactatcaacatcnnnnnnnnnngaacgcctgaaatcgcaggatgttgtgccgcgccaggcccagaactatcaacatctctatgccatggcagtccttccagcctcccaccttgagctgggcccctagcctgtcggctcgctccaggacatcatcctcggtgccctcgatgccccctagcagggtaacatggggagcaaagctgggagcccccgcaatccggttggcctgggcattgatctctctcnnnnnnnnnngcctcggtgccctcgatgccccccagcagggtgacatggggagcaaagctgggagccccagcgatccggttggcctgggcattgatctctctctggagacgctcattgtatggatgctctgcgtcgcgaaatgggccgtgacagggagtgacttgaggctggagtggtcagggtggtcgtgactgtcggctggtggcagacagggacccacctggagccccnnnnnnnnnnggggagtgacttgaggctggagtggtcagagtgctcgtgactgtcggcaggtggcagacagggacccacctggagccccgtcatggggcatgagccacagggagaaggactccactgcactgggagtcattccagggcgacgcctgaactggctggtggctcctagacgcccacgcattggagtatgggtactggctcgcaaagtgacgagcccgggcaacagcttgacaccctctatggtgttgaacaggggtgtcagatgggccgatgaatcagaaactctgagtttgagggcacagtgttatcttgttgcctgcgtttgccgctctccttcagcagttggtaaacccttccagaccggagcgtctcggagtgatcgagatgtctggtccccgctcatgcactcgtctgtcgtgtcgtgtttatcgatccctttcaagcatcatgcacattcgtattatttctgtttctgtgggaattcacgacagcgcatcccaggagctcgccagcgacagcactttacacttcccatcccatgctagaagtgctctcacccggcccactcgggccaccatgcactccacgattacacgccggatgcatggcagggcgnnnnnnnnnncctgacgaggtccccgctcactgtcgtgttatcgtgtttatcgatccctttcaagcgtcatgcacattctcggcttggctgctcattttgtctgtgggaatttacgacagtgcatcccaggagctcgccagcgacagcagcagtttcccatcccatgctagaagtgctctcacccggccccctggggccaccatgctctctacgattacacgccggatgcatggcagggcggagtctacatcacatgctacgaacatgtgagtgctaggtggtgcattggttcgacgaggcccgcgctgggagcatctgtggtggcatgagcgtatggtgcagaatgcactccatgcgacgagtcccctcccatctcatccccaaattcgcagccacgaggcctgcatcgtggcgtgtgcaggcccatgaccacatgaacatgccgggcctggacgtcggacccctgttcgagacggtgcaggccctggacagcgccctgaccgcccagctggctcatcccgggcaggccaccttcctattagtgggtgccgccgggctgctgaccagcgtgtcgccctgcaccctctctgtgctccccctcaccattgggtacatcggcggctacggcgatcaggccggcggcacgtccctgctggccaggtcggccgcctttgcgactggcctcgcggcctccctggccctcctgggcctcgtcagcggcctcgtgggtgtagcatacggacaggtcagcccagggtggtgctgggtggagtgagggcgtgacggtcccacccagattttgggatggccatgcatccgcccggcgacatgaggatttctgtgaacccctgcgcacccaaacccaatccctgtccccaggnnnnnnnnnngggtcccgcccagagtatgggatggccatgcatccgcccggcgacgtgaggatttctgtgacccccggcgcacccaaacccaatccctgtccccaggcggcgggctcggtggcacccatcctcgtcagcatcgtggcgatggccatgggtctcaacctgctcggcgtgctgagcttccgcttccccaccctggactgggatgtgcgggacctgggcctcccacccctcgtgcaggccttcctggcaggtgcgtggacggctgggtgttgaaggctggaggggtgcagagaacctcggaccccttgctgtggtccctctcctcctcagctgttgcagcccacgtcttcacctcccccctcctcctctgctgcacgcgtgcgaacctggcatcaaaccccccacgcccctgcaggggccacctttgcgctggccgcctcgccctgctccacccccatcnnnnnnnnnntgaggggtgcagagaatctcgggccccttgctgcggtccctctactcctcagctgttgcagcccacgtcttcacctcccccctcttcctctgctgcacacgtgcgaacctggcatcgaacccccaacgcccctgcaggggccacctttgccctggccgcctcgccctgctccacccccatcctggccagcctcctggcatacgtgagcaccacaaagcaggcgggcatgggcgcggcactcctcttcacctacaccctgggctacgttgcgccgctgctggctgccgcggtgctgactggcggcgccaccaaggtcctctccgtgcgccggtactccgcctggatccccaccgcctcgggcctgctgctggtgacggggggcggctacaccctgctctcccgcctctttccgtagatggtgggagggtattcatcattctttgcgcctcgagctatatgagccgagggggtggagagtccatgcttgtgtgccatgtttttcagagctggaggcatgatgttaccgcaaggttgttggtagaggcacgcatgatttgtcgcaccaccagctctcacgagaaagagaccaggcaggcccaccgaaatttcgggattcagccgagtatttcgcgaaatcgcgatgccgaatttcgaggccgaattttcggtgggtcattcacgtggatcctgtcnnnnnnnnnnatatttcgcgaaatcgcgatgccgagtttcgagaccgaaatttcggtgggtcattcacgtggatcctgtcgcctggttctggtatagcaggatcaactcacgacagacagaccctccagcgcatgggtcattccactgggcatcaacatcgcgtcgctccgcattgcccatggcagccgcggcggctttgctagccatgcagcgagcagcccggtgcccccagctcacagcccgggccccccagctcaccgacctgcgacgcgccctgacccccggcctcggtcgctgctggagcagcgaagcgacggatgggcccgagggcctgcccctggcccaggtggccaaggcgtgcctggccggcaacccccgggcccagctcacgaccgtgcggggggaggccctcaacgccgggacggagcccaaggttggctcgtgcctggtgcacgccctggccccccggggcctgccccccctcgtcctcctgcaccccgccctgcacgccgaggcgctccgtgacctggacctcaaccccaccaaccccgccagcctgtgctacggcgccaccgacccgccgggcctgctgcagcacgtcagggcggccgggtggctgccgccccgcctcgtgctgctgggaggcctggcgcctgtggcaccctccgaggtgcggggcgggctggcccgatgcaggcgctctgcctggagggctccaaatccacagattgcaggggccgaaagcctcgaagctggcttgttcgtgagagcccctgggcatcgccagcaccacatggggctcgcgggccgcctgccccgatggcctcgtgcctgaccttgtgctcaccggacctcctcaatcccccttcccgccatctccgcaggtggcggctcaggtgtccgaagcccggcgcgcgtggcggggcacgtccctgctggacctcctgnnnnnnnnnncttcacggcccgcctgccccgatggcctcgtgccagaccttgtactcaccggaccttcctcaatcccccttcccgccatctccgcaggtagcggcccaggtgtccgacgcccggcgcgcatggcggggcacgtccctgctggacctcctgcccccggagtccgagctggagcacctcagggggttcagcctgccggagccctcccgctgccagctcgtggatgctgccgggaagcagcatgagcttgccccagaggccgtggatgccgcgctcctggatcccataggtgggtgaagggatctctggggagggtccttgccagcctgcaccctcgcgtgcttgacctcaacacccccagcaattctggtggtgtccaccggcaatcagcgcccaggcagcgtcggaccattccacgttcatgctccctccatcccctgcattcacaaccatcctgcagcctacagccagatggacctgcttcgnnnnnnnnnncgagcttgccccagaggccgtggatgccgcactcctggaccccataggtgggtgaagggttctctggggagggtcttgccagcctgcacccttgcgtgcttgacctcaacaccccaagcaattctggtggtgtccacaggcaatcagcgcccaggcagcgtcggactattccacgatcatgctccctccatcccctgcattaacaaccatcatgcagcctacagccagatggacctgcttcgcatgctgagcgaggaggaggggtggcaggccgccctgcgcctcttctgcgccgggtacctcggcgtggaggccggccccggcgcactggcggtggccgccgaccgcatgggcctcaccgtgctggcgcaggaagttcaggccgccgcctcgggagtggaaccccccccggagcccacgggtgggcgctggcgccagttccgctttgcattccagcgcgagctccgtggccggtccgactttgtgcgcatgctggagtcgatgcggnnnnnnnnnncgcatttcagcgcgagctacgtggccggtctgactttgtgcgcatgctggagtcgatgcgggaggaggtggaggcggcggcagccgacgagtagagaggggggcgtgcccttgtccggcgtgcccctgcccctggaccttgcagcatgtgcctgttgttacagggggaatatcccagagggtggcacctggcctgttaggaaaggggccaggcgccagtcacgatgtgcagatgccccagccccggcacgctcccgggcttggaggaggtggacggcgggggagcatgcatgttgtcatgtggaggggacagtgccactccccagcagagggaaaacggcgtcaaatgtggcgagggtgcgtcacgctgcgaggccaaggggggggccgaggttcctgccggacatgtgggacagccccggcatcatcgcggcggcctccgccagctggcccagggatgcgcggggggccagggagtgccgaggctctgcgggcagtgagagcggcgggggcatgggaggcgggggcatgggcggcnnnnnnnnnnggtgccgaggctctgcgggcagcggggccggggggggcatgggaggcgggggcatgggcggcgcatgcagcgccgcctccaacgcctcggccgccgactccgccgtctcaaagaaggcctggaaagcctcgccgcacaggtcgacgatggcggtccagcagccgcactgggccatgacctgtggggcgggcggggatgcacgtgaggggggag

SEQ ID NO: 41900 - DNA, 10849 bp, Chlorella protothecoides
  modified_base (178)..(187): a, c, t, g, unknown or other
  modified_base (253)..(318): a, c, t, g, unknown or other
  modified_base (612)..(621): a, c, t, g, unknown or other
  modified_base (1268)..(1277): a, c, t, g, unknown or other
  modified_base (2178)..(2187): a, c, t, g, unknown or other
  modified_base (2916)..(2925): a, c, t, g, unknown or other
  modified_base (3878)..(3887): a, c, t, g, unknown or other
  modified_base (5157)..(5218): a, c, t, g, unknown or other
  modified_base (6333)..(6407): a, c, t, g, unknown or other
  modified_base (6969)..(6978): a, c, t, g, unknown or other
  modified_base (9504)..(9513): a, c, t, g, unknown or other
  modified_base (10443)..(10452): a, c, t, g, unknown or other
  modified_base (10693)..(10702): a, c, t, g, unknown or other
gtccacgctgggcgcggccaggagcagggtctccacctcgcgacgcagcgcctcgaagacgcccgcggcgtcccgcacgcgcgcggcgagcgccggcgcgccggagcgcagcgaggtgcaggtgccgcgcagcgcgcacaggtctgtcaggtccgccaggctgcgcagggggccggcnnnnnnnnnngaggcgcaggtgccgcgcagcgcgcgcaggtctgccaggtccgccaggctgcgcagggggccggcnnnnnnnnnnnnnnnnnnnnnnnnnnnnnnnnnnnnnnnnnnnnnnnnnnnnnnnnnnnnnnnnnnggccagcgcctctgcaaagcaggggggagcgacggggtgggggagaattttgagggattcagggtggcagatggcgcagcattgctggggggtggagagacaggggccccagggggcgatgaagagggagggggcggtgaggagggagggatcgcccagcagggtcagtctaggaacatgtcggcaggcgcagcggggaggcccccagcacgacgcgcaccccctgacccgcactctagccacgcaaataaatcccccatcctatccaccttcggcggcggcgtgctgggaggnnnnnnnnnnccccccagcacgacgcgcatcccctgacccgcactctagccgcgcaaatcaatcccccatcccatccaccttcggcggcggcgtgctgggaggcgaagcgcgtggaaaactcctcccaggcggcggcggtcttggggtaatgcagctccacgttggtgcacgccgcgtcgacagacaggccctgggcctccacctcaccgaggtactgggcggcggccgcaaccctgcagcagcagatgcagggagcgcatgtggtgagggtgcaggtgagcacgtgtagcatgccacgcagggcgaaacacgcaggagaagtggggattagtcgcaagcaagttgatggcctaaagtggcgcccgcccaggagcaggcaccccgcctcaaacaccaccgccagagcagcttgcctctgctgactggcctgccagatggcagtggcagcctccagctgactctccagtatcggaatgaagtcggtgcccggctcccactgcccgacgccagcccccggcgccgaccagctttgaggagccggatctgcgtcggtcatagaggggcagtggggcttcagccacacgcctgcagccacgtctccaccactcagtcaatccccaataagcaccagaatgtccctcgacgactcaaggctnnnnnnnnnnagggcagtggggctttagccacatgcctgcagccacgtcgccaccactcagtcaatccccaatgaacaccagaatgtccctcgacgactcaaggctcaacccctgcagcactcacattgcacatgggtctcgggcaccggatccagcggcggcgcgggggttccaggtcgcatcagccggcgactgtacaggaagactggctgagcgcttgccgggtcctgagaaggaattggggtggagccacctcgaggactagaattgcagagaggcattgcaccctctccccacattcccccctgttccagccaaacggcaaaggccctcacctctggcaggttgtactgcgccagggtcttggcaccgtccaccctgtttccgccatgcatcagtatctggtccgcctgctcgatgccggtgagctgggccagggcggcctgcaccgcgtccgccctgtgggggccagatcgcttcgtgaaggggggccccagacctgtgtgagaccgcatgcagcctcatgtaccgatcttaccttgtatgtggtgtgcattccagttcgatgcacttgccgctgtgcgccaggaccaccgttacggacatgtcaggtctcgaggtttcggtcccgagcacggacctggacgcccgcggaggggtagggcacggagcgggagctttgccgaagctctcagccgatctcgtttcacatgcttttgagctggagcaggcgtccctcgctccccgccctctcggagtcgggagacgctggagacctctgatacctccaagacttgcttggaatgatggcagggactcgccacctccctgctatgatcaggagaggagttaccacagtcaaacgatctgaatagcggaagggattttgtttggagcgcgtacgccctcnnnnnnnnnnactatgatcaggagaggagtcaccacagtcaaacgatctgaatagagggagggattttgtttggagcgcgtacgccctcgtcagagctgtgttttcagggcaagggtacccatccagctgggactgggaggtccaccgggtaccacctgggagcacagatgggaggggaagtcgatccaacttgggcgcgatctcagccccgcaagtcaatgcagatcacaacatatttctggagagcaggttattacattgaatacaaagctgtcctggtcgtcccttccgccccggccccgatcgagccgatcgtctgaaggctggccatggggaaggagatagagatgaaggacgccgagtcgccttcacctctcgtggggaaggatgaggctgccgtggaggaggccagcgttctggaacagctggccgtgacggtgtcggtgatcgaccgggcggtgcgtgccaaggagacccgcaccgtcttcaaccgggtcctgcgccaggtggcgggcgtgcgccgacgcatgcagtccaaggacctgcgggactttgtgacggctcacattccccccggcaacccctccctggagcccctgctggcagccctggatgaggtgggtggaggatgggttggatgcgcacactccacagccgtgcagggccttttggggggagggggggcccatagtaggcgtgtatttgtagagtgcccagaacaggccccgccttgcgctnnnnnnnnnntttggatgcacacactccacagccgtacagggccttttggggggagggggggtcccatagtaggcgtgtatttgtggagtgcccagaacaggccccgccttgcgctgcggcagctcgggcctggagcgcatcagcgatcaccgggcattcccttgcccaaaactcccatcagccacaccgctgcatccctgctcatccacaggccgacaccgcggccatgtctaccctgacccccagcagctcccccccggcacccgccacctcccctccgctgccggaggtggaggccctcgctttcctcctggtcacgctcttgctggtgaatgggcggcagtgggccgcggcgcacgacctggccagctccgcgctggcacgcctggcggccttcaaccgccgcacgctggacgtgctgggcgcacgcctggcctcgttgctgtcgctgtgtgcggcgcgcgccgggcgcggcggcgccgcgctgcgcgccgcgctgctggccgctcaccagaccgcggcgctgcgccgcgatgaggtgggccaggagaccctgctcaactgcctgctggccgggctgctggacgagggcctgtacgagcaggccgacgcgctgcgggcgcgggcgcagcgccccgacactgcgcgcgacgtgcagcagctggcgcgctacctgtaccacctgggccgcatccacgctgtgcgcctggactactccgaggccaaggagtgcctgcagcaggccgtgcgcaaggtggagaggggggtccagggtggatgggtgggtgaagggagctctcgaggggagagtggtcctcaaggggagagtggtcctcggggggcgagtactcctcggggggagagtagtcctcggggggagcggggaggcggcggtgagaaaagagggagccgcgcgggcggcgacgttgagcaacctcgccccggaaatctccaccgcccannnnnnnnnnggtgtgtgtgtgtgaagggaggtggagctctcgaggggagagtggtcctcgacgggagagtggtcctcgacgggagcgggggggcggcggtgagaaaagagggagccgcgcgtgcggcgacgttgatcaacctcgccccggaaatctccaccgcccacccttgtgcaggcgccgctgacagccaccggcttccgcgtggccgccaccaagtggctgaccgttgtgcggctgctgctgggcgagtcgctggaccgcggggagctgacgcgcggggagctggcgcggcacctggcgccctacctggcgctgacccaggccgtgcgctccggagacctcgccgagttcgcggccgcgctgcacgcgcatgagcccgccctccgcgccgaccgcctgctgaccgtggtcgggcgcctgcgccacagcgtgatccgctcgggcctgcgccgcgtggccgcggcctactcccgcatctccctggccgacgtggcggccaagctgggactggcgggggcaggggacgccgaggccgtggtcgccaaggccatcaggtgatttcttgtgggtgggtgggtgggtggggttgttgaggaagagggggagagtgcaagatggggaagggagggggggtgcaggcggggctctcgaggctggcaggcatgtgacgctggcatccgggggcaagtgtggctctgatttcccaccgccctgaggctccgctctctgcatgaatggccctggagcctcatgactgacctccgctccacggacaccgcatccacagggacgggagcattgaagcgcagctggaccacgccgcgggcgagatgcgggcgggcgcgacgcgggacgtgtacggaagcggcgagcccgcggcggccttccacgctcgcatcgccttctgcatggacatccacaatgaggttggttggggaaagggggaagcatgggttctggctctgtggccgggtcattgggaagtgagtcaaagggcaagggggagtgcaagcgcggtgtttgagctccagagaccctctccctgtcctacaggcgctcaaggcgatgcggtatgagtcgctgggcgggctgcagctggaggacgcagacaagctgagggagaggcaggagcaggagctccaggcggcgctcgaggacgacgggatggacttctgatgagctggcatggggggatgttgcttggggcctggacattgtcgcatgatgcacggcacgccatgatcgccagggatgccggcgtgatttctcggcggcnnnnnnnnnnnnnnnnnnnnnnnnnnnnnnnnnnnnnnnnnnnnnnnnnnnnnnnnnnnnnnatcttcaatgacagagacaatcatccttcgtcacaagcgctacgggcttacagtgccaggtacacagcgtgtgaattcacaacagatataatcctttcagacggcgaccggcggggcctccacggcgctctccttggcgtcgcgctgcgccgcgttgaggctgggcgccggcgcctcgcccgccctctccaacgcgtcctcggccacggccagggcggccagcttgccggagagcacggcaccctccatgctggccaggtagcgctgcttggtgtagtcgcccgccaggtagaagttggggatgggcgtgcgctgggaggggcgcgccgcctcgcagccggggaccgtcttgtagacggagagcggggtcttcaccacgtggctcttccgcaccttggccaggctgccatcggccttgatctcaccggggaacaggttctccagctcctgaatgaggacgaggaggggttgtgagggaggaggaggggtgggcaaggctgctgcagggccagggtcagaagacccaatccatgcgcaggcaggcaccccacatcctgtcgtccagacagatgtaccgccgcccaccttcatggtggcgtggatgatgtcctcgtcgctgcgcccgatccattcctcggcgggcgcaaacaccagctcaagcatgctccggttgtcgtcatggtactcctgtggggagtgcagggtcgcagattggtggatgtgggatgtggtgggggtgacagaaccatgcccagtgaaggggcgagcgagaacttggctgctcctggaaattgcgccggccaggtgcacctcccaatgtcccaaatcccagcctcgccttgcatgtcgtggacatgtcggcgtagacagagaggagtggggacctggagaagaggaggtggtctacggtggacagcttcctgtcgaaccagaggtggatgttgatgacggggacgcccaccagcttgtccattttcctgcggcacaggggcgaggatcaaaggccccggttcacaaacggccactcacagtcctcaaggtgcccttggattgcccagcattgatcatttagggctccccccctaaaacacacacacacacacacacacacacannnnnnnnnnnnnnnnnnnnnnnnnnnnnnnnnnnnnnnnnnnnnnnnnnnnnnnnnnnnnnnnnnnnnnnnnnnagcaaatttacctgaagaagggctggtcggcccagggttccggcaccagcttcttcacgatgtccaccggcatggccgacatgtaggcatctgcctgcaggctgctgccgtccgccatcttgaaacccgtgacccggccgtcgggggcggtctcgatgcggcggatgccggcctgcatccgcacctccccgccccgctcgcggatgtagtccacgacaggctggcacaggcgctcggggggggcgccgtccaggaaggccatcttgctgccgtgtcgctcctgggcggaggaaagggacggggtgttgggcaaggacgcatgcacgggtgagggccgcggaacacgctggggtctggggagagtgttcttgcagggcgcccagggtggccctgcgctggccaggcctatgcagcagcccttccaggcaccccggggaggctccacacccatcgcaggggctcgagacgtgcattgccttgggggtccagccatccattgcgggggacgggcatcgcacacacctgcaccattgccccagccctcgcacctggaggaacctgnnnnnnnnnntcagccattcattgcgggggaacaggcctcgcacacaactgcaccagtgccccagccctcgcacctggaggaacctgttgagggcaatgagtacgcacaccatggacaggtcctcggggtcgatgaagttcagcgccttggccatggcgatgaacacctcgtcgttcacccgctcaggcacaccctgcggcagtgggcaaggggatgggaggctcagaggtgacggaggggggggtgcggggcgctgaccctgcactgggctcccagctttcctgctcgtccagcgacccaaggccttggtcggcccggcgcctacagcctgccctcggcacagcacctcaccccacctgcttcagcatccactgcttgacggtgaggtggtcctgcgcctccacgtaatcctgcccgccaaggatagcggggatgaggcccagcgcaaactggatcttctccttccagctcagcatctggttgttcctggagtgggcaggttggggacgcgattcagatccagcttgaagctgtttcaaactctgagggccttccctccaaaaccaaggcacaaggacacagatcatcccatcatgtggtccaaatacatcatgagaatagacgtccaggtcccaacccccagcaccagacctgaggatggcgacgatgccgttcaggggcgcaggcaggtcggggaactcaaacctggaaaactcccccggcgactctcgcacggcaaagatcatcgagtgcgacttccactgcagccggtcctcgatgccgagctccttgaagaggttcatcaggttggggtaggcaccaaagaagatgtgcaggcccgtctcataccaatcaccatccttgtccttccacgcagcgacctatgggtacagaggggtagccggtgagctgttcagtgcaacaatgctgactttcgcctagaatttaggccgggaggctaggtgatgggggtatgacaggtgcagcagggcatctaccatcagtatgtagcatgaagtgtgtgtctgcaattctacctcaaaatacatccctccaccaatccctcagcccaccttgccgccaagcacatccctggcctccaggagtatcggtgtgtggccagcatctaccaggtactttgctgccgacagcccagccaggcctgcacccgcaatggccacccgcagggaccgctggggccggggcagggcagtggctgcagaggacaggctggcagcctccttgaaagacttctcattctcgaaggcaggcttggggaagtctcgacactggatctgtaggttcctcttgctcctaggggtgttgcccgtcacaggtgtgaagggtttaatgtgcgtgcgtcgaagggctccggcatgggatccgagggtggcgcaagacgtgggaggggtggcgcacgaacgagaggtgctggacatgccgcaagccctcctcattgtgcccaggtgtcagaaacagttttacagcagcgaccaacccgctcaatgcacggcctcgggcgactgagattcctgtgcgaggcaggaattggtggtggtcagataagaggacatcgctccacagcacgcacgacacactcgtccaagtttgtatcctcgctgcaggccacatgaagggacaggacgttgcatataaccagcagcacatcccaatacatactgctgcgattcttcggattgggctgcgtgtcaacatgtaggggagccacggtcctcgctcccatggccaagccgctggatctgggcctggaggagcgcctgctaaaagcccgcatccagtatgttgcccagctaaaagaagcgctgctggacagtgactccctgctgcacaacacgctggaggtgtacacctccataatcgacggtgtgtccgggcgtcccggaaccgccgggcgagcgtctgtcgggtttcaggatgcatgagagtcggctggcccgggcgcacatctctccaaccaccgatggctggcccctcccttccaagctcagagatcgcggaggaggtggtgcacgaggtcgcggcgctcgtggcccagggcctggtgagtgttacccccgccccctggttcgggaatgcgcagtcgcatggcaattgtccacaggccggttccatcaacccaacgcccgccaccctgtgccaacaggaggacgtgcggatcccgcgcaacatctgcgtggagaaggaggcggcatccactgtgccgcctggccgagtcagcgtggatgtgtttggggtgcccgcctcctccctccccatcgaccccgtctcatgtcccaactgtgcacgtcgggtggcttcaagccgcttcgccccccacctggacaaatgcatgggccgggggcggattggggcgggcaggtgatctgatgcgaaggggcagaggaggcgccgggtgctcaggttcgcggcccatggtgttctgtgtccattgaacgaacctctggccgtgcctatgctggtgcaaaattatttgcttgattgtactgaacccaaccaatcttgacagctctttgnnnnnnnnnncgaacgaacctctggccgtgccaatgctggtgcaaaattccttgcttgattttgctgaacccaaccaatcttgacagctctttgatggtaatttctcttctttatacacaagtgacacaagctgtcaggtctgcaacaggcaggacccacctgtaccggctgccgtgaggaggcaagtctcagagcctgacagacaccttgtcgagcactgtgcgcagcagggcacttgggtcccacgccttggtcttgctttcctctgcaagttcctccccgcgcttgggcccaccatccagggaggcacccgtttcttgccctgcggggcggacaggcagctggtcaagtagggtagcttggatggtagtcgcagcatctccatcatggcactggcgtccccatgcatcgtggacaatgcctttctccccaaagccggggcattcctgaggacccaccgccccgtggacaccgaagaaacccaccgtcctcgcacagctggccccagacccagcgccagccggggtgctcgccacccggccccggcaaccaaggacagaaggagcggtgcatgtccagcggctccattgccgcgctttccagcgcggcgtaccgctgcagggccgcggaggaaagatactgcaccggcccggcagcggcctgcgcgtcggcggcgccctgtgtcgcctcggcagcggcgcgctttgcacccagcaccccctggcaccgtgccgccctctccgcgctttcctcggcgcaggtggccagcgtcgccagcccgaacgcgggagtggaggggggcccgggcctgccaaacgggccgtcgggggcgggggcctctgggagtccaggcgtcgaccccgcagccccccccgcgatcgtggtccccggtatcgaggccggcgagaccccagtccgggcccggcccatgcccgccgnnnnnnnnnntgtcgacccggcagccccccccgcgatcgtggtccccggtgtcgaggccggcgaggccccagtccgggcccggcccatgcccgccgcgttggagcctggtggcgagcgcgccgcgaaggcggggggcgtggaggggaacgaggaccacatgcccacgctggcgccgcacagcgcgcaggtcagcaccgcgctccccggcgtggccggcggacctgcgccggcggccccgcccccgccgccnnnnnnnnnnccccctctgaacccttccccaccccatcgctccccctgctctgcagaggcgctggcgcgcttcgactccgacgccgcgtacctggagtccacgcccctgcacccggcgctggcccgcgccggccccctgcgcagcctggcggacctg

SEQ ID NO: 41901 - DNA, 10502 bp, Chlorella protothecoides
  modified_base (918)..(927): a, c, t, g, unknown or other
  modified_base (2479)..(2488): a, c, t, g, unknown or other
  modified_base (3645)..(3654): a, c, t, g, unknown or other
  modified_base (3824)..(3833): a, c, t, g, unknown or other
  modified_base (4045)..(4054): a, c, t, g, unknown or other
  modified_base (4302)..(4377): a, c, t, g, unknown or other
  modified_base (4504)..(4513): a, c, t, g, unknown or other
  modified_base (4569)..(4578): a, c, t, g, unknown or other
  modified_base (4855)..(4864): a, c, t, g, unknown or other
  modified_base (5372)..(5381): a, c, t, g, unknown or other
  modified_base (6316)..(6325): a, c, t, g, unknown or other
  modified_base (6439)..(6448): a, c, t, g, unknown or other
  modified_base (7433)..(7442): a, c, t, g, unknown or other
  modified_base (7634)..(7643): a, c, t, g, unknown or other
  modified_base (8524)..(8533): a, c, t, g, unknown or other
  modified_base (8868)..(8877): a, c, t, g, unknown or other
  modified_base (9368)..(9377): a, c, t, g, unknown or other
  modified_base (9458)..(9512): a, c, t, g, unknown or other
  modified_base (9695)..(9704): a, c, t, g, unknown or other
cccaaaatcttccagatggctgcaatgagcttcgccacccctgggttccatgctcctactgcagctacgggacatccaggatgcacagaatcagcgcagcgccgaagaggttgctgcctccaagcctcttgcggaggtgctgagggaggccaaggaggccaaggagtcggcctttcaagaaacatggaagcagatgaagacggtgggtagcgtggctgtatcgaggcctgggagtatggtgtggatgtcatgacctccatgaaaatggtaggaggctactgcacgggtaaatgattctgaaccctgggagggctcacctcacctgtgtctctaggcctttccctgtatatcttctggtccctcaactcacccccacccaccccgcctcctcttgacactggcagggcaaaaaccgccctttggatgaggaggagctggagttcttcgacgccgtcgcggaggcggaagccctgaagcgacggcgggagcaggaggaggaggcggcggagctggactccttccgccggctgcgtcaggagcaggaggagggtctgcgctctgacccccccggcgtgctcatcggccccgccgcgccgccgccagagaccgcgggccgcgccgcgccgcagcagaccggcccccggctgccccagaagaggggcctgggcgcagtcctcaagccaatgccccgacgcgtcgtgcgaaaggaggatgacgcggccgaccctccggccgcctccgacccagagggcgacaccggcctggctgggctcctgggcggctatgccagcagcggcgacgagggtgcgggcgacttggcctgaagcgggacctccaggccgcctcctcacgccgtaggcctcgcccatgacgacgagattccactgatcctggatgctccggtccagagagtcgttnnnnnnnnnncaggcctcgcccatgatggcgagattccactcatcctggatgctccggtccagagagtcgttggcacaccctgctctcctgctggcagtctcacaggaagcacctcacactctgctgggcaggccgaggatgcaggcaaagagggcaagggcaaggtgtatgcatggttcccgcaggccgcaccgccggcctcgatcggcgttgcgcggccggcctcactcagcgccggaccgccggcatcaccggcgagggcggcatgaaggtgaccgagcggccgtacagggccggggcgggcgactcgcgcggcaggcgcggcaggatctggtgggccgccgaggtaccgggggaggccagcggcgcggacggcggcctggggccggggacggggcggggcggccgctcgcgaacctgcagcgtgcatggcaggaatggtcaatcgtgggggtgcacatctgcgagcaggaggctgagagggttgcgaagggtctgggcgcacggtaggtattgttgagcgcgtccacagcaaaggaccctgcgaaagactgccgccctgcaacctgcccatcacacagcaatcccccaagccacaccaactgccctgatgatggtccatcctttgtccttctgtccacacctcagacacccgtctgccctcagcaaagcaccccggccaggccactccccaaaagcgcctcaccgtgactcgctgcacgtgctccaccgtcttgtactcgtacttgacggccaccctccagaagatgatgcagttcagggtcatgatgccccccaggcagagcaggaagaggtccagccgccccttgttcaggttcttgggcagccagccgtagccctcggggtctggtagatgggaggggggtggtagtaggggtggtgggtatgagcagagtaggtgcagggcagggatcacttgcctcgccaggcatgcacgacactgcgcaggccttctcagcagccctcacccaggcgccgggtgatgatgtccgcaaagtagatcagccctccggagaggtaggagccgatgcacacgctgaggagctgcgcgcgggtggcggggtggggagttgggagggctgcggctgggtggatgaaggtcgaggggcgggaccgccacagcaagcctgaccggccgccgcctgacgaggtgcttggaggcatgctgcagaccctcggccccgaaccccacactttcccctttcctcgccgcccacctggagtgccatggagcaggagcgcatgacgtccggggcctggtcgtagaagaactccagctgcccgatggaggtgaatacctgcgtggcgagatgggaaggcttggtgggagaagtttcagggcacgcgtctgaccacaggcaggtgtgttcgtgcgcaccagcctctcagcgaccaccagcgtactcgattccccacctcaccccggggtcccttcctcctcacgtcagggcctcgatgttccaccccattccaaaaggacaccaaacaagagcaccccacaccatcaacaccaccaccacaacaagtctgcccacctcgnnnnnnnnnncacctgcgcggcgagatggggaggcttggtgggagaagtttaagggcacgcatgtcaccgcaggcagatgtgttcgtgggcaccagcctctcagcaaccaccagcgtactcgattccccacctcaccccagggtcccttcctcctcacggcagggcctcaatgttccaccccattccgaaaggacatcaaacaagaggcccccaccaccatcaagaccaccaccacaacaagtctgcccacctcggagagaccgacgaggaggtactgcggcgcctgccaccacacggacaggttcaccaccctgccccagtcattggcacccgccgccggcagcacgtcgtgggcggcgtagaggcgcaggcgccaggcctcgagcgacgcggcggcaaacatggccccggcgcagaccaccatgccccagccgatgcggcggagcagggtcatgggccgccccgcgcggcgcagcagtgggatgaccacgcggtcgtagagcgggatcagcagcacgatgcccagcgtgttgacgatggccagtgaggcggcggggatggtgaaggtcccacccccaggcagaggcatggtacgattcatggacgcgccctgcaccacgaagaaggagcccatctgcgttgttgtgcatggttagggagaaggtgggtgctctgctcgcataagggttgggcgggggtgtttgggcgtgctggccgccgctcgacgctctaccctcagatgcccccccccccttctcgcctgcatgtacaccgtccagtagaggatggtggtgacgaagataggcagcatgcgcagcacgagcttcacctcctccacctggcgccgcgtgaaacgtgcgaccccgcccggcgacacgcgcgtgcgcgtcgccgcgtccagccatgcaaagctctggacggggtgcagcgggggggcaccggcgccgccgggggccttcctgccgccaattgcgccagtgagcagggagtgggccgccccgttgccgagcagcggagaggagaggtcggggccgtcctcctggcgtggggggtggagggactttgcagagggctacaagcatcggatgagacgaactgttccgtctacgatctgaggggcgtcctgcgtggcgcgcagactcgcgccaaaccaccgcccgcctggnnnnnnnnnnttttgaagagggctacaagcatcggatgagacaaactgttccgtgtacgatctgaggggcgtcttgcgtggcgcacagactcgcgccaaaccaccgcccgcctggccctgcgcccgatctccagcgaccccacacccacccttcaggcaccccctctctgcctcctgcannnnnnnnnnaatcattggtgggggtcatgggaagtggcagccgggcggaatccaggcagtgcgtgcgcccagagaacctggcccacgaatgctccacaccctgtactcctacatgcccgacccctcgggcgccccacctcacctctccgtcggcaccacgtgagtgtacattggggaacctgccacaaaaaccaggatggccaggcccatgcaggctgccnnnnnnnnnntactcgtcgggggagacgttcccaccgcgccgcttctcccaccaggcgctcatcaccacgttgtacacgcgggttatgggactgcggacagggtttgatcattggtgggggtcatgggaagtgacagctgggcggaatctgggcagtgcatgcgcccagagaaactgacccacgaaaactccacaccctgtactcctccatgcccgacccctcaggggccccacctcacctctccgtcggcaccacgnnnnnnnnnnnnnnnnnnnnnnnnnnnnnnnnnnnnnnnnnnnnnnnnnnnnnnnnnnnnnnnnnnnnnnnnnnnnggaatggcaaacccgacgccccaattcacgttctcctggacccatacaatgactgaaagggatggggggggcgttggaggtgtaagcgaaatgtgctgggaagagattgagacaccactgacactcnnnnnnnnnnatacatcggggaacctgccacgaacaccaggatggccaggcccatgcaggctgccnnnnnnnnnnaggacgttggaggtgtaggtgaaatgtggtgggaagagattgagacaccactgacactctgcatagggcggcttgctgctgcaaagtacaacttgtacctgtgacggcaatgaaggatccgatgttgacaaagaagtagaaccagttgaagaaggaggtcttttccttgcggtcctgcagcgggtggtcgaaaatgaagagagcttgaggtgggtatgctgtgtttggtggcgatgcacacaagaaaattgaggcagactggcgccgcccctccgtnnnnnnnnnntaaatgaagagagcttgaggtgggtatgcggtgtttggtggcgatgcacaaaagagaattgaggcagactggcgccgcccctccgtgctttccgtgccagaccaggcagggcgtggggcatggtctggccatagggcaccgcaggcttgtccaggccgcccccttcccccgcccatacaggaggcctcccacctacctgcggatctgccatgtcaaactggtctgcgccaaaggcagacacattgggcttgatgccgcctgtccccagtgccacaatgtacagggaggtgaagagggcggcgttctggagccgggtcgggtacaggtccgggggaggggtgagcgccgggaccagggccgtcgtcgccaggagcagcatgccctgcgagtgtgacgagtccggacatgggggttgtagatccttctaatgtttaatagaagtgtggcagtgcacaacggcgtgtaaccagatatgacgagctgttggcattgtgatgaggagggtgcnnnnnnnnnnatcatagaagtgtggcagtgcacagcggcgtgtaaccagatatgatgagctgttggcattgtgatgaggagggtgccaaatgctatgcattttgcagctgcatcctcgctcctccgcagaagtccagtgcaccgctcggccccagggaggtgcaggcaggtgccggtcatgatgcttagatcccatcctggggcgctcctactggacaggatcaccacccagtgtagatcctggcgcaccaggaagtagatgagggagaagaccatgatggtcttgtacctgccccacatggagtccgccagccaggcccccaacagcggcgtcaggtagcaggtgcctgagaagagggacacctgcagagcagcatgcccgctctcttcgcccatcacgcgtgtcaggtacaggatgaggttggtggacagcctgcgggggtccaaggggttggtgggagacggaaatcatggcatgcaaagcagagcaggaatgcatgcatgcactctcagcacatgcccctgcttcgatgtctaggctgtgcggcaggacatcgacccgccctgccctcagtgtcgcacccgtagtaagccaggcgctcacaaaactcattgcccaggataaaagggcaaactgcagggagggggaattgccacatcgattgggtaacaatggaggtgacacggtgtgggcccccatactgcctgcggctgccctacatgccaaagatacctgtcaggagggtggagcggtgcttgcgcggcggttcatcgcctggctggccggcctggctcagtcggctgggcgactgcgaggccatccgctcccggatctaggaatgcacagtgaacgacaagcgccgtgggacgatgtatcgggtgcactcagctgtgcgcgtcggtgtcggggggtatagcgatacgcgggcggagggccggcggtgnnnnnnnnnngactgcagggaggggggattgccacatagattgggtaacaatggaggtgacacgatgtgggccccagactgcctgcggctgcgctacatgccaaagatacctgtcaggagggtnnnnnnnnnnagggtgcactcagctgtgcgcgtcggcgtcggggagtgtagcgatacgcgggcggagggccggcggtggcgcactcctagccagctggaccaccggcacacggccacgggtgtacaatgctctgacagccacgcgaacaagctcacactctatggattggacggttgtgactggaagaatgcgtgccgggaggtgtcgaccgcattcggcagcttccgacaggggttgaactgagggaagcccttggccccaatgctggtctttcctgtctcgcgcgctgactcggccagctttggaggagagggcaacatacacatcccgcccttcccaccccacagggcacattcgagtccattcttattcatgtaatggcatctctcgtgcattgccatggggcagagcgggttgcatggaccccgagcctgcgttcgcttccgagcaggccgtgcaggccatgtcgacctgtcaggatgcgggctggaacggagagccagcaagacgccggtgcgcagggtcgggtggtgtcccaatgcgcattcaattggacatgtatgccctgcatggagtctcacggctcatcgcctcctccatggccagatctggaggagacattagcccgggaaatcaaatccttccagcaaagagcatcctcccagcagaaactggggcaagcaggtccctcccgcttccaagcgagtgaagcctccgaggagtcttcctctggattcttggctactttggagaaggtgtgtgtattggaggtcattgttcccatgcattggggggaatgtttcgcccaatcgcaattgtcattgagagcgctcagagagtgatgcgtgcattagcgtgcccgtcgcaacttccaacgtctccgccgacagggcctggtgttctgcgtcttctttgtcttattcgcactggcatggctgggtgcggggctcgcatccgtggccgtccttcattcctcggtgagcatgcggaggannnnnnnnnnggtgttgccattctccctgccactgccagcatgctactgcagttgaggactggagggaggatgtgtgtacagtgtttcatgcaagtttgcctactatctgtcaacgtttgtgtagaaatggctgtacccatctgaagggataaaaaaactcccacaaccctgccaggccatcttggacctgtggtacattcnnnnnnnnnncgtcttattcgcgctggcatggctgggtgcgggcctcgcatccgtggccatccttcattcctcggtgagcatgcggaggacaatgttgccattctccctaccgctgccagcatgctactgcagttgaggactggagggatgatgcgtgtacagtgtttcttgcaagttttgcctactatctgttaacgtttgtgtagaaatggctgcacccgtctgaagggattaaaaatctcccacaaccccgccaggccatcttggacctgtggtacattctctggcccctagtgttccagccagcactaggtgtgctgatgttgggagcgctgaccgtgggcgccgccaagtgggtcaccagccagggcgccaagaaacagagctgaagccggagagcaggcttttggcccaggtctccaggggcggccaagtgcgtccccacttattgcccgtctcatgtgcaggctgtgtgcgccacccgtccctttttctacatctttgccagactgttacctaaacctgcatgtcctaaggcacggaaacatgctcgccagatcgcggtgtgactcaatggcatgagtgcacccgggatatgatcacctatcagcctcattaacgccttcaattcatgcggccccggcagttcttggccccacagtggcatggcatggcctccccctccggctccaactccatctgcagggtggtggaaagcagggcacgcgggatgcagcaccagatgtaagggttcatgattgcgcaggtcaccacgccctcagggtctcccccaccttcattggggcacacccaggaccatcgcgtgcgaccacatcaatcaagctcgtagtccactctgctctagcccccaagccagcctgactcaccannnnnnnnnntgggatgcagcacctgacgtaagggttcaagattgcgcaggtcaccacgccctcagggtgtctcccaccttcatcggggcacatccaggaccatcgcatgcgaccgcatcaaccaagctcgtagtccactctactctagcccccaagccagcctgactcaccaggtagtcgtagcacagctcactgccacgagggatgtgcgtcttcgccacgatggtgatgtgcttgcggccatccggccccatctgcacctgcaccatgtcatgccatatcgagggagttcgtgagcgtctctgccacgactgcaggcggggatgctgatgccgagctccatnnnnnnnnnntgagggagttcgtgagtgtctctgccatgaccgcaggcggggatgctgatgccgagctccatgcagccaagggcatccatcttggagactccataggtgctcaggcgcgatgcccgcacaacaccgacacttcgcacacgcaggggccgggatcaatccccccttgcccaccttggtgtagcagttggggtcgcagctgtggttgatgtaccgcgcctgccctccctgcgtgggggtagggtaactctgtgacattgccagcgctgcgcgctccatgtcaaaggcctggccctccagtcacaccctggaccactctatgaggcaccctgagccctcccaggacggtatgcagggcgtcccgcccagctctcccacttcccaaggaatgcctcagaacagcatgtccctggaaacgcccaccccttgccttgcctttccccctgctctcctgccctcccaaccccctcccccacccatcgagccactcctcnnnnnnnnnnggggggtagggtgactctgtgatattgccaccgctgcgcgctccatttcgaaggcctggccctccagtcacaccctggacnnnnnnnnnnnnnnnnnnnnnnnnnnnnnnnnnnnnnnnnnnnnnnnnnnnnnnngccggtgccgtcctggtcgtacagcgtctcgcgcaggtctgcaggcccgaggaaagggagactgctgacggtggggcggccatgcacctccatgtgcaggcacatgccctgccacatggccgtcgcctgcccccccatccccctaacgcccggcacacctgccatgcggttgccaatcagctnnnnnnnnnntgcatgtccctggaaacgcccacaccccttgccttgccttcccccctgctctcctgccctcccacccccctcccccacccatcgagccactcctcaccacacgcgtggcatcgaccacctgggtggcatccagcctgaacaggtacatggtcccagtgccgtcctggtcgtacagcgtctctcgcaggtctgcaggcccgaggagagggagactcctgacggcggggcggccatgcacctccatgtgcaggcacatgcccagccacatggccgtcgcctgccctcccatccccccaacgcccgcacacctgccatgcggttgccaatcagctcccccacatactccatgatgaagcgctcgggctctgcgccatgggttggcgagggattgagagtggccaagttgagcaccgctgggcgcacgctgcactgcgccaggtcagcgctgcgccccccgcacatgcaccccggcccgcacggcatgccagtctgcagcgccccggcgcaaaccactctcgcccccccccacacctatcatccccccctatggccctcgccaagccgcacctatgtcctccagggcgtacacgccccagccgtgcagcggggagcgtcgctgctggaccctgggcgccgaggccttgatccccgcccagctcagcacggggaccgcgccgcgcttggccgagggggcgcccggcatctccgccgcccgcagcccgcccagtggctgcgcccgcggccccgcgggcggcagactggcgccctgcgccagcccggctcgctgcgcgtagtgcg

SEQ ID NO: 41902 - DNA, 6885 bp, Chlorella protothecoides
  modified_base (82)..(91): a, c, t, g, unknown or other
  modified_base (373)..(382): a, c, t, g, unknown or other
  modified_base (1519)..(1528): a, c, t, g, unknown or other
  modified_base (1725)..(1734): a, c, t, g, unknown or other
  modified_base (2271)..(2280): a, c, t, g, unknown or other
  modified_base (2774)..(2783): a, c, t, g, unknown or other
  modified_base (2863)..(2872): a, c, t, g, unknown or other
  modified_base (3021)..(3030): a, c, t, g, unknown or other
  modified_base (3545)..(3554): a, c, t, g, unknown or other
  modified_base (4356)..(4365): a, c, t, g, unknown or other
  modified_base (4435)..(4539): a, c, t, g, unknown or other
  modified_base (4656)..(4665): a, c, t, g, unknown or other
  modified_base (5389)..(5398): a, c, t, g, unknown or other
  modified_base (5808)..(5817): a, c, t, g, unknown or other
  modified_base (6281)..(6290): a, c, t, g, unknown or other
cggcgcggcacggaggaaatgtatgtctacagtctctttttagcaataattgcttggcactcccagccccgctgcaaacgcnnnnnnnnnntggccagcgcggccacaatctggagctgaggcgccgccgcggcgcggcacggaggaaatgtatgtctacggtctcttttttgcaataatcgcttggcactcccagccccgctgcaaacgcggcaatagcataggcgaggacggctcgggatcccggttgcacatgcccccccccccccctcgaatagtatacgccgagctccgtcaactcccacgagtcgcatggtgctgggctcccctgttcctttgtcactagtgactgctttcatccggataatagtgnnnnnnnnnnagctccgtccactcccacgagtcgcatggtgctgggcccccctgttcctttgtccctagtgactgctttcatccggataatagtgcacacctgtaactgtatgcctgccacatggtgttacatggcttcttgaaggggatgggagggggaaagtgctctatacgtagcatgacgcggaggccgggaggaagagattgggagagtaccgaagatgggtgggtatggttcaaacagctggggaagatacagtgccgacacagggggggtgctctcagatcatggctacttgctctcaaagacataacgggacatgagtgcgggcctagttccagctggccagccgcgggcgcttggccccgaccagggtcaggcagcgccgctggtgctgctgctggcacttgacagctgcccaggccagctggggggcgggctcatccgcgtacggatgcacgaacccggacggccgctgcttcagaatgggtttgatgggggacgccatggcgaagggggcgtggcggaaggatgcctccagggccaactgctcggcccagtggaccgacccggcgtcgtcgcgggtgctggggctgacgcggttcaagctgcagccggttgccgcgtcctgaacgtgtgagagagcgacaggagttgagggtactccgtgatttgggacgcggaagtgtacagcagcaacgtgtcccgtcctcacctctgggaggctcgacgcggaagacctgtctttcaaaatgagcgcctgtccgcccacgggccaggcccggagacttgagcaaaccgctccagacatcttgagggtggaagacgccagtgtggctggggtgaagagctgacagctctaccgtttaccgtcagggtggtgggtagtctctcgacggtcaagctggcagtctgcgggctgtgtccgggagcgaggctgggcgccgcacaacctgaaaagaagcactcgcctgcggggaatgttcttatgtcatagtatgcttcaggcaacgtgccgcctgacaaataaagggcgagttcctcacacgttccgcttcccgccatttctgtaaaatgtacgacagcgtgccttctcccccatgcacttgcccggagtagggcctgtgctttcatgctgtgcacccnnnnnnnnnnataaaatgtacgaagccttcgacagcgccttctcccccatgcacttgcccggggtagggcctgtgctttcatgctgtgcaccccccgtgcccgacatcgacttctaacatagattatgttgccttggatgccttggattacctaattatccccgcaatggcccgacatgcatgagccctcccagcacgaactgaccnnnnnnnnnnagattacctaaatattcccgcaatggcccgatatgcatgagccctcccagcacgaactgacctgggtctgttgcgatccgttgcctgactcaccgccctgggcgggggggcagcaggcagtaccggtttgccttctcatgcgatcaaccagccatgcatagactcctgtctggactcctggtcctgggcgtgctgggcggggcggtccacgcggagacggactcccccctgctgaacatcaccgccctcatgcccccacatcccacgcacgagaacgactcctacatctgcaccgtcgtgaaagcccccgaggaggctatgcacctcgtcggcttcacgcccgaggcgcaccagtccacggtgcaccacatgctcctgttcggtgagtggagtgctccgagccgggtgcgtcccatgcaggtggcccctgccgaggtccatgccccaggagctccatgtcgcttgccacgaaaagtaaaatacgatcacctggccatccccatccttccccaggctgtagaaccccggccaggaccnnnnnnnnnnggacccctggagctccatgtcggttgccacgaagagtaaaacacgatcgcctggccatccccatccctccccaggctgtagaaccccggccaggaccgacctcccggtctgggactgcaagatgaagaaggtgtgcgccgtggccgacaacgagaacgtgctgtacggctggggcaagaacgcgccggcggtgaccctgcccgagggcaccggcttcgcggtgggccccggctctgccatccgctccttcgtcctgcaggtgcactaccgcctgccccgccccgcacatgacgcctcgggcctgcgcatgcagttcagccggcaggcgaccccgcgcagcgcgggcatgctggcctacgccgcgcgcttcaccatcccgccgcgtcagcaaagtcacctggtgcccaactcctgctgctattccgggttcgagcccatgcgcggcatcgccgcgcgcgtccacacccacaccatgggcaggtgggtggtgttgnnnnnnnnnncggcatgctggcctacgccgcgcgatttaccatcccgccgcgtcagcacagtcacctggtgcccaactcctgctgctatnnnnnnnnnnggcatacccacgtgtttgtgctcgtgtgtggatgggttgcatccttggggtgtgggaggtttgtggggagccgtgttgggcaatatgcaatggcagcgtggtggcacgggccagcagaccccttggcagagtgcaggcgcaccagccgnnnnnnnnnnagcatacccgcttgtttgtgctcgtgtgtggatggcttgtatccttggggtgtgggaggtgtgtggggagccgtgttggggcacatgccatggcagcgtggcggcacgggcctgcgagccccttggcagagtgcaggcgcaccagccggccgcatgtcgtgacgccactctgagcgctcgggcgtcacaccatgactgtgcgcccacacacaagtatcgcaggagtgtcttcttggagcgacgaggccccgagccaggcgcggcgtggagccaggtcttcagccaggacccgcagcagccccagggcttctacccgctcacccagaacttgacaatcctgccgggggactctctgcgtgccacctgcctcttcaactccagccaggcggtgtgtggcatggcgggactgagggagggcagtggtatgcaaggatcttgtggtccatacggtgccccggtccaggcccagccttggctggagagcggcccgactcccgcaccctctgcaaggacannnnnnnnnngtggcgaggcgggactgagggagggcagtggtatgcgagggtcttgtggtccatacgctgccccagtccagccccagcctcggctggagagtggcccgactcccgcaccctctgcaaggacaaggtgccaggccgccaccctcatgttgacaaagagaatcacctccccctcccccctccctcacaacacagtccgcccccgtctccgcggggcacggatccgagaacgagatgtgcaacctctacctgctggtcgacgcgcacgtgcccgccttccagtggtgcgccgacagctccagctacgtcgcggcctctccccccggcgcgctccccgtcggcgcggaggcggtggccgaggaggcacactggcgcccgcccgccgacctgggccagggcgccggcgtggcggccgacgggcgcgggcgcgtgtacgcctttggccgcgtggggcgcgtctgggacgccgacgcctttgaccccgccacgcacctgctgcggaggggcgacgtgcctatccccggagcccccctggccatcctggacgccgactccggcgcagcgtcagcccccggctggggcgccggcgccttcctcatgccgcacggcgccagcctggcgccggacggcacgctgtggctcaccgacgtcggcgcgcaccaggcgctgcacttcacgccggagggcgcgcggctgggcgcgctgggcgagcgcggcgtgccgggcgacggcaccggcgcggcgctgtgccagcccacgcacgtcgccgtttcgcgcgacggcaccgtctacgtcaccgacggcnnnnnnnnnngtgttcagcaagtccggcgcgttcctgcgctcgctggcgctgccggcgccggcgcgcctgcgcgtcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcactcgctggtgctggacgagtgctccggcgccgtgcacgtcgccgaccgcgaggccggcgcggtgcacgcgctggatgcgctgagcggcgccctgcgcggcacgtggagcacgnnnnnnnnnncgcgctggcgctggggccctacggcgccgtgcacgtcctggcctgggaccgcgagggccccggcgccgccacctggctgctggcgctggcagccgctccggggcgcgtcgccgccgcctggcgcctgccgggcctgcgcgcgccgcatgactttgcgctgctcccgctcccgcttgcggtcacgctgccgggggagcgcagcctgggcgtcgtggtcgccgaggccgcggcggagggctcccgcctggtcaagtttgccttccgcgccgcgccggacaacggcacggagcctgtggttcacgacgcccggcccctgcccactgcgctcgaggtggccagccactccggcgccgccgcgggccacgcccagggcaccgacgccgacggcatgatcatcatccccccggccgtcgcccagccgcctgtccggggcgcaaacggcacggcgggcgcggatccttctgagcgacgccgcgacaacccctttctgaagaggtctgagccgcagcgcgacggcatcgtgctgctccccgaccaggccgcagcgggcgtggacaagccggtgatggtgacggcacaggcggcacgtgaccggggtggcttcgaggcggatgccgaagagcagggggcagaggtggcggatgccaaaacccaagccgcaggcgtcgacccagaggccttggcgcacagcaaaactggagcccagagggcggcgtcgtggctnnnnnnnnnncaacccaagccgcaggcgttgacccagtggccttggcgcacagcacaactggagcccagagggcggcgtcgtggctcgccctaccgcccgctccagccctgggcggcggcagcctgctggccttcatcgccggggcctctattgcagtggtgggggtgctgggctggcagtcggggtgctggggcgccgccttccgccggcgatcgtcctccccacgccgctacgtcgccgtataggcctggatttttttgtgcaggcccactgtatattctactctcccgactcctctgtgccctgttccccattttcccaagcttgcccccattgccaccttggtccgtgagtgtattacgcattgcattcagcggtagcagggggcacgccgttccgcagccacccggtgtcgttgnnnnnnnnnntggcgatcgtcctccccacgccgctatgtcgccgtataggcctgaaattttttttgtgcaggcccactgtgtattctactctccccaatcctctgtgccctgttccccattttcccaagcttgcacccattgtcgccttggtccgtgagtgtattgacgcattgcattcagcggtagcaggggggacgccgttccgcagccacccggtgtcgttgcacctggacagcgatgcgggaatggccagaagaagagaaggggtgaagtgtgtgggccggttgccgaaacagtactgtgaagggggagcgggggtcaagggccagacttgattgacgaggacacacaaggggatgcgacgggggggtgacactggggcgaaggaagggacgaaaggacctgacaaaaggggacatggatctgggtacagcctatgcagaggtagcgggaaagggtgctgtaatgggtcnnnnnnnnnnaaaaaggacctgacaaaagaggacatggatctgggtacagcctatgcaaaggtagcgggaaagggtgctgtaatgggtcctgtagagcacgagaggagcagcagacggtgcgcacgaggggctctcagcctgcatgagaaaacactatgcctgcaccgggacggccgcggggccggcacccagcgccaaccctccctcgggagccggcgccgcgccatccagctgcgccaacatgcgccgcgcgtccttgagcgagtgccacgcgttcaggtcctccgcctcgcaggccagagcggcgcgaaggtggccccgtgcctcctcccgccgccccaggtccagcagcacgcgcccgcactccacgcggtggatcaggcggcccgggtgcagcgccgccgcacgcaggtaggcctccagcgcggcctcgcggctgccggccaccagcgccgagccgtaggccatgcgccccagcgcacgcagcgtggggttcacccgcgccatctcgtagtgccagcgccccagcaggtggtgagcgtggtcgttgtcagggtcggcggccagcgccgcgcccgccgccgcctgcgcggcggccgccagg

SEQ ID NO: 41903 - DNA, 74 bp, Chlorella protothecoides
gtgctgtgcagtgtccgtgggcgcacgacctatcctcatgctcaagcctctccagccagggctctccagctcca

SEQ ID NO: 41904 - DNA, 178 bp, Chlorella protothecoides
ggcggcgcaccgacccatcggaccggcggccccttgagtctgtgtgcgtgtccgttctaccttccctccctgcagtgcccagatttaacactgatgtcattcacagagctcgacctggaagcccggcaagacagccgctgctgggctaccctggaatcacacaccctcggccccatca

SEQ ID NO: 41905 - DNA, 400 bp, Chlorella protothecoides
  modified_base (84)..(323): a, c, t, g, unknown or other
gaggctgacaggtctggagctggaactctgtacgtcggggtcgtcacgcccagtgcccccgcgccgccctccgagccctcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtcagtgcctcgtgagcaagctgggcggccagaaggccccccagcgcggcgccggagatgggatcgctggcgct

SEQ ID NO: 41906 - DNA, 80 bp, Chlorella protothecoides
gagatgggagggcgagaaggaggggccagagaattcacacttgcacgccgatgtccggcaaggcagagccgaaggcacaa

SEQ ID NO: 41907 - DNA, 68 bp, Chlorella protothecoides
ccgggccgatggtacgctgatcagctcatgccgcagtacatggcacactcttttgaatctcgaaatac

SEQ ID NO: 41908 - DNA, 123 bp, Chlorella protothecoides
cggcgcgagtgggaatggggaatcttccgacacctaggcgtccagctggccctttctgtacgtgtctgacacgcaccctccacccttgccatgtgcccacaccggcactgacatgcaatgaca

SEQ ID NO: 41909 - DNA, 61 bp, Chlorella protothecoides
cgcggcggcggcgtgggcctgggccgcggctgccgccgcctgcagcagcgccacgtgctgc

SEQ ID NO: 41910 - DNA, 61 bp, Chlorella protothecoides
aaaggcggcctgcaggctgttgcgcagctctaccgccgccagcgagtccaggccgacagac

SEQ ID NO: 41911 - DNA, 21597 bp, Chlorella protothecoides
  modified_base (513)..(522): a, c, t, g, unknown or other
  modified_base (992)..(1001): a, c, t, g, unknown or other
  modified_base (1398)..(1407): a, c, t, g, unknown or other
  modified_base (2736)..(2745): a, c, t, g, unknown or other
  modified_base (3362)..(3371): a, c, t, g, unknown or other
  modified_base (3620)..(3629): a, c, t, g, unknown or other
  modified_base (3987)..(3996): a, c, t, g, unknown or other
  modified_base (4323)..(4332): a, c, t, g, unknown or other
  modified_base (4882)..(4891): a, c, t, g, unknown or other
  modified_base (5247)..(5256): a, c, t, g, unknown or other
  modified_base (5492)..(5501): a, c, t, g, unknown or other
  modified_base (6135)..(6144): a, c, t, g, unknown or other
  modified_base (6547)..(6556): a, c, t, g, unknown or other
  modified_base (7683)..(7692): a, c, t, g, unknown or other
  modified_base (7791)..(7800): a, c, t, g, unknown or other
  modified_base (8547)..(8690): a, c, t, g, unknown or other
  modified_base (8770)..(8779): a, c, t, g, unknown or other
  modified_base (9442)..(9451): a, c, t, g, unknown or other
  modified_base (9889)..(9898): a, c, t, g, unknown or other
  modified_base (10552)..(10561): a, c, t, g, unknown or other
  modified_base (11094)..(11103): a, c, t, g, unknown or other
  modified_base (11949)..(11958): a, c, t, g, unknown or other
  modified_base (13691)..(13700): a, c, t, g, unknown or other
  modified_base (13993)..(14002): a, c, t, g, unknown or other
  modified_base (14620)..(14629): a, c, t, g, unknown or other
  modified_base (15455)..(15464): a, c, t, g, unknown or other
  modified_base (15755)..(15764): a, c, t, g, unknown or other
  modified_base (15991)..(16000): a, c, t, g, unknown or other
  modified_base (16573)..(16582): a, c, t, g, unknown or other
  modified_base (17884)..(17893): a, c, t, g, unknown or other
  modified_base (18324)..(18333): a, c, t, g, unknown or other
  modified_base (18795)..(18804): a, c, t, g, unknown or other
  modified_base (19389)..(19398): a, c, t, g, unknown or other
  modified_base (20883)..(20892): a, c, t, g, unknown or other
  modified_base (20998)..(21007): a, c, t, g, unknown or other
ccccccccccctgcccggctgacagtgtccatgctccgtgggaccctgtgaatctgcttatgggtttgtcgctcccctatttcttcctcggcccccactcagaccagtagtactttgttgctcgcacgggaaacaccccgggtttcccccacgccctagccaccagcacttccaactgcccttgcatgcccgatctgtcttgaagccatgcccagcctcgcaacgcatcccctatcgcccctgtaacactagcgcttttgggctggcaccctgtcacaggaaggggggaaccaaggggaaggagcacgcctgccacccagcgctcggggcatgcaaaggtcaatgtggacgggacccccgctccacgactcccctgagtctgtcctgaaagatggaggctcgtctctgaccgggcagggaggtctttctcttcctcctcggtgccgtcctcagcgccccgctggtccgcgtctctgacgcggctgccgggacctcccgtgcctgtggagctcnnnnnnnnnncctcttcctcctcggtgccgtcctcagagcctcgctggtccacgtctctgacgcgactgccgggacctcccgtgcctgtggagctctgggcggcctcgagtcactctgtggctgaacactggcggtggggtgcaggccggtgtgtgcagggccgcgcggtgacttggcgggcaggcaccccgccttctcggagactggttgggttgcagtgcttggcgtgccaggcctgaattgccctgctgaattgccctcctcatgcctcctccctgcactctcgttgcgcggctgcggggacggcggcggcatcaccacccgccgcatgctcacggcatggacctttacagggaaggggtttgagaggtgccaggtcgcagagggacatgcccagttgggcgcggcgggaccagggccaggcccatgcagacagggtatgcatttgtggacctgagcccagacgctgcctccctgannnnnnnnnncttgggcgcggcgggaccagggccaggcccgcgcagacagggtacgcatttctggacctgagcccagacgctgcctccctgagcatgcacagcaaggctgcagtgaggccccccctcaacaacacaaagccctcacctcaaatggggtacgcccggcccgagtggcatgggccgccaggtacccttccacgaataccaggtcgtttttggccagactcttgccagccgacacagcaagctcatgccacgtcctgactctgaccctgacaagtgggtggcatgatctcagtttgggacttcgtactgctgaggtcgcagcaggactctgtcactatcaaaaagctaaactgtccggtccaggaacactgcagagaaccagctgccagtgggtccttcnnnnnnnnnngtctcagtttgggacttcgtaccactgagatcgcagcaggactctgtcgctatcaaatagctaaactgtccggcccaggaacattgcagagaaccagctgccagtgggtccttcaggagggtctgcctcatcagcacgatcctgcgccatgtctccactccacacccacccaccacaatggctccttgagcttattgtaggacacgctgagcgtcaggctggctgtgtaccgactcctcccaagatgggccagggaggggtcctccaccaggtgtccgatcatgtgcaccatgttttgacgctcgggggagtagagcatttggggcaagggggggtagttctcctccaggtcactggccgcgggagcactgtggctgggaaccccacggtggggggccgctgaggtagcctggctggcccatcctcgtcggtactcggataatccaggaggtgtgaggatgcaattggcgccgtttatgcgtctagaatcagtcctcgagcgaccaaaggcagggtcgagtggcatccggcatgctgcccaatgcatggggtgtcggagaaggacgccctgaaaacagtcgaaggcggggcagtgaggcgggtatcacatgctccgacaaataaataataatactgtggcgaaaaagcataagcatgtgtgctctggagtcggaaccttgtccgtcaggcattggatggaagtccgtgtagcgatgaggttggtcgtgctgagctttcgccgaatcgccaaaacctcttgcctgacatgcaactgagcatttcgtgatgtcatgcaccgagagctttacatgaggttccttgaccagtgcggcagcattgcgtgctggaaacaattgaaggtgcaagacatgagaatggtcaaggcgggcgtctggctactgtccttctctcgccttgtcagcgctctgctgactccctggctccctcacaatctttcggattgttttggcatacacctgcatgatggcacacagtgggttggtccattcagacaatactttcagaaagtgaaaactgtcatcaccacggcctgcgcctgtgccaatgccagcgacccactacccacctgcagccggctgtaaccagcgggagtcgtgtatgtggccaggtacccaacgacttgaatctgatcccttttcctcagctgtagtgctgctgcatccgctaggtcatgccaggccttcacctcaaccctgagttgggggggggatgggggaacattaacagcgagaacactgagcctcccatctggcatcccagatcctgaaaggcctggtgtgcgtcggatccccgggcacctgcatgcannnnnnnnnnaggggggaacataaacagtgagaacactgagcctcctatctggcatcccagctcctgaaaggcctggggtgcgtcggatccccgggcacctgcatgcatcaacccatcacccaccaggtcgtgacgggactggggaatctgacggccagtgccagatgagtcaaccgagcaccacttgccagttctacatagtctgggtcccggccaagattgcccaccagtgtcacgtagttgtggtgcggcttgttatatgggacctcttctatcactgtctcggcgtggtcttcataggggtccgggccagcaccctggtccgcactggcagagagccgggaggcggtgaaggaccttctccagggatggcccgcacccagccctccgacggcttgccgtgcggccctgagggcctgcatcgtggcgtgtcgcagtccccagggaccttgtcggagtcgtcctcctgatgttgacagtcgtgctcgtatgaggaagtgcaacttccgcgcgcgcagggagtgcgaatcgcggctggctctaatgtaaagcagccgaggcgtgcgagctctatatggtgagatcgtagatgtgaaaatgcatggaagtcccggggtgaacaacannnnnnnnnntgagtgcgaatcgcgactggctctaatgtaaagcagctgaggcgtgcgagctctatatggtgagatggtggatgtgcaaatgcatggaagtcccggggtgaacaacaggatggaacagaagagatggcgccacatactcctccgggacatccaccgcgctcagtacatgcatggtcccgggataatacattgtttcgcgcctctggccctcagaccgcgtctgcagtgtgcagctgtccttgagagtcnnnnnnnnnnttggaacgaaagagattgcgccacttactcctccgggacatccaccgcgctcagtacatgcatggtgcagggaaagtacattttcgagtctctggccctcagaccgtgtctgcagtgtgcagctgtccttgagagtccagtttatgcagctcagacttgacccaggctgggctggaagagatccagagtgctggagcattgactgtaggttggggaatgggcgaagtggttcagagggaggtgccgtgctcaccaccgtggcatccttgtacaaactttagcgactgacatctgctgtctagaagtaagagacctgcgatgcccctgttctgcccaccaaacgcatcgttgccacctnnnnnnnnnntccaccaccatggcatccttgaataaacttcagcgattgacatctgctatcgagaagtaagagacctgcgatgccctcttctgcccaccaaacgcatcgttgccacctccctagctccctagacttgccccatcgactcacgtccaccattccgcagtttgaagtccgggtggcggggcttgacgctgccgctctctttcttcccccggtagtccagccagtctaaagggtcgcgaggggagcgtacttggctagggtgacggtgcaagtccccaatgaactcatgaactcgtgacgcaatgcagagtgctgggaccggtgcaacannnnnnnnnnggggtgacggtgcacgtcctcaatgagctcatgaactcgggaggcaatgcagagtgctgggaccggtgcaacagccctcactccccagaaagggcgacaggatgctggaccatagcaggtgggctcgggtcctgcaaacacgccatgccgtgacctgtcatcgcccttaatccgacccacccggagatcccacctgaggggttctcaaagagattcatccacagctgatcctgctcctcgtttgacagccgctgcttcgcagctgggctggcctgctcgcctgccccagacgactgatggggcggagcagactcatggctggaggggaatgcatcgttgccttgcccttgggcatcgtatattactttccgtatggcgcgggccacaacctaggttagaggtttgtaagagtggcgagttcagcactgcacagacatgctccgttgctgacatcatctgactgtctcggtatcttggtgcaccacgcaagatcccaaacctaacgacaaaaacggaaacaggcactctgtatcccaagggggatccttcnnnnnnnnnnacggtatcttggtgcaccacgctggatcccagacccaacgacaaaatcggaaggaggcactctgtatcccaagggggatccttcgacggcatgccaggctctgcagatcgtacctgggctttacgattgccagcagcggtgtctagaatggtgaggtagccctccacctcgaccttggagccttttcgcagcccctgggccgccgcctctgccagctcattccatactacgacgtccaccctattgcacgttgacatggcaaggattgcgcatgcatgaacctcaatgcttcggtgccacaaggcgactaagcgggaaaccacagacctcccgattcaacctcagctacaactctnnnnnnnnnnaaacctcaatgcttcgatgtcacaaggcgactaagcgggaaatcacatacctcccgattcaacctcagctacaactctctgggcatatatacccaagcacagcacaggccctggttcctaccagaaggcaggcttcgtcttgcgagccacagccatggccattgtcgcagtcttactcccgctctccaagtagcggaggtccacatcgccgcccagattcccgatcagagagacannnnnnnnnnacacagccatggccattgtcgcagtcttactgccgctctccaagtagcggaggtccacgtcgccgcccagattcccgatcagagagacagtgttatacttgtctttgttgtaaggcacctcctccaagggggccactctgccctctgactggctggcgaatgctgctcgcctggaactttcaacccctctttgtcgccatgatgaaagcatgtgttgtgtgggggtatgaagatgtgcacgggaggtgtgtagggctgctgcgtgccgcatcccccctgccacccgggcagtgggggccgcgctcgccaggagactcagggcgtaacgcatcatgagaagatttgagactcgcgataccctgataccagatatggggcacaattggtctttcaggctgcgcgtcggagttggaaaccaccggagatttctgttcggactcgtgatttcgagacggttcagtgggaacgagacgatgccatacggggatggggtgacccactcaccctgccattcaagtttcttgtggcaagctcccatgtgcacaccttagcttacagagtcaaggactggtccactagggcgacaccttctgcaacacacttctcgcatgtgcacaagaattcgtactctgcnnnnnnnnnncccatgtgcacacattagcttacagagttgaggactggtccactagtgcaacaccttctgcaacacactcctcgcatgtgcacaagaattcgtactctgccagggcatcctgtcgctcttggagtggggcgtcctcgtcgatgtaggagatcgtgatctcctctcccagggagatgtctctgagagccaccagaacagctgtgggtgtgagattgtttggggcgaggggtgaccttcgcatcacgctctttggtgggaatccaagtttgggggccgggaatcttcgacagccaggcaaccgtgcaggtgtgcagatgcccactgacgtccccgctgactgggtatcaagcctgactgcttggggcacgaccccagcccaaccctgctcccgcacctgcccccnnnnnnnnnnggattgtttggggcgaggggtgatcttcgcatcgcgctctttagtgggaatccaagtttgggggccgggcgtcatcgacagccaggcaaccgtgcaggtgtgtagatgcccactgatgtccccgctgactgggtatcaagcctgacagcttgggacacgacctcagcccaaccctgctcccgcacctgcccccgtggtgtcctggtcccgtttgaatgcgtgtgtgtttggtctgcaggagtggttgcagcagctctgaagcctgtagaaccccgtgccactgacgctcagggcatcgccgtatgcctccacgaacaccgccacctcccgcgcagctgcaccggcaggatcctgctggccctcgcttcgcctggggtcagtgaggtactgctcttggtaccacctgtaccaggcgagcgccgggctgggcacgacgaggtccaggttgttcagctccaccatgccgaccaggcaccccaccacgtcctcgtggaagagggcggggaagcgggggtcccagagggcgcgccggaggaggtccgccgcggtctgacacagctcgtgtcgttctgtcagggggtgaatcggccgagcgtgagcagcaggagaggaaccggcgggttgcagtccgaggaggccaggcggtgcatgctggtgggcgggtctcctgcgcatgccgccccacagcctgttgagtcgagagcggtgcagagcctcgagcgacatgtgggcgacggatgccaccacaaacctccaacccccctgcccaatcctgtccctccccctgaagccctcacgttgcctcagctctgctgcctcgccctcccccaggcccgtcacgggcagctcccaccacagccgcttgtgcccatgggccaggggctcccaggctttgaccagggcagcccactcagcgtccgtccgttcgccctccggctgcagcccgccggcctccagctcggcgtcggcccgggacaggacgccggccagggctcgggccacgaactcgaacacagggttgcactcgcgcgcaaagctgcgcagctgtcgcagcgcggcgcgacgctgccgctgcgcgtctgcttgaggcacccgtctgccgccgctcgcgggggggttggcgcagnnnnnnnnnncacacatccatgcagggctgccgctgagagcgcgacacagggaaacatcccggggggcattggcagcgaggactgcgagctcggcaagtaatccagcannnnnnnnnnggctgcgcgcctgcccgagggacccggctgccgccgctcgcggggggtttggcgcagaggagctgggcgtaccccgcccatgcctcggtctcggccacctcgctggcgaacagcaggctggcatcaccccgaccgaggacctgaagggaggtggaggggcagggcggggtgaatggcagctcagcttctgggccaccgtcgcctacacctccatgcagggctgccgctgagagcgcgactcaggggaacatcccggggggcatcggcagcaaggactgcgagctcggcaagtaatccagcacctcaccggagacggcagtggccactggtcggagccaggcaggcggatcgctccggagcggagccccgactcgacctcctcggacactggaaaggtagggcagcacggcggcgagccttcctcacagtcgtcgctctcgtcgctctggcacgtcgtggccgcacacagggcggggtcggctcgcagagctgcaggacgtgccagatgatgggggtttggggtccaaacccagacgagggcgtcggcacgcccttcccttccccagccaggctcgtgagcggcccactgtcgccacccagacagctcaacggggttgtccccgcagcatgagcatgctggcggccccaggaacaacctcccgtaccccgaatcccgccacacagcccgagcacctcgcgcggcgtgggccaggtgagcttccagcgtcgggcccaggacggcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtggtttggggtgacaataaacatcctggtgcgggcgaggtactgcacatccatgctccaccatcccacatagcaggnnnnnnnnnnataccccgaatctcgccacacagcctgagcacctcgcgcggcgtgggccaggtgggcttccagcgtcgggcccaggacggcaaagctgtgctggcaggctgctacgatggccgcagagtcgggctcctgacaggccaccagaggcggctcgatcagcacgacctcgccctccttgaaggactgtggcgggtggcttggggtgagagtgagcatcctggtgtgggcgaggtactgcccatccatgctccaccatcccacatagcaggtacacaatcatacaggtacaggaaccctccagaaacaggtgcaggcagcatgatgcactcacagctgtcgcctgcaagcccttcccccgtccgtgtccgatgtgaggattcacagacagacctgacttcctggtgaactgtgtgggcagggaaaaaggtctgatgaattcaacttgatgggtgacatacggacccaactacaggccaggagttgtgttgcattgccgaggcaattgccccctctgcaaacataccttgatataatagtcggcgatcctggtctcgtctgatggcacctccagcagagcagcgacctggcgtgcgatgaagtcgctctcggctgtggaggacatggcgaggttcctggtattcccaatgaggctctcaaggacaatcnnnnnnnnnngaggccatgagttgggttgcattgccgaggcaattggcccctctgcaagcataccttggtataatagtgggcgattctagtctcgtctgatggcacctccagcagagtagcgacctggcgtgcgatcaagtcgccctcggctgtggaggacatggcgaggttcctagtattcccaatgaggctctcaaggacaatcaatgctggagagagtcggccctcagctctagcctagggagtggacaacgaccaaagggaagatgcaatcgaccctcttgaaagctatgtgaatgcgatgcaatgctgaattcaagattgataagacaataccaatttccaagcctgccggggcgtgggctgggcgaggaacattcgcagcagcagaggtcaacccttgggaggggcagcttgccctcttcgagaccttgtctgacgcctttnnnnnnnnnntgaggaacattcgcagcagcagtggtcgccccttgggaggggcagctggccctcttcgagaccttgtctgacgcctttaggtggccctagcccagcatgctgttgtttgccaatgtgggcgctgagaatctcccactccagcgtgctgcaagccgcgcgaatgctccaccatgcagctcagggcgcgaaccctgtccgggcatcgacggccggggtcgaattccagtacggttcgcacagttccctcccacgacattttaaccggaccagaggtggggcgcgacgctccctcccacctcgtcgactgcgtgtctgtcgaatagtattgcaaggggtgtaatcacaaccaggaggagtcgctgcggcgaagcagtccgattcgtttgcacggtggtgagctgggcctgctgtgcgcgggttcaaatccagctgatggtcgtgctaaatgtctgtcatggtgtccccccacccgcccggactgcgccccccctgtgcatcccgcacccaccggacggggcgaaagccagggatcacccgctctctccgcccctggcctacccggacaaggattctggcccggctcttacgatgcaaacttggccctggcacgcaggcacgggtctctgacacctgcccactcctccccgcagcccnnnnnnnnnnctgcccctggcatgcaggcacggttccctgacacctgcccactcctccccgcagcccgacccatgtcaccatgtgcttcctgccctgttgtgccgccggcgctgtaggcgcagcctacgctgccaacaaggcctccaacgccctggacaaggcctttgcccccaagccggagcccacggaggcagccttcgtcaccgagctgaagctcttctcgggtatcacctcccctccccaggatcaggagatcagcaaggggtttgaacgcaaggcgcgccccgtcagcaagaaggaggccgagagcaaggcccgactccagcgcctgatcgaggagaacaaggggggcggtcggcggtgaaaggagatcctcattgaaaccctactagacaccggcctgttcgcgggatagggggacgtgcctcagcatctggcgacgctcatgtcctcagctacaggcgcgctctgccacaccagcaccgcgcttggctccagcatgacaggagtcctgccggtcccatgcctggccccagggccgnnnnnnnnnnaacgtgcctcagcatctggtgacgctcgtgtcctcagctacagacgcgctctgccacaccagcaccatgcttggctccagcatggcaggagtactgccggtcccatgcctggccccagggccggccgtggcacccaaggttgagacagcatcgctgcgtacaggtgaggggagccggccatgtcacccatcctgccctttctctgcgctgacatgtgatgcggctgggacgtgacccagcacgagttccaagcctgctgcctctctgtcctgaacagactggcgccagcaggcaaatctctgctcctcaccgcaggaggactcgaggatggggacgttgatgtatcacttcggcctgccagtcagaacggcgccaaccactcggaaaccacgtgcgtgcctgctgctgctgtagggcagccttgggcagtgggatggtgccagtgccatgcatgcgtgaggtccggccccttggcgcccagggctgcctgattggtccgacagggcggatgggggccccgctccgccctcgccccacgcctgcagcacggccctcaagcgctgagccctgcgcacccgatggcaacctcgcgccgcgctttcctgcaggcgccccggctggagtgcgcggtccgctgaggggtccgaggggacgggcgcctcccaccacgactccgacgccgcagaggcagagggcggcggggcggggggggaggagctggaggatgaggacgtggagcgaggtgcgcgctgcactgggagggtgtcaggatgctggatgggtgcccactcttttgagagcgtgccggtggggtaaggcaagggtgtcccggcagacaggtgtgcnnnnnnnnnntgctgcactgggagggcgtcaggatgctggatggatgcccactctattgagagtgtgccggtggggttaggcaagggtgtcccggcagacaggtgtgcaccgcatcgaccagcatgggccccccccccttgtgccttacgcagacgtcaacatgaaggtggagcggcccctgacggcagcagaggtggcagccggcctgaggacggtgcagggcatgtgggagatggcagcagtcctggacttcctcacgctcttcaagtgaggcgcatgcggaggagggcggggctgcagtgaaggggccggggtccgcattctgggctgcagggatggagtgggaatgggccgatgctggtggtgaggagcccaccgtccctggggccagcagtggcggggctggaggctggctggccgccaggtccaagatccctcctcctcacagcgttcgacccctgcctgtgcaggccccagctgcggctgtcgcgggagctgggcgccgacgaactggagcacgtgctggtgaccagcgcgggcgacggcggcctgctggccgacctgcatgccgacctcctgcgcggcatctcacccaagtcggtgatcgatcccggcaactgggtggtgcacctggccaacaagatcaagttccactggaaaggcgctccaggtagggtggaaaagggtgaagcagggggtggagggggatgggatggatgagttggcttgggggagtgggcaggaaacagaggatgggatgagggtggaagtgggagggtctccaggaagggagcatggggcagatggggtgcccagcgtcatacttgcatgactgaatacattgccgggaagctgggcccgccccacccccaaacccgtccacctacaacaggtggcgagccctgcccctttcggccggaaaagtactttgaggccgtgacctatgccggcttgcccgtggagcagaggtgggtggttggtggatggggatgccaggtaccccgctgcttctgcagagaaggaaaggattgtcaggggaagggaagtggccagtggcactgtgcaatccaaaagatgcacgtttactcactaccatccaggttgtgcctggcacattcgcgatactacccagtgctttgacaaaccacatcacctccgtctcctcctaccagggtcaaggccctccactttgtgtgctgtgtgcgactggatcgggaggactgccaggtgggttgctggtgtgttgctgtacacatgtggcatgatctggcgctcgggaacgcactctggaggatacatgcggggaggtcaattgtgccaggggctcttctctcccactcctagctcctctgctggtggccaagcgccgtgctaccggaacacccccacccgaccacctagaccagctcactgcctgcaggcccggatcgaggaggccttgcggccgcgcacacgcaaggagctggcggccatcgaggcggcgaaggaggccgcggccgccgcccggccgacgcgtggcagcagggcggcggcggccgccttccagccgccagaggacgtggacagcttccggcgggaggccatcggggcggaggcctccggcatctcctactactacctcactggggagatgggtgcgccgccgtgtgtatgggcatggagtgttgcgctctggatggatgaggatggaggggtgcgaagaagccggcactggggagttgagctcgtgctgtgcgattggnnnnnnnnnntatctcctactactacctcacgggggagatgggtgcgccgctgtgtgtgtgggcatggagtgttgcgttctgggttgatgaggatggagggggtgcgaagaaatcggtatggggagttgagctcgtgctgtgcgattggcgaggggcgttgcagcgtcgcagatgcatgtgtggcaggaaagagcatgcgcgcgggtgcgccagtctggccttctggcttccagccctctatggcattctatcacctgcccattttctcaagcctctcacatccacaaactttcccactgtgnnnnnnnnnnacgctgcagcgttgcaggtgtatgtgtggcaggaaagagcatgcgcgggtgcgccagtcaggccttgtggcttccagcactttatagcattctatcacctgcccattctctcaaacctctcacatccacaaactttcccactgtgccgcccaggctcgcgcctctttcgagacataccggcggagctggcgcggcggcagggccccggcggcgcagacaggggccaggggtcgggggaggaggagagcggccccgaggccgatttcgccgagcgcaagggggggaagaagcggcgggggcgggcggccgcgtacgtcgtgccgcccgcgccagcgccgggggcgtgggagctgctggccaccaccgtgccgcagatggaggtgtgtgtttgggaggagggagacccggaatggctgcggggcgcgtactgtgtctgcgactcaatcgatgcgtgccggccgcctgcctcgaggagctcgccaagaatttcccagggggtcgcaaagactacgcggtctcgccgaaaccccgtgggtaccccgactgctccgcctcgacgtctcacccctgtcgtccaaattctgttcccaccaaccagtcgatcggcgagcggctgcnnnnnnnnnnttgcgactcaaatcgatgcatgccggccgcctgcctcgaggagctccccaaaaaatccccagggggtcgcaaagactacgcggtctcgccgaaaccttgtgggtaccccgactgctacacctcgatgtctcacccctgtcatcccaattctgtttccaccaaccagtcgatcggcgagcggctgcatcggagcatgaagccgcaggacaaggccgtgggccgagtgattctcgaggatgtgagtgcgggaggatgtggttctgggtattgggggggtcaaagtcagcgcacacgcatggagtctctcatgtgccccagggagtgcgctccaagcttctcctcttctcccctgcaattatcagtgtgcacaccaccatcactccttgttctccctcgcagctggtcccgcggctgcaggagcgccaggccgcggaggccaagcgcctgaaggccaccgagcgagtggcgcggcggctgggcgagccgtcgctgtacggcgacgagccggggggcaggtcgcggcgcgaacgccgcgccgtcaactatgccttcaccgactacgacgacatgctgcgctccgcgatccggcgcagccagcgcagcggcgagaccggcgacgagttcctggaggagggtcggcgcggcaagcggggggtgagtcttgtggggggcagaatagtggggggaggcgagtctgtgaaggttgatcacaacctgtgagcgccagtcaggcaacaggggtgcagggttgtcctgcaaggcgcaggaggcccaagagtaccattccaagcaccactgctcgtctcttgacgtaaggattcgctcnnnnnnnnnncgcagggttgtcctgcaaggcgcagaaggcccaagagtaccattcaaagcacctctgctcgtctcttgacgtaaggattcgctccccttcttgccccgcaggcgtcccctgtccgcctggaccccgccgttgaggcgcagatgggcctgaggcgggggcgctccgtcgccggccaccactccgggtgagcagctgtgtgcgcttcccttgaggaatatgggggggtgcatgggattgtaccccacagtttgggaggagcgaatgacgagaacgagggggtggcagggcttnnnnnnnnnntttgaggaaaatgggggggtgcatgggattggaccccacactttggaaagagcaaatgacgagaacgagggggtggcagggcttgctgggagtgggtgacctgcacccgggtgttgtgctggagtcacgctggcaggagaagggccgaggttcctggtacgtctcgtgccaccgcacgccccccccgccgtgctccgcagggccgaggaggtgccagagatcaacgnnnnnnnnnncgagtcacgctggcaggagaagggctgaggttcctggtacgtctcgtgccaccgcgcgtccccccacaccatgctctgcagggccgaggaggtgccagagatcaacgagcgtgcgctgcgacaggctgcggccgcgcagaaggctgaagaggaggccgcagctataagggcggccgagcaggccgcagaggaggcggcaagggcagaggaggaggccgccagggcggcagaagaggcggcggcgcgggcggtcgaggaggcggcgcgggcggcggaggaagcggcggcccgcgccaaggcagaggccgcagcgcgggccgccgccgagcgcgccagggcggagaagcggaagagggaggcggcgcggcgggaggagcgtgagcgagcggccgcccagggtccccccgcgcccttccaggtcgagcggccggcgccgctgcgggtgcgcctgcccgtgcccgcccatctgcaagacggcgcacaccccgcggtgtacgcgcccgctgccgcggagcagtaccccggagtgtggggagggggcgccgccccttggcagagcgccgggcacggacnnnnnnnnnngagacagcgcacaccccgcggcgtacgagcccgctgccacagagcagtaccccggagtgtggggagggggccccgccccttggcagagcgccgggcacggacctgcgcagccttatgcgtctccgcagcagtccgcgtccgcgcagcagtacgcccccgccccggtgcagtacgacccgcagcgatacctgggcatggcgcaggccatcgcggccgccggcgccgcagagcagcggcatgctttccagcccctggcctgggcccccgatgcgcaggtgccccagccggccccgcagcaggccggcgcggtcccgggccagggtgctgccgcacagcatgcacagcatgccgcacacggcccttcgtacgcgtggcgggggcccccgccgcagcagcgctagcctggtcgggcggtctgacgcacgcccgttccttcatattgatgcccgtcctattgcactgtgttgtaaatttgcacggcgctgctgggagcaggggcaggggcatgctgagcactggccgacatggcgcgggcagaaggactcgacggagcctctcgtgtggctgccctccccgacactcgccagtggtgcgcgcacgcacgcgtcaccgccggctgcgctgccggtgcagatcgacgacggcgccgaccagctgttcctcgatgacgctgccggggggcgcagatgggtccagtcgcagcacgctgcagtggatcggggctgccctaccctcgccggctctcaccaggagcgtcaccctttctttcctgctgtgcagctcgtttgcaagcacggcatccaccccatacttctgaatggcagcctttgcctgcagcgggtgatggtgggcagggggggtgccctgtcagtgggaagatccggtgataaaggcaagggcagcggaccgttgccaagccagccagggccctgcctttggtccccaagacacatgaaacttgttccatcggcacagatcgcattgatcgtgactagtggcatggtaagggtctgccatctatcctgacccattccagcacgaaccttggtgaggagcacctcctcgtccgtttccagcttgaatgacacgaccgtggcgtggggtgcccagactgacgtcagctcaccgagcagcttggggaccttttgcagctcgaggacgagggggcctgcgcccgagatcttgtgctccacctgggcagaggtcggagcaaagggggggggtgaggctgggcagagacaaaggcagcacacacatgagcatgccttctgggcagcagctaatactcagatgcccaaaacnnnnnnnnnnggcacacacacgagcatgccttctggcagcagctaatactcagatgcccaaaactctcagacaccgcttccttcccaccatttcagcccagggtatgtagtagtctgacacagctgctgcgaggtagaagagggccaagcgaccgtgagatgcgaggcgttttgctatcacctccagatactgcgattcgggaaatgatgatggggagggtgactggctcgcctgagcgcggagccctcagatttggacagcaagagaagtaagcccagctcccgagattggtacccaatttgatgtgcttcaaaccctgtgcacgccatgcctggcagcgccatgcacggcgcggccactccctttccctcactgtctgcatgcgagaacccacaacaggcataaccttacctggaggtactcaaacacggtcgtgaagnnnnnnnnnngctccctttccctcgctgtctgcatgccagaacccacaacaggcataacttaacctggaggtactcaaacacggtcgtgaaggggacatggaggaacgtccccgggtcctctgtgcagctgtggaaggtgcgcagggcttcggctagggcgctcacctgcagctcgccagggcccgacaccgagaaggcggtggccatgtcctcctggcactcggagaggaagggcagcagggagccggtgcgcgacaggaagatcacggagtagcctgcctgtgagtagcatgtggcaggggggggaagcgagggatgtaattgggatttggcaaggagccgcttcacgagggttgttgcccacatcagtggttcagactagaaaacctgattgcaggaggatggccgccccccttccacttcacacaatgcaccatgcagcgtgccttgaggaactgttcagctgacagnnnnnnnnnnagagtagcctgcctgtgagtagcgtgtcgcagggggggaggaagggatgtaattgggatttggcaaggggccgcttcaagaaggttgttgcccacctcagttgttcagactagaaaacctgattgcgggaggatggccgccccccttccacttaacacaatgcaccatgccgcgtgccttgaggaactgttcagctgacagtgcgccgcgggtgcccttgctgaagttgtcgatgaagcggacacagttcctctccagagggacggtggtcccaccggaggtcacacacacaatgggacgagattcctcttgactcctggccctctccaagaaggcactcagctcccgttctatccattccgtgtccaccggcgaggacttgcggaagctctctgcgccgctgaacgacatgggcagcaggccactcggtggctagacaccccaaaacaccagggctcgccaagcacatgcatatgcagttgtatcgggtcgagtaatgtctcgcatgcctggtgggcactcccgaccactcccatttcggttcgagatcgttctcgtattcaggcgaccgacacacaatgtcgnnnnnnnnnntgcatgcctggtgggcactcctggccactcccatttcggttcgagatcgttttcgtattcaggcgaccgacacacaatgtcgggagcagatcgaaatggatcgcggcgtgtgggaatgccgtgaacgcagggcctcaaatcggcgtttcctcctttgcgctttcatgactggagatttacctgcaccatgactgcgtttggagcgagggctcacaatgctggccgagcctgagccgtaatgagtggcttggtggggggtgtcggaccccatctggtccatcaggagcgtgctgagtacagcctggctcgcaagcacgccctacgagcccggcatgccgacgcattgcacaggtgcattgccaggcggcgcgacacccgcggtgcaggacggcgaggcgtgcccgcctgcgccatggatgcgggcttgtctcgagagttggcccgggcctccgggccacaggacgccctgcaccttctggccgccgggcaggccggccccctctccacagacgcctgccgccaggccatgcaggcctgcgtagacgcgggccgggccgacctggcgcggggcgtccacgccgagatgctgcggggcgggagcagggaggaagggccgcagtggccggcggcagacgcggagaccagcgccgccctgctttgcatgctgtgccgggccggccaggttaaggccgcgctgggcgcgctgcaggacgtgaggacctgtagccttggccggagcggggacgtgcaggtgagggtagctgcgagggtggaggtcggcatggcgtgtgggatgggggtgcggagaggaggatgggtggcaggcaggtgaggggttccaaaggtgcaggtgtggcgtgaccctctcagctcacatgcgtggcagaccaagggcagctgctccagggcgctccccttgcacccagccgccccaaggatccactctccctccaccccctcacactagtttgggcatgtcgtgccttcacccctggatcccgagctgcccctggctctggtgaggaccctggaagccacgcagaacgtggccgacgccgccagcaggtggggccattgtactgtggggaggggcgggcacagacggacacaggagccactgcttctgcttgtgctgcgtctgtatgcacggtcttcccccttcctgtacgggtaccacctcacttcctccgccagcgcgatgcagcccctggtggtttggccctgacaccctcagctcactatgcaggtacgagttccagatcgtgtccggcacggtgaccgagacggcggtggaagccgtcgcacagcggcggggcacactctgggcgtccaccggcggccgggtgctgggcgccaggccgggcctggcctccgtccaccgcctggtgctggaggacgccgctggccgccggcgcgcactgcgtttcggcaccacagacgacgctctgccggccaaggcgggcgacgtggtgtccgtggcatgcnnnnnnnnnngcctcacttcctccgccagcgcgacgcagcccctggtggtttggccctgacacccacagctcaccatgcaggtatgagttccagatcgtgtccggcacggtgaccnnnnnnnnnngctgcggttcggcaccacagacgacgctctgcccgctaaggcgggcgacgtggtgtccgtggcatgctgcccggagcgggctgtcctctccaaggaccgcctgttcaaggccatgccccccaacgccaagccaggtgacagaaggaggtgttgatttctctttcttgattgtgtgtgccttgagggggagggctgggggcgtgtatacaggcgccagggcatccctccatgaaacgctgtgagttgccagggctggcacagatctgagaacgaccatgccttgtcctctgttctgggagaggtgtggtctgaatgctcctgtcccctctcccacccaacccccaggccagcccatgctgttgagcaaccagaccagcggcaagtcgacgccgctggtccccgcgccgcccaccgccgacggcagcatcctcaggtccagcgtgccaggctgggtgctgcccgccttcatgggcctggccgccttcgacacggcggccgcggccctgaatccgggcgcggcgctggcggccaccggcgcggcggcggcgctgggcgcggcggggctggccacacagcgcctgctcctcccc

SEQ ID NO: 41912 - DNA, 75 bp, Chlorella protothecoides
ctcgtacaagcagaggcatctccatctgtcacaccgccacgtcaggccgttgggcgccccaccagcctcgctccc

SEQ ID NO: 41913 - DNA, 536 bp, Chlorella protothecoides
  modified_base (233)..(475): a, c, t, g, unknown or other
gctttcccctcatgcttccaaatccccccacttaccacctgcaggcgggtgcctcttcccatactacattggagtctctggggcccttcgtgatgggcagatactcactggtgcgcagtcgcgaagggctgaggggaaggccgtatcgcttctgaggctgctggggggctatgccctccccacccgcctcgccatgtccccgtggcctccctcgctgagagcccctcgtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcgggagccggcggtagagaccctggaagcatctatgcagggtgctgtgtaggggctcg

SEQ ID NO: 41914 - DNA, 375 bp, Chlorella protothecoides
  modified_base (95)..(270): a, c, t, g, unknown or other
ggggggttggttgaagggcagtgccacgcttatccccgggaactggtggccggtgctgtccgtataccacacccaggcgtcggtgatgccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaccaggttgccagacaccaccatgctgcaggccgcgtagtcgtatgggtcggtggaggagtagtcgggcccgcagtatgccgccaggatggcgacgtcgtg

SEQ ID NO: 41915 - DNA, 64 bp, Chlorella protothecoides
tgtgcggccatggagggcgacgtgggggggggggtgaaatcgggcagcttcctctcgatcattc

SEQ ID NO: 41916 - DNA, 77 bp, Chlorella protothecoides
gttgcgaggcagcagggtctggcatgtccctgaaccgctcccccgcctcgggtcggggcgctcgcacctgttgcgca

SEQ ID NO: 41917 - DNA, 63 bp, Chlorella protothecoides
gaacgtggcctggcggccgcaggtgtggcccctgaggaggtgacctacgtgaacgcgcatggc

SEQ ID NO: 41918 - DNA, 6291 bp, Chlorella protothecoides
  modified_base (526)..(535): a, c, t, g, unknown or other
  modified_base (698)..(707): a, c, t, g, unknown or other
  modified_base (761)..(815): a, c, t, g, unknown or other
  modified_base (3144)..(3153): a, c, t, g, unknown or other
  modified_base (3436)..(3445): a, c, t, g, unknown or other
  modified_base (3507)..(3633): a, c, t, g, unknown or other
  modified_base (4370)..(4379): a, c, t, g, unknown or other
  modified_base (5811)..(5820): a, c, t, g, unknown or other
cgttgctccaaaggccggcgtgctcgttgccccgaaagctggtgcactactggctccaaaagcaggcgcactgccagccccgaatgctaatgcactactggctccaaagccaaaatctccaccaaaggctggcgcgctggtggctccaaaagctggagtgccagcagctccaagggcaggtgtaccggcagccccaaaggctggcgtgctcgtggctccaaaggctggcgtgctcgtggctccaaacgctggcgtgctcgtggctccaaaggctggcgtgctcgtcgctccaaacgctggcgtgctcgtggctccaaaagctggcgtgctcgtggctccaaaggctggcgtgctcgtcgctccaaaggctggcgtgctcgtcaccccaaaggctggcgtgcttgttgccccgaaagctggtgcactactggctccaaaagcaggtgcactgccagccccgaacgctggtgcgctactggctccaaagccaaaatttccaccaaaggctggcgcgctggtggctccnnnnnnnnnncccaaaggctggggtactcgtggctccaaaggctggcgtactcgaggccccaaaggcaggagcactagtgctcccaaacaagctccctgcgcacaatggtggggaggatgatggtaatgacggagcgaccacttagccacgatcggtcttgactggcctgatnnnnnnnnnngaggagcgctggtgctcccaaataagctccctgcgcacaatggtggggaggatnnnnnnnnnnnnnnnnnnnnnnnnnnnnnnnnnnnnnnnnnnnnnnnnnnnnnnnctgctagctgaagctcccggagcggaggccgctccgcctgtgaggaaacaagatgggagcctcatcatgccaagctcctccatagggacacgatccatacaagtcgctattcttgagcttaccaaattggaatcctccaaagctcatggtgagccgagcaaaggtgtctcgatcggtggagccacaggacccttccctctccacaaaaggtctggcaatgacacaacagcttcctgaagacttgattgggatcgcaatctgccacgtagcggtgatgcgctctgtacacccgtgcacgaaccagacacctaggtacactgctgggcctgctgaggtttcgaaaggccttcaccagcatgcaacgagacctcaactctaccaggcatggtgtcagggggagctctcgactctctcaaggacaggtttaaggaatattctgaacagatctacatgttgcagggccctgcgagggtgcccatgtcgctcgaacaaagcagacccatctctctcacctcttcctgcccctgccctgcccgctcctgcttcttaccggcgcatcgtgcccaccgatatagatgtttacatcccttgagggctcagtataatcctgatcgccgtgatggcgaggcagccctcgcccaggtacggagagactgggtgcccccctccccccctcccaatggctcacgaccccgcttcccgcccgaggagccccccaatcccgggcccagccccggaggcgggggtcccaatggcctcaccaaggcattcatagcaggcgccttcgtgctaggtgggcggtcgcgacctgcgccccggggttctgattgctggataggaacgggaatgcgtcatccccagcacccctgcacaccctccacacaccttggctcctggtctcatttcgtcaccctcttcagtcacgtccattctacacataattgtgcaggcatgggcgcaggcatctggtttgacacccaggtcaccttccagccccagaacgtcgcctctacggtgctggtggacaccaagacccccaacagcgagctgtgcatggccaacggctactcctccatggtcttcgaccagcgcatcttcctatccttcaacccgtgcgtcgtgtgtgttatgtgtgagggggaaggggggggggaattgagggaacgcagactcgcctgccctcatcgggttccagagtcaactcctcggtccaggagcctgccgcaccctaccctgccccttttggccgcactgggtccctcagtgccccaccccacctccacaataggctggaaagcctcattcagcaccctccctctaccacttcactcctgccccacaggttcaacgtttacgtggcccagccggaggtcaagcccgggtgcgtgctgcggcgcagcaacgtgggcgtactggagcgcaggggcctggtagacggcgaccaggtgtcggcctgcaagcgctccatgaacacctttgcctttgtgggcgacctggcggggcggccggaggtggcctgcgtctaccacagcgaggacgcggagaaccagtttctgcgggacccgaagatgggcacgcacatgcgtggcgtgggcgtgatgcccgacggcaccgcggcgccggcggcgcggccgggagcagagtgagcggcgacgtgtggcggccggcatggcctctccttgacccttgcggtgccctttgtggcctgacggcctgtgatcctgtgacctttgcagcacgatgcaacctgtcctttgcactcgccgcccaggagcacgcaatcatgctgggccactccacacctgggtccctgggtggaaaagaagcgcgtcgcacaagacctcgccagcgagggccagcgcaactgcaggtgctccggtcacacgttttcgctgccccacaagcagacccacgtcaccccaggaggagctctatcgcagcttccaggcagccttccgcggcggccagcgcctccgcagcctggacctctgagaaccccatgccgcacagggccgctacatcctcggcctccaaggggctggaccagcccttgccccgcccgcccgccgcggcggcacaggcccgaccgcgtcgcgcatgcccatgcgctcgcgccgcaggcgcctgcccggcgggcgcgtgcgatggccgcctgtggactcagattggtgggaggagagagggtcacggcccctccagcccaccaggggaccggatacggcgtggtatgggtgcgacggtcgcccagcagcaaaccagcacgccacagcctggacccccctccatgcatctgtgtgcttttctccagcatcctcggaacccagcacannnnnnnnnntagccttgaccccctccatgcatctgtgtggttttctccagcatcctcggaacccagcacaccaccagactcgctttcagtaacccccagccacccatgcagggcttgtcctcctgcacccacccatgcacaacgctctcacaacagccttgcatggtctgcaggcatgacaccaccaactccaccccaccgcaccactcaaagtcgtcgtcgtcgtcgtcgctgtctgccgctgcggtccgtgtagcggctggcaccggcgcgcggcgcttcacgggccgcnnnnnnnnnngctcgccttcagtgaaccccacccacccgtacagggcttgtcctcctgcacccacccatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgctgtccgccgctgcggtccgagtagcggccggcaccggcgcgcggcgcttcacgggccgcgccgccctttccttgggcgccgcgccgtcccccctgccgcccccgtccagggtcggggtgcgcgtcgcgcggtgcctgcgcgccacggcgctgctgagctgcgcccgcagcctcctcaggacggagtgcaggtcggccagcatgcccgtcagctcctcctgggtgcaggagctcgtgtcgcccgctgcaattttgtgtgtgtggatgtggtggtgttgccggggggacccaagcaaaatgtgagatggcaagcaggtgctggagaggccggtggcttggggatcacagggccatgctccaatcacaactctcactccggtgagaaccggaagaggatgagtgctcgctcatgcacaaggtatgcgttgtcagccgctgccccttgtcgtggtagatggcagatcgcaagacactcagcaccccacccaacacctcctagcccacgcacccagcagggggcagtcccgccacgccggtgcagtgccctgcatgctgtcctgcagcgccgccacctcagcctctgcctgggccatttgctcaggcgtcagtccatacctgggatgcattgagagtcaggacggctgggatgctgaaggtttgggagccgtctgcacacaggaatggaggtgagggcagaggccctgaggtgcgtaggcggtgccccccctcaccnnnnnnnnnngttgggagccgtttgcacacaggaacggaggtgagggcagagaccatgaggtgcgtaggcggtgccccccctcaccccaacacccatcacagcctacagcctacctctcctgcgcctctgcctgcagacgatccttgtcttcccgcgtcaggacagctgtggaaagggtgtgctggggaggcttggagcatgctccttcccgcgggaagtcatcctccatgggcaagcccggctgaccatgggccagtgccataccgagaccttcaatgcaccctgcaagatttggcaccttggtgtgccagcggcgacacttccacagcctctcctctcccgccccaggtagaccagcccccctggacccaagtaaacctcccacccagcactcacgtccatcatagatgatgaggcccgacttgcgtggggcgtccgtcctgccctcgttctccgccctcacgcggtcgaggtcgatgcgtaggcccgtgaaggcggccagggactgctgccccagtaggcgctgggtggcgccgtacagctgctggatgagcttgcccggcaggagccccgtggccaggatctgcacccagcgcccgatgccgtagcgcatgagcaggaggcgcagggttctggtctcctccaccgtccagccgggggaaggggtgaagttccatctacgcagggagtgtgaggatggagctgggagtgaagccactcagggacacctcgaagacctgcatgccggcgctttgggcgcatagacatactaattttgcgatctgaaccatgccaggtccatctacaactttcgcatgcgacgtcaaccccttcacaacgcacagcgacactgcgtcgcccagtttgggtccccgtatctccacccggctcgcagtcatcgcgatggctgggactgtcttgatctatcgctgcatgcgacagtcacggagattgtttggagttgaatggtacctctgccgaggcttctcggcagcagttatctaccatatacaggacctggcgcccggtcaattgaattcggactcaacaaagcgtagatccacaccctagtctccaggaaaaggcaaccttacatccagttgaaggacatcgcggcggacccgggttcgattcccggtcgttgcacgacctgccacaagcaagccctctcatgggcaacgatagtgtagtggttatcatcgccgcctcccacaacaaattcttttggttttgggcgaaatttttatgtcaagtgaatctcatcggtaacgcaagggccgccgccgtcgtccacaccactcccactctgcttgccaaccccacttcctgccacatattgtgcctacaaccagcgcatggtgcgcaccgttttacaaaggggcattctgagagtttgcttgccgtgcttcggccacctcctgctgcacgctctgcacgtggnnnnnnnnnnatcttctgtcaagtgaacttcatcggtaatgcaagggccgccgccgtcgcccgcaccactcccactctgcttgccaaacccacttcctgccacatatcgtgcctacaaccagcgcatggtgcgcacagttttacaaaggggcattctgagagttggcttgccatgcttcagccacctcctgctgcacgctctgcacgtgggcgtcactcagtgcacctgcgtgacggcggcgccaatccccacgaccgcgacggcggccacgggggtcacgtacacggccaggcggcgcgcggcggcggccttcaccggccccgggcgcagtgcgtgcagcagcgccagggccagcgtgaagagcgtgagcgcgttggcctggtgcgccgcgcccagctccaccggcacggcgttgagcagcgcggccaggcccaggcccacctgcaggcaggtggcagcagccagcgcggccgtaagcgt

SEQ ID NO: 41919 - DNA, 78 bp, Chlorella protothecoides
gccccggcacccacactcctcgcgccggcgcccgcagccaagcccgcgccagccagcggcgccggatgctggtcgggc

SEQ ID NO: 41920 - DNA, 97 bp, Chlorella protothecoides
atgtcagggcggcagggagctggtgaggacctgcggaaaccaggctggtagaagcttgacagcgctcggtagacccggtgacctcccaaggcaggcg

SEQ ID NO: 41921 - DNA, 47975 bp, Chlorella protothecoides
  modified_base (516)..(525): a, c, t, g, unknown or other
  modified_base (1329)..(1338): a, c, t, g, unknown or other
  modified_base (2036)..(2045): a, c, t, g, unknown or other
  modified_base (3017)..(3026): a, c, t, g, unknown or other
  modified_base (3702)..(3711): a, c, t, g, unknown or other
  modified_base (4435)..(4444): a, c, t, g, unknown or other
  modified_base (4683)..(4755): a, c, t, g, unknown or other
  modified_base (6203)..(6212): a, c, t, g, unknown or other
  modified_base (7080)..(7089): a, c, t, g, unknown or other
  modified_base (7476)..(7485): a, c, t, g, unknown or other
  modified_base (7915)..(7924): a, c, t, g, unknown or other
  modified_base (8870)..(8879): a, c, t, g, unknown or other
  modified_base (9546)..(9555): a, c, t, g, unknown or other
  modified_base (10225)..(10234): a, c, t, g, unknown or other
  modified_base (11061)..(11070): a, c, t, g, unknown or other
  modified_base (11698)..(11707): a, c, t, g, unknown or other
  modified_base (11938)..(11947): a, c, t, g, unknown or other
  modified_base (12000)..(12009): a, c, t, g, unknown or other
  modified_base (12063)..(12175): a, c, t, g, unknown or other
  modified_base (12660)..(12669): a, c, t, g, unknown or other
  modified_base (12919)..(12928): a, c, t, g, unknown or other
  modified_base (13747)..(13756): a, c, t, g, unknown or other
  modified_base (14177)..(14186): a, c, t, g, unknown or other
  modified_base (14318)..(14327): a, c, t, g, unknown or other
  modified_base (15058)..(15067): a, c, t, g, unknown or other
  modified_base (15605)..(15614): a, c, t, g, unknown or other
  modified_base (16101)..(16110): a, c, t, g, unknown or other
  modified_base (16256)..(16265): a, c, t, g, unknown or other
  modified_base (16349)..(16358): a, c, t, g, unknown or other
  modified_base (18397)..(18406): a, c, t, g, unknown or other
  modified_base (19286)..(19295): a, c, t, g, unknown or other
  modified_base (19717)..(19755): a, c, t, g, unknown or other
  modified_base (19882)..(19891): a, c, t, g, unknown or other
  modified_base (20104)..(20113): a, c, t, g, unknown or other
  modified_base (21272)..(21281): a, c, t, g, unknown or other
  modified_base (21863)..(21872): a, c, t, g, unknown or other
  modified_base (23050)..(23059): a, c, t, g, unknown or other
  modified_base (23640)..(23649): a, c, t, g, unknown or other
  modified_base (24074)..(24083): a, c, t, g, unknown or other
  modified_base (25349)..(25358): a, c, t, g, unknown or other
  modified_base (25795)..(25804): a, c, t, g, unknown or other
  modified_base (26558)..(26567): a, c, t, g, unknown or other
  modified_base (26931)..(26940): a, c, t, g, unknown or other
  modified_base (28058)..(28067): a, c, t, g, unknown or other
  modified_base (29875)..(29884): a, c, t, g, unknown or other
  modified_base (30186)..(30195): a, c, t, g, unknown or other
  modified_base (31275)..(31284): a, c, t, g, unknown or other
  modified_base (32024)..(32033): a, c, t, g, unknown or other
  modified_base (32158)..(32167): a, c, t, g, unknown or other
  modified_base (32560)..(32569): a, c, t, g, unknown or other
  modified_base (32935)..(32944): a, c, t, g, unknown or other
  modified_base (33359)..(33368): a, c, t, g, unknown or other
  modified_base (33646)..(33655): a, c, t, g, unknown or other
  modified_base (33823)..(33832): a, c, t, g, unknown or other
  modified_base (34305)..(34314): a, c, t, g, unknown or other
  modified_base (34934)..(34943): a, c, t, g, unknown or other
  modified_base (36440)..(36449): a, c, t, g, unknown or other
  modified_base (36525)..(36766): a, c, t, g, unknown or other
  modified_base (41938)..(41947): a, c, t, g, unknown or other
  modified_base (43034)..(43155): a, c, t, g, unknown or other
  modified_base (43586)..(43595): a, c, t, g, unknown or other
  modified_base (44645)..(44654): a, c, t, g, unknown or other
  modified_base (44916)..(44925): a, c, t, g, unknown or other
  modified_base (45524)..(45533): a, c, t, g, unknown or other
  modified_base (45961)..(45970): a, c, t, g, unknown or other
  modified_base (47370)..(47379): a, c, t, g, unknown or other
  modified_base (47910)..(47919): a, c, t, g, unknown or other
cgcgggcgcgctggccgccgaggcgacgcgctccgcggcgctggcccgcgacctggtgcgcgcgcgagaggacgcgcgccctgtgcagctgatgctggtgcacgtgcgcgagacaccgcaggaagcgctggcctccgcgccgcgcgagctggcctggttgcagatcgagtgccagcgcctgggcgaggagaacgaggccctggccgccgccgcggaggccatgcaggaggagctgagggccagcgccgcactgctgcgccactccaaccccaaccagaagatccagtacacccagcgcctgaagctggagctggaggcgctgcgcaaggagtgcgccgccgtcacccgcgaacgcttcaccctggagcagtgcatcaggtgagtgaatgttgtgaggctgtttgtggtgtgtgggggggaaaatgggaggaggagagtgggctgctgggggaacaggctgaggaacaaggccaggccatggccactttctgtcccgcttctgtacgtaccagattnnnnnnnnnngaggctgaggaacaaggccaggccatggggcgtttctgtcccgcttctgtacgtaccagattcctagccctgcaccaaactggccagccagcctctcctgggtcccaggtgctcagcacgacccagtcccccttctcccccctccgaaataataggtacctcgcggtcctggctgggcacacggaggcggcgcacctgtcccaggatgccacgggcctgcagcccagagtggcggcggccgccatcctgccaaagtctctggccggcgagcagcgcttctccgtcggcctcatcagcgcccgccagttccaggtgcggatgccgggatggggcggcgagtggtttcgatttcgagagaggagtgccatggcccggggatgcagtgtcccggggtgatgccgatgtgtgcatcccctgcgtccatggccatccttgccgctgcgctgcagggcggcacggaaggcacggagccgctgagtccgcgggtcctggcccgcgagtcgagcgacgtgagcgacctgggcctcaccccgaggtccggcaccggcacagccggcggggagagggagacggtggaggggcgcatcctgcgccacatctcccgcgtgtgtggggctacgaagctggtcaccccccagccgcccagcgaggaggaggaggaggcgggcgaggagggcgaggcggcgccggaggctgaggaggagggactggtcacccccacaccagccatggactgagacacccgtgcccatcctattcgcagcttttatacaacagcctgcgcgtcagcccacggcgcctcgnnnnnnnnnngtgagacacccgtgcccatctttttcgcaacttttattcgacagcctgcgcgtcagcccacggcgcctcgcgaagagtgcaggaagcatttcctgtgtacatccatccctcaatgattcgccacattttctgaactgattattcctgcctgcgaccccactcatttgcctgtaacccatggtagccgaccggggagcacctcgtgcaggacaggatcgcctcgcctctgggtcaaccagcctggggttgctggggcaccaggttcagacccccgaaacggcaccgcgaacaggccggcaaccgatttgcacttcgcactgcacaccaaatcatacaactcaaagcacttgagccgagtatgcctcgtgaacccgctcagggtcccgactggcgtccctaggtgtcgacatgcggagatggcggacccgctggtgggtggctgtcttcctctgcatcgcccctcattgctcctggggaaccgtcatatcctcgggcactctgacatcgtgcgtcagcaatggctcggtgggtctgagtggtcccgaaggggctgggcgacagcagtagggttaccgcccatgtcaagggctcgtccccatgtcagcagccagcaacaacttgcagcaagaccctcctacctccatgcttcagaaagacagcactgagatctcctgctccaagaagatcctggtgacccnnnnnnnnnntcctccatgctgcagacagacagtactgagctctcctgctccaagaagatcctggtgaccctcacactggccaacaacaagctgtatgcctccgatgagctgcagttcaccctctcgtgcgtgaacaggtacgcaatggaggcctggcctgaggggatggctaggccatgcagatgaacatatgcccacctccgaaccctccacacccttgtaagtcacagtcttcccctctgtcttccacgccgccttaccttctcgccacaccctcacccaactacatagtgccactggagtctgtccctgcccgtgcgactacgccaccgacgccacctgcacctgccgcgacctggcccacgacatgaccatctccatgaccaagggcgcggtgtatgcgctctacccgctcaccttcagcaggcggtaccagggcgcgccgacggagaccatcgtgaccacgacggtggagaactgtaacgacgagtatggggcagtggctcccacctgcggctgggcgaccctcaacggcgtcaatgtcctgtgcgctggagattggtccaggggggaaggggaggaaggtgggggggtttgagccgggccgccacgcttggctgttctgggtcgctgcaccaaagtacgggcatcacgtcagggttgggtattcaaacgggacctgaaccccactgcctccatcgcactccccacgtggtgcagggactcgcaaggcttctgctgtgagtgcacactggtcaacggatactggaccaactacatgcgcggcagtctgtactgccccgctgccgcaggcaagtctccgtccaagtacatcgcctccgcgcactgcctacgcttcaacgacgactggtggtttgtggtgagacggtcgagacgtggagggggttgcggaacggacttgtagcagtccgggagccgccgcggcggcttcagaccctgtcacatcaccccctggggcannnnnnnnnnttggagggggtgcgtcacggacttgtagcaggcgaggagccgccgcggcggcatcagaccctgtcacatcaccccctggggcatgcatggcgggaggtggtggcatcctcggagagaggaaatcaacagcggcccagggtgccccatcccaccccgcactcctcctacacaggggtacgtggtgggcaactaccagatggacttcaacatcgccttcaacgtgacgaccaccaagaccggcggcaccaacgccaccagcgagaccctgaccgtgaacccctccgtccccattgtgcgctcggccgacaagactgtgacggccagcctgctgggggacctggcatcctactcccagatccccaacctggcaaaccactacctgatggtcatcctggacagcctgagcgacaccccctccgtcgccttttccaagaacaaggagacctggatgctgctggatccagcgctggtggaccctgcgggtctcacctgcgacaaggttggcatcacctactcgtgagtgccgataccatgaggcgggggacaggggccggcatggtctagacaccgtgaggtccctggcatggctgctgatgtgggaccttgatcctcaggagggagcagagggtgctgccttcctctcaaagccgccaccccccgcgctcacagaggcttnnnnnnnnnnggcaaggtccccgtcatggctgctgatttgggaccttgatcctcaggagggaacagagggtgctgccttcctttcacagccgccaccccccgcgctcacagaggcttccgggtgaacttggcggataagtgcaacatcccaaatgggtactgcctgcgcaaccagctggtggacctgtactacgccgacgtggagaggatcaacgcaggccacgacccactatactttgtgacaaagtacagtggtggcgtgaaaaacgagcgccaggtgcggaggagtaggtggagcctgggctgtgtgatacaagtgcacgcctatcatatggtttgtgccttcgccctgagcagcagagggaagggcggcacggttcctgttcgagaaaccacgtccccgcatcgccatgcagatgacatacagcctgagctcctctgggaagacgacatttgtactgaacctgcccgtgccctccctgacccagagcctggtcacgctggctgtatctgctgacagcgtgcagtttgtgtccaacacctcgccggctaagatccagagcacccaggtgcggaaggtgtttcaggggcggagtcagagactggctccaggcacctaggatgtccatcaaatgagctgatgcgtcagacaacaggggcctcgctcctcgcccaaacttctgatggcgtctccccgtcccatttgcagctctgcacgctgtatgacgtgcagnnnnnnnnnntggagtcagagactggctccaggcaccgaggatgtccatcaagcgagctgatgcgtcagacaacaggggcctcgctcctcgtccacacttctgatggcgtccccccgtcccattgcagctctgcacgctgtatgacgtgcagtgtgggacctttgagtccctcaaggggtctggctacctcactgtgacggtgagtgatggccgagggctgaggggcctcggggggctccccaaactcnnnnnnnnnnnnnnnnnnnnnnnnnnnnnnnnnnnnnnnnnnnnnnnnnnnnnnnnnnnnnnnnnnnnnnnnnaccctgactgccgactactatgtcagcctgacgagctgcagcgacaatgtggtgaaagccctggtacgcctgttctgaggctgggcgaggtcctactcttgccttggattgtctcaggctgtccagcagacaccatactcgaatcagcacaggtccagccgggtcagtctctcgctccattaccctgcctgcccaggcccagtatgccacgatcaaggctggcgcaaagtacaactttgttttcaccatcaccatggccaccgaccaggccacgtcctccacctgctctgtggaggtgagggactcccagggcaacctcctggacagcactgccgtcacatgggccacccacggcacggactacggccaagaaccacaggaaggaaccgcctcgcctccggtgggcgacggcgggagccattggtgctgggcgttggccttgccatgaggataggaagcatggaagtggtggacggtctgaatttttagcccatgtcaagcgccgggtgtatgcaccacccatacatttgtgtgaaggaccgacaacagccggaccagcttcagccagttcctgtgcatcccctcacgcagtattatgacgactccaccattgccacatccttctctggctgcaacaaagtgtgcggcaccgtcttgtccctcaagtgcctcgtcaagtactcgtgctggtacaaccttgccgcggtgggtgggtgtggatgtgctgaggggagggtgctgcatgcacgtgactcctgaacacaagctcaggaggggcgagggatgccagtgggcagccgcgagctccgccagccagtgtacaggctccaacccggagcaaactcccctgcagcgtgtcaccccagcaccacctttgtccctggtgcaaccaactttgcagggccttggctctgcttcggccgcaggcctcgccataatcgctctgatatgggctgccaagcaaggctacatcgttccgatcctgggaatggccctccgtctcctctgctgcagcggcccctcgtcgcaccgcagcaaggcaaagaaggtcgcgcctgcgcagccccctcctccccccaaagccgacgccacagtcacactcgatgccggtgcggcgtccaagacctcgctgccgccagcaggccccacagctgcagctgacagtggagctctcctgggaactgggccgccgccacccggcttcaagcggctcagctccctccgaaaatcctggctgtggccaggcaggttcatgccaggcggtgcgggaccacctgtcatgcccaccgacagcatgtacgaccaggcgccgctgccacatcattcacaggtgggggcacaggatcgagctcgaggtttgaggatctgatgggttttgcacagctttgagtgaatgaggagaggtggtggtggggggctgagctgcccagtgcctcgcggccgtactnnnnnnnnnntcgctgccacatcatccacaggtgggggcacaggattgagctcgaggttcgacgatctgacgggttttgcacagctttgagtgatcgaggagaggtggtggtaggggactgagctgcccagtgcctcgcggccgtactcattcgacctctgtgcggatgccccattgctgcagagcattccgaccccctgggccccttccagtgaaacaggggtgccccagtatggccctttgggttcttcccacgcggtagcactggcaggctacgagccatcgcaagcacaccattcctttccccaggctggcatccctcactctggggcaccattttcaagtcctgtagccctgggcgctcattacagcacgcccagcaccccttggcagcaccaagcagccgaggtaggctcccctcctagcctggtcatgggcatgcccaccgtgaaggctggggcccctcaagggtggcacctcccaccgccgcctcaatcctcacatgcccaggattggaatggggcggcaggcggaggtactcagatgccatggggcacaggagagccctgggtgccccagcaggcctcgccggagcagtcgtcgcagcctggccgtcatcggccatgggaatcatcacctgctcaaacagcaaggtggagccatcagccgatctcccaacaaagcatgccggccccacaccctaatccaagccatggatctcagtggggttgaatgcactgccatttaagattccgcttgaggtggtgatggtgtttctctcttgattggctgcatgctcgccgatctgatcaccatgccgtggcagacctggctttttttttttgtggctgctcgtccaccatttgcaaacagcatgnnnnnnnnnncccatgccgtggcagacctggcgtctgtattgttcgtgctgctcgtccaccatttgcaaacagcatggtgatcacatgcacatcgtcttgatcgcaatctttgctccgtgagtcacggcagaactctatggggcacaccctttgggaacaatacgcttggaagtctcgcttgacctgtgcaccgatgcgtacaatttccccaggtcacacagacgtgaacccttacagtttgaagctggcaagtctagtatgttcacagaggatgggacgcaatacatgctccaggcaatcgcatgagatcaatggagatggaatgatcctgaatagaggctggttggggaatacatacaggccaacaaacacgtttctctgtgtgttgaaacatcnnnnnnnnnntcaatcgcatgagattaatggagatggaatgatcctgaatgggggctggttggggaatacatacatgcaagcaaacacgtttctctgtgtgttgaaacatcctcggcattatccaggcactctaaaccgtgtctccagattctccagcgcagaaacctgctttaatatactggccaaccttctgaggcatgaagctgcattacaaaccctatgattgttcacctttgagtcaggctgcaggtacatgggtactcattgccccaacccagtgaatccttgaatggcgataaccccgctacctatattgcgagagttttctttacgtaagttctggaacctctcgcaggcacaagtttagatggtccagatacttgctatgtaaggaatcgggcgcgcgatcatgtggactcggaccaactccccccagctnnnnnnnnnntcagcgcaggaacctgctttaatatcctggccaaatttctgaggcatgaagctacattacaaaccctatgattgtttacctttgagtcaggctgcaggtgcatgggtactcattgccccaacccagtcaatcctggaatggcgataacaccgccacctatattgcgagagtgttctttacgtaagttctggaacctctcgcaggcacaagtttagatggtccagatacacgctatgtagggaatcgggcgcgcgagcatgtggactcggaccaactccccccagctgcgcagttacaaccccccacttagcaatgcatcgtcgataaagacccgcaataagcgaatccaggcatcctttgctgatgagataaccgccgcttgtcgagttgcaagcccagcctgtaggcagctcttggaatgggtgggtgtgtttccactcttgaatctgcgggacaggccaccaatcatgcactgcctgccagcaacgactacgagctggtatgaggggggagtggcgggagatacatctacagttcccatttgtcgattatctcaacgtacaacaatttgctgctgccgcaggtatgccgctcaagcaaggaactcgaacacggtacgtgtgcgatgctcaggcaatcgattccaaaacaaaaaagttccgtttaagcagaatgctgccctctgtgctcacatctacaagccgtgcaccactgcagttctgactgtggggtttggagcgcagggcaagggccttcatgagaaggccacgtatgtggaacagtacctctcacccgtgagttggcaagcacggtttgttgcagacattgagtttgtgatattgtcatccttggaccctgtcaaatttgctcttctgctcgtgcacttgaagatctgagaacaccttgcaccacccctcaacctgcaggatctaatccgcaagatccnnnnnnnnnngtttgcctttctgcttgtgcatttgaatatctgagaacaccttgcaccacccttcaacctgcaggatctaatccgcaagatccgctacttgtgagtgaatggggggcagagcagaaaggggatggtgtggctgtcaagactcgcacgtcgaccgcttgcatatcaattggcgaaggggttgttgagttttgtcagcaaagcatccctccgtggtccattgcagggccacaatccgcaataaactggtgggatgtggaggaagctctgatgctgatactttagagactggacgaatggcaggctaggctctagatcgtgatattgaagctttgaacatgctgttatgccatgtgtgtctgtcttgttgtctgctgatccctcgatcccaaccccttctgccaggtccatgagtatgacttcaactccattcccaaccgccagcagtttctgaacaactttcatattgcacagtctgagctacaggctgccctgaggcagcatggccgcatccagaacgtgccacagccgtcctcgcaattctgtcgcgtccagtgagtgctcggaaggttttccgctggattgtcggagactcggcaccccatcgtcggtctccctgaagcctgcgctgcatccgggacacacacaccaagtcccatggcctgtggtnnnnnnnnnntggaaggtttttcgctggattgtcggagactcggcaccccctcgtcggtctccctgaagcctgtgctgcatccggaacacacacaccaagtcccatggcctgtggttggcctgactctcctgtcagtttaccatgcaaggcaccctactttcccctgctgatatctatttcgcactgaaatcaccgcttgaacttcgaatttgccgctgtcttgcattgcgatgtcacagcggaacctactgtacaaggtcagcgtactgtggtggtgcatcataccatacgagcagggcgtaacgcggcggtcagtcctaagcggtgcatgcacacgcctgagtagtcatgccctgcggttaaaccacccctgcgcagagcccacaaggcgctgcaggatgggcacccgctgcaggatgggcgcagccctctggttcagcgccagccagacctggccaggggtgggagatgggtgcacggcatgtgaggtgggagtggtggagcgattggctgggcctcaacacagtgcacgtccatgtgctctccgggcatgcagccacctggcaggctattcaaggtgctgcatgggggcctccaccccctctgccaacctccgccacaacagccaggttcattcgcccccctccccctcagcccacctgcttgtggtagtgccccnnnnnnnnnntatgcagccacctggcaggctattcatggtgtcgcatgggggcctccacccaccctgccaacctccgccacaacagccaccttcattcgcccccctcctcctcagcccacctgcttgtggtagtgccccgagtggccagactggtagcgcagcttgagctggttccagatgacaaaggcggtgccagcgccgcggaggccgagctgcaccacggacaggagggtggtgaagcccagccccacctcccccgcggcggccgcggtgcgcaggagctccaggcggggctccaccagcgcgtgcacgcggccgaagctggcctggtaccagcgcttggtgccgaagatgcggtgggaggcggcgtcggcgtggagcagggcgtggatggccagggggagcacccccacgcccaggtgccggttgctggacaggatgacggagagcagggtggggaagaagaccgcgctgcctgtgcaagggcagaggggggacgttgggggtggatggagctgtgctggctgggggaggcacactcaccgctccacaggcagctccggcccacacacggggccgtaccagagactgccgtcatccagggcatgatggccgcggggaagggggacaggctgggagtcccgtgctgaaggtacagctgcgggcgggggttggacggagcatgctgagcagcagctactgacgagatggctggggtcagcaggttgcagctcccacaggtcagcgcaccaggctccacgagcgtgcgcccgggacaggggaacggcccccgcgagccgatcacaccttgaggccgttggtgaggagcgagagcnnnnnnnnnntgagatggccggggtcagcaggttgcagctcccacagatcagcgcaccaggctccacgagcgtgcgtccgggacaagggagcggcccacgcgagccgatcataccttgaggccgttggtgaggagcgagagctggcaagtgagcgtgaaggcagagtatgcaagccgtggcaggaagggctggagggagaggatggccatgaggacgagtgcccactcgccagcaatgatgtacacctcggagcgggtggggagcccagggggatcggggcgagcagtggcagcctgtgcgtttgccggcttctcggccgccggcctggccgtcgcgctggcggcggcctgggatgccgcatcagcggcaggcacggcaggcttggccacgctgctgggctcgaagtctggatcctgcggagcaggaagaggatgccatgtgagctgaggaccaggaggagcgtatgtggccgcatggcgccgcacccactctcacgatttcgcgcttgtagtacttggccttcagcttgagcagggcgtcctcggatccggaagggatctcgacgcgagacaggtacgccttccaggtctcatctccttcgaaatcgtactgtctgtgggcggggagagctggtgcnnnnnnnnnntcagcagagacccctcacgcacctgaatgcctcaagggacgccatcttggaagaatcgatttgattaattccgtgcgtgatgagtgtgtcatcaggtacttcacatcgccgcggctgccaggacctgtctcctacacctgcccggtacctcccgagcgcgcgattcggcgctcgggatcgatattcgacctcaacacgttgatcacacaccctcacactctacatgctcgnnnnnnnnnngtggagcgatcacacaggcagagttgcgaagccatcacccgagctcccttgannnnnnnnnnatggagcgatcacacagacaggggttgcgaagccatcacccgagctcccttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcggctgccaggacctgtctcctgcacctgcctggtacctcccgagcgcgcgaatcggcgctcgggatcgatattcgacctctacacgtcgatcacacaccctcacactctacatgctcgagctgaagcccatatatacaacaacaatgcccaaactcacctagtatgcttagtgccaagccgatatggcttcccaaccctcacaggtttggcttcccaacctaggagtttgggccgcttcacatttggcagatccctgcaagaccgagccgcctgcacgcacaattgacgtcgtcgacttgacactggacgacgataatgtcgagactgcagctcatggcagtccagcatgttgcatatgtgcgtgggatggctgaaggggcatgcgtgactcgccaccttttgctggcctccttccggaagccagcgttgcgaccccccttgctcggcctcgatgcaggcctggaagtgtacggggcggaannnnnnnnnntcgccagtcctacgcatgtgggtgtctctgaaactggcaaaatcttccctcacactctcaatctggttccaaccctgaagtgccccatctttgcaccccactgcagtggcttccaggttcgtggattccaagccacagacactctcagagctggcgccaccccccagcgaggagcggagcgtgcccaggctccctgctttgctggaagatagcgccccgctgctccagaggctgcatgccttcttcgagnnnnnnnnnngaggggcatgcgtgactcgccacctttggtggcctccttccggaagccagcgttgcgaaccgccttgctcggccttgatgcaggcctggaagtgtacggggcggaagacaaggccgaggtgcgtccatgtcatcacacattctgctcctcgtgcatcttgcaatggctggagctgcagcggagatgccccctctgcaaccagaccatcaccaaaggtgccccaggagggtccgccagtcctacgcatgcgggtgtccctgaaacaggcaagattttccctcacactctcaatctggttccaagcctgaagtgccccatctttgccccccgctgcagtcgcttccaagttcgtgggttccaagccacagacactctcagtgctggcgccaccccccagcgaggagcagagcgtgcccggactccctgctgtgctggaagatagcaccccactgctccagaggctgcatgccttcttcgagcacgagcggtacagcctggggcgcagaaccacccccgccccgccgccccgcccccgatggggaccaggcagcgttgggcatgcacgccgccaaccggcgccccccgccgcggggcccagcccctacttccagcgcctgcagcgccatgccaggagcatgcgtcagcctgccacgccggcagcgcccggccctccacctgcggccggcacagccgaggaaattcttggctggcgccgggcggtgtacgccgaggggacctggacccgcatccagtggccgctccaagagcggggagtcgagcctcgtcgttcgagggccgagctgcgagcctgggtgctgnnnnnnnnnnggagcggggggccgagcctcgtcggtcgagggccgagctgcgagcctgggtgctgagggagctgcaggtcctgctgccgggcgtggactgcaccctcatcctcaccctggtgctggccctgttcggcacccccgggccccatgcggatgccatccgggctctggactgtttcttgggcaccaggacggcccacttctggcatgaactcaggtgggttgggggaggtttggggaatgtattgctgaaatgggcgggggagtgggtcgctctttgggggcgaggattttcactgccggtttctgcaggacgagggtgcgctgcagagctctctacgtcctatggccgtcccttgcgtccagggttctttcggcctcgcccctgtccctgccggcgcacgatcatgcgttgcgcgccgcccgannnnnnnnnntggggaggtttggggactatattgctgaagggggcgggggagtgggtcgctttttggggcgaggattttcattaccggtgtctgcaggacaagggtgcgccgcagagctctctacgtcctatggccgtcccnnnnnnnnnngaaaggtacgccgctccccaagtcggtgaggcacgctcaagacttgctggcaggcctttggcccagacgacggaagctggagcaggaccatccgactcaggaaggctggaggatgcacccagtcaatctggtggcgcggcgggcaggcttgaagagggcaggcgtgcagaatgcgaggccctcccgccacaggcacatcgcggagtgggacgacggagactgcggagatgggatgtcagccctgggcagcacgtagccatggagaggagcaaggagcagcggttgggtggagacagagagctgcgagagcatgaggaccatagaagacgaaggagatcgcgttcaacctctaggcgacgagattcacgagaagggagaccctgccacagctcaacatcagaaaggcatgcccagcaggggtcgtggcgcagcactcgaccgcgacagctgcctgcccacgggcctggaggtgtttcttccacctcgcgcgctgctggataccatgatccagaggatcggtggcagatgcaaggcatgtctagcacaggcagggactggagatgacgatgcctttgccttcttaccttgaccttgtattaagcactggaggagcagtgtgcctgcagtttgtacaatttatgaatgggagctgttctcagaaagacttgtgttggggcccaaatccagggtctcgattcccgcggaccccgctgggacctcccgaccgacannnnnnnnnngcttgtgttggagcccgaatccagggtttcgattcctgcggaccccgctgggacctcccgaccgacatgccgacagctgatctctgatggttctggagggcatgtaaactcgctccccagctgaccccaagacatgtttgtccaagaataagaactatatattttgaaggattccctggggggttccccatgcggacggtactggtcacaggtggcaccggatacctgggccaattccttgtacgagcactcgacgcagcagcctacagggtacgaggcccgccatgcattggtgcaggaagatccgagaatgtacataggcgaccccaacaccctgcactcttgcaggtggtggctacccaccacactacccgcccagcagctgagaagaccagggtcgagtggcactgggtaagccagtgatagacacagcatgcttcagggtgcaggcagtcgccgggatcctccccgtcacgcatccctgcatccgcgcaggtggacctgacgagcggcgatgggctggccgattgcttctcgnnnnnnnnnngcacagcatgcttcagagtgcacgcagtcgccgagatcctccccgtcacacatccctgcatccgcgcaggtggacctgacaagcggcgatgggctggccgattgcttctcggccctgggtccagagctcgtggcggttgtgaactgtgccgcagcgtccgccccggcattctgcgagcagaatgctgatcatgctgccgcactcaacgtcccgcaccagctcctgaaatccctggcggggctcgctacgacccccctgctcatccacatctccaccgaccaggtgtatgccggcacagggacgcccgctgcagggtggagcgaggactgcaaaccccagcctgtcaacgtgtatggggccaccaagctggaggcagagcgcgtcgtgcaggttgaagccttgagctgccgagaaccccatgcttgcgagccctatcctgatgccaagggcactgcgctggcggacttgctcccctcctggtgaatgnnnnnnnnnncgtcaatgtgtacggggccaccaagctggaggcagagcgcgccgtgcaggttgaagccttgagctgccgagagccccatgcttgcgagccctgtcctgatgccaggggcactgcactggcggacttgctcccctcctggtgaatgnnnnnnnnnncacgcaggagcatgcccccactttacaggcagacacgcctggggcgttcacagccccttttgcactgcccacagaaacccaccnnnnnnnnnnacacgctcctgctcctgcacaaacgactcgcaggcgagctggcccaagcatgtgatcctcaggcccagcatcattgtcgggcccccccctcccttccccgtccaccgcccgctcttcctccaatttgtgctgagcgcactctcacaacaggtatgggatgggttgtcctggggtgggcatcaggctccccgtgcccgctgcacccgggtgcgcaggagcatgcgccccactctacaggcagacacgcctggggcgttcacaaccccttttgcactgcccacagaaacccaccacgttcttcactgacgagtggcgttgccccgtcagcgtgcacgacatcgtggcggcctgcctgcgcctcattgcagaggcagacaagccacgggcgcacaggtgcggtccaggtgcttggttgtcagagctcgcatgcgggacttttgtggagtcgggggtgaccgccgggggacccggccggatgcggcaacccatgcatgcggcatccattccccatagtgaggcgtctccctcttccagcacctcctccagatctggcccaccattcccatgcgcaggctgtacaacatgggcggtccccaccgcctgagccgtgcagagatggccgaggctgcagcggcggtcgggggttggtccacggctgccgtcctgcggcagccagccgcgtccgtgacccgcgccgcaccctctccgcaggacatcgccatggactccagcctgtgcgcggcagacctgggtgtgcacgcaacacccctggaaagcgtcctgcgtgccgtgtgcgcggcagcgcagcctgacccatgaaggaggccgggtggaggcggccatgtgagggtttccaagtgaggctctgggcgtgctcccaggaggctagcccgctgctatgcctcggcttctccatcccgcttcctctgcggcatgcgagtgtaatgagacgtcatttttaacagagggtgtcccagaccaagaaacgcctgcgatatcaacgctgtcaccgccagcattgcctgtgaccagcttgcgcaccttcttctccctcctccgatcccggcggccaacggagtcgccggtcaatcctgcacctgcggaccccgacggcgctgccattgcggaagacaccggtatgcccttgtctgcctgcggtgatgggcacggaacatgctcggcggaatttccaagattggtaggcttaaggattgcagcctgttcaggccgtttcccaccgcgatgcacgccacaggtctgccggggtactcacctctgccagctcaaacacgcctggctccagactgcacccttggtcaagcagggcgcgggaaaggggtttgaactcgaacgtcgcatctgcagagagccctgcagcagccaagggggccagcagcatcccaggacccctgcattgataggggatgtggacaggtgtccaccggccggcaccgcgatcatgggagaagatgcagatgctagctctcctgtttggcgcacttgcgaaactccgtggctccacccattcctctcaggtagtcgccgtgcttgagggccccactcaagactgcattggcaatgcgactgaggttgtgcgcctcaaacaagtcaatatcgccacgcagctcgtcaggcacgactgcaaggggattggagaagctgacgcatgtgaatgattgcgcatcgaggcttgaggggccctccttgtcgtgcaaggccggcgcaactcactcggccccggctgcagaattcgataacctccgtcagccatgtgttggcaaaacaaggcttgcgatgcctggaaaacttcaaatgaaagctgggcctccgaatcagccttcttgacatttatacggtccgggtgcaaaggtaacgacagcggcatgaaacttccgggaggatcccgccgctagcatgccgtgcgtgacgccagatcataataccttgacattgcgcccttgcaacacaggactgaccacgtagtcagtgctcaatttcaaattctttttgagacagaggcgccatggaggtcgaggccnnnnnnnnnngcacataggtggtgctcaattttaaattcttcgtgagacagaggcgccatggaggtcgaggccggcacgagcctggtggtcgtgctggcactgatgttcttcggctccctgctggccagtgccctccccttcatgtttcagatcagggggaacagcatgaaggtggtggcagggctgggaggtggcctcctcctgggcactgccctgtccatcgtcatccctgagggattccactccatggctgaggcaaggggcacatttcgaggatggcagattctctcagagacaggggcgtgatgcagtcatgggatgctgtccacatctatcttcatgaaactaccgatcaagcacggtgtggccatgccctctcatcagcacccccaccttcccccgccgcccaggtggctgaggagcatgggcatgccgggcacgggcatggggccgacgattggtcaggcgccatcctcgtgctgggcttcctcggcatgatggccctggaccggtcccagcccggccacgggcacgggtgtgggggtcatgcccacgaggcacgccctcgcggccggcccggcggccgcgaggggccccccagccccacgcggaagccgggggccgtcgatcccgccgtcctggggctgctggtgcactgcgccgcagatggcctggcactgggggccgcagcactgtctggcaacacgcagctcagcctcatcgtctcggtggccatgctggcccacaaggtgtgtggggtttgggaggcaaagtctggaactgggctttcactgagggtagctgctcacacgcaccctgcaccatccactccgccgtgacatgcgatgcatggcgcatgagcgcctcatgctgtgtcgtgtcgtgccgnnnnnnnnnngtactcagacgcaccctgcaccatccactccgtcgtgacatgcgatgcatggcgcaggagcgcctcatgctgtgtcgtgtcgtgccgcagaccttcagaccaatgtgcaccccctcccggccacaccacatgctcgccaggcccccatggcgttcgggctggccacctacctcataggccgcggggcggcgtggcgcgaggcgcgaggcagcctcctggcctttgcgggggcggcgcctgcctcggccacgctgacgtacgctctcctgtccctcttgcccggcggcgccagctcccccacgcttgtcgcacgcagcctcctggcctcgggcggcaccttcctgtatgccgccacgatgcacatcctgccagaggtgctagcgggtgctgggccagggacggtggcggcgacagcggggggnnnnnnnnnnnnnnnnnnnnnnnnnnnnnnnnnnnnnnngggctgggccatgcgcactgagctgccgtccctgccgcccacctggcttcagacggagactcccttgctggagagcagggtgttgttgattttttttttacaagggtgacattctgtgcagagcagnnnnnnnnnnaagggtgttgttgactgtttctttacaagggtgacattctgtgcagagcaggcaatggccagtttgtccgccatggggcagagcagactggcatgccgtggggggcagatcagagggcgcgcagcaaacggcatttgcagcagtatgaaagtacaaagactagatgtaccatgaccaacccaggcacggccagtcaggtttgggttcgggccnnnnnnnnnnggtatgaaagtacaaagactggatgtaccatgaccaacctgggcacggccagtcaggtttgggttcgggccgtgccgcacatctggcactgctggctcgacatgcgtgtgttggcgtaggtgctgcgagtagtaccgagggggaccttactgagttgtgttcacgcctagtaaatggtcaccaccagaggaagaccccccaagctgcaggacacagtttcacatgtcacctcccaccatccagaccagctgccccccccaaatcacgcaccaaagctggcacatccacgcatgtgcctcgtcctgtgagggcatgttgcgggccgggcggggcctggggtgcttcatggtcatgcgatatgggtcgtaggcgtcagacctcgggcctgccctggcatccctggtgggctttgcagaggtgctggcctcatcagcaccccgccctccagtcttggggttcactgggcatgggagggcgcgcggagctgctcagcaagcacgagctgggcgggatctcacacccatggcagcccctccgtggggaggcatcgctgcaaggctgaggtggaacagaccggcatacaggaccaccaggcccctcatcgaggggctgcaagattccgtcatctggaccctccccctgctcacctgtgtcatagctctggagggccaggtccagccccttctccatctcgttgaccagcttggtgaagtgggacctcgtgacatctgttagccctatcaactgctccctgcacgtttgcaagcagggtgcagcagggagcagattggtgtgtgtggattaatgagtccttggtgttccaagatcacaaaggagccaccagcccatcttgcacagcaccacacggagtagggatgtatccaaaaagaccacgagcaatcaatccactccaagcattgtgccatcatggcccccacaagttccaggttcaccaccccacacggcccaacacctcgggcataccggaacacagcccactcctcgacggctgtctcgctgtgttcgacagtgagaaacacctggaggtccttctctacctgcaaggatacctttgtgagcgctaggtttagggcagaaacctcgccagggcaccccaccgtgcacccgtgacacgcccctggccctcgagcatatcctnnnnnnnnnncccccccccagggcaccccgccgtgcacccatgacacgcccctggccctcgagcatatcctgtgagcgcagccgcccgacgtcaccttgtggtgcagccgctccaggtagtgctccgcttggccctgcacgtttggccaggccttggaattacagaccttgatggaggtgtgtgtggtatggcatggcaaagctcgagtcatccactagccacaagctccagagacctctgccctgggggttgtaaggagtgaccccaccctggtgtcacaacatgatacctgattaaacacaaaaaatctctcatgctgctctgctgccagatcctccttcttgccatcctctttcgtaaacttgtagtagccctcggcatacgtccacttcaggatgcgacggcagtcgatcacctgggtcgacaagcaagcacactgccacctggtggacacactgcattagcccaggtagtagactgccatccaggacccagttccagtcaccgagccgcgtcaaagtaatcttcatcctcttcccaatgccatcatgacaaggcaccccctccacccacctgcttccacgcatcctnnnnnnnnnnctccagccaccgagccgcgtcaaagtaatcgtcatcctcttcccaaggccatcaggacaaggcttcccctccacccacctgcttccacgcatcctccacaaacttgagctgactggagggtgttgctgtgatctcggagagtggttcctgctgcctctcacggaacttgatcaggtgagtaagagcctggtgaggaggtgggggtggtgtaaggtgaggaccaggctgggtatgtggcatggtattccgttggggtccatgcacatggcccacaaaattcagacaacataatgccagagcaaacatcaaggaataggtgagtcaggtcagagtccacccttagatatatgcatgcagtatgccttttcaatcccggtcctctccaaatccaatactccatcctaccttggcttttgcccggtcgttctcggcccatcgctgccagtagtgcatgtaccgttccagggattgcttggcctgttcacgctgcatctcacgctcgtccagctccccattttgccgggccttctggtacctggacacattgtccagtgaagaatgtaggcgccatgcctggcatccctttcaggcagcccatgtgcacgacattcgatcttcccctgcacgcactgccccagacaagacacccacgcacatgttgcagccgtaatagccgcctgtgttttcgttgtgctttctccagtccccgaggcacagccagcagaactcatgccggcactggctgcaggtcatgtgcatgcagccttggttcttctctatgtggcgcctgcaaggaaaggggcagttgcaaggtgagggagtgcaggcaggcgacagcctggagcctgaccgaccatcttcaaccttgtcttcaacggtcttccccaaactatcatccatccccaattctttgtccggctcacttgcagtttggacagttcttggtatttgccaaaatccacgtcatgttctcgctctccttgctgtctcgaataatccacaggttaacagttgagcagtcgacctggtgggaaagtgatttcgtgtcagaaaggcatttatcagaacatgggcctgtctgaaggccacgctctgacactcatggttccttggatgagccattcgctgtctatgtcatgagacacttcagactggatgcccacccctccctcaccctnnnnnnnnnnaattttcgtgtcgaaaaggcattcatcagaacatgggcctgtctgaaggccacgcactgacactcacggtcccttgaatgagccatttgctgtctatgtcatcagacactccagactggatgcccacccctccctcaacctctcaccggacgatgggcttcctgcttgcacttgaagcaatactttgagccgcagtcacagatcacatccagcgcagctgtcactgggacagacattgcctctgctgcccttccacagtctgcaggggcaatgggggaggtagcacgggttcggataaccaacatgacatcccatgcttctgctgcatatccacacgtcacagaagtgtggcctcagggattccagaagagaataggaagctgttgagaggtgccaccggtgatcagtccgacatcaaccaaaatgatggctctccaaaaggatggagtagtcgcaccgttacccaacgcagcccagggtattttggctctcctgcaatgcccaatgacaagggaccagtaccgacagccctctccacagcagcactcggaaacgcacctggagcgggacaccaggtcagnnnnnnnnnngaagggaccagtaccgacagccctctccactcgcaaacgcacctggagcgggacaccaggtcagcccgctctgcatctccacaaaagactccagcaggaacttacgccagcgtgccttatgggagtcgtctgcaaccgcatcgagaatggcatccggaacctgcatcatgcattgcggcgtcgatgaaagatggtgggatgtttttggcaaagggagggacccagggtttgacaagaaggccgttcagtcccagctggccacagaaaggatacaccttcccatacttttcagcagcgatgcccaccgcagcttctcctggcatggagggacctcgccttgctcgcgactccttcaactcagacaatgacacaaggaagctcgcaaagagcccagacctaccagcacgctgcactctgggtcgggnnnnnnnnnngttctcctggcatggaggggccccgccttgctcgcaattccttcaactcagacaatgacacaaggaggctcgcgaagagcccgaacctaccagcacgctgcactctgggtcggggcatctgaggtccagacatttggggcctgactccacagcagtgtggacatacccagtccagcagtccttgcaataccggtgtccacaggcagcggcgtgcatgctggttgcagggaaggtctcaaagcagataccgcactggccctgcttgagcaccaagttggggaagaaaataactgatggcaaatgattgtcaaccaatgctgtattgtcacaggttttggccatcaggatgagacgctctgcatgccatgactctgtagatgaatacacgatgcttatgcctaccagggtgcaaactagatcgtcccttcaatataaagcctcactcatctcacctctgcatcatcctgtcgaggggcaggtgtctccctgatgcctaccctctctttcaccttatctgcgttcgagaaccattcatcctgaagcctcgttgtgtccctgtgttgtattgagccagggcataccgcgcatgagtaagagggatcgtagtgtacggtctgacttcgagcatccgccaacccgccaaccctgcacaccatttgaaggcgtggagcaagcgtgctgcttcgccaattggcatgcagcatagctcagcaatcctgccggctgctgcatcgactctattttgtaatgtggtgttgtctagtgtggtgtaacctccctgttgtaggaggagatacgcattcatattagaaggtgaaccgagcatcagcttgcatcacctgaaaccttgggatgcaagcaaagcgcgcaccttccgatcgctcagtagacccgcgctacccgcatcgtcatcgaagtcaaaatctgcagcttcagatccatagctgaattcctcatcctcgtactccatgctattcgcttgcgagtctgactcgcctggctcggagtcggtcattatggtgaccccagggaatacaggtcatgcaatagactccgatcgatgcaacaaaaggcgagggtgtcgatgattgtcggtgcagtatgctaatcgatcccacatgctccaggggcccaacctagtgatttccctccgatatgccagcttggcgtgatgtgccgtgcggaggggtcacgagtattaagagcgcctgaggcaccaggacgggaacaccaggttcccacagcgacatataattgccgggaccnnnnnnnnnntgtcacgaatatcaagacttgccacacagcgccctgaagcaccaggaacaccaggtcgcctttcccacagcgacatataattgccgggaccgattgctttgagacgctactttggtgcccttgcgcactgtgggccctgttcattggcccgagcctgactcctccgccttcatgatgcacccttagccgacgccgggattgaacagcatggacgagctcaaaaagctgcaatacctttcgctcgtgagcaaaatcaccacaggtacaccacgtggatcggggctagcttcagagatgggtggacatgtgctcgattgccgcgagtctgttgcgtttcaagccgttcgctccgcgacacagttcctgtgtggtgcagtagccaaacaaacagtgcatcctgagcccgagttctcctaaaccaatatcagagctggaannnnnnnnnncgcgtttcaagcccttcgcttcgcgacacagttcctgtgtggtacggtagccaagtaaacagtgcatcctgagccctagttctcctaaaccaatatcagagctggaaaaccacctgggcatcggcgacaagaccctctccgagttcatcatcgagaccagccgtggccagccggatgctcgtgcgttccaggtcgccctcaacgcacagggagcagagctgccggatggtctcccagacagactgtggaccatcatccagaagctgcttcccagcaagtctgcgcaccctggcacgtcccgcccctcggggcccctgggctccgccctggccctgccggattcccgggagcgggtgaaagccatggagcaggagatcattgccgagggggaggctgctcgccgacgggagcgccaggcctcccacggcggcgcctccaccagggacgagcggcatcgaggccggagccgcagccgtagccgcagcagggggagggagagggcgggtcgggaggagggccgtcgggaggcagagcgccacaggacgtctcctgacagacgcggacgctccaggcgcagccccagtcctgtgcgcgaggtcatggacgacgaggcacagctgtacaagatatacagagtgaggcgggtgtggcggatgagaccaggatgtgcagggttgtgagtcttgagaaggacgcatctggtgcacacccctaagagagtagggtgctgtgtgaggccgcatgtatgcatgcnnnnnnnnnnatatgggaccaggacgtgcagggttgcaagtctcgaggagaacgcatctggtgcacacccttaagagagcatggtgctgtgtgaggccgcatgtatgcatgcaggctgtgatcggccttggcccgttgcccctgccgcattgacgctccaccaccaacccctcctttgtccaggggcgagtcacgaatgtcatggactttggctgctttgtggagctgcaggtgagtgggaccacgaagtgaggggaagggggggaagagtaggtcataacctcgttgtggccagacctgtcctgtgactttcggttgcaagcatgttccctgagaacctaactgttcatagaatctgtgagagtgccacaccnnnnnnnnnntaactgcaagcatgttccctgagaacctaggtgttcatagaatctgtgagagtgccacaccgcccactcagctgagcttggcgccgcccccatcatcccatctggatcaaatgtgcagggcgtgcgcgtcaaagcggagggcctggtgcatgccagcaacatctctgccaccaagcgcgggtctgccaaggagctcgtgtctcgaggtgaggccagtggtctttggtgggaaccccagagttgtggacctgccctccagagggactagtttactgtgttcatcttggggtgcgcctgtggcaaccagtgaacctgggttgagacaggtgtgtgtgcccctgctggctgctggctgctgcattccccctttccacatctcaccaggtgacaatgtgtgggtcaaggtggtctcacgcgctggtcagcggctgggtctcgcgatgcgtgacgtcgaccaggccaccggtgaggacctcctgcccatggccggcggggctggaaggggccaacccaatggggccggcgcaggcgccgccccctctgcactgcatggcctgtcaggcatcaaggtgaggggtcccggcttttgcctttgaacatgctgcgcgatgtacctgtacctatgcggcagtcttgtgtcttccagtttgggagcaactctcaatggcaaagtccggggtatgctctggagggtgggtgttgccagggcagtcacaggtcattgtgtggtcggcgaatacccctgctgacccctctacgcacgcggcccccaccctatatccaccctcaggtgaaggacgacggcgacgatgccaagccccgtcggcggggacggcgtatgacttctcccgagcgctgggagattagccagctgatcaagtccggggtgctggacccatcagagtacccaggcttcaacgacgatgagggcacctatgccgacatggacgacgaggtgggtgtggacttggattgtgcacagaagccttgcatcttgagggagatgtctcttggtgggaatgcagcaagactagcctttgcaagctcatgaagggcgtgcagtcttcctcacctccctgatctgcttggctggtggatgtcaaacccttcttgctccnnnnnnnnnnggctcatgatgggcgtgcagtcttcctcacctccctgatccgctaggctggtggatgtcaaacccttcttgctccccctcacctgcctgccggctggttctgcagcccataccatgaccttcctcagcagacaagggacctgagaaccaccccacatggcccaatgcccacccgcaccctctttcccccccacaccacgaccttctccccaacaggtggaggaggagtttgagatcgatatcaacgacgaggagcccctgtttttgaaggggcaatcttccaagtctggcggggagatgagccccatcaagattgtgaagaacccggacggcagcatgcagcgcgcggccatgacccagtcggcgctggccaaggagcggcgcgagctgcgcgaggcgcagcagcgcacgctgctggaggccatccccaaggacctgtcccggccgtgggaggacccgctggcggacgcgggggagcgcgcgctggcggccgagctgcgcggcatcgggctgggcaccagcgaggtgccggagtggaagcagagcgcgctgggcaaggcgccgacctttggcatccgcgactcgcgcagtatccgggagcagcgcgagagcctgcccatcttcaagctgcgcgatcagctggtcgcggcggtggccgacaaccaggtgctggtggtgatcggcgagacggggagcgggaagacgacgcagatgacgcagtacctggccgaggcggggtacaccgcggcggggaagataggctgcacccagccgcgccgcgtggcggccatgtcggtggcaaagcgcgtgagcgaggaggtggggtgccggctgggggaggaggtgggctacgccatccgcttcgaggactgcacctcccaggccaccgtgatcaagtacatgactgatggcatgctgctgcgcgaggcgctgctggacgacgccatgaccgcctactcagtcatcgtgctggacgaagcgcatgagcgcaccatccacactgacgtcctgtttggcctgctcaagggcgtgctggcgcggcgacgcgacctcaagctcatcgtcacctccgcgaccctggacgccgagaagttctcggcctacttcttttcctgccccatcttcaccatcccgggcaggacctaccccgtggagatcctctacaccaaggtgggtgcagggtatgtgggggaagggggggcgagggggggtcagaaacaggagcggggagctcggggcaggactggcgagcttcagggtttttccagcctgggaccgagtgctttgcaattcaagggaccctactgcctctgtagcttacacgcacatccagccttcaatgcgagtatcccaaccactcacatcccccgccgcatcccaacacaacccactgcaggatccagagagcgactacatggatgcggccatgatcacggtgatgcagatccacctgacggagccggagggggacatcctgctcttcctgacagggcaggaggagatcgacaccgcagcccagacgctgtttgagcgcatgaagagcctggggcccgccgtgccggagctcatcatcctgcctgtgtactctgccctgccctcggagatgcaggtgggctgcgggggatgggggacagggtacagaggatgtggggggtggaggcaagggcgacgggaacagtgaggtgggctgggcgggtgatgcaatcacgcagccacagtgccagagtgcagtggccaggggggcagggctctgtaacttgttgcatggtgagacagttctcccaccaggtgcgtcttgcagtcacctgnnnnnnnnnngacaggagatgtggggggtggaggcaagggcgacgagaacagggaggtgggctgggcgggtgatgcgatcacgcagccacaatgccagagtgcagtggccaggggggcggggctctatcacttgttgcatggtgagacagtcctcccaccaggtgcgtcttgcagtcacctgcatgtccactgcacgcggaattgtctgcgaaaccttgcactgacgctccgaccattccctgcgcagacgcgcatttttgaccctgcgccgccagggacgcgcaaggtcgtcatcgccaccaacatcgcgnnnnnnnnnntggaattgtctgcgaacccttgcactgacgctgggaccattccctgcgcagacgcgcatatttgaccctgcgccgccagggacacgcaaggtcgtcatcgccaccaacatcgcggaggcgtcgctgaccatcgatggcatctactacgtcgtcgacccgggtttcagcaaacagaaagtgtacaaccccaaggtgggcagtgaggtgctggggtgggcgccccaagcgtctctgccgcctggtggggacttgggttgggcaggggtcggctgcacacccatagccgaagggctgagccacagtacatccaccaaactcccaccctacagatcgggatggactccctggtggtggcgcccatctctcaggcctctgcgcgccagagggcgggcagggccgggcggacggggcccggcaagtgctacaggctctacactgagatggcgtacaagaacgagatgctgcccacctccatcccggagattcagaggtggcctggggatttggagtgtggtcttgggagagggcatcgggagacagagctgggtgtcaggttgggttctgtgcaaggccacctgatggcaggtcgtgtcagtccccttacactgcagtcccgcacgccacttacctttttcagatccaatctgggactcaccgtgttgacgatgaaggccatggggatcaacgatctcctgaatttcgacttcatggaccctcccccagcacaggtgggtggtggctggtgtgcatctacatgcatggatcatgggagaaggggacaggacagcggcctcgcaagaacaatcacacctcccttgtgtgtgcagtgtggagtgccttgtcaatcgcccattatgtcctcctgcacccccttgaccttgcagacactggtttcggcactggagacgctctataaccttggagctctggatgaggagggaatgctcacgagactcgggaggtgagtggctcgatgtgtgatggggcatacttttgcgcaggtcgtgtcatggggagatgcagggggttgtgatgcccttggccgaagaggtctgtagacgcccatgagatcgccagagnnnnnnnnnntgggaggtgagtggctcgatgtgtgattgggcatacttttgcgcaggttgtgtcatggggagatgcaggaggttgtgatgccctgggccgaaatggtctgtagacgcccatgagatcgccagagtttgagcatgatcgcgaattcattccttggatgtcaggctacccgtgctctacaacacgcccatcccacatctgcaggaaaatggccgagttcccgctggatccacctgtggccaagatgctgattgcctcggtggacattgggtgctcagaggagatccttaccatcattggcatgctttccgcccagaacatcttctacaggtgtgtgtaacgtagctttgtgtgtgtgtttgcctagggatgtgcatgagtatggaggctgaagcttgtgaccatgctacccaagtctaggaacaaggctccatgtgcatagcatccctccatgctttgcttgtgcaatgcgccatgctccgtatgccatccccaccacacacccctgcagacccaaggagaagcaggcacaggccgaccagaagaaggccaagttccatcagcccgagggcgaccacctgaccctgctggcggtgtacgagggctggaagaacagcaagttctccaacccctggtgctttgagaatttcatccaggcgcgctccatgcgccgcgcgcaggacgtgcgcaagcagctggtggccatcatggatcgttacaagctggacctggtatcggcgggnnnnnnnnnnaaggagctcgtgaggtttgggccgcgcatggccatttgggatccagagggcagggagagggcgtgcttgactgggcacgatctggcaggggcttgcaatcgacctgtcctacatgctcaggaagnnnnnnnnnngaggaggtggagagggttgggccgcacatggccatttgggatccagagggcagggagggggcgtgcttgattgggcacgatctggtaggggctcgcaatcgacctgtcctacatgctcaggaaggtggctcgcccaagccgccaaacatcactcctgcaatttcgtgccagggaggaactacactcgcatccaaaaggcaatctgcgccgggttcttcgcacacgccgcacgcaaggacccccaggtgagtcatggctgcacagggccggtgcgcatgtgcctgtgctggattggcagaaagcgaaatgtgaagcatggcacgcactttgcagtgatgcttcagcgcttgattacaatggttgagtatctgtgttgctgacgccagccgcatnnnnnnnnnnaagtgatgcttcagcgcttgattgcaatagtcgagtatctgtgttgctgacgccagccgcatcacactccctgccccccgccatgtattccctgcaggagggccacaagacggtggtggagcatcagccggtcttcatccacccgtcctctgctctgttccagcatcagcctgactgggtcctctaccacgagctggttctgaccaccaaggagtacatgagggaggtgagttttggaaggaggggaatggggaggatgtggcccaggagggtagccttcctgtgtgcagcagcaacaactggtcttgcacaacacttgttgcttgaagctcgctggctgacatgtctctgcgccctcgcaggtgnnnnnnnnnngagcaacaaatggccttgcacaacacttgttggttgaaactcgccggctgacatgtctctgcgccctcgcaggtgactcaaatcgaccccaagtggctggttgagttggcacctcgctttttcaagtcagcagacagccacaagctgtcgcgacggaagcggcatgagcgcatcgagccgctctacgatcgctacaacccacccaacgactggaggctgtccaagcgcaggggttgattgttgtgctgctgtggaggtgaaacgccttgtggccaagccctggagcctcacccgcgctatgagcatgcctgtgcttgtcaatgtaaatctgctgcccctggccagatgattgacacgaggagaattggtgggtctgtccttgctctcagcatgcgcagcacggcctcccttcaannnnnnnnnngactgcccctggccagatgatcgacattgaagagaattggtgggtctgtccttgccctcagcatgcgcagcacggcctcccttcaaactttcgaacagtggaggcgcatggcaggatgcgcgatgccgatcgaacggcttgctatcctcattgacatgacatgaccagtgagcaggacaaacatgaaagagggcattatgtcaaaggcatccgatgcagcgattgctgccattaaggccacccccgttgtcaggtacaagaggtctcggaaaagcgcnnnnnnnnnngttgctgccctcgaggccgcccccgctgtcaggtacaagaggtctcggaaaagcgcccccgcccagctggtgatcgagaatcgagatttgacgccatccaccgccaagaaacatgcgaagaagtcaatcgatgtcacaccaacaatttcgccgccctcggcgcggccnnnnnnnnnncactcgaggtttgacgccatccaccgccaagaagcatgcgaagaagacaattgatgtcaaaccaacaatttcgccgccctcggcgcggccttgcgcacgggttgcccagagtgttcctcccaggaccagcatcgccagcctcgagcatgctgctgcctactttcagcaattggacgaggaggagctggtcgaggaggacgcttctcccacgcagtccccacaaccgccttgcagctttactcccacccctagcttcaccgaaaacgaagggtggggctccagcgagaaggatggactaaacatggacaccccccgcacatctgagcggctcctcgcactgcgctctgagccatacaaggtgaagccgtggtgggcgtgcagctcgaaggtgtgcgcaccggtggaggtttggaacattggtatgcatgtgcagccatgaaaataagggaatctaacatctgcctgaatccatnnnnnnnnnnaggactcgacatggacaccccccacacatctgagcggcttctcgcaccgcgctctgagccatacaaggtggagtcgtggtgggcgtgcagctcgaaggtgtgtgcaccggtggaggtttggaacattggcatgcatgtgtagccatgaaagtaagggaatctaacatctgcctgaatccatcacacctgcagggtaccaccatcagactctccaccattttctcggagctccaagctgctcccatgctcaagtcttagagtagcaaatggctgccgtacaacatgacatgctgctggagcctcatgtggatgcaatccatgcagcttgaactggccccttgatttgtgaagcttgcttacaatgcctgacaggctgtgccatattctgctccaggacttgtagcccttgtacttcttctcaatcatggtctccaccttccaccttgccctggaagacatacttcatcctagatctttcaggtgcgctgaaagcaatgctcctcacccttggctgtcgacgattttcaggacatgaatgtactgctttgttggagtcactctggcagcctgcatgcatgccggggtgggaatggtacagggatcacagcagactgtgctgnnnnnnnnnntccttggctgttgacgattttcatgaaatgaatctactgctttgttggactgactctggcagcctgcatgcatgccggggggggatggtacagggatcacagcagactgtgctgggtccacagcccatctcaaagtaaaaaactgtcaggtcacgatgttccgggcaattcctctggcagctgggtcgagctcttgatgccgcgtgcaaactgtgctccaatcaggcacaccactccaaagaaggtgtagagcaccggcacggaaaaggcgttgacggcaaggaggaaggcctgaccaattgcaaagttgcagatccagtgggtccccatggccatagccatggccttgcctttcaacgtgagggagtcgggccgggtgcttggatcttgctgacagcgagggctgtgatctcgtgacatgcggaggactgctttccctctgcagtcctccagcgggcatgttggattcaggaccctctgccccgccaatgcatcggaggattctcgaaggaagtcccccccaaggaccctccccttcacccgcccacccacgcacacacctctcaggttcacgggggtgatctccggcaccagtagggcgggcacggggcccacccccagcgagaaggagaggatgtaggccagcgtgcccagcacggcaacgtagggtcccaggtgtgccagggcaggcaggcgcatgcctgcggccatgagcagcatggaggcccccatcccaacccagctccagctgagcaggtgcctggggtgccgggtaacatgggcgggcgccgggtgagaggtggacggcggcagcggctaggccgcggcccgcacgggatggagctgacccgctcattatgctctgcccacccaccaagtagcctttgccctccgtcactgggaccctgtctggaccccagcgcgcattgtgtagcttccagtcgacccaacacacctgcgtcccacacgctcgatcacgctcgccgccagcagggagcccagcacgttcaccgtgcccacagccgcgctggccagcgtgccggagtggaatcccgcgcgctgtgacacagagggtcgaggcgagggagacagggagggtggattgtgctgctcgtgcccagcaccctgccaggcacgagcagtaggctgaactccaccactgcacagcatgcaagcctccgtcaccagggcgcacgggtttgcacccaggatgacccctgcaccgcatcaccaggccctacctcaaacaccgacgaggagaagtagacgatggcgttgatcccgctgaactgctggaggaagaagagggccgcacccgtcagcgcgccgcggttggccaccacctcgccccactgcgcgcggtccttgggtcccccgtccgacttggcgtgccctgccatgtcggcctccagcagcgcctcgccacccgggccccacagtctatgcgccgtctcatctgcgagcgcgtgctgcccgctcagccccagccaggagggnnnnnnnnnncacttcaccactgcgcagcatgcaagcctccatcaccagggcgctcgggtttgcacccaggatgacccctgcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttcgggggccaggaacagcatgcctgcccatggtgtatgtgtgtgtgtgtgcgagtgtgtgtgtgtgtgcgagtgcgcgcgggaatgaccgcatggagtgaccctctggagagctgagctacacggggactctcacacccctgcaccgtggtgagcatgatgcaccccctgcctgtccaacccaccagcgccgagcaggacggcggggagggcacccacccagaagagcgcgcgccagttgcgcgtgggcaccagcacattgagcaccagggccgccaggatgccggcgcagatgagcacctggttgagggtgcccagggcgccccgctggctaggcggggccacctgtgggtcggctcgaggatggaatgatgcaggccggtgggaaaggggtgagcaggggatcgagtgctgggccctctgcgttgccatgcagcacatcacacctcggagatgtacacggggacgagggcagaggaaaggccaatgcctgcgccggtgatggcacgcccggctatcatgaaggctggcgaggtggccagagagctgatcaggggcccgatgattaggggagcggcatccagcaggaaggccctgcgtcggcccagacgatctgccaggccgctgccccccaggctgccaacggcggcaaaggccaggagactgctcaccacctgcaagggatcgtgggtcagggcatcgaggctgtagcatgcagtttacagtcccggtccgcatgattatgccctatactggaatgcctcccgtttgcataggcacctcggacccgagaaagtcgcgcaccaggccctgcagagtggcgtttcccccgaacccaagatcggaggcgatggcctccaaggggccgttgatcactcccaggtggtacccgaacgcgagagcccccatgcccgccacgcccactcccagggacacgctgcccgacggactgtgggcaccccttgggccggacacggacgctccaccggcatggtcacccatgggaccggctgtggggctggagactctgcgactcatgtgcctctgcctctgagcgacaccgctcgcaggtgtccgacaagcacccactttgacaagatcagagctgtggacatacagcgcgatctgcgaaaacgtgtcatataccgactttacgttttgtatcgttcggatctgtcttccaacgtacattttttcgttagaatatacgttcctgattcagcagctctcactgtacttttgggatgcttccgccgattgaaacggctgtttgatgatcgccccagataatttacatcacacaaaaatgcagtcagggcatggaccaaagtgcagcgctattgcaggggttgcaaactaggagcatgagctctctggggctcctggaccagacatggtgtcgcctgtggcgcactgatgtaggccaggctgagcgctaatcctcagattctgacagcagtggagtagaatgagcaggtgaagaacaagacatgctttgagtggtcagcctgtctctgtggaggccaaggtctactgagtgcgacgttagtatgcatgcacaagtagggtaaacccttggtgacaactcacctgaccgactgcatggctcatatggaacaacgtatctggaacgtggtctgcgcttaatgatctccaattttgttttgaaggtcttctggctccactcaaatatcttcccgcttgtattcacaccaaggtaagcaatgtgcttctcaacctgtgccggaataaggggctcgatggaacttagggtttcgcctaatcttgagttcagcacacccccgcctgtcacccaccagcaattcaatccaagccaagaaggctagtgggattgtggtgatctcttcttccgggctcgggagctctgagtccttgtggaggtttttgcagctgcacaacatactcctgtacatgtagaagccatactcgtcgtcctcagcctcttcgctgtcatctccggtcctccagattggcggtcctagaatcaggagcagcgaaaggtttgatcgagggcgctggtcaccacaggcgacgtgtgctgttgccaggccgcacattcatgtacgaccctgttctcctttacagaacacatcatcccaatcatgcactccgacatcaggcattgcatccttgtacacttaccattctggatcatgtcaacaatgcgtctggggacttcgatagtccccttgctaattggcacggtgatgtagtcccctccagcctcaacctcgtcccgctcgatgtactcgtgtagcagctcagcaacgaattccgcggtggctgtccgaaagggcattctaaagtccccacggattatctggtggatctgcaggaggttttagtgattgtatactgcgcagatgtaggtgggatctgcatgggcgcacccttaccttattctgcaaactggccctctgaagatcactgtagtttggggggagtagttccttgcatgccttgtctcggacggttctgaatgagaatgttggtccctgtgctgccaggtgcggccacaagaacttgacaacttcctccttctgcaaggacgatgatgttggtgcatgcatgagttgcaagactcgcaagatggtggatgtggcagtggttctcccctgggtaatgccttgggatggacaggcaggccaatcaaaaagcatgctgcccaacccaaatccatgtcaacaggtgcctgccactgcagatagttcatacctcaacagacatattctggtctttgtgtgtgttgatttcgtcctcctgtgggtcagtgacaatctgatcagacggagctgcgtgtcagattttggtgggagcagcatgccagacttaccactttcttcgacagctctggaatctcatccaggcgcttggccatacaggccagtgactctctgaagaatgtgcgcagatcgcgctgttccctcaggatgtcattcatcatcgaaatgagttgtccagaaagcgacacaggaacctgacgtagtgtatatagcagggatcaggtcttatgtacgtaattcacgagcatcatttgattgcaagtgaactcacgtcttccaaagatggtgtttcatgtagctgatggatggctggactgcagaagtccatagccgagtgtggcgattccccgcttgaactcgcgcagtcctcattttgttgtcctcttaaggcgtccagttgcggagaaggacatgcccgttcaatgttctgcggtggtgtgcagagcagctgctccaagtgtactctggcactgcatctgtgctctagctttcgccgaaggcactggacctaccgtagatgcgctcaccctcaatcggctggccatcaggttgctgaacctccctctctgtagtggatatgcagcgtgcgactgaggatgggttcggggaatgctgccataaagcgcacacacggacacaccttatgaggctgcatgtctctcgagcccgtgcacttctgcctacccaagcatacgcaagtcaatgcgtgatcgaaatagggaaacggccatggtgatgacttacaggtggcgacgtttgcgtaccgtcgctgttaaagatcggagctaaaattcaattgcgacagcctgaccttcacgcgtaaatatggcactgcagtagcacatcgtcataggtactggccagtagctagacccaactcaaatttaacttcggcaacgtcgccttggactgcacacaaaagtaatacttcgcaactcactggctcctttcgcacagtctatgatgggtaagccgtcatcgccaggaggttacaagtgcgcctgtcacaagcgctggaaaaccatgaggggccgtgaccagcacatacgagtagcaggatgctcttatttcaaatcaaggcgcaagcctatgtttgcaaaagtgatgcgttggttggaagaggcggaggctcgggaaatgccgtccaccaccgaaccgagtgttggcacttcaggtggcaagggacccttggcgcagccgatcgcccgctcatctggtcctgaggatgcccgcggcctggaactcaactggtcttcggaacacttgaagattctgcccctgacgtgagtcccagcaatctcagagtgtggctcttgtacatcatcagcctgcatgagaacattcgtccattcctcctgcagattgacgcctggccgatgccttggggcgagcaacacctttcagaagatggccaccagtcctgccaatcctatcagcaccaacccaggaccagacgctgacatggttgcatttggaccccctccccactcccaccgtcacagcctacaacaagtgggttgaccttgtcgggcgcgagaaattatcacttgcggatcgggaacgtctgcaggatttaaggctcgggtgaggggcacattgagtgggaccgtacctcactgcttattcgtacaatgtgatagggtcgccctgcttttttgtgtcagacaggatgttctgaggacgtgctgcatggttgaaatttgcactgagcgcgtgttgctgatgcctgcggtgcagaggattccatactcgctgctttgcattcactggagcattccctctccatgcacagagtccagaatcgtatcctcgatgagtttggccaagccagagtgtggaggaatattataaagttcttctcgatggagaaggttgagcacgcaatagagaggctgggccccgtagccttcttcagcactggtccattttagaggaatcgtgtaaatttgaaggtatactccaacttccacaacaacagcaagtcgacggctgcccatcaagtccgtggcacaaacatgcacacacgcactctgctacacacatagaacagagccttgataccctagccccaagtaacccacaaccaggacggtaaattctgttgcctgttcagctcaagtcatgtataggcatggtgcccaagccacaccacccctgcccccgtcccaacccgtcctgtccagatctcgcagcgggcagtcgcacaagcatacgcgcagcggttacacatgccaaaaccggcttctggtctggtgagacggtatcacgactggcttgactgctccatggatagatggccagatccacggcttgcagtgcacccctatgcggaccactgttgtgggggcgggttagaccctacaannnnnnnnnngcgacaccgctatgtccgacacgcacccactttgacgaaatcagagctgtgcagagacccacaggagtggctctggactggaaaatcatgaccctttaggaatgctgagggcgtcaggcatgtacaagggcttggatcatagtagccgggcgaagcgggaactgccccctttgaatagtcagcggacagcagtgcatccgaatcgtgcggcccacccactggaccttagccaccccaaatgccggaattggcttgttggatcaatcacgtttcatagtcgcgtgggcgtgcgtctggcagtagagggagtagagggagcaggtcccgtcacttctccagaagtaggttaccacattccttccatttccgccgagccagataagtataatgggagatagcaagtccagttctttattaattcatgcacctttggatccacgtgattctgtgtgatgggggaacagtgcgattcccccagctgcgcttggagacaaccagggcgcgccgcgctagggcaggcctcagtgtgggtgtgaaaccagaatgatatgcggggcaggccctaaggtgcacttctattgtgcaacagaaggattatatcataaagaaaggcgcgcaacctgcaaatttcccatcggtctgagaaccctaacctcattacggccgcacccgagaatccccagaatggtaaactcggccatatgcacgaagcccctgcccgcaccaccttcagtggatgccaagctcttcaagagcttcggcgtggaggtggtgtcggggtttgaccccaccgactttacccccgagcaatttatcgaactggagaggctcctgtacgagcacgatgtggttctcttcaggggtctcgacctggccccagagcaccagtacaaactcaccaaggcctttgaccccacttgtgagtcatacggccacggcaacaaccaggtgagggcgtgtgtgggggggttttgcagccagacaaccctgctgtgggtccacccttgcaggagtgtatctttcatgtagacccttgggtgtgatcctgggttagggcatgcacgcaaaggtccctttcgcatggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaggcaaagtccgtgctgcacccagacctgaagaccatccccagcgtgccccaagtccagctgattggaaacgggatcgtgcacgaccactggggcctggccgaggccaagctcaagcacccgcaccatcgtaccttccacaaggaccctgtgagcgaggaggacgaggcggcgggggccacccgattctaccgctggcacatcgatgctgccctgtacggtgacctggccccgcccaaggtggacgagggcgagggtggtcctggggtcctgctcgggaacacccatcctggggagggttgcaccctacgacactgatttgtatcaagaaggcgctggtgcatgttcacaacgctaaaatctcgattgcatgggccgctgtcgaggttcccgctcggacagaggcatgttgccctcagcccgctgcnnnnnnnnnncgaacacccatcctgggaggggttgcgctctacgacactggtttgtatcgagaaggcgctggtgcatgttcacaaggctaaaatctcgattgaatgggccgctgtcgaggttcccgctcagacagaggcatgttgccctcagcccgctgcggggcttctcgggctctgcacgccttacctccctccccttccgccctcccgccgtgagcacccaggtgacctccctgtacgcagtggctgcccccgccggcccgccccaggtctgccggtacgacgacgggaccggggacgagctcgccgtccccctgggcactaccgcctttgtctccggcaccaccatgctggacgcgctcccgcccgccctgcgcagcctggcggtgcgctcctcggtccgctacgccccgcatccctacgtctggatggcccgcgcccacgcgctgcccacgggcctgggcctcgaggacgaggggctggaggtcccccccgaggagctgcccccctgggacccccgggaccagcagaccctgcccgtgtgctggcgcaacccggtgacggggcgcctgcacctgcaggtccacccctgcgccatccaggccctggtggtagagcctctgccccccggcgcggcatcccgaacgaccgacgccctctaccccgacggcggcgaggtcaccgacctggccgaggtgcggcgcctggtctacgcgctgcagcgcccgggcatcgcgccggggctggtgtacccgcacgcctggtccgacggcgacctggtcctgttccacaaccggggcgtgctgcacagcgtggtgggggccttccggcccgaccaggtgcgcaagttccaccagtgcaacctggccgccagcgacctccctgcagggcccacgcccgaggacatcgccacgtacgcgtgagtccggccccgcgggtgctcgccatgtcgacgccgcgcaggcgccccgctcgctgtaccctgcctctgagatggtctgggttcccgcttcgccctgcacctgtacttgtatccctgttgctttcagatccttccgnnnnnnnnnnttgctcctgagttggtctgggctcccgctccgccctgcacctgtagttgtatccctgttgctttcagatccttccgtgcgggcaaggcgctgactggcaggtcggaagcttgcacgctgccgtcatgcaatgtagaagtcaggatgcatggcagccccatctctcgggatgcctgtgtgtccatagtgcctcccgggcagccagcgctgtcgttgttgcaccgtcaggcccccctcattgtgctcaggactccttgccccannnnnnnnnntggcagccagggctatcgttgttgcaccgttaggccgccctcattgtgctcaggactccttgccccaggtcgtcctagcccctcccactcccagctgccttcttgaaacagtttgaaactcatatagctcggcgtggataggtttgtagaccagcatatggggaggtctggtctgcagatggatcttgctctacccccaaatgcatgctgcagcacaacgcccagaactgggattcgctcggattccccttatggcacgataataacacagcactcgttattatagcagatccgagggcaaaactggcatggcaaggggtaatgggcgacagatcaaataactcttcaaggacatcaactctctggcagctgcaaggaaagcggttcacaccgtggcctgacaaggtggggtgctagcagcagcggcgcaccagctcacgccgccgaggccaggaacacttggcgtccattggtcggttgcagggcacggttgttggtcctgctgccgtgcgtggtggtgcattctgctgcggtcattccacctccgctgtcttcatctggggagcacgtgagctcgcgctcctcgggatgcgaggccnnnnnnnnnngtctgctgcggtcactccacatccactgtcttcatctggggagcatgtgagctcgcgctcctcgggatgcgaggccaacgccgattgcagggcctccagctgtggcaccgacagaccctccatgggatcggtgaagacatgccagctcacgccttcccagcaaggcggcgccgtgagtgatccctggtaccaggcatagctcgagttggagggtatgagcgtgttcaggtcaaaggtggtgtccaagaatgttgcgtcctgcgatatggcgtgggcacaagtgatagggaggccagggagagtggattcctttctgcatgggtcagggtcgtccagaggtcccctttcacccagatctgaacgcaggggtcccctctcacgaatcctcacctgtgcgactacgtcatcctgggagggaagactttctnnnnnnnnnncggccagggagagtgggcttctttctgcatgggtcagggtggtccagaggtcccctttgacacagatctgaacgcaggggtcccctctcatgaatcctcacctgtgcaactacgtcatcctgggagggaagactttctacgatgccctccatgaaaggcacagttcctgtgaagacatcgtctgcgttatactcaaacgtgacgccgaacaccgccaggcagatgttgttccggcagtacctcggcaccggtgcgtccgtctcgttgtccaccttcgtgaccaggtgcagctccaaggggcacatgaagccgtccactatgtgctcgcatgtagaatgccaatggaactggaaaggtttgacgggaacggaggagatgttctccgcgtcggacccccacatgccgttcgtggggatcacggtttggctgccctcgaggtcgtcccattccacctgtgagaggtggagtgaggattaggggtggggcctgatatatccatctggaacaaaatattcggcttcgaagcccttcctggctccaatggccctgcccgatgtcaagcgtgggagggccccatactcgccgtccgccaggtcgacgatgatcggattcggcggatagaggaaccggcggggaccggataagacccagcctacacataaccaaaaggtgacgacgcacctggattgcggtcctgatgttgaatacgcggagtccctttgccttgccaaactcgaacgagatgggggggccggcgaatggggcagcagcagtcagctggatggcaatcggggactgtgccctgccctccttgcaggtcccgggccagtcggcgccattgaggtcatagttccaggcggaggtgtcggactcctgtgaggttcatgagggcagtcggggaggatcggaagcagtgaaccaggagcatggagagggggggcatgtgacctgccggagatgaaacttatccagtccttatccagccctcgacgcatggcgcgtaggcaaaggctatcaaatgaagagagtgtggcatggagtggattcgagacaacgagctacgccgaacgccggcctgctgcccccgctaacctcagcgatgcgtctgcccttatggaagtgctgctgaccgcagccggcggtcagcggtaggacatcgcccagcgcaaaggcaatacataggatgatgcatgagagtaccatgatgccaactcaaggtcaccgggctgacttctgtgaacccggaaagactttggaagtcttatgtgccgagccatcacctcgcctgttccaagaaagtcggcgcagctgacgtgaatcatcagcgcgcaatgtgccatgcagcgagtcaggccgtgaggcgccccatcgctgaagctgatgacgctatgcctaatttnnnnnnnnnncaagtcttatgtgccgagccatcacctcgcatgttccaagaaaatcagcgcagctgacgtgaatcatcagcgcgcaatatgccatgcagcgagtcatgtcgtgaggcgccccaccgctgaagctgatgacgctatgcctaattttgttccaacagaacagtctcatgacttccctaggtgtcaattctacaggccacggcacagggttgccacgtcggcccgcaagatgggattgccggttcccgccgttttatcgttccccccagaatgcaattggatccttcatgcgccgagtagcacctaagaccatgggatgcagtctcaagagatgaaattggttgtcgagatggaggtcaagttgggctgtgggtcagcagtgtgcatcgtcggcacctcatcgtctccttcgcgtagcggcaggcgggctgttgtgggggttccccatgaccgggccgtccgcctactttccacctgttcccgctctgccccacgtccacgcgtccttgcgacgcctatgaaacccgaccatcnnnnnnnnnnactcggcccacaccgcgggagaagcggggttactaggccacattttgggggagccc

SEQ ID NO: 41922 - DNA, 70 bp, Chlorella protothecoides
gcgcaagtggtttggcggctgggcagggcgatgagaaggtcgtgcagggcgccgagagggccgtgcaggg

SEQ ID NO: 41923 - DNA, 68 bp, Chlorella protothecoides
ccaccatggcgccagcgggcgttccaggcgatccgattgcagcaccaggtcctgcggggactgctgtt

SEQ ID NO: 41924 - DNA, 61 bp, Chlorella protothecoides
gggatggcggcggctgcttcttgggggaagacggcggctgcttcttgggggaaggcggcgg

SEQ ID NO: 41925 - DNA, 61 bp, Chlorella protothecoides
tttgcaagaaggccttttagagcgtccccgccgtaaataaccacaacagctaatactacag

SEQ ID NO: 41926 - DNA, 97 bp, Chlorella protothecoides
tcagtgtgcacatggcccccagccactgaagcccccctccctcctttccacccccccttgctgctgcctccaggtgggcgctgaagtttgacaacgt

SEQ ID NO: 41927 - DNA, 63 bp, Chlorella protothecoides
cggccttggagaccaaaatgccgattcattgctgcttgttggtacccggagggctgcgacatt

SEQ ID NO: 41928 - DNA, 64 bp, Chlorella protothecoides
ccacccaaaacggaggctgcaagggtttctgggccctcgacgccctctgccaaagcctccaggc

SEQ ID NO: 41929 - DNA, 430 bp, Chlorella protothecoides
  modified_base (127)..(366): a, c, t, g, unknown or other
cggggcagacagcgtgtgcctgccaggtggagtgacgccggcagcgcagccggtcgcgcctcatcgcctcatgcgcccccctccactccccagggcggcgcgtcgtccccgcctcctacgctcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgtccctgtcgagagtgggggggcagaagcacatgggtgggctcccctcagtccagttccg

SEQ ID NO: 41930 - DNA, 61 bp, Chlorella protothecoides
cggggagggtgactcctcggggctggggcttggcgactcctctgggctggggctgggagac

SEQ ID NO: 41931 - DNA, 61 bp, Chlorella protothecoides
gcgagaggtgacacgtatgcttctcagaacttcccgcaccctcttgcaggcctcgggtttg

SEQ ID NO: 41932 - DNA, 61 bp, Chlorella protothecoides
cctggacccgccacgacgcgcccgcttcgcccgcggcgcagcgcgctcctcgccgccggcc

SEQ ID NO: 41933 - DNA, 92 bp, Chlorella protothecoides
atccacccagagcccacagaggacccagctgcaggcctcctcggcctcctcgagccctggagccgcaccctgcggcatgatgagatgcaagc

SEQ ID NO: 41934 - DNA, 61 bp, Chlorella protothecoides
cgtcgctcacgaaacatcgtcacggcaggggcacttgtccagtcccggcagctgcttcgtg

SEQ ID NO: 41935 - DNA, 135 bp, Chlorella protothecoides
gccgcaggctctgggcagtgctacctgcaatgttgctgcacgatggggtttgcggtgcaacaaagcccaacctttagctgtctgtgggaagagggtctacaaccagaatcgatcgggttttccaccacctctctt

SEQ ID NO: 41936 - DNA, 102 bp, Chlorella protothecoides
tccagcccaaggacactggccagccgcgccgtacacctaaattctgtacaggcttgccgccgctacgccgatgtcagcgggtctggcaccgagacgcaaacc

SEQ ID NO: 41937 - DNA, 61 bp, Chlorella protothecoides
ggcagactgagtaccgagaggatcacccaacacctccccttgtcacggggatctctccccc

SEQ ID NO: 41938 - DNA, 80 bp, Chlorella protothecoides
gttggcggagggcaagtgcaggcctgggtcgacgctgcgggccccctcatccacgcccgtctgctcccgaccccgcgctg

SEQ ID NO: 41939 - DNA, 66 bp, Chlorella protothecoides
aagcatggcactctggcttcgccagttcaggagcaccctgctgctgctacttcgatgtctgggcag

SEQ ID NO: 41940 - DNA, 61 bp, Chlorella protothecoides
tggcccctggcctctgagcaaacgccaagcaccgccgcccctcgccctcctgccacagtgg

SEQ ID NO: 41941 - DNA, 61 bp, Chlorella protothecoides
ccatcctcgtccacgtccacctcgaactcctcccgcttgctctggaggcaggcctccaccg

SEQ ID NO: 41942 - DNA, 77 bp, Chlorella protothecoides
tctcctcctgcgatgggaagggccgcgagggtgggaattgacgtaggagaggctgaccgaggcgcacatgtgtgggc

SEQ ID NO: 41943 - DNA, 61 bp, Chlorella protothecoides
ggttcggaatgcgtaccgccgagcgtctatacagccggagaggcacggtgcctgggattgt

SEQ ID NO: 41944 - DNA, 107 bp, Chlorella protothecoides
tgtcggcaagaaggtggccagcggagggttcgggacggtgtacatggctgagatgaaggaccctcgccaccctggagagacccggtgagtgggatgctggtgtgggg

SEQ ID NO: 41945 - DNA, 3625 bp, Chlorella protothecoides
  modified_base (133)..(224): a, c, t, g, unknown or other
  modified_base (1122)..(1131): a, c, t, g, unknown or other
  modified_base (1698)..(1707): a, c, t, g, unknown or other
  modified_base (1913)..(1922): a, c, t, g, unknown or other
  modified_base (2057)..(2066): a, c, t, g, unknown or other
  modified_base (2589)..(2598): a, c, t, g, unknown or other
  modified_base (3328)..(3337): a, c, t, g, unknown or other
gccggccagcttccgggccggcgggccagcggcgacgctcgtgcacgctgtagggacgggccccgagccctttgcgacatcgccgaaaggggcctcggccgcggcgctgggacggaaccgagcggcgggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgcgacgagggcgccgaacgccgtcgccctcgcgcccagcccctcccccgcaccgcccagcatcccggggttccgcactggcccccaggcctccccggcggccagccccgagcgcagccccccctcgtccccgcaccgcgtggtgctcagccccgccagctcgctggcactccccgccagccccttcgcctcgggcgaggggggtcaggaggccaggccatccctgcgcaccccctcgctggtgggggccatctccctctccggccccctcgccaccaatgcctccagtcagccgctgccggagcagggcagcggcgaggcgggggcggggccacgccgctttgcgaccacggcgtcacccgtgcggcgttgggcgtggcagaaccggggcgcagcggaggcgtcttctccacggagcgccatgcggccagagggctccctggaggatcccgctgcgctgccgggggccgccgtgtcctctaccccggagcaggaggagggggaacgggatctcacggaggaaggggagcagcacagcggcgcgcttgcaggccaggcaagtccagccggtcttcccacggcacccgcgccgtcgacggcggggcgtgatgcaaaggggccggtctccgatgggtccagagccgagctggtctgtgtcgcagccctggaggtgagtggcacggctggcacctggcctggctgctgtgcctggtagggaggtggcacgctgcttggcaaggtggatcatagtgcatcgcgcacacaatcaccctccaggcgtgcttacactgggttcctttccgcctggggagtatccacttccagtggtgtctccacatcgccacgttcagcttctttccaacatcagatcattcgccggcgcaggcgggcgtgnnnnnnnnnnagcagcttggcaagatggatcatcgtgcatcgcgcacacaatcgccctccaggcgtggttacactgggttcttttccgcctggggagtatccacttccagcggtgtctcaacatcgccacattcagcttctttccaacgtcagatcattcgccggcgcaggcgggcgtgtaccggattggaggcagcggcacattcctcccagagacctcgacctcgcgctggtacaggcccgctcggcgcctggcgcgcacgctgtgcgcgctgcacgcgcccctcgaccttgcattcgcagaggaagcgaggggtgccctggagtcggcgctggcaagcagctggcaggacgctccgaggtataggtgctgtcccatgtcagatgctcatgcgtacagtggggacccatctctgtggtgatctacctgggttcatggaaggctccatcaacatgcagctgcaatcgtggcggcatgtgcttggtctgtgcacctgtggtggccatgtgcgtggagctgctgaggcggtctaaatctcccaattgacgctgtgcctctaagatggccatcagatgnnnnnnnnnngtgcgtacagtggggacccgtctctgtggtggtctacctgggttcatggacggcttcatcaacatgcggctgcaatcgtggtggcatttgcttggtctgtgcacctgtggtggccatgtgcacctgcggtggccttgtgcgtgcagctgctaagacggtctaagtttttcaatcaacgctgtgcctctaagatggccatcagatgnnnnnnnnnngcgcattcagggtttggatggcacatgcggggtcgaggaatgtgctgcgatgccttgggtggctgctgcgttgcacacttttggtgtgatgatgccaaagcagggtgtcttatgccccctcttcgacccccgcannnnnnnnnngcctcaccggtgtcacagctggcactcctagaactggaaaggacggcgtacggggccttgcttgaactggcctggacaggggcgctccttcccggtgagccggtctcacgcatgcagggtttggatggcacatgcggggtggaggaatgtgctgcgacgccttgggtggctgctgcgttgcacagctttggtgtgatgatgccaaagcagggtgtgtcttatgccccctcttcgacccccgcagcagccgcgagcagtaggtcgagcgctcatcgagagacagacagggacctcaggatgtgggctggtcactcgaatggcaaggagagccggacaagctccctgggacatgcctccagtgactcccttgacctcgtcgacgccctcgtggtgcgctgtgcttccagttcataacagttctggctcatgcgcatgtgtcttcctatcaagggagggtatctccgctgctgcagggtgcgcatcggaacccagctcccgagtgcaaggctccccagcacctccnnnnnnnnnnccagtttataatagttctggctcatgctcatgcgtctttctaccaagggagggtatgcccgctgctgcagggtgcgcatcggaacccacctcccgagtgcaaggctccccagcacctcctctgcaccatcccatcgcccgtcaggcacccgccgtccagcactggtgcgccggactggaagctgcacagcagctgctctgcggactggcgtgccccgagcgggcgcggcgccagatggcgctgctgggaaggagggtcatgctgggcctgctgcgccgggtggatgccgccctgctggagagcctgcaggccaccgagggtgagcagaatggtgaagctgcatggggcccgggtggccacgcagacgagaggactctgcatcagcgaacaagaggaggctctccttccggtgcatcaccgtgcccctcccctcacacctcccggcggttccatgcagagcggagcggcgtgcggcgcaccgacccgctgcgcatggaggcgcgggaacagcaggcagggctggaccccgccctgctccccttccccaggtctgtgtgtggagggagtctggcgcgctgggcgtgacgcctggtacctggggcattgagtgggtggtgccaggcatccatgcagtgcggggggggggggttcatccgacccctggcccatgccccgatggtgacactgggtgggcacgccccgctccctccccgtccgtcccacccagccnnnnnnnnnntccgaccccttggcccatgccccgagggtgacactgggtgggtacgcaccgctccctccccgtccgtcccacccagccctttcccacccccaaccaccgcgctcccaggtgcggggcgctcacctgcggcacgggcgtcgcgctgaagctgacggcctccgccctggccggctgggcgggggaggcggggctggggcggcgcggcgacgagcacttcccgggcctgagggccgcagccaatctgctcatgatgcccaaggaggtggggtggtggaggggggtgggtgg

SEQ ID NO: 41946 - DNA, 11430 bp, Chlorella protothecoides
  modified_base (223)..(283): a, c, t, g, unknown or other
  modified_base (9818)..(9864): a, c, t, g, unknown or other
cttgacatcccctccctccacccattcttccattcttgcagcgccatgaccgcaccatgtctggcctgctggacagccgggtggcgctgaagagtgcactggaggacaacgacgcccacgtgaagaagcaggagaccacggccatggaccgccacttcagcctgccgcagccctcccgctccagcaaactggtgcgtggaggggggggggggggggggggaannnnnnnnnnnnnnnnnnnnnnnnnnnnnnnnnnnnnnnnnnnnnnnnnnnnnnnnnnnnncacgggttccttgcgattcagcctgaaaaactgaccctgctgatgggtgcgtgccactcgcatgctagtcatacaagtatgagtgcagaaaactcaacgccaggccacccacacatataatacacccttggctccaccccgcataccaccacagcatggccacgggcccagcaacctgcagcccatccgccgcaacatcagcggcatcagcaccgacgacatggcactgctgcagagccatggggcagaggcacccaaaccaagtgagttggtatttcgatggcaggcggagggagcacgttgagcggagctgatgggcgcttctgctctggtcgcatgtgaatgagagatttctcgtatggtcactactccaccagctcgcgtctcccagctgcctccttcaacgacttcctccctgctaccgctcgcacccccaccacagacaagtctcccgccggcatcgagcgcgaccacctggtcttcttcagcctggaccacgaggcatgtgttggtgacgtggcggctgccatcctctccctccagaagaaggtggaggccgctggcgccagcgtgggggcgggcgtgctctccatgatgggcttcgagacctccaaggccctcctccaggtgcatggattagtttggatacaagtgtcagaggatgggagatgagggtgcctgaatgcccgacccctacattctgcttgaacagcgtggtggacaacatagtcgacgcagacactgggagcaagccagggtgcgcatgcatgcatgcaatgtagaaacagagcctcctgagaccctgcgttgaagcagaataattctcacgattgccgcaagctccctgtccctacagagggaaggcgtggacctggagagcatcgacttcatggtgtgcaacagcggcgccgacacctggcaccgcgcagacaacggggagtgggacgccgacgaggggtatcaatgtgagtggagtttgggggttaggaaggtggcgctgcttgtttgaatggcaatcctcgacaatttgagattctgcatagagactttggtgaggttttctaggtcgcttgcgttgccaagaagtccccttcccccatctctgtcacctcacagccctgatcgagtttgagtgggaccggacctccttgtaccgcaccctgcggaagatcgtgagccgccctgcgcctggcgacaactccaaggccctgcccagactcaaggtgggtgtcggtgctggagaagatgggtgggagccacaggttgctgtccccttgagacctggatgagggcaacgagtcatgtatagctcccggccctggtgacaacagcatcagcagggagttgcctcgcgctccatgcctgcctggcatgcggaacaccacgggagctacagcgctcggcacccgttgcgggctcccagcctgctgcctgctccgctccccttggccaagatcatctccaatcatattcgaacccacccacacaccatccctcaacccggaatcccacccacaggagctcctgtacaatgtggtggaggcccccgaggtgggcgtccacccgcgccacttctgcatcgagctggacccggagacacagtccatcctggccgtgggcatgggtccgcgcgccaaggacaccaagggcgtggccctggccgccaccgtcaccgaccgcctcaagcgccgcctgcgcagcaagggcttccgcgcctcctacaccctgcagatggtatgtgagggtttgtgggggttaggaagagaagggctaccttgtgtgggggctggttaccttgttcactgccggcttgaatcaagtggccgaccctcggacaccgagtgagcttgcgtcctcgcgagcggccccggtccacccccacaccccgactcccgctctgctcatggcccattccgcgctgtcctcccctggcacagatccctcgcggctccagccacaccgcggcactgcacatcacgcccgtgagggccagccgcgcgctggcgctgcgctttcttgcccgcctctggggcaacgacctggagagcgtgaccgtggtggccctggtgccctccacgcgtggcgaggaggcaaaggccatgacggtgtccagccacaccaacgacctggccgaccttctggccggaatgcagcgggtgagtgctggtccttgcccccatggcactgattccctagagggtatccagccttctctcctaatggcccacccaagcatccgatgtggcttgaacccccccttccccttctgcaatcctccctctacaggcggtggtggtgccggtggagtccaaggacaagctgccccaggatgagctcctggaccagtttggcgtggacctccagccctgggcctcctacggcgaccgcgtgagcgtgcaggcaccggacagcttcgcggacacgctgctggccaagctggccaagtagtgagcgggcgagggggctccaagctctgcccagcccggggtagaagcgtgctgggacgagggctgcgacgtgctggccacttggcgatcccccacagtaccaggcccctgcacgcatgtgtgcctggggtcggccggtgctcccattgcggggagcaaaacttcccctttgagaataacaggcccccatgcaatgcagtagccaccccatggaacccacttgatcttcacctctttatacacctttcaaacaggcccccaacaccaaccttcaccttgtctgcatccttgtattctctccccctctgtactggtttccttttgaaatcgcctgttgtgatgttcctgtgtggagagtgcaacaaggtcagcgcgcgcgcgcagttaccatgcgcagggcaacttgtccgcagtaaaggcagcaccatgcacaggtagcaatacgaacttcaaatggtatacatgctgtaaatatacttgtcttggacatattcctggctttgaggacagcgcgatggcaggtgtgctaaggacggcctgtcgggcagcagctgccttcaccagccgaggggctttcgcccagcagctgcgccaggccttcacgagcgccgttgaggcacctacagtatgggtgttcctgggaccaccggtaagatctcggcgacctggagaaggggagggccaacccgaagcacgacgcgtcaaccatgactaaccttgccacgctccccctttcccacgtttagggcgtgggcaaggggacctactctgtccgtgtggccaaggcttttggcatggaccacatcgcagcaggggatctggtccgtgcggagatgaagagcgggagccagctgggagcagaggtaggttcccctgggggtcctgcagcacgcgctcctcgatgcatctgtccggcagcctgccgctttgatgaccgcacgcatgcaccaagcctctgccacattgcgtgctcgcagatgaagtccatcgtggacaccggggccctcctccccgatgccctcatcctgaaggtcatgcgtgagcgcatgcgactcagttcctcccgcggcatcacctccttcctgctggacggcttccctcgcaccgcggagcaggcggatgccctggaggagataggtaacgtccagctcgctctaaacctgtccctgcggcaagaggtgcgtcttttgggggtgattctgctagattgggggtggaatggccgccaactggaactggaaaggagggccgaaattgaactgggactctgatctcaggctccaattttggccccctgcgccatgccctgcatcctgccactgtcaccgctggagggtcttggtggccccccagttgtcagcccccagccctctggcccatgctccttcctctccctccccccttctcaacaccccctcagatcctggtggagaagtgcatggggcgccgcatctgcaaaaagtgcgggtccaactacaacatcgcggacatctacctgccagccacggcggatcagcccgaaatcgtgatgccgccgctggacccgccgacggcttgcctgccgcacctggagcagcgcagcgacgacaacgagccgaccattcgccggcgcctggaggtctaccacgccgctgcgcggcccgtggaagagttttacgctgcgcgcggcacgctggtggactttgagatcacgggcggcatccccgagacgctaccacgcctgctggaggtgctcaaggggctgccgagccagcaggaggcggcggtggcctgagcgattctggtaaaacaacttttccttttgtttcacgtcgaactgaacctctgtagacaaagaaattgagcctggcatcgggtggagggactggcgagtacactgggggcagaggaaggcgatgcatggagggcaaggaccgtgcatgcaccagagccgcctactccttctgcttcttcttcttcagcttctttttcaacgatttggccagctcagccgcatccgactcctgcgcggccggcggcgccgcctccacgtcacgtccccgtgcccctgcctcctccttgggcgcgacaaattccgcctcccgtttccgcttccgctcatccgtcttgctggcctgggccgcggacttggccatgcgcgcgcgcgctgcctgctggtccttggtcaagaagtactcgcccgactccagcatccggtccaccttgctgaggggctgggcgggggggaagggggtgtagggcgccttgggcttgatcaccgccgctctccgcttcacgttcttcttcttgaagttgggcaggaagcggtcccagttctccgtggccaggttggggtccttggccagctcgcgcttgatcatcagcgtcttgatgtggtagatggggtggatgttcttgatgcagtcctccaccacacgacggacctgggggatttgagtgggagggtgagtgttgtttttgttgtgtgtgggggggggaaggagaatctgcagcttagcagccctcagctgacaagttgcagccccgaggggagcgtcagccaaagcgccaggcaccggagggcgcgctcaatgtggcgcacggggaagctccgcacccgcttgtccacaatgcacatgtctgtcctcattctaccagtcgtgctccgcgacaacttccgtacctgcttgagacccttccagccccccatggccgccaccgtgttgccctggaccaggatgaagcagccggtgagcagctccagggccttcagggttgcgccgttgggcccgatgaggcgctgtcgcctcttcgtgaacttctccttgttccggataaggcccccgatcttgatgatgtcgcactgcatatcatcctccaacaccttcagggcctgtaagaagaaagagtgttggggcggaggggaaactgtcttggcaaatagccccaggaggacccaggctccttgtaaatgtgcatgcaccatctacattgcacaggtgagtcagctcaagcggctcccccaggtccagggatgccctccgtgtcctcctcaacagcctccacccagagcagccctgctgcatcctcacctggggcgcggggacgctgcgggccagcagcttgatcacgtcccgggccttgaggatgatgtagggatcgtaggtcttgagcgtggtgcgcacggacatggagccctccaccagattgagctcgcatgccacgccatgctccttcagggcccgggtcacggctgaccagacctcacgcaggtacttttctgtgtcaacgaggggttgtacgggtgctgggagcttgcttctggcaatgtgagcctgaaccacacctcctgatgatgggatcccgtcagcgcatgacggcccagccagttccccaaagcaagctcacctctatactttgggaacagggtcgcaaaggcgctctcctccagaagaccactcggattctcctccttcttgaagggttgcacttcccagtggttgatgccgtcatggtcccatggcttctccttgcgatgctgcagggaggtagtgagaaagcacacacggggcatgagccgtggccgacgctgccgtacacgcagcatactagcagcattgagttctaccgagtagtaaattccttatcccagcctgtgttacctttcccttcacgcgcggccccctcttgtcctcaaaggtgtctccgggcttctcctccgccgactcgtccgacatcggaactttcctcgcttcagcaagcagtggaactcctgtctcagtattttgtatcaaatttagttatgcatgtaattggtgtgttgcgagtgcatcgtctgcatgccagttcacactcgcccatgagaacgacggtgggcgcgggcgcggcgacatccatccatcggtcgccctcccgatccccaatggtgattaccattctctcactatgacgaaagacctgctcaatcttacaggtatggtacactaaatgcccagctccagcttgagcgccttgatctcagctttgcagtgctcatggtgctccgcaggcaccaccacctgctgcttctcctggcccacatatacggccaggtgccgcaccgcctccgcaaaacgtcgaaacaggtcggccgactcaaaattgctgtagaggacgctgcgcgtggcctgcagtcgccgcagctccttatcccacagtcggatctggtcggtcaccacctggcatgggcaaggtaataaaggctggtgacggcacaggagcctgacgccaaatgctccgatgtccatgcatgctagaacatccctttccccccctccccccctccctccctttctcctcaccccgggcacggtgggcacccgggcctccacgcgggggtgggcgtgctggcgcaggtaggccacgatctggtcgcccgtggccccgctttccagggcctccagcacgctctcgcgcgtgatgctgcccacaaacagattgggcagcagcacgtcgcagcgcacgaagaactgaaggatagcctgctgcaccgctgaggaggtgtaggcgtacaccctgtgagtgaggaggcggagggtgggcctggcagcggggaggtggggcgctggggtgcaaaggcgcacctggtgcggcccgggcagggagccaatacatccccaccacacacaccggcccgtcacctgaaattagtctcgacgatgacaaagccgcgggtacccgagggctgcgtgccgccctccgccagcaccctggccaagggcgtcgccagcagcaggcgggtggtgcctgcaggcggagcggcgggcgggtgtcctggtgggcaaggagtgcaaggtgccccagccactcagcagttgagaggcggcgccagcgcctgccagtcagcgcaccgcaagaatccaggccatgcgagtccctctgccctgccgatcacggcacaacatactgggtgccgcccaccatgctgggagggcatgagcagacccagctggcacatgtccagtgcgagcccctgctccacggggggaagttcttgcaggaccaggggccgacaccccaggctgcccagctgcagcaaaaactccaagacgacggcgaggctcgcctctgcgtttgcatggggggtttaggatgtgaggggcgtggtggcacatcaggccggcaggctcctgactcctcgctcctcccccgccctcgccctccccacctgttccctccacctgcgccgcatactgccgtagcagcgtccaaagctgctgaaaggtgtcgaggagcaggtacttgaagccagcctcggtgatccctgtgccgacggagaggcaagaggggtgcatggtaggactgtcaacagagctgcgctgggcaatcaaatttcggcatgtgttgagcaccctcccgccactcacggggctggtgatgagggccgtcgttggacatcaggcccagggctatcaggagaccaggcacgtccagggtcctggagttcgcggacgtggcagggatggtgctggccgatccgaccaagaataacaagatctcctgttgggacgtacgcaggcatggatgagggtttgagggcgcccacaggatgagggacccaccgttcgctcaggacgagcggcccccacgccagcgcacctcccatcgcttctgtgcgtagtctgcgatgctctcaggggtgacattcgctcggggcacatcctggagacttgaattccaggccaatcccctgcaccgatgggcagctccatgagtttgttgtgcgagatgaaggtgacgtgtgtcaagcactcgatcaccccgaaaatatgcgcacttgtacgcacctggccgagccagaggcgcagatgtggtcccggaaagcatcgtgcagcctgtacagctgctgtccgagcttgtcgcggtagccttggaacaggttgagccgcaccagtgtctccagcgcaacctcatgggcagtggcagcctcccgcgtgggccacgacgagattaaagctgtgggagtcgggtaagagaggtgtgatgcccaggagcatggaatcatgccaggccaactcagagccggcccaggtggggaagggccataccgtcatgcaggcccatgcgccctggccgcaccttcagatgtcccctccggcaccaagagcagccgtgcaacatactgagcagctagcgggggcaggtgctgcaggatcacccggcagatgatggaactggtgtacaggggtgcaacctttactgtcgggagggattccaggtactcgatgatgtccatctcctggcagccaacacacagtctatgctgagtaacaatctctactacattgtgcgaatataaatgtcaacaacgtgctgtggaactccaccgtccccctgatcgcgtaaagtcctggacatggagcagcacccccagggcgcgcgggggagcgatgccggagcagggttgtaacccggcaggggcacacacttacactgcaggagggacggcgtcggtaccttctgatagtgatgatgcgccataatgtgttgtgatcggagacacgatgccatcctgaatttcgcttcagcaggattggggtctcacagccatgaccctcgcacgccgagagctgtgagggctggcaacccttccctctgaagatcgccgatgctggaggactggtgacgcagtgtcatgtctgctactctatcgtatcagcagccgcagaaggtcccgatgaagctggacaccctgtcgcggatcctcgccgagatatgccagccaggtgggtgtggggcccaggtcatggatgtcgtagccagtgcagtgggcatatttgcgcacggttgtgcccaaagaactgccctgccgatgcccctgcaggtttccaggagcgccgggacgaccatgtgctccgggaatttgtcgacagcgaggcccgcaacttcacgggagagaggttcaacaggttcgccctggagatgaaccagaggatcaagagtctcatccggaggtcagaggggtcaggagtgtgcccgtgaagcagggtgctgctgggtggggtgccccgcttggggtagcatcccagggataggtggctccatcagcctccccccccccccccccccgnnnnnnnnnnnnnnnnnnnnnnnnnnnnnnnnnnnnnnnnnnnnnnnatgatgtggcggagcgcatgggcgggctggtggccatcgaggagctggcggggtccaagatgtacagcggctccccagcccggctggcagacctggtcaagctgctgatggaggtcttccagccggcctccgaccagcagctcatggagtttgccgcgcggacgctgggccacacagtgaaggctggcggggcgctgatggcgggggtggtggaggagcaggtggggcctgggtggccgggggcgggggttgggggtgtcgcgtgtgccgcccgcccgctggcggtgcatgcgggtggggtggcgatgccgagtgggtgacggcatgtcgagagcgaggggaggacctcgcggggatggtgcgagggagccgcaccggcccaaccccagggccagccagcactgccctgccaccctcgcgcccctcccctcccactccccaccctcccctcgaccatccccagtgaacccctccccccccgcacctgccccggcaggtcaagctgggcctgtcctggctgagcgaccgcgcggagtaccaccgcctggccggcaccctggtgctccatgagctggccatcgccgcccccgcggtcttcaacgtgcacgtcaaggtgtttgtggaggcgatctggaatggcatccgcgaccccaagctgcacatacgtgagacggcggtggcggcgctgcaggcctgcctggtgctgatcgagaagcgggagacgcgctaccgcgtgcagtggtactaccgcctcttcgagcagaccaaggccggcctggcccgcgccgcgcctgtggagatcgtgcacggttccctgctcgccctgggcgagctggtccggcacaccggcgagttcatgctggcgaggtaccgcgaggtgtgcgagacggtgctgcgcttccgcgacagcaaggagaaactgatccggcgcgccatcatcacgctgctcccccgcctcgccgccttcgccccggagcgcttcaccaagtcgtacctggacagcgccaccgagcacctcctggcagtcctcggctcgcccgccgaccggggggcaggtgggcagggacgccgtggttgttgtgaggaggaggggggaaggggggtgcagcaacatggagtgagagctcgttggatggccagcggccaggggcaagcgcagcacgcccatgcgccttctgcgtgctctggcacccacttccccagcgcccgcacgcgccgctggtgaggggcccctgggttgctttttctgacactgcactctcttcccatcccctacacacacacaaaacactaggtttcgcggcgatcgcggagatgtcgacgtcgctgtcctcggcgggcgtggccagcaagctgcgacgtggggattacctgcgccccatcgcgctgcacatccgcgatgcgctgctcggccagtccaagacgaaggcgccgtgctccgaggcgctgcactgcgcgggcacgctggcggtggcgctgggccgggactggcagccctacatccccctcctcctggagcccatgttccagaccgggctgtcaggtgggtggtgggggggggtgggg

SEQ ID NO: 41947 - DNA, 73 bp, Chlorella protothecoides
ttgtgggagggagaagaatgcctcttgggggtccgggcggagaggagcgacggcgggacaggcagtcacgcac

SEQ ID NO: 41948 - DNA, 109 bp, Chlorella protothecoides
gcgggcacgcagcgcagcgtcggagccggcgcgcagcgcgcagtgcgagtcctcggccagcgcgtaccccgtggcctcataggcgtcctccaggtagcgctgcgtcacg

SEQ ID NO: 41949 - DNA, 11611 bp, Chlorella protothecoides
  modified_base (1245)..(1254): a, c, t, g, unknown or other
  modified_base (1823)..(1832): a, c, t, g, unknown or other
  modified_base (2235)..(2244): a, c, t, g, unknown or other
  modified_base (2738)..(2747): a, c, t, g, unknown or other
  modified_base (3119)..(3153): a, c, t, g, unknown or other
  modified_base (4455)..(4464): a, c, t, g, unknown or other
  modified_base (4668)..(4677): a, c, t, g, unknown or other
  modified_base (5472)..(5481): a, c, t, g, unknown or other
  modified_base (5539)..(5788): a, c, t, g, unknown or other
  modified_base (6621)..(6630): a, c, t, g, unknown or other
  modified_base (6718)..(6937): a, c, t, g, unknown or other
  modified_base (7262)..(7271): a, c, t, g, unknown or other
  modified_base (7495)..(7504): a, c, t, g, unknown or other
  modified_base (8246)..(8255): a, c, t, g, unknown or other
  modified_base (9420)..(9429): a, c, t, g, unknown or other
  modified_base (10329)..(10338): a, c, t, g, unknown or other
  modified_base (10510)..(10642): a, c, t, g, unknown or other
  modified_base (10759)..(10768): a, c, t, g, unknown or other
  modified_base (10895)..(10904): a, c, t, g, unknown or other
agtgccccgacgcggggctggacgccgtgcccgccgcaccgccggccaggacgtcgcccgcctccgccgcgcagccgcactccaggacctcgatgcggcgccgcttgtcggccagcgcggcgcgcgcggcggcaagtcgctcctcccccaccgccacctccccgctctccacggggcggatgaacagggagatgtaggtgtagggcagggtgacggagccgtagccggagagcacggccacgaggaccacgcccagcgcaccgacgcgcgcgacgatggggaggaggaggccggcacgctgggcgcgctgggcctcggacccgccgggcaccagccggcccagccgccagaaggccaggaggaagaggagggtgagcaggagggcgagggcgagggctggcgggccggggaggcggcgccgggccaggcgcagcgtgtgatacaagggcaggaccaggaggaggaggaggaggagcagggccaggtccgcgcgccacaccaggatcctaagcctgcgttgggttgttgcacgcaggaggatgagggggttcgttggaggtgtgagcggccatggaagaggcggtgtactgttgcccgggggaacagatggcagcaagagggtggagcgctgccgacgaggtgcacagagaggtcaacaacaactcaacagtctcagcgatccaggccggcggccacagtgggacagccagagcacgacgctcaccctgggttcagcacgtccaggacctcgcaaagcaggaggaagagctggtgggaggacagggcaaacacgcccgcgaacagggcgtgctgggccctgtccaggcccccacccacgccgtcgccgctgcgctcgaggtaagtccatcccccccagaagagcagtgccccggcgctgaaggccaagaccaggtcaagcagcatgccaggtgggggagggacccccacgggggtaccagcgctggggcccgacaccgggtaggggcaggctggaggtcatcaagggagggctggaggtgcgggcatggccgcgatgcgatgaatttccgggacacgaattggtaacatggggattggcgcatttcctgggacgcatggatcgggcaggcaggtaaccacgcacagacgtgtcgcgattccggaaggttcaaacttgtcgctgccggtctggatgatgcctccgctggagggtcctgtgcccccgggcgcctgatccatgcacagcaagtttgcagacgaacaccnnnnnnnnnnaggatgatgcctccgctggagggtcctgtgctcccggtcgcctgacccatgcacagcaagtttgcagacgaacacccgcacctccgacccccccatcctacatccaagtccatgttgcgggtgtgtgcagactcttcaaggtggcaggagagcagtgcaggcagtattcctatgcttgagttccaggtgtggcaggggatgggcctcagcaccttggataatgatctacccggcgggctcacaccatcatgcccttgtggtacaggtccagcagcgacaggcagatctccaccccgatgaggatgatgatgatccactccagcgatgtggactgcagtacgggtgcggcaggcgggtggtcggggggctggggacggggcatgcagccgtggtgtctggctcggatgcaggtctcgacggggcagcctgtgtgctggcatgcgccgctccagctgcacagcagtatctgcggcgtgtcctggccctggtgaaaccgcactcctgcagggtagctgcgaccctgctcaagcaacaaccgccgctgcaacccagaccttgccttgcggtcnnnnnnnnnntaccgcactcctgcagggtagctgcaaccctgctcaagcagcaaccaccgctgcaacccagaccttgccttgcggtcctggaaaatctctaggaagtacttcaggttgtcctgcaccaggttgagcttcatgtccagggtcttgaatcgcgcatccatctccagctcggagcgcaggtagtcccagatgcggccatactgcacatacttccaggcgatgtcataccttggcatgggcaggtggggagggggaggcgtgcgtcttgcggagggcagagtgtgcaggtgcaagggtgtgaggggtggggtgctccggaggtatgcagtccgacggggcatgggcatgttgctgggatccctgaggcccagggatccccgacagcatagatgccgcttgggtctcnnnnnnnnnnagatgtatgcagtcagacagggcgcgggcatgttgctgggatccctgaagcccagggacccccgacagcatagatgccgcttggccctccgggtggccagggccagttccatgccagattgcaccgatgcctcagctcgccgcccgtcctaccccttcctcactccacaagcaacacccccgcccacctctcgttcacccccagcttggtgatgatgtcggtcatgatgacgttgttctcggccaccaggcgcaacagctcctgcgcgttgatcttcttcagattcagcgtctccttcatctccttgttgatctgggtgaactgccccagcatgcgctccacgtgggagctgtagtaatccagggccactgactgggccagcacctgggagatgacctgtggcacagtgggtgggtagccgtgctgggcattgtgtggatgcacgccgggtgagatcgggaccggaggactcccctgcagcgtggaaacttccnnnnnnnnnntgtgggtagccgtgctgggcgttgtgtggatgcacgccgggtgaggtcgggacaggaggactcccctgcagcgtggaaacttccatctgggagtcgagggcgctgggtgcgcagaacgtgaccagcggcgggcttgaagcgattttcatctgtatgcaaacccgctgttcgtgcctggatgttcttcaggtcgagctgctgcaacctgatgcgctccggggtgagctggctccaggtggggagctgggaggcgacggacagtgtgtactctgcagtgcaatgtgcttggaaaggctgagccatgaggtgatcaggcactatcaggtgtggccccatgccggcatcccccccccccccccccccggggggggnnnnnnnnnnnnnnnnnnnnnnnnnnnnnnnnnnnttgggggatcactgcccggaagggcgcaggggggtttgctccctccaagtgaacacaccactgcgcccccggtgcagcccgcctcccattcccaccaagcaagccctgcaccttcattgtacgggcgctcggctgcgggggtcgggtcgcccgccacggaccggcaggcggagagccagcgatctcgctcggggagctgcgagttgccgatgaggaccacggagccgtaggggaaggccacgatgtagggtccatgctggatcccctgtacgggcagggcgtaaagcaggagtggggtgagtggtgactgcacgcctgaatactccgacgacttctgcactcatgaagtcacagccagccattgtacaacctgttgggcagggtcttgctcgtcccacctgctcctcggccgtgtcggggtctagactctggtgtggtcccagcaggagagcgccacggtgcatggcactgaagcacccctgaaactcaggcttggagtgcagggcggagacgtcgatggtcgctccaatgtacgtagcttcaacccggtagttctgccgagtgaccaggcggttcacatcccggctcgctgggtgagcgttctgggccaggctctcaggaccggaggtggaggcgtcaggggccggagggctgggggaggcgctgccggggctggccgatgccgtcacatcccgcgccgaggtccatgctgccggcaatggcctggcatgcagactgtggctgcttgattgctggcgggcgatcgagctcagggagcccagtaaccgcgcagtgcgaagcatggagagtggcacctcaagcacaggtcagcacatgaaggggtcggcggacgcaccggctgtgcgcctcgatgaaggatgtcgtatcttgtcagtggtgataccagagaacaaaagtggatgctcctccgcttggatcgcacttcttaaatggggactccctgcgatcgctattctgtggcgccctgagagatgtcccccggtgacagttcggcaccccagtcgataacctgcgccgaataccaggcggcacccacagccccaccactcccttacgatgaggacatgattatgcatcgattctccacctgaccaggaggtcctccgcgatggatgatgaactcgagctggagctggagctggccgaggcatatgacggaggtgggtgtgggtgcacatctgttcaggagtagtgtgaaacaaattactggaacttacttccatccacaacattctctgtcgtttccgacgctcagaggagctagactacggcgaggatgannnnnnnnnnaagtagtgtgaaacaaattactggaacataattccatccacaatattctttgtcgtttccgactctcagaggagctagactacggcgaggatgatgagcctgagcctgcaatcccctcccacccctcgacaaaggcatcacagttctcgaaagagccccaggtgcgcatagaatctgacatcaagacattcatcctgcccaagnnnnnnnnnnagcatcaaagtcctcgaaggagccccaggtgcgcatagagtctgacatcaagacattcatcctgcccaagcgcatgtaccggggtaccctagacacgcaccagctcccccaccttgtcctccaggttaaagatgtggcacacgcctaccaagacgacccaagggctgggaaccggggaaggtcgcacacctccacatccaggactaccgatgcaagagatcccgactccaggtcccgccggcgcagtcgagacgacagagggacgcgaactggatgccagccgcgggggcagcgctcgccatccaaggcgcaaggtgcgctgggcatgtggaggctgcctccaccgttggacccttgactgacaacgggagcctcagcggctttgctccttttcatggggagtttctgctggcgatgcgtgcattctggcaagtctggctcgttcttgacacggcctcgcaccctgctggccggcctcgcagatctggaaacatatgagggggcgctgccatctcccttcctcccacctggaattctggcggggccaggccaccctccgcccccctcaggcatgacctcctctcgccctggagggaatgctccagtggcgcccagccatccaccgccgcagcccatggtagagtaccagagacttgatgggagtatgggtggcagacccgcgaggcgggtgtgccactcccgaaggagcccttgtccccatccacagttgctgcccgcatgccctgttctgccctgcatcaatcggcagcctctcctgccctccgcagggttccnnnnnnnnnncgtggcggctgcctccaccgtaggacacttgactgacaacgggagcctcagcggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgatgggagtatagttggcagaccggcgaggctggtgtgccgatcccgagggagcccttgtccccatccacagttgctaccggcatgccctgttctgccctgcatcaactggcagcctctcctgccctccgcagggttccacatacccgatgggcatgatgggcgccatgccctccccacaccccatggcgctgatgcaccaggcgctgctgctgcagcagcagcagcgccagcagcacatgctggcttcaggcttcaggggtggcgatggtgctcccggcttccgacaggggcagccgccgccaccccccctccccccgggcttcagcgtgccaccctcaaaccctggccagcacatggtgggccccaagccgcctcctcccccggcggggcctgcaaacaccccaggccccagggaggaagcgttgcagagaccgcccaggcccctggatcgagtgcaggggccccccttccagccccagcagcagtggcagacggggccacattccggcagcggacccaggccgcccccccccggcgtgccaggggtgagccaccggctgggctcggcgcagggggcctctgtgcgaggagccatcaggcgggagggcgcggcatccgcagtgccgccgccgccggggccgccgcccgaggaggaagcaggagagggcgagcaggagaggaaacggcggcgactggaggagattgcgaaggctcgggcagctcaggaggcggagaacaagaggttggccgaggagaaacggaagcgtctggaggcgcgtcaggctagccagcccagtcacgctgaggtgtgtgtgcgctgagggnnnnnnnnnntccccccagcgtgccaggggggagccaccggctgggcttggcgcagggggcctctgcgcgaggagccatcaggcgggagggcgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagggagggaggcaaggggagtaaggacagggggtgtgaacacacagtctgaactctgagctatgatgccctctggctggaggctcccttacatgtgcgaagagtaacacccctgacctcatcttcccactctgtgcgcagcctgccgcgcagtcgagcatggcccggcagatggaggctctcaagaagaagatccaggccgaggaggcgcgcctggcagcggcaaaggcggcagcagccagtgcgcagggcggggcagggcagcctggcaatgatgagcgcggggtcggtaccccagacaggccagtggggtccagcaaggnnnnnnnnnngaaggcggcagcagccagcgcgcagggcggggcagggcggcctggcgttgatgagcgcggggtcggtgccccagacaggccagtggcttccagcaaggatgctccagacgggaccccaggcgcccagccaggagcaagcatgccggaagccagctcggagaagggcagggaaatgggcggcaatggcgagaggaaggggcttcgaggaggggtcgtcagcggcnnnnnnnnnnggcatgctggaagccagctcggagaagggcagggaactgggcggcaatggcgagagtaaggggcttcgaggaggggtcgtcagcggcggtggcagcccgggtgcccccacaagtcaggaggacgacctgcagatcacgttgacgcagtgatcacagctagcctgcatgcagctccaggtattgcggccaggcatggaagggagtgggtgggtggggggcaacgtgatcatgctcgtgggcttcagccagagcccttcccaggtcccaggtattcgctcagtgggccagtgctgcgccccctctcctgctttaaaccggctcaggttttcatgcactgtcctgggctgagttcacgccctgaacagcgaatgatacatgtgcgatgttgcaaacgtgaccccagaaactcattttcatccctttatctgtgaccctacgcccccgtattcatttgacaacctgtgcagcgccttcaagaacaggacatgacctgctgtcaagctttggcagctttgtaagatctcagtacaccgtccagcgggcataatctcctgcaggggatggggggacccgaacacctcgcttccccaagaggataatattgcgatatgcacaccgcgatggatggcacgggatgatggtgcggcaaccctcgaccatcaacgtatacagctcgttttatcaacatttttaagcttactcaaccgatagaagcatcgacatgcaggcggtcacgtccacnnnnnnnnnnccgtatacaggtcgttttattaacattttaaagcttactcaaccgatacaagcatcgacatgcaggcggtcacgtccactcgcgctttcaccccggctgtcgcgacacagcgtcatgcccggcgacaggtgaccgtccaggcgctgtcgaggcctcaggtgggcgataatatggggtggtggtgcatcggggccttgttgagccgaggtgggcggtgaaatgggggacggatccggccagcatgagtgcaggcgggcccgatcgcgacatggagttcccctcgttccacggtcacctaccaccccgcatcgcagaccgctgcggcctcggtgcccatgatcgccgtgattctggccggaaccgctgccatgaccctggcccccgccgcgctggccgaggacgtgcggaccaccagcgccccggagggcgtgcgcaaggtggtctgcgcctccaaccccacctccaagctctgcctggaggggtcgtacaagaggggccaggccccttccctgaagaactaaagctgaagatcgcgccagcctcctcatctgccctcgctgtacaggggaggggagggtgcactgggcctcctgattttgtgcagctctcgattgtaacagagggagaagcatggaggcgggcgtttgcagagtgcagagccattgtcgggcatgcagacccacaagcgctgcaaggaggggttgcaaaaggctggaccagggaacaatctggcaggggcatcgtgccgcactttggcacaccacccgcagatgccattagcgctcgcaccggcacgcgtcagcccagcactcgcagcgccgccgccacctcgtccctggtcagcacgctggtcgggtccagggtgccctccggaaactccctggccagcaggtcctccagctgcccaagggcctccgctacgttccccgcgatggggccggcgagcgccgaccggctgcctccatccggcagcgacgccctcagcgcggtcgcggcctccggcagtacgcccgccagcgctcctcgcaggcgctgactcagctccgccacgcgctccggggacgcaaatgcctgtagagtgtggtgcgatgcgatggggtgaggggttgctgttgcggagagcaggtggggcagcaggcaggcatggtgccgagacagcctgggnnnnnnnnnnagccctcagcgcggtcgcagcctccggcagcacgcccgccagcgcgcctcgcaggcgctgactcagctccgccacccgctccggggacgcaaaggcctgtagagtgtggtgtgatgcgatggggtgggggggtgctgttcgggagagcaggcggggcaccaggcaggcatggtgccgagacagcctgggtaatgattccatccagctcgctgccggcttgtttgctctggacccaggcgccggcgacgcagagcagggacctttctgtaacttgaacagcaggcaggccaggcatctctctgacccccgagttattctccattctccaacttcctgctcaccagttggtgcaagggcttggtgcccacggccgcctccttgtccgcccccgcaccgcccgcaggcgcggccggcaccttgcccgcggccgccgccttgctcatgaaggacagcgccggctccaccgccagcttggtcacggacatgatgaaggactcgcagctgaacttgagttctcgctccagctcctgggtggaaggggtgcgttgatgggtactggacatgcatcaggggtagctgcggccggtgacgcagggtccagaggtgggccccctcaccctcaaccccatgccccagtcccaaaccccttgtaaacacgccaacaccatagcctgcccaccttcttggcttcgaaccggctctccagcaggcgcggcgcgccgcggctcatcagctgcagcaccgcgttgctggaggaaagcgtgaagagtgggagctgccccgaggccgcgcggcgcagcgtctcccgcgtgtggctgaagtccaggtcgcgctgcaccacggcaaaggtggtggggtggcgtgcggcaccctcgcgcagggccagcagctgggacacannnnnnnnnnaaagtccaggtcgcgctgcaccacggcgaaggtggtggggtggcgcacggcgccctcgcgcagggccagcagctgggacacaccgaagagctgggcctggaggggggtgcacccggggagctgcaagagtgggatgggggggggggggggttttttgggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggattccattcacgctgtcctcaatttccatcgctcctcacaactcctgccttgacttccaccacatctccagagcaaccccactccccatctctaccttggccacagcgcggctnnnnnnnnnntagctgcaagagtggattttggtggggggggggagttcatcgtgggtgggtgaaaatgggggggatggtgcacgcagggtcgatgaggccccccctagtcagcgcttgcgcatggtcgctctcccannnnnnnnnnaaaggggggaatggtgcacgcggggttggtgaggacccccccagtcagcgcttgcgcatggtcgctctcccatgcctccagcccctcctgggaccaccacctcgggattccattcacactgtcctcaatttccaacgctcctcaaacctcctgcctcgactcccaccgcatctccagagcccccccaccccccatctctaccttggccacagcgcggctgccggcaaggacggcgagcgtggcggcggccagcgcctcgtgcgccagccccgcgaagatgcgcgcgtccaggcgcggcgccagctggcccagcagcgccagcgtggcggtgacggggggatactggcgagcagccggcgggcccgctggcggtgtgctcgagtctgtcggcgggtccccatcgcctttggcgactcctcctgggccgacagactctgacgctccgtccgcccgcatcgcgctgccggccgctgcgtcgcccccctgcaccgccctggccacccctccctgcccccttccatccagcgaatagtagccgtcaaagtcggtgggcaccgcggcgtgccccgccacacgctcgcggatgaaggcctgcgcgcggaaggtcaggcgctcgcgcacgtcggcgagcacgcggcggaaggtgggcgccaccagttcgtcggccggcgcggcgccgccgccgcgcgtctccgccgccgcggccg

SEQ ID NO: 41950 - DNA, 66 bp, Chlorella protothecoides
caccattcaaagcatggtcactgctgggtgacagcattttggtccagacatgtctcatgcccccct

SEQ ID NO: 41951 - DNA, 1563 bp, Chlorella protothecoides
  modified_base (213)..(284): a, c, t, g, unknown or other
  modified_base (674)..(683): a, c, t, g, unknown or other
  modified_base (995)..(1004): a, c, t, g, unknown or other
  modified_base (1259)..(1268): a, c, t, g, unknown or other
gacggcgggcgcgccgcgcgtggcacgtgtgtcgcgcctgggggacgagcccggcggaggtgccggggctgaggaggaggcagccacgtgccgcgcgtgcctggcggcggcggcggcgctcagcgcgcgcagtgcgcaccccatggcggggcccaccctggcgcacgccgcggggcagggcgtggggccggggaacgtgcgggtggagggctnnnnnnnnnnnnnnnnnnnnnnnnnnnnnnnnnnnnnnnnnnnnnnnnnnnnnnnnnnnnnnnnnnnnnnnntcgggtgcgggccgcgccgggaggggcagaggacggcggcgagcagtcgaggccgaatcgtcccgtcagagtgagcgcgacgaatggcagcgcggcgggcgagcaggctgcgctcggccggcccgcggtgcatggtgtgccggtccgggccgggagcgctggcgccggggacgacgcggcggccttggctggcgatggcgggcccgaggcgcgcttcccccctgcaatgggggattcgaggccatacgagctgcaggaggacgccgccggcccgcttcaggatgcctgcctcggctcggtggagtgggtgagcccccgcctaccccccgccctgcgcgcggcgctggaaagcgcggccacccgggcgcaggcccagggccgggccacctnnnnnnnnnncggctggcgatggcgggctcgaggcgcgctccccccctgcagtgggggattcgaggccacacgagctgcaggaggacgccgccggcccgcttcaagatgcctgccttggctcggtggagtgggtgagccaccgcctaccccccgccctgcgtgcggcgctggaaagcgcggccgcccgggcgcaggcccagggccgggccacctctgtgctcgtgctgagctccgcggctgtcgacggcgatgccaaggtggcggggctcgacacgccacgctggtcgccccacgcccgagcctggctgctggagtacgagnnnnnnnnnncccgcggctgtcgacggcgatgccaaggcggcggggctcgacacgccgcgctggtcacctcacgcccgagcctggctgctggagtacgaggatgccctgcggcccaccagccgcggcgcgctggagcagctgagacaggtggaatgcggggggtgggtgatgtctccagcccatgggctgcttcctggaatgggctcctcgtgtcacgcccttaccgcaaccaatgggccgtgaccttgagcaggctgctgcctnnnnnnnnnnagcccatgggcttcttcctggaatgggctcctcatgtcacgcccttaccgcaaccattgggccgtgaccttgagcaggctgctgcctcacctgtcagtgtatccaaccatgtcctcctggctgtcgctgatccccaccccccgctccttgccctagaacccccaacccccacaaccccctcaacgcagttcccccaggcccgggacggcatcctgatgctgaccggggacaatgagggcgcggcccagggcgccgccgcccggctcggccttcccgcgtccagcgtgcgcgccgc

SEQ ID NO: 41952 - DNA, 61 bp, Chlorella protothecoides
tgtctgggagggagtgttggatgtggaaggggcccttcaaacagccctcctggctccccaa

SEQ ID NO: 41953 - DNA, 64 bp, Chlorella protothecoides
gcagtgctgcagtgtcaggagtatgttgggatgttgcggtgaggaacagcacccttggtggagg

SEQ ID NO: 41954 - DNA, 61 bp, Chlorella protothecoides
aaaccgcccggacccactcggggcagagggtgcacactctgcctcccagccacccaagcac

SEQ ID NO: 41955 - DNA, 61 bp, Chlorella protothecoides
aggtggtggaggattggatgctgtgacagggaccgtcccaatgcttttttataatggagaa

SEQ ID NO: 41956 - DNA, 61 bp, Chlorella protothecoides
catcttcggacggtgagcgtggctggggggggtgtatgtgtgtgggatggtcttcctgtgc

SEQ ID NO: 41957 - DNA, 61 bp, Chlorella protothecoides
ccaagtccttgacttccatggctaccggagggtcatgccttcgcttacttatcactagtgg

SEQ ID NO: 41958 - DNA, 61 bp, Chlorella protothecoides
cggtgcggcgcaagaaggtgcgcctcggctaccccgccagccagtggatcagcgtgtacaa

SEQ ID NO: 41959 - DNA, 68 bp, Chlorella protothecoides
gcctcgctccccgtggccacccctgctgccattcctcacgtgaccctgcagtcgcctggccgcctcct

SEQ ID NO: 41960 - DNA, 128 bp, Chlorella protothecoides
ggacaatcagaccagagtgaagtgctgatggtgcctaaactcagcaacatcgaagtctgtgccaattctccagggcccacatcacctgcatggcatttgtgcatgtcccggtctgagactggcaggcg

SEQ ID NO: 41961 - DNA, 66 bp, Chlorella protothecoides
agggcaagaaggaggaggctgcaggtgagaggaaggggggaaggggggggggggggggggttgggg

SEQ ID NO: 41962 - DNA, 101 bp, Chlorella protothecoides
cccagccccgacccccgccgccgcctcgccgcacgccccgccctgccgctccccgccgccgcctcgccgcacaccccgccctgccgctccccgccgcacgc

SEQ ID NO: 41963 - DNA, 80 bp, Chlorella protothecoides
ggcgcgccctgtcacaggaggaccacccagagcctaggaccaaacaccattccacaccgcccaatcccttctcccttctc

SEQ ID NO: 41964 - DNA, 111 bp, Chlorella protothecoides
ccagatgtccctgcacaggaggcattgtggtgtagggtactgagccaggaatccatgtttcaggcaatctgacccaaaaaactgaggcaagcgctgcctggctgagactga

SEQ ID NO: 41965 - DNA, 71 bp, Chlorella protothecoides
ctgcgcaggctgagcagagagcaccctcattgcgagggcggcagtggctggttgttgccatgagggccggg

SEQ ID NO: 41966 - DNA, 390 bp, Chlorella protothecoides
  modified_base (102)..(315): a, c, t, g, unknown or other
cggcgccggcagggacgaggttcaaaccccctgaaagctccttcccacccctttcccagagatgactgcgacccagagggccccggcatgatcatcgccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggccagctcccgactaagctgcggcaccagctgtggtccgcgtgccggctcatacgctatcttaggtgactt

SEQ ID NO: 41967 - DNA, 80 bp, Chlorella protothecoides
ttgcttgctgcctttcttcagtgatgtcgcttcagaaccccctccccaaccccattgcagctgaaccagctgggtctgct

SEQ ID NO: 41968 - DNA, 128 bp, Chlorella protothecoides
cgcctccaagctcatcgtggtggcctgctttgcggcctccatgcagctgccgggtgccattggggcgctcatcatctgtgagctgtttgatctgggaattaggggggggggggggggggggggggggg

SEQ ID NO: 41969 - DNA, 1331 bp, Chlorella protothecoides
  modified_base (87)..(96): a, c, t, g, unknown or other
  modified_base (430)..(439): a, c, t, g, unknown or other
  modified_base (674)..(683): a, c, t, g, unknown or other
gtactgcgatgtggcgacgcgcggggggaggagaaggcaggggggggacatacacgtgtgtgtgtgtgtgtgtgtgtaatcaacagnnnnnnnnnngctgcgccaggaccgcagggtcggcgggggggccgaaggtggcgcgcgcgtccagccaccacttgggggccaggccccctgggcggggggggggcacctgcgggcaggggcggcaacgtggagtgggtgaggggggggtactgcgatgtggcgacgcgcggggggagaagaaggcaggggggggacacacatgtgtgtgtgtgtgtgtgtgtaatcaacagagctgccgccctgtgcccaagatatcacacaccagcatgcaccggctgttccagtcccatggaaagggtgaagacacacacttgtcctgctcctgggcacgagggcatacccnnnnnnnnnnacccaagataccattacaaaccagcatgcaccggctgttccagtcccacggaaagggtgaggacacacacgtgtcctgctcctgggcacgagggcatacccttcccttcaccctctaccaaacaacccccttctccctagtaaacaaaccggccgtcccctgcagcagaaacccaccaaggggacctgcgacgctgcctgttgatgctgctgctgctgctgctgcatgcggagtnnnnnnnnnncaccaaacaacacccttccccctagtaaacaaaccgaccgtcccctgcggcagaaacccaccaaggggacctgcgacgccgcctgttgatgctgctgctgctgctgctgctgcatgcggagtggcggcatgggcatgggcggcatgaaccgccctccccccgaggccgcgtagtagctctggtaccaccactgcagcgggtccatggccagaaagcgcggcgggcccggtccgtacatggcctggggcggcggcggggggcccggcgtgcacggcccctggccgggcgcccagccgccgtccagccccgcggccagcacggtctggcgctggcgctgctggggcaggtaggcgggcgtcgtgctgaccccggacacggggcggtgctgagcgtcctcttcgccatgcccggactgccggtggtgcttgccgggggtcagcttgtgcgggtggtggtgccgcgggcggtcgacgccggccgcgggcgagggggccgtgggctctgccctcgccacgggcgggcggccctgccgggcctcggccctggacgcgccttctggctctgcgcccggggacaacgcggcggcgccgggggtagtcgctagtgccggcgccgaggccccgcgcggaggcgaagccggcggatgcg

SEQ ID NO: 41970 - DNA, 107 bp, Chlorella protothecoides
acctcggcagcaaccctgcccccaccccccctctcttggtgctgggtgcatttcaggatgacatggtcacgggggggccccagcctgggtgcagtgcagggcgagtg

SEQ ID NO: 41971 - DNA, 6181 bp, Chlorella protothecoides
  modified_base (257)..(266): a, c, t, g, unknown or other
  modified_base (569)..(578): a, c, t, g, unknown or other
  modified_base (844)..(853): a, c, t, g, unknown or other
  modified_base (1126)..(1135): a, c, t, g, unknown or other
  modified_base (1336)..(1345): a, c, t, g, unknown or other
  modified_base (1614)..(1639): a, c, t, g, unknown or other
  modified_base (2023)..(2032): a, c, t, g, unknown or other
  modified_base (3160)..(3197): a, c, t, g, unknown or other
  modified_base (3395)..(3404): a, c, t, g, unknown or other
  modified_base (3492)..(3501): a, c, t, g, unknown or other
  modified_base (3589)..(3724): a, c, t, g, unknown or other
  modified_base (4073)..(4142): a, c, t, g, unknown or other
  modified_base (4881)..(4890): a, c, t, g, unknown or other
ctacgaggccggcgggcggggatcgccccgcggcccggcgctggcggcgcggcagccgctggccgcagtgctggccgcggtcctgtcccgtggtggccggctgccggacagcgagggcggcatgggagtgctgctggagggcagcgcctcggggcacgtggccgtggccctggcggggcaaaccctggcgatcttcggcctggcgcagccccaggggcccgctcagccccgcggccagggcctggccgcgggggcgnnnnnnnnnntgcctggcgcagccccagggtcccgctttcccccgcggccagggcctggccgcgggggcggtgcaggtgaggggttgtggcaggaaaggaaggcatggaggttggggggaggggaacgtggatggcgccgtcgccctaccaagacggcgtgtgggcacacaggagaccggggcgacagggctgagagctggtgtgatgccctcgtgtgtatgttgccctcgcgcagagggcgatgcccccctagaatcccgcggaggtttaccacttgcccatgtgaatccactccccaccctcccgcagatnnnnnnnnnntggggcgacagggctgagagttggtgtaatgccctcgtgtgtatgttgccctcgcagagagggcgatgtccccctagaattccgcggaggtataccacttacccgtgtgaatccactccccaccctcccgcagatcctccagggtatcggtatggtggcggtggtggcggtggtgctggtgcgggcgcacgcgcggcgcaagcatcgggtggaaagcgcgcccagcgtggagcgtctcaaggcctttgaagccatgcttgcagacnnnnnnnnnngagtgtgcccagcgtggagcgcctcaaggcctttgaagccatgcttgcagaccccaagacaggggggaggggtggtgagcagtgatgaggaggggggtaggcagcttgggcatggtggcgggcagtcggtgcttgctgaggtggatggcccctctccctggtgggtgaaagccgtccatcacagtcagccatccctgcacccctgtgcagggctgacttcaagaacggggctgaagtcccacgcgccgagcggcgcaaggggcggggcaggcnnnnnnnnnngaggatggggctgaagtcccatgcgccgagcggcgcaaggggcggggcaggcgggaagtcaaagcgggcacatcggagagcgcacagtccccccttgaggggacgggcggacactgccagctttgagaacctgggtggcagcgaggacgacaatgacgcctccgttcacgtgctcctcagcgagctcgatgtggaggtgcnnnnnnnnnncccccccttgaggggacgggccgacactgccagctttgggaacctgggtggcagcgaggacgacaatgatgcctccgttcacatgctcctcagcgagctcgatgtggaggtgctggaggaggagtgatgcatactgtgacaccagtgcgcaggaccacagagctctctctgcgtgaccaattgagaactgattacaaagagtgacatagctttaaaacatcgcatcatacgtcattcggagctgcgcctccgcttcctgggccccgcannnnnnnnnnnnnnnnnnnnnnnnnncctgcgtgaccaattgagtactgattacagagagtgacgtagctttaaaacatcgcatcatgcgtcagtcagagctgcgcctccgcttcctgggccccgcagctgcgccctcggctgccagcacctgctgtagagccgccgtcgacatgtcatcctccgacacgagctccacatccgagccggcctctccctctgaatcactgtcgtcgctggaccctgctgggatggagaggaggacgtgaccggacgtggcgtgcaccgctgggaggaggcgggtctatctacgactgatggcggcgtgcagccaccattgccctctccagctgggagcctagggtagagtgatctctgaccaaatgacccacctgcatcagacgtgccggnnnnnnnnnngccactgtcgtcgctggaccctgctggtatggagaggaggacttgaccgggcgtggcgtgcaccgctgggaggaggcgggtctacctaagactgatggcggcgtgcagccaccactgccctctccagctgggagcctggggtagagtgatctctgaacaaatgacccacctgcatcagacgtgccgggttgcctgggaccccccggcgccgcgtcctcgtcgctcgaccccgcctcagggtcgaatgtctcgtcctgtgtggaagaatgatctgagtttgcgggctgaggtgagggctcataggaaatcagtggtcaaggtgcaggtggcaggccgacctcctttgcatcccagcacaccccatgctgtgctactgcttcaccccacctctgcatctgatgaagagctggcgtcccctgagtcctcgcttccatctgaaccctcagaatcgtcagccgggggtcccagcttctgtttcatcatgtatgctgcgacgatgtggcaagggggttgttttgccacggcggatttcagctcctgaagtgtagcagagtcagtgcaggtcaacgactggacgggcaccatgtcaactgatcccagctctttggccccctccccacgccaggctcacattcgaagggcccagtctcctcacgcggcagcatcccaaactcctccaccctgccatccttgcggtgcacaaacacatcaaaggtggaggatgttccccccgccctggccagctccatggccttaatttcttcccgcgggatgaacagggccggctgcaggggatgggaactcgggcctgttgatgggagttgggtctgcccgtctccatgccaccaagaaccacaatggtcacttttcagatgaaaacgcacacaaaactgaccgattccaggaagcagaggccggcgggcatggggaagagggtccccgccctcgccttaacatgggcggggacacccgagtggcccgacgacatgcttccaaacagtgccgggtcgggggagcagaaggaggcgggcgggacgcctagctgcctgtggatcgcccaggggatgaaagcggcctctgagcccggctgggttgtggtcgcagctcgcaagccagagagtcggagannnnnnnnnnnnnnnnnnnnnnnnnnnnnnnnnnnnnngacagaggacgactgcggcgggcccctccaggggatccctgctgcctgggctcttcaccgccagctgggccgctgcagtggtgctgatgaccaccgctgtgagcggcgacttgccattcagcagccctgcatggctggtgggaccaggttgggggcaagggttaccgagcctgcctgagaaagtactggggaagctcnnnnnnnnnntagcagcggtcgtaccctttggccctcccctcaggctttaacccacgatgatcccccttgcacaacaattgcctcacccgaacagctnnnnnnnnnngagcagcggtcgtaccctttggccctcccattaggctttaacccacgatgatccccattgcacaacaattgcctcacccgaacagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcagcagccctgcatggctggtgtgaccaggtttggggcaagggtttcccagcctgcctgagaaagtactggggaagctcaggctgctcgacgtcctgccctgaggctaggtcgagcgctccctgcctgattaatggccattgtgtaacccccctgaggcatatgagggcaaagcacccacccaagactcactgtgagatgacaaggaacaggagcaccttgcccttggagtcgccaggcagagaatccaggatctgcgtcacatacggtgatgtgggtgggattgggagggagagggggaccaaatcacttggaaagaatgtccatccccaggatttgctgggttnnnnnnnnnnnnnnnnnnnnnnnnnnnnnnnnnnnnnnnnnnnnnnnnnnnnnnnnnnnnnnnnnnnnnnggccacacctcaccagaatgtgggtcactgcagcatatggtatgctgatgctggtcttcgggctgtgcagggagaatgatttgtcatggaaggccaggtcgtgcttccccctgtacgcgaaagatgagaaggatggtaagcgcaggattgcctgtggggcttgcaagggcgcagtcctggagcacctcgcaccgtggggtcacgaaattcagctgcggcaccgtgcacagcgatggctgcgccgcaggtccttgagtggatgctggtggggttgggcctggctcccccttctgatggagcccctcatcgagtacatcggcgatgaggccggggaggatggactgggcgaggtgcgccgactgcaggacacctaacaaggccggacctgccttgagtggctccacgagaggcttcaacctatccatgtttgaagacgtgatggtctgtggatgcgtgagggacctttgatgatagggcaccccgatgcgaagctgacgcgcacgggtttaaaatggcagagtgatctacgtatgttgacccacagacgatccgtgcattgcacccatgaacatccctgagcatacggattggatctccttacagaaacgcgaccaaatgcctgctggtgtctctcagcagttcggggagacgtcaaattgagtgaaccccccctctatgcatgcagacaagggcaccgagtgtattctgtggccctgaactatacactccagcgcttggnnnnnnnnnnccgtatgtgttgacccacagacgatccgtgcgttgcacccatgaacatccctgagcatacgggttgtatctccttacagaaacgcgaccaaatgcctgctggtgtctcccagcagttcggggagacgtcaaagtgagtgaatgccccctctatgcatgcagacaatagcaccgagtacattctatggccctgaactatacactccagcgcttggtgtttagcaatgaccattgcaaacccatgccatgggactttatccatccttgaggtgtgtggcctgagtgtgtgcatggaattccgaccagctggcactatcagcagagcacgctaagtgcaataagtttgtacctattatgtacgtctctgtgcgagcagcagcagctactatcaagccaaacccttccttacaaaccaatacatggaccactgaacgatgcaccttgtgtcgaggtatacacgtgccatgcagcctggtaaaggcgccaggctgcagaagagagcatcaatacaaatcgaccctggagggattacgtgcaatgaccaacgtaattttcatcaaacgattactcagtcattaaaagtcactcactggtgcccgcggccttgccatctttggaaatatgtattcgttttaattacgaggtgaaggctgaacaggcgcagctgttgagactgggccccgcccacgcaggccggtccctcgtgagacacgcagacccgacaagctggatccaacacaacaggcctacctggccatggctaccccccaccctcccatgagccaattacttcaggctgtgggtgcttcgtccgtgtctgatcccctggagcagctgaaggctgccctgagcgccgggcaggtgcagggcgcgtcattcaagcgcgcccgggtggaggagcttgctgcatcggcagagcagcagggcttaggtgggcggtggctgcggtgaactcgcggggaccacgttgcatttgagaatgcgatcgcggcctgctgagtgtgtcttttcttgagggctgccgaagcccatgaggagacgtgccccagctcggcctcgtggtgcatgaatccgtgggcagaccccctcccgattgcatggcgacgcagcccttctccatgtgatgtggagtcgctatccttgcagtaaaaagctcgtcacgaggccccattgagcaccccttggttcacccagggtcacctttccctccccatcgtcacacgctacccatgcgcccccccttccaggccgatggcaccactccggcgccccgcccccgcccccccctcccg

SEQ ID NO: 41972 - DNA, 121 bp, Chlorella protothecoides
gccctgcggggcgcccaggggcgccccgctccggtcgcacttgccgctggtctttggggtgtcgggggggcggggcggggggtcgccgggacgggggggtcctctcgcccgccgcagggtc

SEQ ID NO: 41973 - DNA, 61 bp, Chlorella protothecoides
ggcaaagggtgtttgtgggacacggcgaggggtagacttcgggcgtggatgcgaccgggga

SEQ ID NO: 41974 - DNA, 371 bp, Chlorella protothecoides
  modified_base (98)..(291): a, c, t, g, unknown or other
ccaccaggacgcagagcgtgtcgccggggacgaactcgccgccgggcccgggccctggctcggcgctgcggggcagcagcgtcacgcgcgccagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtggcggcgcaggcgggttccccaacggcggcacaatgcgggagcgaggttcgcccccgcgcccacggggtccggccc

SEQ ID NO: 41975 - DNA, 94 bp, Chlorella protothecoides
cggagtctgcgaggcgtgtagggtggggggcgaggcttcaggggcagggggtgggatgcactgtcacaacccaagcttgcccatgggagtaggt

SEQ ID NO: 41976 - DNA, 826 bp, Chlorella protothecoides
  modified_base (458)..(467): a, c, t, g, unknown or other
ggcgcgccgccgccgcggacggcgatgtgcgagccccgccgccgggccccccgccggtcgtcggcgccggcgtgccggcgccggcgcacccaggcccgggccccatggcggatgcggaggagccagcgcacacgagccgcagcatccacgacttcctgggcagccacaccgcgtacgagctcatccctgagtcgggcaaggtggtgctgctggacgtggacctgcccatgcgccaggcgctgcacgctctgcacgagcagggtgtgtgctggggaagggttgtgtggggaggtgtgtttgtggaggggtccatcccaggggagtccagcgggtcgctgcgaatcttatgtacacgatgggagggggaggggcatcgctccccacgctccacaccattcgacacccctccacatcccccctcccccccaacaacccgccatctacgcaggcatcgcgtnnnnnnnnnnaacacccctccatatcccccctccccccaaacaacccgccatctacgcaggcatcgcgtcggcgccgctgtgggactcgcaggtgggcgcggtggtgggcgtggtctccgcctccgacttcatcttcatgctgcagcgtctgcgccatgtggtctccgcctccgctgcgctgtccgaggcggagatggacgggtacaccatccgcgcggtgcgcgatgagctggcggccgagtcgcgtgcgccgcgcgcgctggtctccgcgcgccccgccgacagcctggcggaggtggtgcgcacgctggtggcggcgcgctgccacctgctgcccgtgctgggcgaggacgcgggcggcggcggcg

SEQ ID NO: 41977 - DNA, 147 bp, Chlorella protothecoides
gccccatgtggcttccgacgcatctccctccgcccacccccccacctcctctccctccttcccctccctcgcagctgggtgggcggcgcgctgcgcatcgcgcactgcggcggactgcacgtgccccagctcaacgcgctggtcaag

SEQ ID NO: 41978 - DNA, 153 bp, Chlorella protothecoides
tgcagttcgtgtatgtccccatgtagataggcagattgccgcacagtgacagtgacacacttgccacggtcgccagccggcaggccccgccctacgcagcaccaccccaccatcccaagcatcccccccttgcttccctcacctcgagctgga

SEQ ID NO: 41979 - DNA, 78 bp, Chlorella protothecoides
agggggaagaactgagcaagtgcagccaaaacggggtcgcagtcttgctacagatcatgatgcgctccagtctcggga

SEQ ID NO: 41980 - DNA, 2078 bp, Chlorella protothecoides
  modified_base (197)..(206): a, c, t, g, unknown or other
gcgccgcgcctcgccccgcgcctggtcggcctccgcgccggcggccgccagcgcggccgcggcgcggtcgcgcgccgcctccagctcacgcgccgctgactcagcatgccgtgccgctgtctccgagatggccagccgggcctccagacaggccagccgggatgcggtcgcggagatacgggcctccgccgcagtcnnnnnnnnnncgtctctgagatggccagccgggcctccaggctggccagccgggatgccgtcgcggagatacgggcctccgccgcagtcctttcctcggccctgcccctggtctctacctccagctgtgccgtggcgctgctcgcctccccttgcagcctgccagggcagtggggtcccgggagtggtgaacgagggccaggacaaaatgactcggcagatgaagatgcagtgcatacccacctaccccagtcccaggaatagcaaggtccagtcaatgcatcaggtcatcaaccgccaggcacaacccgccccacctctcggcctggctcagcaggctccacccagccgcccgcaggcgtcgcatgtgcccggccagggtctccaccttggccttggcgtctgcgcgcttggcaaaggttactttgtgctccaggcactcggcgggcgtccacccggtctcccctgcaacctgagcccactcatcctcaacttccttggaggtggcagtgggcgcgtggggcagctctgtgtgagagttcattttccagctgcagacgcaagtacccacagcatagacaatattgaatcccagccatgtcaaagacccaccttcgacatggaagtaggctctggggccttggcactgggtgccgagctcggcctggctgtcgctctttttggcgccggtgccgtggaggcgcctggactggccctcctcttccgattggcggcagcattgatggtctacaagtattttaagggcatatgtttttgtatccgcgtaagaagacacatcgcgtgctccccgtctgcgcaagaaaagctcggcacggcatcccgtgcgcaaccggccccctcacctcggccggtatcgcttggagcggcgcccgtgccgtcgggcgggggattcgactacgtctttccattttgcggtgactccatggcggtgtgcgacctcctccccggtttcggtgttttcagctgtcgcttgtgttaattttcgggagtcgccgcagcacgcgccgcagcacgccctccaggtgagctccacacctctcgtcccttctctgctgcggtgctcggaccaactcctgggatacattcaaacgcgcatgcgtctagacgaagacaacctcttgcaatgcctcctcgttcctcctcctcccaggcctcctccccctggtctcctggaagcgcaggcccatgtgggcggccacccgccgggcgccgcccgcgcccaggagcgccgcgatggtcttgccttcccccgctgcgcgcagctgggcgtgggtcggcatgaccctagggtcgaaagcatgggcatgctggagtgctcgcacccgcgccgccgccgcctccagcctgccctcctggcgcgcctgccctggggtctgaggcatccgcctggtggcccaatgggaccctagattgagtcgcccatccaccccgtcctccttgcccccgcccgcctcctcgtacatgaccagcttgcgggcacaggccttgaagccgccgttcagccgtatggcacgaaccaggtcagtcctgccctccgccaccagcgcggcggcggtgggcaggcgcggggcgcttccctctggctccctcagcaggtagggcgccagctcggcggccagcgcgggcatgtcccagtgcccgttgggccggcgccgggccatggccaggtccaggcggcgcgccgcggcggccatgccgccgtgccgatcgaccgcccagctgagggagttggcgctggaggcgcggagggcggcctgggtgggcaggcggccgccgccatccccgccccgcgccgccatccaggcctgcagcgcctcgtccacgctacgcgcgtcgcgccagtggccgcacggcaccacggg

SEQ ID NO: 41981 - DNA, 9175 bp, Chlorella protothecoides
  modified_base (392)..(401): a, c, t, g, unknown or other
  modified_base (470)..(479): a, c, t, g, unknown or other
  modified_base (1023)..(1032): a, c, t, g, unknown or other
  modified_base (1385)..(1394): a, c, t, g, unknown or other
  modified_base (2055)..(2064): a, c, t, g, unknown or other
  modified_base (2745)..(2754): a, c, t, g, unknown or other
  modified_base (3876)..(3885): a, c, t, g, unknown or other
  modified_base (4756)..(4839): a, c, t, g, unknown or other
  modified_base (5162)..(5171): a, c, t, g, unknown or other
  modified_base (7545)..(7554): a, c, t, g, unknown or other
  modified_base (8512)..(8559): a, c, t, g, unknown or other
ggcagggcggcgggggaggcgcgcgggcccggcggccgcgacgacgacgcgcccgaggacgcgcgcagcggcctggcctcccccgcgctgcaggcgggcagctggggccagatctgcgtggcctgccgcatcgtgcgcccgctgcgcgccaagcactgcggcgtgacggggcgctgcatcgagtgctacgaccactactgcccctgggtggggaacgtgatcgggcgtggcaaccgcgccttcttcctcaccttcctctggctggagctgggggcggtgacggcggcgatggccgtggccgtggcacgcctgcactcgagtgcgcactttggggggagggggggggatccaagtgcaggggagacccctggcgggggggggggctggggcgnnnnnnnnnnaaggggggacaggcggatgtccaagccatggcatcgcacctgcaggactcctcaggcggtatgggtccnnnnnnnnnngttttttggggggggttgtgtgatccaagtgcaggggagatccctggcggggagagggggggggatggactggtgcgcccatcaggcggcaaggggggacaggcggatgtcccagccacggcatcgctcctgcaggactcctcaggcggtatgggtcccaggaagctgttgcactcagggcccacactccccccccatcccccaccaccctccatccctgcagacctggcgcagccccggcccgggcacggccccgcgaccctggtctggcccgtggtgttcgtggtggccgacgccttcctcctgctcagcattgcagccctggcactggcacagaccaaccagatcgccaagaacatcaccaccaacgagctcgccaactggcacaggtgcggggggcaaccaatgggtcggctgcctggcctgagtgcatggggctttgcgacagggaccccagtgtctcctccgccacaccaggatcccacggggcaggccactccccctagagccttactgaagccggcacacctcctcatgctgtccnnnnnnnnnngaccccagtgtcacctccgccataccaggatcccacggggcgggccactccccccaaagccttgctgaagccggcacacctcctcatgctgtcctcgcgcccttgctcccaggtacaagtacctgcacgcggccgacggcgagttcctgaacccctttgaccgcggctggaaggccaactgcgcggaggtgtgctgcgcggctcagcgcccccgctcgcagtatgtgctggagggcggggaggactctgtgtccctcctcggcagcgcgggcgggaagctcgatgccatggtgtgacgcctgcttgacttcacatggagagttgccacgcagcgctcggagcattcgggtagnnnnnnnnnncgccatggtgtgaagcctgctcgacttcatactgggagatgccacgcagcgctcggagcattcgggtagtttccgcgccgttttccgcctgggcgagtcgccggggtcctccccactctcacacactcgtcgcacatgcctccctttcgcttcctccccgttgcaccgacactgacacgtgcgcgcatccatgtgtgcgatgtacaagcgctgcctgaccagcgagtgagagccagcagagggagggaagggttgtggacagcaccagacaacactgcatcggggtggactagggtatcctccatggaaccgtcgggggaggaagagcggcggcgcagggtttgcgctgcatcgagaggtgtgcaggtgtactcagtcgccggccaccttttggcctgtccgctcggcgggaagaggtcggttgaagccgccctggatgtgggtggtcgagagggtggcatcatggtctgtgcttgcggtcgagaccgagtgaggtcccacctggcacgggggctgcaatgcccgagccaaagcccccctccccgcactggcggtcaaacatccccccgaacagcttgcaccggcaggcatgagccgcaggcccggccacccaccctgcgattcatgaattggcgggcctggcgggtcgacttgaccttgnnnnnnnnnntctcggtcacccaccctgcgattcatgaactggcgggcctggcgggtcgacttgaccttgacggcgcccacgctggtcctgggatcgtccgactgcttgccctgggtggtgtcaaacccctgctcagcgggacaggggagatgcatgagacgctaggaagggtggcggtggacatgtcagagccaggcaccaaagcgcatcgcaatcaacagccaggatgctcctgtaccctccgtcgcaggatgctcgcggcgtctgctcggtctcccccgcccgacccagacttcccctcgcactcacaaaggggatgcccatggcggccatcatgcggatctcgtctgccgtcacctcgccatccaactccggcgcgccggccggcaggctgggcgggggcggcggggccagcggtggcggcggcggcgcgggtcctgggaccggtggagggggcagggggggcaggggcggcacgtcctcgggtgggggcgggaagggcggcggcgggggcgtccgcgacctgctgcgccgccgcttggccccgcgcccatcccggtcccggctgtcgtccctgcgggccctgcggcgatcgtcatcccgcccataccgccggtcctcgcgcgagccgtcccgtgcgtggcgctccagatcccgctcaccgcgccgctcccctcggtcgtcatcatnnnnnnnnnnagcggcgatcgtcatctcgcccataccgccgatcctcgcgcgagccgtcccgtgcgaggcgctccagatcccgcccaccgcgccgctcccctcggtcgtcatcatgtcgggcgtagggttggccgccccgcctgtcctcatcctcatatcgccggctcatcacctctgaggggcgcctgcgaggctgcccttgctcgaggccgacgaacggctgatgttggtctgcagtgtccgggccagctgcagccgcttgtcgtgcaaagtgtcaaagtgcttcacctggggttgggcaggaagggagctcttgttgggccaggccccgatgatggatgtccctcatttcaacagccagcaccacatgcgcccgcttcgacaagccgagattcactgatggaatcagcatgactgcaacaagatccgcctcacccaggaggctttgcaagaggcctcgtactcctttcggacagatttgcacgccagaggggcctccttgcccggccggaattccgcaccgctaccttccaagcacgagtagaacttgtccctggcctgcaagatgggaattcgaacacacaaggatgaggctcttcaaggtgaagattggcgtgtcaggcctcactcaacccattcaccaccctccatcacctggtagcacttgttccgtgctgccctcagcacactggaatcagcagcagcagacattcctatccatccacatcacactgatttgaaagcactgctgcgtgaagaggtgcgcaagatgctttttcttctccctagggggccaatggtcggatttcccgtgctgagctggaaccagcatggcacgcagcagccacttgctgccgcctggactcgtggttctctgcacccttgggttggaagagacccgagtggtgacagaaccgaatcactaaaggtgtattggggcgtacacgccctgcgatctggttctatccgatcgccgacctggtacgtgccatcaggcaccgctcgccgaggtaggtggggggccacaggggtggggcgcaccgcgcagcgccgcgttacaaaacgacttgtgaataattccctctgtatagctctccggcggttcgatggccttcatcgcctcgcagtgtnnnnnnnnnnactcgcccaggtaggtggggggccacagggttagggcgcaccgcgcagcgccgcgcgttacaaaacgatttgtgaacaattccctctgtatagctctccggaggttcgatggccttcatcgcctcgcagtgtgaaggctggccgtatgcacgcttccacgcctcatcggtccccttcccgcccattcccgacaggccatggccggagccccgacctgcgggctgcaggatgtgaaggagggcaaggactaccattttcccacggaggaggaggctgtgctggccttctggaccgagatcgacgccttcagggcccagctggagcgcaccaagggctcccccgaatactccttctacgacggcccccccttcgccacgggcctgccccactacggccacctcctggcaggcaccctgaaggacattgtcacccggtacgccgcctgcacggggcaccacgtggagcgccgcttcggctgggactgccacgggctgcccgtggagcatgagattgacaagcagctgaacatcaccacccgcgacgacgtgctggctatcggcatcgacacctacaacgaggcgtgccgggccatcgtcatgcgctactctggcgagtgggagaaggtggtcacgcgcatggggcgctggatcgacttccggaacgactacaagaccatggacccctccttcatggaaagcgtctggtacgccttcaagcagctctttgacaagggcctggtctaccgcggcttcaaggttgttggtgggcacgcagctacccggggagatgggccgggtgcattgcgcagaggtgctgcagaccgccgatttgtggcttgggagtggatatggcttggtgggatcgtgtgtannnnnnnnnnnnnnnnnnnnnnnnnnnnnnnnnnnnnnnnnnnnnnnnnnnnnnnnnnnnnnnnnnnnnnnnnnnnnnnnnnnnctgtcttctgggaacaaaggattgcgccgccgtgatgagcacagcctaatctattttctgacacctctattgtgagggtgggcatccacatgccgctcgttgagctcaaccgctgtagtgtctgagcgcaccatcccgtgtgattcctcagctggttgcatctgaagccttggatggggcagcgtcgcctcccggccagcttgcctgcatacgctgctcctcctgcccccgttcagcttagggcgcccacccaaaggaacccccctcaccctcccacattaacctcacccactcccggcccctccccaggtcatgccctactnnnnnnnnnnccagcatagggcgcccacacaaaggacccccctcaccctcccccattaacctcacccagtcccggcccctccccaggtcatgccctactccaccggcctgtccaccccattgtccaacttcgaggcagggcagaactacaaggacgtcagcgacccctgcgtctccgtggccttccccctggacggcgacgaggaaggcgcggcgctggtggcctggaccaccacgccctggactttgccctccaacctcgcgctctgcgtgcaccccacgctggagtacgtgcgagtgagggaccccgccagcggccaggtctacattgtgctggagagccgtctgtcggagatccccggcgccctgccccccaaggccggggccaagaagaagaaggacgcaggggagggcgcggcggcgcccgccggcttccaggtgctcgcccgcttccccggcgcggagttggcggggcggacctacgcccccctcttcccctactttgcgcacctgaagcagcacggcgcgttcaaagtcaacgtggacacctacgtcaccgccgactccggcacaggggtggttcaccaggctccggcttttggggaggaggactattgcgtgtgcctggcctcgggtgagagtaccaggggggtgggttcagggcttctagagggactagcgcgctgcagcgcggcatgtggtgatgacacagcacctgttatttttctgacacctctattgtgagggggctgggccctccctgagctcaaccgcttgaagactgaacatgccgaaggcattgcagctgcagcatcctggtcgatggcacgggcacgtggtgtttgcaagccgtctgggcgagttcaaccctgaagtttgtatccccgggccccccgccccgccccttccccaatccacaggtgtcatctccaagggagaggacctgccctgcccagtggatgccgctggacgcttcaccgcggaggtgaccgactttgcgggccagtatgtcaaggtacggagtggttatcagtgggtggcgggcttgcacggggccgcagggtgatcgcagcaggcacacacgtgtggtggacaataggcaccgccctgtgctcatcttcagcccttcccgatccttccaagtcccaagccaacccctcaacccccccccccttcctataaaggatgcggaccgtggcatcatcaagtggctcaaggaggctggccgcctggtggatcagggccagctggtgcattcctaccccttctgctggcgctccgacacgccgctcctgtacaaggcggtgccctcctggtttgtgcgcgtggaggagatcaaggaccgcctgctggccaacaaccggcagacgtcctgggtgccggccttcgtgcaggagaagcgcttccacaactggctggagaacgcgcgggactgggccatctcgcgctcccgcttctggggcacccccctgcccatctgggtgtcagaggacttctccgaggtcgtggtcatcggctccatcgacgagctggaggcgcgcactggcgagaaggtgggccggagcttttcagttggggtgggcgaggggattcgggccggcttgtgctggtggcgctggagtcgctgtgtaggtcgtaggcccgatctgtgaacttcctggtgcgtagttgttgctgttgtggcgatgctgacctcagggtgtaggtccctacccctgctcccacgagtcagcccagccttggatccccccttttccaccttgcatcgtccagtccacccattcatggagccccccctgccccgcctcccaaccctcactctgcccaggtgacggacctgcaccgccacttcatcgaccacctgaccatccccgccgccgacggccggggcgtgctgcggcgcgtggacgaagtctttgactgctggttcgagtccggcagcatgccctacgcccagaagcactaccccttcgagaaccgggacacctttgccgccaccttccccgcggactttgtgtccgaggggctcgaccagacccggggctggttctacaccctcatggtcctctccaccgccctcttcgacaagcccgcgttcaagaacctgatctgcagcggcctggtgttggccgccgacgggaagaagatgagcaagcgcctgaagaactatccggtgtgtgggtgcggatggttgactggttgagcatggggagggcagctacggcttggatgtcgtgggtgcgacaggagccagggagtgcaaggccgtggggtccgggaagaggcctgtgcacatggagttggttctgggcatgtcaagaatggcaagtggggctgctgtcccgacgttgtctcgtctcttcccagcctcatgcatgtctccgnnnnnnnnnncgcacatggagttggttctgggcatatcaggaatggcaagtggggctgctgtcccaatgtacccccgtctcttcccagcctcatgcatgtctccgcccttggtcgctccagcaatcccagcatgggtccctcatccacctccccccctccccaccaccgccaccacgacccttccaggacccgatggaggtggtgcacaagtacggcgcagacgcgctgcgcctctacctgatcaactcccctgtggtgcgcgcggagacgctcaagttccgcgaggacggcgtgtttggcgtggtcaaggacgtcttcctgccctggtacaacgcgtaccgcttcctggtccagaacgtgcggcggtgggagggcgagacgggcgaggcctttgaccctgcctcgcccgactacggcgccgcctcggggtccaccaatgtgctggaccgctggatccgggccgccacgcgctcgctggcagcctacgtgcacgctgagatgggcgcctaccggctctacaccgtggtcccgtaccttgtccgcttcatcgatgacctgaccaacgtgtatgtgcggctcaaccgccggcggctgaagggacgcggcggcacgcgcgacgccgggcaggccctggccgtgctcttcgatgtcctgctggacgtctgctcgatcatgtcccccttcacccccttcttcaccgaggccatgtacggcaacctgcgccgcgcgctggggccggacgcgcccgtctccatccacctccgcgacctgcccaaggtacagagagttggtgggggggggaagggggtggtgtgcagttcagtacacagggcaagacgtgcttgtgtgtatgtcttcgatgccattcgtgtgttgtgaacgcgaccctttcacccctgggacctctctcagagcttcacacaatcctgcagaatcccaaacccttacgacccccccccccccccannnnnnnnnnnnnnnnnnnnnnnnnnnnnnnnnnnnnnnnnnnnnnnngaaacccaaatccgcaggcccaggacgcgcaggagggcgacgcccagattcaggacagcgtgcgccgcatgacgacggtggtggagctggcgcgcaccatccgcgaccgccacgcgcgtggcgtcaaggtccccgtcgcgcggctgacggtggtgcaccccgacgccgacttcctggccgacatctccggcccgctgtccgcctacgtggcggaggagtgcaacgcacgcgccctggaggtctgcgccgacccgctgcgcttctgctcgctgtccgccgcgccggagtggggcgtgctgggccggcgcctgggcaagcgcatgggcgccgtggccgcgggcgtggccgcgctgacccaggaccagatcctggccttcgagctcgaaggggaggtcgtcgtggccggcgagcgcctgggccccggcgacgtcaaaatcgtacgcagcttccgcggcagggcggcgccggccgacggcggcgcgcccaccgaggacgccgcgggcgacggggaagtgctggtggtgctggacctggccagcgacgcggcgctggagggcgcgggcctggcgcgcgaggcggtcaaccgcgtgcagcgcctgcgcaagaaggcggggct

SEQ ID NO: 41982 - DNA, 106 bp, Chlorella protothecoides
ggcgaggaggatgccgtacacctttgggctccagaagcacatgcacataccaattgcccccccttcccaagctgctgctgcacacctggcgacgggctgcatcttc

SEQ ID NO: 41983 - DNA, 161 bp, Chlorella protothecoides
gatgccctggccaccgatgtgaggcctgggttgggagaggggaatggcgaaggcttggctgtgtgttcctcagaacctgtgcccagcccagagcatgcatgacccctcccaccccccggccccctacaccaagcaggtgccaccccagatccaggagctga

SEQ ID NO: 41984 - DNA, 61 bp, Chlorella protothecoides
cgcctccaccgcccccgccgcgcccagcagatgcccgatggcacccttggacgagttgatg

SEQ ID NO: 41985 - DNA, 61 bp, Chlorella protothecoides
cccgatggcacccttggacgagttgatgcgaaggccgtcgtgccctagcaccgcacggatg

SEQ ID NO: 41986 - DNA, 135 bp, Chlorella protothecoides
tccagtcgctggtgcttgcggtcatggagcaagtcgtcgttcctgcacgcagacaggcagccggtggcgccgcggggagcccacggcgggttgcacaggggtcccacggggagcatgtggctgggtattgcccta

SEQ ID NO: 41987 - DNA, 76 bp, Chlorella protothecoides
tggtgctgctggcccaccacccatgcctgatcccctcaccccgacccacacgcgcgcaacagccatcgatcagtcg

SEQ ID NO: 41988 - DNA, 13018 bp, Chlorella protothecoides
  modified_base (1380)..(1389): a, c, t, g, unknown or other
  modified_base (1989)..(1998): a, c, t, g, unknown or other
  modified_base (3048)..(3132): a, c, t, g, unknown or other
  modified_base (3296)..(3305): a, c, t, g, unknown or other
  modified_base (3415)..(3424): a, c, t, g, unknown or other
  modified_base (3534)..(3626): a, c, t, g, unknown or other
  modified_base (4846)..(4855): a, c, t, g, unknown or other
  modified_base (5219)..(5424): a, c, t, g, unknown or other
  modified_base (5480)..(5489): a, c, t, g, unknown or other
  modified_base (9764)..(9773): a, c, t, g, unknown or other
  modified_base (10219)..(10228): a, c, t, g, unknown or other
  modified_base (10597)..(10606): a, c, t, g, unknown or other
  modified_base (11263)..(11272): a, c, t, g, unknown or other
  modified_base (11732)..(11741): a, c, t, g, unknown or other
  modified_base (12612)..(12621): a, c, t, g, unknown or other
cgctggcgcgcgccgaggccgccgagacggtcgcggaccgggaggccgcgctgggtgccgcggtggagagcctcgcagccgtgccggcggccgtggacctggccgccctggcgccgcgcctggcccggctcagggccttccgtgcgctggcgggcctggccgccagccgcgcgcgcctcctcatggggggggacggcgtggcgctggggaacggcgcggcgggcggcatgcagccatctgccgcggacgctgcctacgagccggtggtggagatcgccagggtcctgctcgccccagacccggagcgaggtgtgtgctttggggacgtagagggggagtcattgggggctggacggggggccaggcgatgctgctcgtatgtctgtcatggcagtcctgttcctgggccttcagcaacatacacagcacgtgggaacggcagctcacaacccctcccactcgtaccgccgtccccgaaccgcagccaaggggacgcggtgggagggtttggtggcatccatcgcgccgcgtgaggcgccggagctgcggcgtgcgctgctggatgcggccgtggccacccgcgatccgggcctgctggacgccctctactcctgcctggtggacgcggggtgagtctgggagggcctcgcgtgcatgcctgatgggttgtatgttggggttgaaaggtgcctccaaggtgggattgggaggtcaagtggggtcctgtgataggaagagcaggcccccgcagccagagcttccactgggaggcaatgtggcagcgatgatgaggctggtcagaattgcaaacggaacgcattgcatagtagcacatgctttagtaagcgaaaggcaatggcccgacctgactacactgcacatccacaaaacccaaacacagggctgtcggggagctgatcgccgccgatgcgccggggctggagacgcacctcatccgcggtggcggcctggcgggcgtcgcccacgcctcccagatccggggcctggagccggggcaggtcgcgcgcgtggtggcactggcgcgcttctacaccgcgcgcagggagtacgccaaggccgcccaagcctacgaggtgctggccgacgtgccagtgactggcccacgccaggagctgacgctggagcagagggccgagtacctggccctcgccaccctccaggtgcgaggttgggtgtctctgtcgctgaggttgggggagttggtgagtgaggcgggttgtgcacatgggtgtatctcggctgggcgcgctgaccgccagggcttgaaccgaaaaggtctgcctggtcctgacacgattgccagccccatctgggaacctctccccacaactccgcctgcactccgtctcccaggcgcgnnnnnnnnnnagggcgcgctgaccgccagggcttatacggaaaaggtctgcctggtcctgacacgattggcagccccatctgggaacctctccccaccactccgcctgcactccgtctcccaggcgcgaagctgtggggaggctgtgctcctggaccagctcacggccaaggccagggtgctggcggcgcagaggcgcatcctggagatgctgacaagggacggtgagcaattgagcgagtgtctggtggcttcttgctggatggatgagaaggtgaagctcctgtgaggggcatccttgccagcacgattgcactcacatcttgaacctgatgtcacatccacactccagcagaggagggaggggcggacgccgaaacgctggctgcactggaggcggggccgcgacccctggcagagctgtacaacgacatcgccgtacctcgccaggtactgcgaggcttgtggtgctgcaggaagcgtgaggtaccgtgggccttcaatgttctcagcccggcaggctgtgtgagcatctctcctcagtccaacctttgagggactccaattggtaccccccccacaccttgctctgcagctgtggtcgagctgcnnnnnnnnnntcaggctgtgtgagtatctctcctcggtccaacctttgagggactccaattgggccccccacccaccttgctctgcagctgtggtcgagctgcctggagatgattggcatctccgcctatggcgatgccgcctacgtctcacagctctgggacctctcgctcaagtctgcctgggaggtacgggaacagcgcgagggagtgttcttgttggtgcagtgatcgttcctcgcccgactgctgccgtatcctttcatgcgcatacccactgtacaaactcacaaccaagcgcagaggggctgggcgatggcagcgccggacagcgaggcggacgatcctgtccatgcagccgccgaggcattggaagaggtcgctcgcgaggtggagtttgtcgcgcagtccgtcggagcccccgatgagaacaggtgtggtggatgtctttgcgtgatctcacgttgttgcggagcctaaccggaggctgcttacttgaagggctgcaattttaagatgtggagaattttcaacgccaaggctaggcatccaaccccctccctcggctctccttcctcatcaatgcagcctgccgctgccgcatgtgacccttcgcctcgagcaagtggctgccggcctctggcccgtcgagacggggctgccgctccccgccggccgcgtcggccgcgcggtgtcggtcgccgccggctcggatcgcgagggcgccctccgtgcctacgagaccctgctcggcacggcaggggtcgacgccggggacgagtctgccgcaccctcgctgcgcgcgcgcctcgtggagtcggcgctgctcctcctgcaggccgccgccgagcagttgccgggcaccgcgccgcgcgagcgcgcggcattggctgggagctgcgacgcgctgctgggatatgcacggcggcttcaggacagcgcagctgccgcccgcctcgtcccggagctggaggcggctgccgctgccctgcactcccgcacctctggcagggggctggcgttgctgggagggttctgatgaggagggggcgctggacgctnnnnnnnnnnnnnnnnnnnnnnnnnnnnnnnnnnnnnnnnnnnnnnnnnnnnnnnnnnnnnnnnnnnnnnnnnnnnnnnnnnnnntctgagcagtagcagacaggttgacactcactgtcagagaggcagagagggggtaagcaaccatgcaaccagggatgcctatgatgccaaaggctcatgctggctgcttgccgcctctggctgctgcgtcacatgccccgcaccccccattgtcatatccagcnnnnnnnnnnggtgaagttggggtcgagcatgcacagtgcgcctcgtgtctctagcatgcctctcgctgtcgagcgtggtccaggaacgaggctagcaacaggaattcttgcaaaggcgnnnnnnnnnnagtgaattcggggtcgtgcatgcccaatgcgcctcgtgcctcttgtatccctctcgctgtcgagcgtgatccaggaacaaggctagcaacaggaattcttgcaaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaagcagggatgcctatgatgtcaaaggctcatgctggctgtttgccgcctctggctgctgcgtcacgtgccccgcaccccccattgtcatatccagcgtgcctcctccggcgctaagcatgagcgtgggtttcgagcaggcccccgctgccagggtcagcaggcccgcgccgtcgctccctgcagcggtccgcgcgcagcgcagcagggaggcctccagggagcaggtggataggaggctcagcagggtggccctgaagcctcctgccatgggtccggggcggcgcgccgcacattgggcatcggatcccaccctgcccgccgcggcgatgatgcgttccgcgatgctgcgcggggacacgcggccggccgcccctgccaccacctgctgtgcaaatcccagcaggagggcgtgcagcaccgcccactgctggtcggtgaggccgggaggggaaggaggctgggcgaggggggaaggaaactgggctggagctggcagcggtggccttgattcaaggacctgcaccccttggagtgctccctccctgtccaaggcctggaccaggcagaactccagcagtcgaaaccacagggactgaggcttggtgtcgggagctgaggaggcgccgtcgcccaacccatcatcctctgcttcttgtgagaccctggcgaatcgagagggggcaaggaaggggattcaactcatgcagggcggaacatctctgcagaactctgctaaacaaattcctggtgtgcagcaagcttggccatgacttcacacagaccctcaccttgtgcacagtgtcagggcagcttccagggcccgctgtgaagcctggagctctggcatggatgacccgggaagaggggcatgaggactgctggcatcaggccatgcgcccctggaggccgtcccagcgctgaagctgccgcggcgcagatcgatgtcctcgcccaggctatgctgactcatcatgaactccgcaaggtcggcgtcgctggaccgggcaatgcgtcgagccagggccaaggtggatgcggccagtgcctgcaggatggtgtggcttgggagcttagtgtggcaggaacagggaaggaaggggaagtcaagagattggtagctatgagactcagcttcatggccccattaggatctgggagaagtacaatgctcagacgcttggtgatgtccatgtgaacgcatgtcagactactttnnnnnnnnnngagaggttggtacctatgagactcagcttcattgccccattaggatttgggagaagtacattgctcagacgcttggtggtgtccatgtgaacgcatgtcagactactttaccagcccccgtacctgcacgtaaacctccagggctgcgctggagtccccgctgcgttccaagagataccctgcggccgtttggcagccctcgtgacgcatgcaggcctgcagacaggccgtcacgctgtacccgtcgtgcgattggaggaaagcaaggactgcaaagtgggacagggtgtcatggggttgtagcaatcgagggtgcaaagggagggggcaggtctcctgaaggcaaccgctgcccagattctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcattgcagagaccggttgttggagtgcaatcgagaaaatcttgcctccaccnnnnnnnnnnttgtagcaataaagggtgcaaggggggggcgcaggcctcctgaaggcaaccgctgcccagattctgactcccctcacccttctgtggctcgtgctggcaaaggaggtccacatagcgatcaacgacgcctcgctcacgcagcagagccgacaggacctggtacccctggggctggagctgcgtcaaaggggggccaacaagcgagatcaggacagagctcgcaagcgtgtgttggttgggcattgcagatacctgttgttagagtgcaatcgagaaaatcttgcctccaccttgaagccagacaattcaacagcgagtgctgagtgtcagacaccgaatcactggctgcctctccaatcctccgatccaagaccgtccccacggacacccccaagacacaagaatcatccctgcgcccctcagcgcaccttgagacgccctcccccgtcccccagcccaaccagcgcccccaggtagccgtagtgcagctgggcctgagaagcgaggccctccaagatctgcctctgccggtccggcgcgatccaccgcaggaagaaggcggccgctgagtcggcgtcctgagctacaaaggccgcggcgcgagagacggcatgctccaggaacgcagagcgagtccccgcatcgatctgtgtgctcccatccagcaccgactctgcgtaggcagcggcgggggccctgggcgcgaggctgccctcagatgtctccgcgccccagctctcaatgctgaggcaggaggccagcgccgcagcgtagtcgccgccggcatggtgtaggctggcctcggcgcgtgggaaagagtgccgcctggcgagtgacagcgcctcctccctctccccaggggtcattgccgcggcgttcacggccgtgacggccgtgaacgccgcctcgccgtggggcagggcggcgaggcgctgcagtacccgcagtaccacgccgccacacgccctggcccggccggcggccaggtgggcgccgatgaagtccaggctggcgcgtgcctgcggcacctgcgctcatccggggtgtgtgtggggggggagggggaagttgaagggaactgttgggtgcctgggtgactgaaagttggtgcatgctgagatgcaccatgctcaacttgcaccgagcacctgctgatcctgggcacctccagcatcacaaacttgccctcaatccccactgaaaacaatcaactcacatctgccggccaggtggctaggacctctgcggcgaggacgtcgaccgcgtgctgagtcaccgtgctgtccagggtatcctggtccatcctcgggcagctctgcccggcaaggtcgaccacgtcgcccagcatggcctcccacccctccagtccagaggaaagcacggccaatgttgataacgggtctaggtccatcaggaaggtcagggcggggtgtcgcgattgctgcacagaagggtttgatagaggggttggggaggttatcagagcatatgcaagggttggtgggtggtctgtgccatacgtgttgggtccctcccgctctgagatcaacgctatcgtcgtggatgccctgcccatcacagcatcaccgcacatgccaccccagtaacccccaagactgacctggacggctggcggtgcggaattctgcccccccgactcacgctgccccccgctccaggccctccagcagtctgcgatggccggccatggcgtcagcagcaggaaggccagggcctggctcttggccacgggtgcgacgccggggtcaagcgagccggcgcggtggggagggtagcccaggcccagcaggcacgcctccagcaggagccagagtcgcgcggccagctgcatctcccgggcagtgtacgggcgtagtccatctgcctggcagccagcgcctcggggaccatggctggcggcaccagcctcagcgtcgccctttccttcctgcgcagcccccgcgctcaccgcctccaccagcagcaggcagaggggcgtggtccagtcgcgcaggaccccgccaaagatggcaatgagggcggcatgcaggtcgtggcgcatgcagagtggcaccacctgtggtcgagacagggacggagagaacttgttggatggggagcaatgcagtgccaagaggcccaggcggagccaggcagtgtacaaagccagcgtccccaaccctccccaagcatcccaggacactagtttcatcgggacactgccctgcagccggcacctggctgaggtccagggtggtcgggtccaggcgcagcacgcacgcctccacgacctcggggcggccggcggccgcgtagcttcccaccagctcctgcatcacctcgggtcccaggctggtcagccgacccgccgacacgtgcggcaccagggcctccaggaaagcatggcgtggggtcgcaagcgaggcctcgcccaactcgcctcgtccggccgccccctggtcctgtgcacctggcgccgacagaaaagcgttcgccactgcgcctgagaggaggtcggggcgcccgagcaggaggcaggtgcgcaccgccacgtcagccagcacggcagggctcaggaacgcatgactggatgcagtgcagccgtggtggtcgccactgcctccggtccctcgagctccctgcgggcccgccagctggtcggccagcagcgccagcagcgcgcgctcggcggcaccatgcacggcggcacgcccgctcggcggccgatcggcgggccaggcgctctcgagaccgggtcggccgccgcgaggcaccatcagcacacgagcctctgccttcaggcaggcgcagagcaccgcgccgtgccgccccgccgccgccagcgccgcgcagcgctggtcccaggtgcagcgctgcaggacgctgacatggcggcttcccagcaggacgacctggtccccggcaaaggccaccgcatttccggccggaggcgggggtcccggcgcagacgcgccgccgctaccgccgtttgcttcgtcagggggcgggccgccggccagccagtccggcagccgcatcgagtccacgccagtcatgtgtggggtctgcagtgcgccgtgaccagggccgtgcgtatctccaccccgccaggggtctgcaaacatccacaccgcggtggaggtgcctgccgggccccagggcgccagcgccgtcaggctcccgctctgcagtagctgaagggctgaaggggccgagggcaggcgcaggacgcccagagcctcgggctcggcgagtagcggggcctcggcgcgatggtcacgccgcggcggcggggtcgctgggttggacgcgctggtgcctcctgggcccggggacgctgcgtggctggcatccccccttcgactgccgccatcctcggcgacgggcggcggcaggctgtccatgatggaggtccggtacagagccaccctgcctccgctccaggcgatggcgatgtgcacggtccttctcccgccaggctctgaccagtcctctgaaataccccaggtcgcaatgggaggcccaggaggcccagaccacgcgtcttgaccctcaaggccggggtctcggaaggcgtggtgtacgcgcaggcggccctcgggcgtcagctggcagacgagcacggcgtggggcgtgcctgccagaacccagtgcccgatctcctgggggggggggggaagtggtggcttcaaggcggagacgctcagtgccagaggaatgatgggctctggggaactatggaaagtggtgtcgggcagatcctgtgcatagcctgcatgcctcctggaacttcttcacacagtccctctcaaaggccgccgcacgtgcaatgctcaccggcgtgaagtgggacagcgagggggcgacgcccggggtctccgacccccggccccccagcgaccgatgggaggccaacacgtcgatggcgagcacgctgtgcgcatctcgcggcggcctgtcccccggctttgatcccgggggcgttgcggcgctggccaggtccagcacgtgggagggcactgaggccgacccggtcagctggcctgcgaagtggaaggtgggggatagaagcctggtcatgcttgaccaggaactttgctcgaacggcccaggctgccggctggaggctgccgaggatgccacattgcacatggtctagctcgtgcacaatcacagtgggctgcaaagaggctatgtgcttgacacccagggacgaatgggccctttcacccaccgccccccccacccctcttgctcacgtgcaaagctggtgannnnnnnnnnaccgaatgggccctttcacccaccgcaccccaacccctcttgctcacgtgcaaagctggtgagggcctggctggttgcagacaagtggcgattcacgtcgtgggctagcagccgcccatgcgcatcggcagtcagcgcccaggtaaccccgccaccgtcggccagcgcggcgcagacgacgcgcgcgccgtggactccggccaccgccctggcgaggagccaggcgggcggccccgccagcgcgcgcgcgcgcagctcccatagccgcacgccaccacccgcgtggcccgtgaccagcaggggcccgccggcgtgggagcccagcgccaggcaggccactgcatcgccgcgtgggatagaaggatcagccaccaggcgcagccctgaggggtctgccgtggcggcggtgggccgagggccggaagtcgcagcgccggagacggctnnnnnnnnnngtcagccaccaggcgcagccctgacgggtctgccgtggcggctgtgggccgtgggccggaagtcgcagcgccggagacggctggactcggcgggccggggacgaagacggcagcggtgccgatggaggtgcccaccgccaccatgcccaggtagcgggtgatgcaggtgggctgcccggtctgtcctccccggaagagctgcagtgatggtggtgggggtgacttgtttcgcgggcagcagtctcgtggcggacacggcacacactcagctatgaaacacgttcagaggctgtccccagcagggccgcccagctccagcgcccatcacgcccggtccgtgccccagccagacccagacccacagcgcannnnnnnnnnatttcgcgggcagcagtctcgtggcggacacagcacacactcagctatgaaatacgttcagaggctgcccccagcagggccacccaacgcccatcacgcccggtccatgccccagccagacccagacccacagcgcaccgggtcaaaggggaccgactggaaagcacgaattgcggcgtgcgaacccgtcaccgttcccctcccgtcctgccacccctcctccggccagctcccatctaggggcgccagctgctcaagcagcacggcacactccaccagcgggtcgctggccgtgctttcctcggagtgatcgccaatggaaggcgccgccccgtccagcccctgccgtcccagagaggcaggcacctgcatcctggccaactctgcctccgctgcagcggcgaggatgcaggcctgtgcttcggagctcaggtctgctgggtctgcagggtgcggaatgccaatgtccatgccctctccagggcttccgcgcggatctgttgacacatcaactatcgttttaggtagagttccgttctcgcccggcgggagaggggcgattattgttgagtgggaccccagcagtgcttctccattgtccgactctgctggcatgtccatccgaaagctcagtctggctggccggtctaactcttnnnnnnnnnntgcgcggatctgttgacacatcaactgtcgtttttggtagagctccgttctcgcccggcgggagaggggcgataattgttgagtgggaccccagcagtgcttccccattgtccgactctgttggcatgtccatccgagagctcagtctggctggccggtctaactcttggagctcattcaaagcgacgctccgctctgctgcaatgtccgttggagcctcaacagggagtaactcctcctcttcttgatacgatgtcccttgcggtaggttaaccaggccatcgccatccaagggtgccgccttctccgcaaacaccagtccgggtttcgccggtgcaaaccccatgcccaatgcatcctcctcctcactgtcagtgatggagctcaagcccccgctggaggcagggctgaggccatctgcggattggatgtcagctgagctggcgggggaggctggggnnnnnnnnnngtcgccgcagctgcctctgtctgaatgctgatcgtctcctcctgtgcgctcgctgtgtctggtccggcgtccgagggcaagcctccatctacggctgtggcctcctggcaagcgatgtcatcctgacgaggctcagatgtctccggaacatcatgcacaggctcctccccatgactagctgctgaagagctcgggggcgattctgggccttgctcctcagtgtgcaggcctgcgacagcccatctctcctctaaatctgctccctcaggctcttggcttgactcaacggggatgacttcaatgcccttgtcaacaggagcctcagcccccccccttgcggctcggtggatgagcaggcttcaggctgtgggagtgggcagcggggtctcttatagctctttggcgcaacaagtgatgtgcatctgtaaacactctctctagatggagacacgtcgctatacctctgattcttcatcgctcgccaagaggtcctccaggagccgatcaaggtctgcggccattcccagccctcaagaagtgatcttggcaccggggtcgttccaggactgctccattcccctgttagggaatactacgtatatacatcccgttccacaggtgtttaggtcgatactcttacagaaagggtgcagaatctgttgcactggggccatgcagctctttcgttgatcttcgtgggcgcccggaaccaccacgatcgctcttgtacgctctttcctccccacctgcttccacactgccggtgcgaggttctgctaaatcaccggctctggcgatccagtgccctgtgagaactgttgcgagcggaggattttcgagcagttgacacatctatatcgtccgcgcactnnnnnnnnnncgcgagcggaagatttccgaacagttgacacatctatatcgtccgcgcactcaagctttgcttgtggagcaagtcggggtccctgcgcggaaagtgatcgcacctggctcccgggccctttcctcgggaccccgccatgacggccggcgtgctgaccgcccgacccatggatctcgacacgaaggagccggggttggagaccgggcgggataccggtgacgcactggaggtggccgacgaggacctttacccccgcctcaaggccttgcagcggcagctggagttcctgggcatccaggtgaggggtatgtgcttggcggaaggggtgaagtgggggacggaaggggccgttccgccctctgcctgcctacccctccccacccccaccccacccccc

SEQ ID NO: 41989 - DNA, 87 bp, Chlorella protothecoides
atcccaacttcctcttttcctgagccccccgcccccctctcactgcccccagtctccaccccacccctctttaccacaggagatata

SEQ ID NO: 41990 - DNA, 133 bp, Chlorella protothecoides
cttagtgaagtggcacccaagagcatgccaggcatcttgtcccttccaccatcagcccgcttcctcggtcacagccctccaacccccctccatcaccccccaacccctcgcagcccggtcccacccgaccttc

SEQ ID NO: 41991 - DNA, 61 bp, Chlorella protothecoides
tggggatgggcttgccgtctgcaggcgggggagggggcgggacaggggcatgggcgagggt

SEQ ID NO: 41992 - DNA, 70 bp, Chlorella protothecoides
ggttagggaactggcttgtcacaggcgggcttgttcgcaaggaggggaaccctgcgtgctgcccgtggcc

SEQ ID NO: 41993 - DNA, 61 bp, Chlorella protothecoides
tccaccaaccagctcggcagcaaaggtaccatggctgcgtcccgtgcatggatgaacgcgt

SEQ ID NO: 41994 - DNA, 62 bp, Chlorella protothecoides
ccccccccccctcctttgcctgcacctggtcggggttgtccagaccctggagggagcacagc

SEQ ID NO: 41995 - DNA, 103 bp, Chlorella protothecoides
cctggccgccatctaccggcacgagggtttttcgggcctgttcaggtatgcaggcgcgccggtgcccatgcacataatgccgggacggtgtgcgcagcttccc

SEQ ID NO: 41996 - DNA, 71 bp, Chlorella protothecoides
gagcctgagtccacaccttccagagctccccgcccatctgctggagaccccaatcattcggcccaggccag

SEQ ID NO: 41997 - DNA, 162 bp, Chlorella protothecoides
gcgggaggcgaagggagaaggagagggaatgatgcggcgacggggtggggcctggcgtgcgtgggcggggggaggtggccggggggttgcgcctgggggtgccgggctgggtctggccctgcgggcctgtctcgcgcagggtgccgcagcaggacactgccc

SEQ ID NO: 41998 - DNA, 61 bp, Chlorella protothecoides
gcgtttccgggtgaagatgtaggcggcggcggcaaagatgagcagcgagcagccggcgatg

SEQ ID NO: 41999 - DNA, 70 bp, Chlorella protothecoides
gactacgcgctggggtccaggtaagaaagggagaagaaaagagggggggaggtggcacatgatggatggc

SEQ ID NO: 42000 - DNA, 61 bp, Chlorella protothecoides
gcgcactgtgcccccgctactcgaaccctcagagcgccccttcaccagggccgacatagta

SEQ ID NO: 42001 - DNA, 61 bp, Chlorella protothecoides
aacatccagccagtcgaggtctattggctggatcatcacgccgcttccctgtgccaaacgc

SEQ ID NO: 42002 - DNA, 61 bp, Chlorella protothecoides
taagataggaatgttacagacaagaccccgcatacggtgaggggcttgggtttcaggcacg

SEQ ID NO: 42003 - DNA, 70 bp, Chlorella protothecoides
ccatgagcacatactcctctgcaggttggcttttagagtgattgtctttgcaatcgtgttgaatggattg

SEQ ID NO: 42004 - DNA, 78 bp, Chlorella protothecoides
cccggctggaggatcctcagctcaaaccgaactcaacttctatatcgtgtggcctcgatgggcgggagttttcgggga

SEQ ID NO: 42005 - DNA, 41122 bp, Chlorella protothecoides
  modified_base (1344)..(1353): a, c, t, g, unknown or other
  modified_base (1737)..(1746): a, c, t, g, unknown or other
  modified_base (2504)..(2513): a, c, t, g, unknown or other
  modified_base (3262)..(3271): a, c, t, g, unknown or other
  modified_base (3670)..(3679): a, c, t, g, unknown or other
  modified_base (4964)..(5095): a, c, t, g, unknown or other
  modified_base (5178)..(5187): a, c, t, g, unknown or other
  modified_base (5395)..(5421): a, c, t, g, unknown or other
  modified_base (9232)..(9241): a, c, t, g, unknown or other
  modified_base (9620)..(9685): a, c, t, g, unknown or other
  modified_base (10133)..(10142): a, c, t, g, unknown or other
  modified_base (11201)..(11210): a, c, t, g, unknown or other
  modified_base (11563)..(11572): a, c, t, g, unknown or other
  modified_base (12324)..(12333): a, c, t, g, unknown or other
  modified_base (13497)..(13506): a, c, t, g, unknown or other
  modified_base (14969)..(14978): a, c, t, g, unknown or other
  modified_base (15909)..(15918): a, c, t, g, unknown or other
  modified_base (16288)..(16297): a, c, t, g, unknown or other
  modified_base (18101)..(18110): a, c, t, g, unknown or other
  modified_base (21968)..(21977): a, c, t, g, unknown or other
  modified_base (22629)..(22638): a, c, t, g, unknown or other
  modified_base (23090)..(23099): a, c, t, g, unknown or other
  modified_base (25938)..(25947): a, c, t, g, unknown or other
  modified_base (26612)..(26621): a, c, t, g, unknown or other
  modified_base (27392)..(27401): a, c, t, g, unknown or other
  modified_base (27769)..(27791): a, c, t, g, unknown or other
  modified_base (27951)..(27960): a, c, t, g, unknown or other
  modified_base (29228)..(29237): a, c, t, g, unknown or other
  modified_base (31266)..(31327): a, c, t, g, unknown or other
  modified_base (31472)..(31481): a, c, t, g, unknown or other
  modified_base (31993)..(32002): a, c, t, g, unknown or other
  modified_base (32365)..(32502): a, c, t, g, unknown or other
  modified_base (35135)..(35144): a, c, t, g, unknown or other
  modified_base (35725)..(35734): a, c, t, g, unknown or other
  modified_base (37638)..(37647): a, c, t, g, unknown or other
  modified_base (37911)..(37920): a, c, t, g, unknown or other
  modified_base (40102)..(40163): a, c, t, g, unknown or other
  modified_base (40340)..(40349): a, c, t, g, unknown or other
  modified_base (40444)..(40453): a, c, t, g, unknown or other
  modified_base (40547)..(40648): a, c, t, g, unknown or other
gggggggggggtggggggggtgttgaggccattgggcgggggcattgagattctgagctcagggcaggccaatgcgggcgcgacgctggccccggctgtgtgatagtgcgctgggacaggatgtagactgtgagatcgtcccacccagattgatgctgctcacagctgggccgatccattcatgactgcggggcacgctgtctccgagctatggcaccccacccgccatcgtttcaatgacccacgacacaccccttctctcgttgagcaagtccccgcaaacccatgtcgctcaccacgtagcccctctccggggcaaaccaggtgcgggtccgggcgtagagggtcaacacgtcggccagcgccgtcaacccgccacccaaacccacgtcaacccggcgcagctcccgcacgagatcggaaagcgcggcgcgggcctcatcgacgccggccacgtcccgcagcaggatgcccagcaggcacaccagctctggcgcaagctcagcgccgtgcctggccgccagcctcgccacgtcctcccgggtctgggtggcggagaagtggcgggataggctgggggaggacaagacctgggtcaaaccctgcagcgccctgaaacccacgctgcgcggacctgcgagtggcgctggcgggattgtgtgagttgtgtgtggaatggtgggcgcaggtcgtcatgcaggggtgctggtgagatgctgagcaactgcgacaccgcaacttgacacaacatcgcaacgagctggcggtctccctccagattcttcaccctgatccgttcccataaccccaccatccgccagggcacaaacgattgcccaacatcaccccccaaatgcactacaatctcaccgtgccagaggtggtccaggacctcggcatcggacagcaggtagatcgctgggccctgggactggcccggggctgccagcaccatcttgaccttgtccagcgtgatcacgatgttctgcaggcggttggcagtcacgcctctcgcctctgtgtaaaagtaaagaggtggggggatttaaagaggagctgccttcaaacatcaggaatgtccaggctgccatggacttgtggcgcgccatcagatggaatgcatggcacccagatgctcagctagtataaattcatgggcctgccccttcagcagggtcctgcttcgatcaagtcttctccgactccaaacagctcccgtaacaattgaacccaagatgcacctcccgccctgcctgccagtgagcagccatctccacctttccctccccaaaacaggcaacataccagcgctcgctgtggcctctgtgtagatgcccagcggannnnnnnnnngaattcatgggcctgccccctcagcagggtcctgctgcgatcaagtctcctccgactccaaacagctcccgtaacaattgaacccaagatgcacctcccgccctgcctgccagtgagcagccatctccccctttccctcccaaacaggcaacataccagcgcttgctgtggcctctgtgtagatgcccagcggatgcttgagcagctccgagcagaggctcgcctgctcctgctccaggtactcgcacacaagagccgcccacttctccaaccaggcgggcactcgctgcccctgcaccgcacagcccagggcgctcgaccccagtccgtgacgctgcggcgaggcgggggcacgcgtggaggacaggcagggagtgatggaannnnnnnnnntgcgcttgaccccagtccgtgacgctacggcgaggcgggggcgcgcgtggaggacaggcagggagtgatggaattgccagcggccatgaaggcgggtagcacaaggggccagtccaacctcccttggcctggccctgggatgcttcctgcagagggccatcctctcgctccagatcccaggcatcgtagactctcccacaaccaaaaacaaccccctcacccggagacgtgccgcgtcgtccggggtcaatggctgcgaggcggcgcggaggaggcagacctggcggtgcagaaaattgtgctttgctgccatgaccgtctggaatgcacgggagccagtgtagtagaggtaggagcccctgatggtggcgatgaaatggaggaggggtttgtctggcacatgccttagggcagcatgctttgccatgcaaagtgcaccacaaggtgctgctgctgatgcacattcagtgtatcccactctgctgtaccgcccagagggcttgcctgcacgtcgcggtgctgcacaggcagatggcatcccggaactccttctcagactcggtgacagacgagtagtcaaaggtcagctcctctcctaataagcaggccagatcatgggagggtttggggagggacatacatggcgtggccgcaatcatttgtcctgcaagcacttgcttttgggcaagcattccttgggccattgaatggcacgaggggatatgaatgctgatgaacttgctacccctcctcctgcnnnnnnnnnnaccgcaatcatctttcctgcaagcacttgcttttgagcaagcattccttgggccactgaatggcacgagggaatataattgctgatgaacttgctacccctcctcctgcacagtgacgtgttcactgccatgcccaggtgccgcctcaccctctgcgatctggcgcagggtgtgcattgcgatggtaaggcgcccatcgcaggccatcaccgtggcctggcaatttggggtacagctgtggctcatgcgtgacgcgatcgtcccctgcaagggcgggggggcaagcaaggaggaaagggggggaggttattcttgggaaatcgggctgcggagctcagcacaacattctactctgccctgcgtgccacatgcctgcacacatcatgccgcaagcgctgcccggggtgccacatccacatgcgtcagccgttgcacggctgtgctgcacgaatgctccaccttggaggcggcgtcgatgaagaggacatcatacccttgctcgtcgtcctttggccgctccaagactatgttgtagaaatcgggcagctcgtcacctgtgatcttcttaaccgcgtcctgagggccagtcaagtaaacatgtttgtggttggtagagggttcattgattcctgtgcacatggtgctcctcacagtggccagtgcagccgccgctcagtggttccccactctttcctttgcttggaagaacagagcatgccgccaggcacatgccactcaggagcaaacannnnnnnnnncgctcctcacagtggccagtgcagccgccgcccagtggtcctcctctctttcctttgcttggaagaacagagcatatcgccaggcacatgccactcaggagcaaacagggcccgccccttccaatcccgctgcacctggatctcaaaccatcgccagggggtgtggatctcccccagatactcctcaacaaaggtgaggggggataggccggctggccttttacacaccagccccatgcccttggggtgcagcctgaagtaattgtaccccacctggtagcgtgggggagggcaagagtgtggggctgggggataagtgccatgcaatgcggtgttccgcgcgcatgcatctcacgactgttattatgaatcgagacgttccctccctcgcccgcacannnnnnnnnngttgcgcgcatgcatctcacgcctgttattataaatcgagacgttccctccctcgcccgcacaccttggcaagcctgtcaaggacagccttggcggcccgagcgctggcaggcacagctttttgatctcgctcacggatgtgattcagggcaagggcgatgtcccacccatgctggccctggcggagggtttgggagggagaaagttgggaaggtaccgcacagaacgatctggttgcccgcggaccgtgggcggatgcgctgcgacaactttcgcccagagggcaaagatcacctccaacctccccctcccctccacttcaatcccagacctgcttggtgatggccggcagcaggacgccctctatccaggcatgcacgcgggagagcacgcccgcggcgtcagacccgaccccctccgcctcgatttctccaccggcaggcgaggtggcgagggcaaggcccgcggcatggccgcccgcggtggccgccaccacggccgccgcggctgccttggtggtggaggagctgccgaagggcttgcccccaccctccgctccgtcctgggacaggtccgggtgcggcagctgagcggggctcttggcctggccaaatgccttgctttccagcacggctgggattagaggagattgggtgggaggaggtggatcaaggacatatgtgcctgagcaccaccccaggtagtagggcgagtgaacatgcagatggcagcagttgatggtcttctgtgtacagaatgaacccctctttgcatccaccgtcatctccacgaagatcatgctgcaccggggcaagcagccccgcacctcaacacaccctgaagtaccatgacattcacacaaatggcttgtctgtcgccccaagtatcctgtctcaccatcttggatgttgcggcgcgtgtagcagtccatgccccaggcgtccctttcttccacatccaccccaagctgtagtgtctgcctctgagatatcgctcgattcaagcactctacttggtggtgtggggggtgaggtcttcagggtactgggatgctgtgagcggaacgaggtactgggagtaaggtccgccaccatccttgcatcttgggtggacccgcaaggtcaggtgcaccagtcccctctggccttgccgtaggtcaagggtctgtacacacctcccgacggtcacagcccaggaacatcttgcacccagacactcctgtgcagacaaaaccctctttgaggccctgcatgccccctcccagctctgaccctcatcgttccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttcggctcatcttctcaacgtggggttgcgaggcaatcacaccttgagtagcgagacccaacactcgactccggcccctnnnnnnnnnngcacccctatgcagacaaaacctctttgaggccctgcatgcccctcccagctctgaccctcatcgttccgccccaccagctgttgccccaccttgagcaggacagccgcaagcgtcgtcgcactctgtgttggcggccaggcacgcacagccagacctgaagcagtcgtgctccaagcttcggaacaggcagagcagggcaggggggnnnnnnnnnnnnnnnnnnnnnnnnnnncaggcatgtccctctcccccactgtcctcccatccctcagcctacctgtagctgcccaggccatgagtggtggtgcagttctggccatcgcagccccccctctttgtggtcaacagcttcctccggatctgctcgaccatgcccggctccaggatgtcatactcactcaggcgggtgtagggccgggccgggaatggctccttccgccactccccatgccggaagggctccttgttggcaaggatggaggggggcaggcgcaggctgcccggagtgcggctgctggcgccgctcgaggaggccctgtccgccatgcgacccggttttcttgcggtgtcggggccgcgcagtccgtctgcagccagcaccccttccagcccgctcgacagaacggacaggagggcgtcctgcaggctcgccaggcggccccggcgcatggcagcgccctgggacgaccaaatggcaaggggaaggtggggaatggcatgaacaatgcatctgtggcaatgtggggctccgcaccaggccaatgatggtgagtcaaggctgcaaagggcacaccatgtccatcctcacggctcctgtcaccaatctacagagacacagactgcggatgccgacctgcagggtgatgtatcgctcggtgcaggcatgcacctcgtctgccactgccgccagcacgtccccaacatcctcaaaggatccagctgtgggaggggcatggtgcgaggaggcaattgatccagccactcttcacccttgcaacactctgctttcagaagacattgcagggagaacgcctccagcaaaaggagccgctcaccctctagggacgagatggtgttctccagctgcaggcccatgccctggagctggaccaaggcctggctgccccgtacctcctctagcagcacttggaataactgcgaaagggtggagtggtgggtggtacttgatactggtagaaggttcaagcatgacaagccttacatagacatgcacgcctcgttccggggaactcctgcaccagactcccaacttctgacgagcgtcaaccaggaacacccaccttggagtgtgggtgggttggctgctggcctgcatccccatcgccaagctctccagcaccctcctgcttctgcgtcttgaactcccccgcctcgaacttgacgaccacctcctcgccgccaccggcacgaggctgctgcagggccaaacgcaacacccgccccacctcacgctgcgaggcagcatccaacacagcgaggctccctgacagggataaggggtcggggctgtccccgccgtcgccgccggccttccgcttccgcgcggcggccgaagccgcggcgcgcgcccttcgcggcttgcagtctctctgcttgtgtgcggcgcaggctgcaacgacccctgggtcgatgcagatggaaaggtgatcctgcagcgccgacgccgggaggaagagggagggacccgaaggtgctctgtctggagccctgcctgtcgtgccctcgcttgctaaatctccctgggccagcatgagagatgatcgaccaccatcgccctctgccgctccactgaacgcagcgttgccagcatccaggaggtctgagagggcctgtgcccgctcacgctcccccctctcaaactggagccgaatctccgaggcacaggcggctctgaatgcatccacaacggcagaccccggcacactggagctcttcgaggattccaggatcttgctgttgtcgaataattgatgggaggcagggcaacgtgaggatttggagaggccatgtgggagcaggagagggaaggcagtggtctagccaaaccacagaccgagacctgctctgctgttccaactctgttgcccatccctccgcccgatagaacacacctgagcatgtatatgacttcccttcgatacacctcatcccctgcttccaggcaggagagcagatcgccttcacgtgcagcttgcaacaagtcagtcacgactgcccgaccttctccttgggagaggatcccctgctcaggactagaggacacggcaacggcctctgagccctgatccccactccaaacggtggatatgggtgggagtctgaacgtgggtcgcatcgtgattgagaatcgcgaagtgggctgtcagttgcacctggcgggatgcgtcggtcgtggagcagggcgcactctccctgccagatggcgtgctagccttgctccatgatcagtatcgctattaatactaaccaaagtgcatcgaaatgtggtcagcaagtcagcaatgcatgcaggaggatttggatcgagatcacttggaccgatggcgcgctcctggtatccgcttgaaatgtcttggcagaagccctcccagaggatgatatttgtagcactcgctgaagactgcatggcgcatcattgcacaaaactataaaaagtctggacaggtgtcgataaacgcttgaaaatctacgcgagggggatctgggccggtcccggcagccgctacggaggggtgcaggtagtccactaggcagcaccaggaagtcatggcgagcacggctgtgctaggacactgattctctcaggtcggaccaccatcccgaggattgtttgattgcatccctcatattagaccaacgcctggtctgaagaggttgtgaccagggggactgtccatgcattatcacacatgacccaccgggctgctcatcccgtcttccctggctcgtcgatgcaggacactgttcgagacacctttaaatttctgttcatctgaatggcagctgctgagaggcccagccggtctgggacaggagctgaccgccaccggagcgatgctgcagctgcagcgcaggtcagtcggcaactcctggagtgcccctggccggaagccctggctggaccggagctgaaccggcagcggcatgcagcgctgctcctcaccaaccaggcggacccaggggagcatggcttctcagcacgcccactagggctcatggttgatcatttgtcgggcaacacagccctcttcccggatgaggcggacccggtggcagccctggaggctgccagagcgctgctggacagcacgccccccactgggtacctggcactggacactggtggtgagggactcgtgctcgtgcctgagaggctgcgaggtgcagtggacgactcccaccaggatgaggagggctgaaatcttgtacagacatctggagcgagaatcgaatccttgcattcttgatgtaacgaaggggcgtgtgtaaatgcatcgcgatcccaggagacccctctgcctgtgcaggatgctcaaagccagcaactcccagggataaaggccatgcgcacaaatccccgagtgatggtgccggggattcggcagtgcggcccctccctgaccacttcgggagtaggttttccccgcaaacccgttgactgcatataaatccatactgacggagctcaggattctctgtccgtgccccggtgtggaggcgctcacgaaacaacccccagggcccagaaggggtgactgggaacggggcgagagagtggccttcagtcccctccgcgcagcaccttccgggatgtcaaacccagtgagcaccatggaagccctggcagagatcgcacaccgccatttcagtcactccggccgtccttgctcaggtgcgtgcgtgtgcccgctgaggcacatatgtgctgagcagtttgagacacgcgtcgaagaccgcccggcgtcgtgtacatccccataccgtccatatttaccgcgcagtgacgtctcccggggcgaagnnnnnnnnnnttgttagacacgcgccgaagaccacccggcgtcgtgtacatccccatgccgtcccgatctaccgcgcagtgacgtctcccggggcgaagtgcggacccgggcatggcgtcgcggtggaacaggcagggactggggccccagcggggggtgactgaaaatgggggttggggaatgtcaagttcgccgaaaggtgctgcacggcgccggccctccattcagcctcactctgcccagcgtgatgggttgtagaatggcctggtgctggtgacgtgaccccaacaccactctggctgagtagcagaagtctctctcagcgtctcctgcgctgggcatcgcccgacggcatgtgcctctgccctctgatcccatcccccccccnnnnnnnnnnnnnnnnnnnnnnnnnnnnnnnnnnnnnnnnnnnnnnnnnnnnnnnnnnnnnnnnnngccttctcgcagcctcagcaacggggtacggtctggcgacggcgacccagaggcgcaggaggaccccgcgagctccccttgcagcaccccgggaaccatggagacggccaccgcgatgcacgtcccagcattcgaggggcgaggagggcactccacagaggtgcggggcggggaacatgtgctccctgcctccaagtccacgaagaggcgacgtggggcgggaccccaggaggcctgccccttctgcggccacctctacaccgtgcgtgacgggctgtcggccaaggccaacactgcggggcagcgcttgcatcagcgcaagtgccagtgccggagcaagacgccgccctgcaggtgtgcgcggggatgcagtggctgatgcgctccctggttgagatccggcggggggaggggtcggtccgattgggacggcacgaactgctcgtcnnnnnnnnnnctgcgcgggaatgcagtggctgatgcgctccctgcttgagatccggcggggggaggggtctgtccgattgggacggcacgaactgctcgtcgggggaagggggcgccggtcatctgtggtgttcaaggaccttgctgcactctcctgcaaactccccctcccgcacttgctgtgcaacccctcctcgtgcgcccaggaactgccccaactgcaaggtggacgctgccgtgatggccatcaccgaccctgatgctcaaatggcggcgtgcgaggccaaaggctgcgccatctgctcctgccagtgagtgagggattgtgctatttgcgactgtctgattgtatcctgctgagggcttggtaccaagtgaaggtgtgcattgagaaaaccctggagggacagggaagaggcctgtggaggcagcattggaccatctgcagaaggtcttggctgacccaaggcagtgcacagtccacattgcgataccagcgcctgctatgaatgaccgctcaagctgcctgcagccccagcttgcactgcatgcacctcttctcaaccctgcccctccgcccctcgggtacctccccacagatgtccttcggtgggcaagtggatcgagggcgacgcggcctcacgcaaggccttcaaggagcgcaccgagcgccgcgccgagcagctgcacctcctcagcctgcggctggtgtcggggggtggcgcggcaggggcagggagcgacggcctgccctgcgacccggcggccctgctcccccacatcgcctgccccgcccactcggggggttggtccgtgaagcggttgcccgccgacatccgctccagcctgagtgcgctgcagcaggaagcggctgccaacggtgggtcagctggctggtcagggtgggtggtttgtgtgccaggcgggagggctgggtgcgcagtggagatccaggagggtggccggcatctcttgtggcgaggggctggatctgggcggcatgcgctggaaagcaagtccctgcctcgcactcgcatgcattcacaggcggcctggcaacctgccctgnnnnnnnnnnttggccggcatctctcgtggcgaggggctgcatctgggcggcatgctctggaaacaagtccctgcctcgcactcgcatacattcacaggcggcctggcaacctgccctgttcctgtttgcaggcaagaagagccccagcgcaggcgggaggggggaccagaccccgaccgtgcgcggcgcctggccctcgctggatgcgagcgggggaccgatcctggacggggccgctgtcggcctgccctcgggcgccgccggccccggccctgcggcccacgaccatcgcaggcgtggcgtggacgcagccgcgcccgagggcgccccgtcgcgccctcaccggccgcaggaggacgcgnnnnnnnnnnccgtggtgtggacgcaggcgcgcccgagggcgccccctcgcgccctcaccggccgcaggaggacgcggcggcgccacagcacgagcaccactgcccccacccgcacgccgactgcacctctgcctgctgcagcgcccccaccggggacgaaggcgccgagcgggaggtgcagggctgcaggcgccagacgcaggacggcatgagcccgggggcctttgcctccctgctccgtcgcatgctcatggaagcgcggtcggggccgtggttcgccggcgcgcggccggcggaggaggacggcgcgcgcggcgcgccgtctgggctgcctgcctccgtcctgctccagccccagccccggggcggggcggggcggaccctggagacccaggactcagcgcacttctccgcgggcgtgccggtcgcacacacgctgccaggcccaggttggtgtcgcgggccgcggcggcgacgaggattgtgatctgaatggcttgcctgcacagcactcctctcaacaccaagctgcctgcctcgcctcactcctcccactcctgcgccagtcgtggagctggcgaggtcggtgttcgagcctgcgctgggaccgcccgcgctgcaggccgtgtgttccttcctcagcgcccagtgcgtctctagcctggagtgagtgaggagagggcaggtggtggtggggtggtgggcgggtgagattcagcacctttttgtggaaaagccatctgcactgccgaagacaggtnnnnnnnnnncgggtgagatgcagcacctcttttgtgaaaagccatctgcactgccgaagacaggtgaaggaaaattctctgctagacatcctacaataacgccatggcacaaaacgcaacacccgcactgtccacgattgatgtctccctgattccccggccactcctgtgcagcgacctggagttcctgcagctggagtggatggtgacagcgctgcacccccatggcattccagtcctgctcctcaacaagttcctgacgctgggcaggaggggcgcccggcagggggccgggctggcggatgcacaagtgcccgcctgacgcactcctttaaattgtgtaatcactgcatcgagtaccgagcatacgcccctaatctctgcaacgtttcaaatgtttggcaggtctcggcattgcaaggctgcatccgcagttgccgagtctttgaccctttgtctcagacatgcatcacgtcatgcgtttttacccctcgactccgcctgccctgcgagcccaaatttcgccccgttcttttgaaagtactcttcaggggaggtgccccaacaccctttgacgctgctcgtgtactgctgtgtgttgctattttggacagagggcacagccggcgctcaagagtagaagaaggtggagaggtcctgcagctgctgaagcagggcatgtggacatcacctggaggcttggagaatgacgattgatgcttccattctgcctccagaacaatcctttcacttgtcctccaactcaaggaggcagttcccactacaggacaggtatctcccggctacaatggctcgacactcaaaagtccagccattctcggtagtagttgcaggtgctgggagagatggggccctcctccacacagtcatggatgatggggcagacgccgcaggggcaggcggtgaggggggtcgattccaggccgtgatgcagcgcctgtggggtgcaggagcacaggggctgagctcgagacctctctgatttcagtatggggaccaggatattcaagtgaatctcaagatggagcagaaatgtgtggccttcacagggcaggatttaatgcaggcattccattgcgcgccggttgcagccctgcaggttctcaggaccccactttctatccccacccctgccggggccgcaccggtcgnnnnnnnnnnaattgcagccctgcaggttctcaggacccccactttctttccccacccctgccggggccgcaccggtcggtagaggagggctccctcctcatcctccttgctttccagctgaccatcatacaccagattgttcagcagcagtgccatgtcgtcaggctgcaggggcgtggagagcgtgcagatcttgttctcctccacaaactccaggacctcgatggcagtgcacacccgctggtggcggatgaagctcatgacggcctgcacgggttggagtccattccacggtgagcatgggttttgaaattgccaaaggacatgctggagggggcagtgagctgcatcaccggggccaggcaggactccctggtgtggcgagcaggacgccagcctcactgattatgagatgcaggctgaacccttgatctgctcatcccagtagtaccccacacacttcctccaccctaccccttgcatctccacgatgaaggaggcgtccagcttgccgtcatccccataccagggccctcctgtgatctccttggcaggctccagctcagacagcatgtacatctgcgagggggaggatgggaagtgactgtacgcagcgtgacgtaatgatcgccatgacaccaattttcgcttcatccctacgccgacaggatgagcacctgttgcaaggacaactggatatggtgcaggccaagcaccaaaccctgcatgcaccccaagtcaatctggactgtctgcctccctgttcctccctccctgtgccagccatgtggccctttcttccctccagctgaacaacacaccctgtccccagaattcccaccttgcgcgacgcattctgcacgctcttcacgaacttgatcatgcccttctcctccagaaatttcacgatcttgttgatcctgggctgggacaggttggtccggcgtttcatgtccttggtccaaatcccttcagggagagggggagggaagggagtgggtcctggggaatctggattctgaaacataacagagctgcaaggaccatctcagaggcgtgtatgaggcagccactccataaactcctcgcaactcacccacattcccagcccttgctatgcactggtacaggaggtggtcctcggttgacaatcctttcagcctgcgttgtagagtgggcgagtgttgtgcagccggaaaccattccttggctgacctcccgatgtgcaacccccccaggctgcaagcccgccctgtacagctcgcgacactcttcccgcaccacagccttacttgatagcgtcctccttctgcaccatcttgtagacatgaccccctcctgtggctgccatgaggatctggagccgatgtgtctgtgggttggagtggcaggggaatggagggaagtctagcactcatgaaacacacattcccccaaaccatggacatcccagcccctctgagcggtgcctnnnnnnnnnncgccatgaggatctgaagccgatgtgtctgtggattggagtggcaggggaatggatggaactctagcactcatgaaacacacatccccccaaacgctggacatcccagcccctctgagcggtgcctctgcaggtcctcgcatgcccagctgcccacccgcaggagggagttgatggcttgggctcgtgcctccatcgagactcccggcaactccacatccagtactccatcagaggcgccctgcggacagcatgtacagggcgtgcttctcagtgcgcggaacatgcctatgcagtgttagacctggaatcttatggcaaccggaaccgcaccgtaccccctcacacagacggacctcggggtagcgccgacacgcagcgagaatttgctcctccatggccagcgccgtcccgctacaacgccaggggctcggccatgcagtaggctagtgtttcggtagttctaagatttcgttctgttcgcacaggggattcctgttgagagatgtgtcgtcagggacagtaacaatcagattctgctgctctcggtaaaagagtcgtcgtgcttgcggtgcccaaagggaactgcctcagctttgttgcttgctgtttggtgttcgtcgattttactttagatgtaaacattcgcttctcatatagcaattttagagcatgccttgcatgattctgagaagcaatgtcgaggtacactgtgcgcgcgagcgcgagagttcaccaggttggccgtactccccattgtcgctctgcacctgaccaccacctgttccccagacgcactcacgcactcacaatcgcaggaatgaaagccaaatcagtacatctgatgcaatgtttgcaatcagagggagttcttgcctagccccctgcttgtaagtcttgagttgttccccagaagccatccactgctattnnnnnnnnnnactgttccccagacgcattcatgcactcacaatcgcaggaatgaaagccaagtcagtacatctgatacaatgtttgcaatcagagagagttcttgcctagtcccctgcttgtaagtcttgcgttgttccccagaagccatccactgctattcgtgaccgagtcttcagcattagcttcgaggccttcacttctgttccaaaattctccaggaactgcatggaattggatagcgaggtcgttgtgattgagggggagctctgcaatgggcgtatgaagacacggtgagagcaattaaccagaggacatgatctcacgcccatgatgcgtgtgcctatgctactctatccgccctcaccacccatactcacnnnnnnnnnnggccagaggacatgatctcatgcccatgatgcgtgtgcctatgcaactctatccgccctcaccacccatactcactgtcacaaggagatcacagagcaggccgggggaaagggttgtcaggtgcgcatgtgtgatcaggaaggtcacatcgtaaccagccatggggattttgcgaacaatccccaagtcctcagctctgtgtgggatttttgggaggggtgttggaggaatccatgcacgcagaagtccatccgcagtttgtctggttttggagttcctgttcttcatccagccgcaggactgcacatgttctcaccgcacctgtgcatgaggaacttcaggtgggtgtcgatgatgcacctctctacctcgtcctgggccttgaacctcagggagatgcgagaggagttgatggaatgctccaccaggcatccctcctgggcgccgcgggtaagaacgatgggcgcggcgatgagggcgtggcccgggccctccacctcgatgacgggcttattatgtccttccacatggggtgaggggtagtccatcaggcacagcgcctgcgtgatggcttgtcgcacttcggccaggtacgtgccgcgactggccgaggccgtcatgctcgcgacggtgtgctgcgacccgtcgcccctgcggcgccgctaccactgccgatcgtgcattccgcgatgttgcttgcctcgttcaatggggcggaagtcgacacaccgtcatgctggtgccgcgatcgcacaccgctgtcgcctcttattcaaacttcccggatctggcgcccacgccgaaatctcacccctgcgccatgttcctcaaagaagcccaggccgtacagcaagcgccctaggatgcgtgcatgcaccacgcctgctttatcaggcatccacggtagctggcaccaggcccaccgccgcctcctgcaggctcagctgcacccccgccacctggcccacccaggcatccagccgccccttcagccgctgcacctggtccatggtcagcacccgtggctgcacccaggacacctgcacggtgccagccacctggtcgatgaccccctccagcaggtgcaggctcagcgccttcatgagcaggaactcgacgccgtccaagggcagcttggtgcgctgcccgatggcctccagggtcagggtgcggtcctctgcaggcaggctgctcaccatctcggtcagggacaggatggtgatcttctcccgcagctgccgctcgtgctgcaccagggcaggctgtgtgtgggagggggtggaaagcaggaaccagtgagtgtatgggaaatccttacccacgtgctcctcaaggacagggtgctgagctggcaatcatgcctcagaagatgcgctgtcctactcccgccagggcccacctgggcgttcagctttgcggcatgagtcacacacagcgagtcgtagccgtggatgtcgcctgggtagacggggtgagggggaggggagactcgttgacaccttgcagacgtgggtgcacatcagatgtggcaggagccatgttgctgaggtacctgcctaccaaaatgcacgtgctcatgggacatcaccaagcccattgatcacacagattcctcaggtcccccgttgaccatcccattaaaatactgatcaaaggccataccgttgttgaaggccaccaggagctcatacagccacgcgaaggcgctgttttgcaggacctccacctgtgtgaaaggaaattggcgcatcaacataaggaatggaggagaaagatgtcgtagtctcatcgaccaccacactcnnnnnnnnnncgaaaggaaattggtgcaccgacataaggaatggaggagaaggatgtcgtagtctcatcgaccaccacactcatttaatgtcaacggaggaacacgacagcacatcctgtactggagtatagcagctcagcataccatgcatgagcagtggtacacacaagattttgcacatgggacccccatcatctcctgccatcgactcacgatggggtggaggagcagctccccaaagctgtacaccgtcttgccaaggagtgcggccagtgatacatccaccgccaaggcctggaggagcaaagggagtcgggtagctgtgagagatgctgccatccacatccgctgccacgccttggaaaggtgtgcaaatctcatacaagggattcaaaatccagagcgttgagcgacctaaatgccaccctaccttcccattggtagaactcatcttctgtgcagccccaacccaccacctcaccagtcgcgtgtcggctggcagggtctcctgccgcacatgcgcaaggtacaacagggcagccttgtagaagtcgccgtactgttgctgggccttgtgatgactcatggccacataatggacggccgctgagactgaggggtccacctatcgcagccaggcgaggagggattggtggttggcgcaaaggaatgcagtgggcttcgcctccagattttgcctctgaaatgagtacatgcagtgactatggtttaacaaccctcatcacatgtgcgcaacaaccaccccccgccaggaatcccatcacgggtgtaaacaaacgcacctcttgtaggccttgcagctgcttctcccctgcctccagggccttgttcgcctcctcccagcgccccgccgcctggtcatactgcgcgacgtgcatcttgaggtacaggatgggctgtaccgcggcagccagcttcaggttttccagcccggtaatgacatcctgcaggaaagctacgccctcctgtggtacgtggcaatggtgtggaggggaaggggctccataagatgggatggcctgatataaggaaacctttctggggtgaaagcaccagcatccctcctcgtggccagcctcaccccaggccaaactcctcgagaccctgcccagcactcccacggtcctcacgtcggggttcttgatctgcttggaagctgcaacggcaaacaatgccagcttcagcaggttgatgtgcggcgcaaagctggcgatgaagttttggtagagggcgatcagcaccccgtcctcctgaaggcgaggggtgttgatcagctcctccagcttcaccgacagctcatgccacagcttcttatgatagagctctcctagtgtggtgagatcctctgccagatcagggcgacgtgatgcggtctcctgcaggtagacctgctggcgatccatggctcctcacaggtcagctgttggtgtggcgcaatcgtacatgcctcgtgccaatggctgtcgagacgacttggtgctcgcggtgtctgcgcgaggcccagggtgcgccttccatgaccaacgagagccaagcatgcagtgcctgctgagggtggtccggagatgatgcaccggccccccatgaggggcacctgtgcgctcggcccgcccgatgttgctctccatcccatgcctactacgttgctcatgcattctggaatcttgtatgcagtgcgttgcatccttgcgctcccaaactgccggtggtctccaaggcagacacccctcgctcggaaggtgcacagacggaaacaagacagtggttacccaggggcggggttaggagggtagggacgtgccgtcatgatatatgtctgtgtatgtggatgctccatcaagcaccactctccacattctgtcgtgtctctggtcaccccccctggagtgcaattctaaccacatgcaggaagacagacacccctggcacgggccaggagcacctctctgcccgctagactcctgcctccaatgcctctgtccgtggtgtgttggaccatgggccagctcgtgatggtgtacagggtggcaggcactcattgatgctcctgtggactgcacctcagctcatcctcacgctttcctcccacaggccgtgatcggcactggggccggcggcctagtgaccctgcgtgagctcctgaaggaggggcaccaggcgacggcctttgagcaggcagaggatgtcgggggcgtctgggtgtatacagaggagaccgagaccgatcccctcggccgagacactggtgtgtgtgcgcaggaggtgtgcggaggtctccatctgtgtgctccatcacgatgtgcaactggctagcatttgtgtccgaggcaggccgggacgacccttgctgcccctgcgagggtgtctagcagagggctgtcacataccgctcagcagacaccgcgccacagaccagcgtccccacaattcacaccacaggaaggaggcaggtgcacagcagcatgtacgcaggactgcgaaccaacttgccgcgtgaggtcatgggctttggccactaccccttcaccaccacattcccagggtcggcggaccctcggcagtttcccacccatgatgaggtaagcttgtcagggaatggaggcaggggctttgccgcacagcctctgggctgctgcggcccaaactttgtacttctgactctgcgccggattttgcacaaccgctgagctcctcctccacgccctcccatccggtgtgtaggtgaggaggtatctggccgcctatgcggcagagtttggtctggagccccacatcagatttgactccagggtgacccaagtcaggcaggaggaggcctcaaatggggaagctggcgcgccaccacgctggagggtgtcgactgcgtcttcgaaaagccaagcaggggctggtgtgggcaagcaggaggagcgccaggagacctttgatgccgtggtcgtctgcagcggtgggtgaaaggggggtaagggtcgcctctgggcctccctgctggccatgcatgtctgagtcgaggcgtcgccttcaaaatccatggtgttggtcgctgtgccccaccgtcttgcacgctgggcactgccgcacttacatcagcccatgcagacaacaatccgtgttgaggctgtgtccacttgtgtccctgtggagccccgagccatgtcctccgcacccagctcctctcaccccttgctcagatcctgtctccctgacccgtacccacaaccccaggccacttttctcagcctaaagttcctcagctcccgggggtggagtcctttcccgggcagctgttccacagccacaactaccgccacgcctcggatttcgcgggccagcgtggtgagctgagctaagagaaagggagaattttcggtccatggatgccggtgcatgatcagacttttcacagattggaaagggcatgagcgcctctgtttgcgcgagagcaggaggggatgccatggcgctcggcagtgctccgccccacagcgtctgccacatccctgtcctgacatggtcgatgcagcagcggggccatcaagccgccaccacaccctcaccccttgcgcgtgcagtcgtcctgctgggtgccgctgccagtgggagcgacattgcattggagctcctcggaaccgccaaatggtgcgctgaaaacagatgagggtgtgttctggacactggttggcgattgatgcagtgccccatctgtttggcagcagccaggagtcagcctcaccagcttgccactgagactcatgggcattgcctggtgtgccatgcgggctctgcctgccagccagtctctggcacccccttttagagttgtgatgctggccatggtttccaacnnnnnnnnnncctgcctgccagccagtctctagcaccccctttcagagttgtgatgctggccatagtttccaaccctccggtctagtggccccacggcaagtgctcgttcacgattattccagcattgcgtctccccctgtccgcagggtctacctttcggcacgcagtttcagcaacccgctgacgggggagccccaggcggcggccgtgcacagcgacgacgaagcggagcatgccagcacaggcgcagcgcaacggcatgtgacgaaagtcagctgcatctcggctctgcacccagatgggtctgtggaattggcagacggtacgctgctccctaacatcgacacggtcttgctgtgcacaggtgtgtgggaaggacaggcaagggttggggttcatgtgtgggcggcagaggttgggaggttggagtggagggggtggtttgcctgggtgtgcaatggtcttgagaaggtaatatttgatgagatgaggagtctatgccaacatctcctagaggggatggttgtctggcagatggatctgtagagtttctcctcgaaagagtaagagtccaatgtgcaacctttgctatagagggttcctgcttcttgacattaaagttcgtaatccaacaactgccctatgaacccccacattgtcnnnnnnnnnnctttgccatagagggttcctgcttcttgacatcaaagttcgtaatctaacaactgccctatgaacccccacattgtcaggctacagctacacctaccctttcctggagccgggccatgtgaccgtcgatgacgtgagggtgcggcccctgtacaagcacctgttccctcccgctgacgcgccacggctgtcctttgtcggcctctgcttcaagattgcgcccttcattcagtccgagctccaggcccgctggatagctcggagtctctcgggccgggcgcggacgcttccatctgtcgaggtgaaaatatactgccagggagggaaggctgaagttacagcaaaagcttgcattttaagatgccgatatggttagcaggcatcttgactgtatgctcgagcacctcgaagcgaggtctatacccagccctcacccaacatttgcctgccgtnnnnnnnnnntgttacagcaaaagcttgcatttttagatgctgttatggttagcagacatcttgactatatgctcgagcacctcaaagcgaggtccatgcccagccctcacccaacatttgcctgccgtcctgccaggaaatggagagggacgtgcaagcatttgatgcagcgctggaggcggaggggatccccccccgcttcacgcaccgctgccagggtgagtaccagtggaagctgaatcgaagctacagcgaggcagcccagggtgagtcgcctgatcgtgcagatgcatcgatgtgggttctcatgtacaaggggcattgggtaaaagtgcggagcgacctcagagcagcgtcacgctttgcagaggcctcctcttcttacatagcaaggcagcacatcagatttgtcacccagcaagccctttcacgtcgcgctcagggcccatagttgggagctggcgggaagaggtcttcaacgccactgggaagctgaggacggacttccccgagacctaccgcaatgtgggagtgggcggcggcgacaagtgggcccttgccgccgcggtcgaggctcaagccctgagcgagtgggaggaggggggcaggaaacctctaggagagtgaatgtgtttttatgattcctgaagtccgggctttcagaaacgccccccactctagacattacccccatgaaaactcaagactcaacagcgggcatgctcgcctgctccatacatacgttcatgttattctctgctggattctgtggggctactgtgtaccttcccagcactgtgatatccattcttgccaatgataaagcagttgaaaagcagcatgtaagaagtagcagattaagaggctgggaggcagggggcaatgcgcgccaggtgcatcaacctggcagcgctctaaaaccggcctctcctgccgccgccacctctcctgccgccgccgccacctctcctgccgccgccgccacctctcctgccgcctgggctaccccgtccaaagcctcccctacctccacggccccgcccgccatcgctcctctctcccctacctcggcctcggccctctcccctgcctccaccacggccctctccccggcccctgccgcggccatctcccctgcctctgccgcgccctctgcctcctgaagccagcgcatgctcctcgccgtcgcttgcttcgctgtcgtcgtcgctggcggcggcacggccgtcctccgatccgctctcctcgtcggacgcgctctcctcctcctcctcctcagccccacagtctgcggcctgagccgacgggcgtgaccgcctgccagcgccctcctcctcctcgtcatcagaagacagggcgtactcgtgcaccagatcgtcgacgccgttggaggcaccagcgtttgtcgccgccgcctcctcctcgtcctcctcgtcgctcctcggcttggccggagttggcagcaggctgcccctcggcacagccacctccgcctcctcctccgcagccggcccgtcgtcgtcctcgtcgctgccgtccccgcccttccgccggccgatcacgacgtcgtcgctgcggcggagggccgcacgctcggcggccttggcggccagcacgcgcgcgtactgctgcaggggcgcagacttggcggcggcctccgtagaaaggaaggcggccacctgcgtgatgtccttggggctgaactccacggcatcgcgggctcgcccgacaaaggccacgttgcggtcgatcgcatcgatcagctgcttcccgctccgcctgcgcgtgtgagtgatcaagggtgccagcagatgatgtggtgttgctcgttgggtctggagcgctgaagggctgtgggagctgggctgcccgttgcattggatgaagccgatgctgccaggcccagttttgccagtgcttgcacattcgtatggaggctcgactggccggcccaagtcccccaacccccccttcaaccccccctggtctcacccacccaacaccaacctgaagcggtcgacggggcagttcttgacgaacctgcgcagggagacggtggtgaggtgcgccagctccgggaaggagacgtggcacgcccactgtgccaggtgctgcgtcagcagctccaaggtctgcgccacgatctcctcctggaaggccgcgtcgcggagcagggtcttgggcgccctcagcaccagggcagggtcgaaaccggagtcgccccccctccctgccggccgggcaagctccggccaggccaggatctccaggagtaggggggcgacggggacgaatgccccggacgccgcgctcagcgcgcacagcgcgcgcacgcagcgcaggcgcaggggaaagtaggagggcgtcggcagcaggccggccacgcccagcgccagctgggcgaccgggtaagaaagcgcagccaggtcgttggcccccgcgccgcctttcccctgcgccgcgcgggtggcggcggcggccagcacgcgcgcccagagctctatgcagttgacggtctgccagcagtacacctcgcggtacgcatccttggatttggtggaaagcgcgccgcgcagcagcaccgccagcgcgcggatggcctcaaaggcgtgctggtaagacgcggctgcaggggaatgttgcagggagagatggggcattggtggcgggaagatggtggggtgcggcatgctgtctcgtgccaccgaccgccgacgggaaggtggcgatctgatacgtcgaatggccaaatcccctggatccaacaacttgaagacagaagtctgcctgcacatccctctctccatgataccccccaaactccaaaccttgcccgccccacctgggnnnnnnnnnngtggtggattggtggcgggaagatggtggggtgcggcgtactctctcgtgccactgaccgccgacgggacggtggcgatctgatacgtagaatggccaaatccccttgagccaacaacttgatgataaaagtctgcctgcacatccctctctccataatacccctgaaactccaaaccttgcccgccccacctgggtcgatgctgtacagctccaccaccgcggcccccatgaagtcgatggccggcagggaggaggcgttgacaaacttggcgttggcggcaaaggcgcgcgccactcccttgaggcaggcgtccagtgtagacccccccagcgccagcgccgcgccgcgcacaaagagcacggcctgcaccctggcggccgcgtccgcgctgccaaacagccccagcgcggccttcagagagcggcgccggatcttctcgtacggcgccaggaacactacggaggcgcgcgcccggcgcaggatgtacgccagcatggcgccgtccgtcaggtgacctgggggggttgggaagggggatagtgagggcggctgagttgggatggtctccagatgaaggcagtgtgggggtgaaagtaggaaaacgaaagcaagcactgagtggcagcagtgaatgcttgacagctgcgagagaatgtgcagtnnnnnnnnnnggtgtgggggtaaaagtaggaaaaggaaagcaagcactgagtggcagcagttgatgcttgacagctgcgagagaatgtgcagttctgggctggggcgtgggcagcatcgcctgcgcccgccgatggacacatgcacgttccaaaggtcacaaagcccaggggactcctggtcactctaggctacatacgactccgaggcgggctggggaaacattgaggcaccgccagggatttgacttgagccggagcagggcaggggttgggtgaggggcccagaaaacaacggctttcccgcaggacgacatccgtctggtgacgacatagaaacgtacaacccagctcaaaccagtccagtccagtcccagatgccgtctaccccggatcatccagaaaccagtaccaaagactcatcgagtgtcaacctaagaggtgcagggtgttgcccaggtacgacttgatgaggggctccaccttcttccagcgggggagcttggtgagggaggcagggcgcagggtggaggtggcatccacacccaacagcctcctgaacaccccgtcagcctctttctgcaggagcatgatggggatgggccgacgagggatgggtggtgcaggggaccgattgtggtggtagggctgccgcccctgcccagtgcatgcatggggcagtttggtgactccacaagggtgagcaaagggttccatacacacaccatggcagacctggccagccccccacaccctcctcccacgcccgacgggcacgtaccnnnnnnnnnngcacacaccatggcagacctggcgaggccctcacaccctcctcccacgcccgacgggcacgcaccagcatgaagagcatgatgcggttgaagagggcagaggatgcgatctgcagccccgcctcccccgcctcgtcgctgtcgccgtagtgacaggcagccctgtacgcctgcgccagatggcgcatggcccccagggatggccccgccagcgccgccgccgtccagccttggaccagggacagggtgaggggacccttggtggggagcccggcgacggcctcctctgccccgccagcaggggtccccttcttcttcttgtccttgggcgcctcgtcctcatcctcgtcaccctcggcctcctcgtcnnnnnnnnnnnnnnnnnnnnnnnaaaagagccgtgcaaggtcagagcagaggggaagaagggtacgccaggtctgtctccattcaagctttgacccccctccaaccctccattgttggccacggtcctggaagtgctgccaagaacacccaaccccggtcacctggagatacttgtaaaactnnnnnnnnnnccgctgtccgcttcctgtgcagtacagaataatgagggggaaatcgttgggcagctgggcgcagggaaagagccgtgcaaggtcgagcagaggggaagaagagtacgccaagtctgtcttcattcaagctttgaaccccctccgaccctccattgttggcctcggtcctggagatgctgccaagaacacccaacccccggtcacctggagatacttgtaaaactcagggtccttctcccgcagagcctccagctccgccttgtgggaggcaaccgcattcgtgagcttagccgaggaagcagccagaccagtgccgtcgtcggcctcctcatcgctcgagctctcatctgcctcctccaaggccgcagtcgcagcaggagcgaccttttcctcctcctcatcggattcagatgcggctgcattcaagtccccagcctcgctgccgctgctggatgagtcaccttcgctcatctcctccgccctgccttcgggcaggaaatctccggacaggaactcgtcgatatcaagctcctcgacattcttctcctcagctggcttggggtctgcaggggcggagacatacagagctcgtcactgctctttgcacctcccagtgtgtcgaggagaacatgggcccactccccttgggcaagaggcacagcccaccacccgaggttgacgggcggatagggatgccaccctttatgacgatcgatgcttgtgatattatacccggtccgtgccccagctcaagggacgtcgcacctgctgcagaggctggaaggtcccgcttgcgattcacactctgcaggtgcttccggcgcttaatggtgccctgcaggtgcttcgcctcaaacttccgttgcctcttccccttgggcatcgcactccgctatccaacggccagcagctgggggcccaggcctgaacgagggactcgatgtcgctgcctcccaccgtactgttgcgtggtgtatattgacgcacgggccacttcttcccaatcaaacttcaaagattgatatatgtttaagacccttgaaagcgcatgcatgcatgcatcgggcggaacaccaactggccatgggaatgggcagccagagaccccgcacgcatttcacggactcgagtgttgtgttctggctgacaccaatattcacaccagcacacactgtagggcgattatcaaggttcccatgtccccttggtgaattttcaaatggatgctcccactcaagatgcctcactttacccaatcaattatgtgnnnnnnnnnngtgggcagccggagaccccgcatgcatttcacggactcgagtgttgtggtctggcttacaccaatactcacaccagcacacactttagggcgattatcaagggtcccatgtcccctaggtgaattgtcaaatggatgctcccattcaggatgcctcactttacccaatcaattatgtgcatggccggtcatctgttaagagtgaaagctagagggccagtcacaacaacatccaaggcaaaatcgtcgcttcaattgtatcatacattttcttgtcatcatattgggatcaggttgtggcataccctcaacatcgggccgcttgtgtaaatcttcccactcctcgatatccgcgagtcgagccagcgcgccctgtccgaggggtgggatcacttcacattgcaccccctccagcacccagattcggtgcccatgggtcaacgatttaccacaacaccacccttcccgagtttatgagaccagggtggagacttttcctgcgtggatgttggcgctgctgaggtccactggcgcaccttccttgtcgcgagtacccccccggtgcgcgccggagggccgagcgacggccgctgcgtccgccatgcaaattatctaggcctagggatgacatgtagtcatgtacttctcaagcacacgcgccgaggcgtcgcgggcccaacccccacgttaccactccccctcccctctggccccccaggttccccgcagttgcggcgctgtccagcgcgcccctggccatggccgccccccggcctccccccccaaccgcctcctccgcctccttcggcacggccagcagcgggggctcgctgcccacctgggagccctccgcctgcctgccccggctgacgcgcgtgctgaacgcgcgcgacctggccgaggccctgcccgccatcagacccggccgcatcttccgctccggcagcccctccaacgcgtcgctggaggacgcgctgctcctgcgtcgcgacctggccatccagcagtttgtggactttcgctcctcctcggagctggcggaggacaccgcctggcccctggtgctgtccaacggcgtcatcaagacctacgacagctcggggcgggtgagcgaggtggtagtggaccgcaacccggagctggcggggcacggctgcgacgcctttcccgccgagctgcaccgcctgtcgctgctggagcgcaacaagttcatccgcggcctgcttccgcgcttgccctaccgcgcggtggcggcggcggcctggtacaagctggtgggggacgaggtggccatgcgcggcgctgtggtgcccgtcatcaacgccggcggcctgctgctcatctaccagatcctgctggagacggccagcgtggagctggcgcgcacgctggaggtggtcgcggccgccgccgccgagcgcaagcccctcctcttcttctgcaagctgggcaaggaccgcacggggacggtggccgccctggtgctcaccgcctgcggcgccagccgggatcagatcgtggcagactacgcgcgctccgacggcgtgaacgaggtggcgctgggcggcatcgagcgcatggaggacgtgcagggcatggactccgccatctttgcgtctgcgcccgcggagtgcatggaggccctgctggaccacgcacaggaggcctacggcggcctggccaagtatatgacggggatcgggtttggggaggagcggcaagccgcgctccgggaagccctgacgggaggcgactggtgatgaggcatgctttggtgtgcagagtggcgtgcgggtgaaggcgttggaatgtcgactctgatggcgcccggcagggtcgttccgagacctgcaaggctggaaagtcacccaagcccggcgtgcgccttgtcttccccctgacacgggtctttgccggaggtgaagcccctctttgtggagtgctggtgcctgatggcccggcactctgggccactgtgcacacaaatggcagaaagactgtcatccccccagtacaccttctggctcagnnnnnnnnnnnnnnnnnnnnnnnnnnnnnnnnnnnnnnnnnnnnnnnnnnnnnnnnnnnnnnaaccccaggccccttttggagaggttgcccctttgatggccgtgatgtacacttcacagaatgccacataccgtggcaccaagaaggacacccagaggaccctgacacatgaaggggtccattgtgaacccaaaattgagtgcgnnnnnnnnnnacacataccgtggcaccaacaaggacacccaaaggaccctgacacatgaaagggtccattgtgaacccaaaattgagtgcgagcacaattctgcccgagtggcacacacctggtctgccattgaaatgcgcctggcctgttcttgcacggtggctgatgtgatggaagagaaaagatttcagacccctcacgcaaggctttggcagatacaaggagccatgcatacgtctgtctgcctcacatgaccaggagtcaacacagcataccaggctggaaatgggcaaatgtgcaatgacgaggcgtgcaaaaccctcacaagactgagggagcctcttgggttgccacgctggttcactcaagcagcagcgagaggccctccattggctaagcatgctcccggccaagggaagctataagacccatgggctcttcttcgttctcacatcgcgttttcgggtcgttctgcgatgcagagagggaatcgatgcgaagtgatgggcttgatgaagcannnnnnnnnncaagcatgctccgggccaagggaagctataagacccacgggctcttcttcgttctcacatcgcgtttttgggtcgttctgcgatgcagagagggagtcgatgcgaagtgatgggcttgatgaagcagggttgggtaggcacacatgggcttgtgctcctgatggcaggaacacttcaaatagaaggtggcctgccaatctggaccctccactggcaccctcgcactcaaatcctcactgcctcctccttgcccacttccaagcacatactcgcccctcaccttcctcccatggacccagagatcccaggacatctctgcgcccaaagctctggcgccgccagtccccatcatcgctccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggcgccctcctcttcctggcccagctcgtagggcgtgaggaggctggaggggtcgtgggccctccaggactgtcgggcgccggggtcccgtggcgtgcggcccccggcgtgcctctctgcgcccgggagctggatgggggtcagcggggggtgcggctcctccaccgccgccgccatgggcggcgactcccgctcctcggctggtgccctgtggtctggcccggccagcggcctgtgcggcctttccacgaccacagcagccgccttcatcgccgtgccgcgcggcacgtggaggtccacggagtccctcccgcgttcggtgcccagctccagcgagcgccccgcccgggaggtgaagccgccaaagtagggggccgcggcgtagccgtccatggagtcgcgcggggcctggcgggggccgggggcgggggcgtgcctggcagggcgctccacctcgccctcggagtccagctcctcgacgaagaaagggtgagcgggcgccgccgggcgggcgtggaaagcggcagagtccagcagctctcgcgtggtgccctgtggcgagggggatgtttggaaaggatggaaagtgtgaaggagcgcatgatcatatggcccggtgggagggagtaggaaggcgcgatcggatccaggtgccgcgcaggcacctttcagaaaggaatgtcgacacaacgtcttgcgtgccacgaggccccctcagagctccttccgacccctaccccagcaaggctacccctccacccagccacgccctcccacctgccgccttgtggcgaccatgacttccaggacgcggggactcccgtcgtcgtggaagacgacctgcttcccggcacgccggctcggataccgggaggcgctggctgatgggccgcccggggcggggctgatgcgggtgcgggcgtagtacgcccagtcatagctaggcggggaaggcgacgagctggcgggaacggcctgccttgttgggatgcgctggtcctcgggggtgcctggagcagagtagatcacgttgggatgcatggtgtggggcctctgcgcggcttcgggggacatttcagtcgctctcgcccccgcgccggctggggctggcgagtacctgagaggaaagggtggcgatgccgggtgtgctgcttgcaaggtgtcatgtgagccagcaccgacactggcgacgcaggaaggtgtgcaccgcataccctactcgggtgcccgaactgtccagcccacccactgcagcattgcctacccaccgggtgctgttcctctcatgcccaatatgcagccaccgtcccatgaacccaggcatcaagtgacccatcgcaccatggtagttggggcgggtatggcgggggactgggcgctcccccgtcagcgcttgtctgaggctgggcctggggctggcgtccccacgccgaccaagcgggctgggcttgttgtggaggccgggacccagacccgctgctccccggcgattcctggaggagggacgccagtaggtgttggacgccacacaactgctcttgctgcggccatgctttgtagatgaagccgtgatgcctgtgagacacatcacactccagctggcattgaccctggtcggcaccctctcatgtgcttgatggccgcagccaccctcacctgcggtacacaggcgccgtagtagggcacgatgctgttggaaggggggccgccggctttctctacgtccttctctgccgaagacctccgcttcctccgggccagccagaagagcagcatcccaatggctgtgggttgggacaggtcaagcccatgacttgacacaagcagtggcaagtcacgcagtgatcccccatgtaagtaatggatgaaggaggatgcatacgttgtttttggaaaacacctggcgatgatcggcctccacatgccctaccagctgcacaacaggttcccaaacacctacccgcccctaggaggagagccccgcctatgccggcacccagcgcgatgtacaacgccgtattctgcccctcagtgggagggctgggagacggtgcctgataagtgacgggtgatggggaggtctccgccggtgatgggcttggggatggggacggcgagggggccggactgaacggtaggagggggaccatgtcgaactgctggagctcgcgggcggagaactgcccatcatccagtacggttcgcagggaccccagactcggtctggatggcattgcaatgtctgcaacgctactgtcgcgattctcattgggctgcagaccgcttataaagcctgccctggtgagcactagcagggcgagaaccagacaggcgggaagcctccggcgaccattcgaggcacagggcggcatggttcctggctcgatgggtcccttcagtgcatcctcgattggcggagtgcgatcataccgcacattcagatcggaatggttgcttcgcgggtctgccatgttcgtactttctgattcgatcgtggcgaccagtagtacaatgaaaccctagaggcgcttccgaggggtatggcccgaatgctcggcatgaggcttggagaaaactcccgtactctaattcatgagtatataaatcatcctgaggtgactccgatgcgnnnnnnnnnnaggaaatggcccgaatgctcggcatgaggcttggaaaaaactcctgtactctaattcataagtctataaatcatcctgaggtgactccgatgcgatcgcatgggtccttcgggtgtgcaccttgcgcgccgatacattttcgtgcatcgtacagcggcaggtgcaatgtcaatcgcccgcccgcggcgagtccctctcagatcccggcttcatcacagaccagtacatgcttgcgcgtgtgttattcaaagtactgcaagtccaagtcagcatcttgatcgtcagtctatgaggccaggccacggcatggaggcagcgacatcgccgtggggagaggcgaccgcctggaaggctcccaggtgcacactcgcacatggggcagccccacaaggagttgtataatggaacaagggggtactggatggtgcgatgcaagcgcacagccatcgtcacattggacatgcgggattcataaaagggtcagggtgtgtgtgttctcctactgagtcagctggaagatgttttgaagatgcctggaaatcatgcatcaaaatgcttgcgtaccagcacatcccgccggnnnnnnnnnntctcccactgcgtcagctggaagatgttttggagatgcctgaaaatcatgcatcgaaatgcttgcgtaccagcacatcccgccggtgaaagctgtactgctcccagatgtcgtcgtcgccggcgagatgccccgcatccttgggcccagactctggcagatccctggtggtcgattggtccttgccgcctcctgtcctccctgccccgatggaatcgctctcccagccttccagcgggccaggggacgaggcaaagtatgccgccgggctgtcccagtccccaccgccctcgctatagggggtcagcaggctgcagggattgtggctgctggcggtggaggcgcgcaggggcttgtggcctggaaggaagagcgacaccgcgctccccgggtctggtaggggggtaggcggctcccacgggccgtcagagctggaggtggagagctgggaaggcgcctccggcggggacggcgcgatcttctggcccgggggcagaggggcggggccggccccgctgtttggcaggggccagccaatcggggcaggggcccttgcgaccccatcctgccaggccttggccggcctcgccggggcagggggcacttgaaggggagcagcgggtgctggatgggacacgggagggccagaggggacgccaggcgccttggccatggggtctgcaggcgctgcatggtgcagcgaccccgccacctcccccgactcgcggatgctgagcacgccggaggtgccgctgtcccgcatcgtcctccagtcctgccacggcgcctgctgggaagcgagaacaaggtatgatgagtgacaaggtgctcgggggacgacgtgtgcatcgcctgcttcagcagcacccgtgatgccccaggatgttaccactgcgaaagactctggctgcaaaacttggaacccatccccgcttccccaacatcaagtagacaagccttgcctggtgagtcggcatgctgggggtggtgggtgacagaccggtctggggggccgcgggcgggaacggctgcgtctcgggcgtgccttggtacacgggggagaccggtccgatacgcgcgacgtcgtccatcgagtcccgggccctcagctccttgcgacggcaggttggtgaaatgtgaggacttgaagtcgacgtcgcagccacggggtctacccaggtccgtgcatagaatacactccaccatgcaagacccacctctggatcatgggcggcgccgttcgccccgccaggccccctccgccccgtgctgccggtccaggcatggaccccgccgcccgggcttcgctccggctcccggaacatcacccgcttcgccctggtggcagcgcggtgcccggcccgtggccccctgtcgggcgagggcgcgaccgggctgggtggcgaatagcgccgctccgactcccccggcgaggtcaggctggagggcacggggctcagctcgatgtcggacaggggcagcgcctctgggtcaaacgcgccgttcaggcgcaggctgggccgctcggggctgtacaccacgctgtgcacgctggacagggagctggccaggctgcggggcaccatgcgagccctggggtggagggggggaggtggggtgcagggggacgagggaggtgatgcggagaggggtttgatggcgccgagaacaggtgcccgtgtcagagggtaggagcatgcgagtcagcgtgtcagcggccgctttgcggtgaccggcgtgctctcacggtcatcacatacccaacactgctcaccacttgggacgcaggttctccttggccgcctcctcctcctgcatgctgggggtgctgacgaggtagggcagggcgcggggcccctccggccccggctccaagctcggctgactggcagagtccaggggccnnnnnnnnnnaaggtagggcagggcggggggcccctgcggccccggctccgagctcggctgactggcagagtccaggggcccatgcaggggctgtgagtggggcagggcgtgggagacaggggctgaggtcgacacagatggctgagagcttgggtgggggaacatggacagacaagcagatcgtttttacctcctgtccgcatggtacagggcatgtacggctcatgcagaggcctcacgctgcccttggcccaacctcaccgtggccttgtnnnnnnnnnnggcttgggtggggaaacatggacagacaagcagatcgtgcttacctcctgtccgcatggcacaggacatgtacggctcatgcagaggcctcaccccgcccttggcccaacctcaccgtggccttgtcagagaaggcatccctgttccggccgttgctgctctgccagtcgtgcgggggcacatacgggacgatggcatcagaggacttgtcgccctccgagatggcggcagggggccggcgccgcatgcagcgataaaagagcagcccgatggctgtggggagggggattagagttgtgagggccgtggcctaaggcttgtcacaacatacagcaatggtgcaatccaaggcctcgttcctcctggttgaacgctggcatgggaaggtgcaacctgtccaaatgcccagcccttcactcccccccactcaccggtgcccagcaccagggcgccgccaatgccggcgcccagcgcaatgtacagcgtctggttggtgccggggtccgaggccggcgcccccgcggccgtcgcggccgccggggtcggcggcgattgcccctcgctcccaccgccctccggcgacgccagggcggggctctgctccgacgccgtaggggatggcggcggcagcaggagggccacctccgagggcgggtctgccgcgccctgttcgggcgaggcggctgcctgggcgaggtccacgcgctgccggccagcctgggaggatgtggccaggccagcccgtggggcctggtccagcaccgcgccgctgcccggccccaagattgccgcagccgcgaagatgggcgggcaggcggtccggtacaggatgacgtccaggggggcagggggcgggaacggcaggtgccaccgccggtcggtccggcccagcagccgccgccatgcgtggtcggccgccacctgaggttttatttgtgggatggggaggtgtgagatggtgggggtcaaagtggtggggctggtcagatggtgggatataagccggctggggcaccgagggtcctgccctgagcaggtttccaagccactgcctccaacgatgttgcaggccatggaagtcaggcacaggcagattgagatcacggcgctacgcaccactggcaacaaggaggcctggtccgaggtgttgaccgaggtccgtacccatatttgagcatgtttcagcagatcaggtccggcctggggtggggagagggtgtgcaggctttcggccatgggtccccttgggtgccaaacaggctggccaaaggggggaagtttcccggaaatctgcggatttagggtggctgctcccgccctcgacacgggaccccactcacgctggtgaggttgagcatgagctcccctccccaccccatctcgtagtctgacacattaagtgtcactgggaaggcggtgcacgggtcgtcctgccagggcgcggggatcgcgtgagcgggggcgggcgaggtggcaaatgccgggcaagggtcacttggccccagtccgtcctccttttgacacacaaccgcgcccagccaatacagttcaaccatcatgccgctcaatactgaccagcgctgctcgggcgtgaccgaagaggctgcaaatgcacagggcggcaagcacgccgatacgggttcggcgcaaccagccgggctccatggcgttctcctgagcaagggcaaatgcttgtgctgatgtacgccttacccccgcgcaagggcattgtgaagggaaagccaagctgtcatgtgcgtaacaacaggtcagcaatgcagtggaaactgcgtcatggggatccccggcagtatggcaagcaggaattcaaaatgacgacctcaccaggcgacgatgcgggtctgtccaaacgtcatgaatccatgatcttacatcacagctagaattcgacgcatgtgataatttgtgcagcggcatgaagccggcacaggaactccctcccaagtccgggaacgagtcggctgccgcccatgaagcccagatcggggcataggggcgggaaggagttgaagggttctcgtaaaccacacagcggcccgccttctaagcgacgatttcgcaggagccttcgaggtgcttctttccgcacaagctagcccaccatggcccgcttgcggcccctcgcgcggactgtgtggtggaggcggtaggatcgttcccnnnnnnnnnnnnnnnnnnnnnnnnnnnnnnnnnnnnnnnnnnnnnnnnnnnnnnnnnnnnnncagcgtcgcgctccagaacttggaagatcggcgatacgattgcagaacgacatcaaactgcaggaagggtgggtggcatgatttctgcgagggattctactatgggagatacgggttgagacatgaacagcatgcgtctgcagctggcgggcctcccatcaccagggaagtgctggnnnnnnnnnncttggcctccgggtgatcgtctggggcaaggacctttgaccggccatacacactcgcacccacctccccctccctcaccttccgcaaatcggttnnnnnnnnnngtggcctccgggtgattgtctggggcggggaccattgaccggccatacacactcccacccacgtccccctccctcaccttccgcaaatcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgctttctgcgagggattctgctatgggagatacgaattgagacatgaacagcatgcgtctgcagctagcgggcctcccatcaccagggaagtgctggcagtgggacaggggatgtgcagggtcaagaaatttaccccatccgcgatgctcaccagctctggacccttctctgcgtgggcgctcaagaaggcacgttccaggacatacagatccacccccttgtcctcgggcagggatgagttctggctgagcccaaagtctatgagaacctgggcagggcatgtgattgttgctgttatgatcagtctggtcaatagctaggctttagcactggggattggccactttcaggacgcaccttgcttgtgtaatgcagcaaaatacagcccctccacccagcaggcgagccttgcatgcagtattgccccacctgtacagccattccccacctcaccagctcattgttaccc

SEQ ID NO: 42006 - DNA, 79 bp, Chlorella protothecoides
cgctggctgggacctgggggtgtactgaccaagaaagccgggccgcgcggcgcgctgcaaccgcctcacgaggtgcggg

SEQ ID NO: 42007 - DNA, 61 bp, Chlorella protothecoides
catggcggtcagaatgctcccccaaccctgttccaggtgctgcctcacctccttgtgtgtc

SEQ ID NO: 42008 - DNA, 120 bp, Chlorella protothecoides
acggcggtggtgggctgggtaccgagggtggaggaggggggttggggctgggcacagagggcggggatggcggcgggaggctgggctgcagtggtgagggcggtggggggctggggctct

SEQ ID NO: 42009 - DNA, 61 bp, Chlorella protothecoides
gggaggggtttaaccagtacgcagcctggctcctgccacaacctggttaccggccaccacc

SEQ ID NO: 42010 - DNA, 71 bp, Chlorella protothecoides
gctcgcccgcgccgggggtgagggggggcaacccctccccacccaggctggaaagcagggcccggcaggcc

SEQ ID NO: 42011 - DNA, 65 bp, Chlorella protothecoides
atccatgcccgctcggcgtccccagccgcctcacgtacacgtccgcccagcgcccccagccgctg

SEQ ID NO: 42012 - DNA, 63 bp, Chlorella protothecoides
gcgcagattgactcggaagacgtgggtgtccttacgatcgacggcggtggaggagggcgcaac

SEQ ID NO: 42013 - DNA, 126 bp, Chlorella protothecoides
gcacgcgggctccctcattcccgtgtcgcgtgtggggcgtgcatgcatgccgtgcccttcggcccgacggaaagggggtggcagtgcaaggcatgtggctggcgcgcccaggcgttcagcgtcatg

SEQ ID NO: 42014 - DNA, 61 bp, Chlorella protothecoides
tgcaggagccccagacggccgctcttcccattctccttacggcagagccgggcagacatgg

SEQ ID NO: 42015 - DNA, 42485 bp, Chlorella protothecoides
  modified_base (320)..(329): a, c, t, g, unknown or other
  modified_base (1150)..(1159): a, c, t, g, unknown or other
  modified_base (1800)..(1956): a, c, t, g, unknown or other
  modified_base (2028)..(2037): a, c, t, g, unknown or other
  modified_base (2464)..(2473): a, c, t, g, unknown or other
  modified_base (2714)..(2723): a, c, t, g, unknown or other
  modified_base (3577)..(3586): a, c, t, g, unknown or other
  modified_base (3789)..(3798): a, c, t, g, unknown or other
  modified_base (3878)..(3887): a, c, t, g, unknown or other
  modified_base (6154)..(6163): a, c, t, g, unknown or other
  modified_base (8348)..(8357): a, c, t, g, unknown or other
  modified_base (8541)..(8550): a, c, t, g, unknown or other
  modified_base (8953)..(8962): a, c, t, g, unknown or other
  modified_base (10804)..(10813): a, c, t, g, unknown or other
  modified_base (11179)..(11188): a, c, t, g, unknown or other
  modified_base (11486)..(11515): a, c, t, g, unknown or other
  modified_base (11806)..(11815): a, c, t, g, unknown or other
  modified_base (12168)..(12177): a, c, t, g, unknown or other
  modified_base (12688)..(12697): a, c, t, g, unknown or other
  modified_base (14165)..(14174): a, c, t, g, unknown or other
  modified_base (14304)..(14313): a, c, t, g, unknown or other
  modified_base (19162)..(19171): a, c, t, g, unknown or other
  modified_base (19608)..(19617): a, c, t, g, unknown or other
  modified_base (19778)..(19787): a, c, t, g, unknown or other
  modified_base (19875)..(19884): a, c, t, g, unknown or other
  modified_base (20251)..(20260): a, c, t, g, unknown or other
  modified_base (20434)..(20443): a, c, t, g, unknown or other
  modified_base (21504)..(21513): a, c, t, g, unknown or other
  modified_base (22120)..(22129): a, c, t, g, unknown or other
  modified_base (22281)..(22290): a, c, t, g, unknown or other
  modified_base (23280)..(23289): a, c, t, g, unknown or other
  modified_base (25648)..(25657): a, c, t, g, unknown or other
  modified_base (25892)..(25901): a, c, t, g, unknown or other
  modified_base (26300)..(26309): a, c, t, g, unknown or other
  modified_base (26761)..(26770): a, c, t, g, unknown or other
  modified_base (28790)..(28799): a, c, t, g, unknown or other
  modified_base (29647)..(29656): a, c, t, g, unknown or other
  modified_base (30165)..(30174): a, c, t, g, unknown or other
  modified_base (31764)..(31773): a, c, t, g, unknown or other
  modified_base (33812)..(33821): a, c, t, g, unknown or other
  modified_base (35594)..(35656): a, c, t, g, unknown or other
  modified_base (36011)..(36020): a, c, t, g, unknown or other
  modified_base (36516)..(36525): a, c, t, g, unknown or other
  modified_base (37072)..(37081): a, c, t, g, unknown or other
  modified_base (37153)..(37162): a, c, t, g, unknown or other
  modified_base (37443)..(37452): a, c, t, g, unknown or other
  modified_base (37595)..(37604): a, c, t, g, unknown or other
  modified_base (38727)..(38736): a, c, t, g, unknown or other
  modified_base (39498)..(39507): a, c, t, g, unknown or other
  modified_base (40038)..(40047): a, c, t, g, unknown or other
  modified_base (41544)..(41553): a, c, t, g, unknown or other
  modified_base (41894)..(41903): a, c, t, g, unknown or other
gacgtcgccggcgtccgcacccgctcccaggccggccatgagctcggcctgcgcgcggagcgcggcgtctgccgccgcgccacgcacgatcacgcggccgggggtgacgtagagctgccggccaaggggcgtgaagttgggcgcggcgcggaggggcgcggacgctgccgcgcccagcggggcggccaggtaccgcgctgccgcgccggccgtccgggccaccacctgtgcatgtgtgcgaggggggagatgaggagggacacagtcatgccggagcgctagagcacaaccctcggcgtcgagacccgggttgccacagnnnnnnnnnntatgtgtgccaggggggagttgaggagggacacagtcatgcgggagcgctagagcacagccctcggcgtcgagacccgggttgccacagcgcggggtacgcctgtgctgccctgtgccctccggttccctcctcattcaccacaacaaccctgcacatcaaaatcccactccccagtcctgcctctcccgccccgtcaatgtcagccccctcttttgcatcaccaacgcaccctgatggggggcgtcgcggcggcggagaagcgatctttcagctgctggccccgcgcggcgctcgagctcgcagcctcttcggcggagtcgggcggggcggcgggaccccccgtccgggacctcgcccctgcgccggatgcttcctcggccacccgaccggggcgggcgctcaggggccccaagcccggcagggaggagaagcgctccgccccgacggcgatgttgttggccaggccctcggaggggggggtgggctctccggccgtacttgccccctcgggcctgcccgctccagaccccgccctccaggatagcagccgtgggatggggtcctctgcggttgtgtgtggtgggaggagggggatgggacagggcgcctgatagggttcaggaccggcatgggacgcctcccggttgacaggcaccctcctgaacaccaggcgacggaacattgagacagcggggcgggagccgaatcccaggacggccacgatgcacccctccctgtcggacacctcatcatgccgacattccttcttcattcccacctggccaccccataccctccccagccccccacctggcatgnnnnnnnnnngtcccaggacggcacgctgcacccctccctgtcggacacctcatcacgccgacattccttcttcattcccacctggtcaccacataccctccccagccccccacctggcatgaggtagttccggatgcggttatcccaccccgcctcgcggcagatatcggccagcacgccgttggccacggcgggcgtggcaaagccgtagcaggacacgccggcgtgcacggcgcgcggcaggcgggccagcaggctgaccgtgcacagcgcggccaccgcgccgcccagggagtgcccgcacagcaccaggcgcttgccgcgcgcctcggcctccgcgtagatggcctccacggggacggagcgcgcgcggttgaggaacccgcggtggacgagggggggggcggggccgccgccctcctgggcgggcgaggcctcgcctcgctcggcaccctgagacaggggcttggcgggtgcccaggccgccggatccagctgcatctcctgcagcggggagttggggaagggttggggtatgggtgagcctgctgtgaggagggaagaacatcagaatctacatggccacacccgtctcccacgccaagcagcccctggtatgggctggtccatacacaccgatgcaccccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcctcagtatagctgcagagaatccatcccctgcctcaacgcagccgggggtggcctgcagcggcggtgnnnnnnnnnncggccacacccgtctcccacgccaagcaacccccggtataggctggtccatacacaccgatgcaccccgctctcacctcctgccagaggttgacgttggtcatgaaatcggaggccatcttggtgcccatgaacgccagatacatggccgagtcggactccgccagcatgaacctggaggcaggggagtgagggtgaaaagctgatacaggttcgtgccatgctttcctcagtacagctgcagagaattcataccctccctcagcgcagccgggggtggcctgcagcggcggggcgcggcagcccaagctgcatcgcagcaacgcctcatcccaatgctcaggttccactgcctatacccccggccataaatttcaacctgtgttggacgtggggaagcgcccactgcactgccctaagtttgcagnnnnnnnnnncccccccgccataaaattcaacctgtgctggacgtgggggagcgcccactgcactgccctaagtttgcagagaccgggagggagggtggcggtcaggtcctggatgcactccagtacctctgcgggcttcatgtccaccaccttgtacacgacctcggacaggacggcgcacgacagtaggtcctggtgagtcccggagagagaagtgctgggttgagcagggcgccatgtggtgcatgannnnnnnnnnttgagtttcggagagagaagtgcggggttgagcagggcgccatgtggtgcatgagaggattctgtcacggagcttctccccggagcccgggatcgctcacggccagcaccgtacctgcaattccagcacgctttcgacttgcaggtggcgacatgccgcctggaggaggtcaggaggtagggagaggccggaggcctggctaggcggcaggccggtcgcggcgaatagccgcttggcgaaggccaccgaagactgggacaccgcgcgcaggatcacgcccaggcgtctggtgggtgacacgacggtccttggcgccaacaatggtatggaaggggttgacgtgctccgtcgcatggcccccatgccgccgctgggcagcagggcaaggcctgacagtcgggccatcccgcactgttgccgcggtttgcgctctgggccgctactaggtaggtatcggggaccgcgggcagagtggggagctgtctatgtatctgagacaatgatcggcctcctggtgctgatgaggaaccaggcctgggaaggttaacgcgccgggtcagccctcgatggcggggtagggacgctttttaaaaaacaacctcagagggccgtcgaagagagtgttaacagttcaaatgccttcacaatgtggattccaggggctgactcctcgcaagactacgcttggacggaatgcatcccgtacgggtcgggccattcgcgcctcatggggagctgcagctgggtgtgcgatgcgggggttaggccaagtggtgtacgaaaccctttgcccaaagtgctctttcggaatcgctctgtggtattgatccggtacttttaaaagttacgaatcnnnnnnnnnnagatgcgggggttaagccaagtggtgtacgaagcccttttgcccaaagtgctctttaggaatcgctctgtggtgttgatccggtacttttaaaagttacgaatcggaatggcgaacagcatacttttacaacggtgagcgaggtatgtgtccatacacctagtcaggacacgaggtccctcagtgtcgaggccacgtatctcnnnnnnnnnnacactcccgtgcatcgggtggagtgattttggcgcaatgtgtcaaaccatcgccctctacagggcgtcatgatgtcttcnnnnnnnnnnagtgagcgcggtatgtgtgcatacacctagtcaggacaccaggtccctcagtgtcgaggccacgtatctctgtagtgcgttgaaggacgggcgtcctcagcggacactcggggccgagccggagggagccacgatgcacatatggagttgccaaagcagcgtgggcaatctggtttggaaaagtcgaccctgggagctatgctgtgcatgccgcgcatcgtcccgttgcacgatcaatggcaccccccctcgggcatcatgacgccaccatcggagggtgcagaagtggatggctccactcccgtgcatcgggtggagagattttaacgcaatgtgtcaaaccgtcgccctctacagggcgtcatgatgtcttctgagtggcctatgtaggtccccgggcacagtgcctgccctccgagacaggctcgccccagcccctctgccggcatgtccacccccaagggcgtcatctactccatcgcggagcgcacgggcaagctggtggacctgacatacagctccctggtgcaccagttgggcctcactccccctttcttcaaggagggcctggggcagctggacgtggtggacttccacaacgacctggtgaccctgagagactggctcccaacggccctggacgacccggtgagcccgagctgtgcaagcgccgacgttgtcaagctggtgggcagcgtcgtcgctcaccccaagcgtgagggcgctgcactctgcacctgcgcagaatttccccacaaacctagccccttgttgttttaccccaggaccggcgcctggactgggtgcagaccgacgccgggcgcgtggggtccaagcggtaccgcgtgtaccgcgcgtccttcgagagccccgtggcccgcgactcgcgcgccgcgcacgcgctccccgccgagagccgaactgcgcacgcgctgtggatcgcgccggacccgctgccgggccaggcgccggggccctgcacgctgcagctggcggccacgggggaccacggctttgcccgacgcacccgcctgggcttgcccctggttgagaaggtgcttgtttgagtttgtttggtttgtctgggggggggtaggagggtgttctcatggctgaagcaggcaaatgactggttgaagtgcttgacgtggggtggatctgtgcccagggtgggtgaggtgcccgtgtctggctttgccagagggatggccagttgctgtcgccaccacacgtcggcaggcatgaactccgagcgccctccgctccgcccttccctcgatgacttgagccacgcccgctccctcagctcgacgctctcacccccaccccaccccttccttctcaccaaagggcatcggcaccattgcgctggagtcaccgtactatggcctgcgcaagccggcgcagcagcgcggcgccaagctggcccgcgtctccgacctcctgctcctgggccgcgccacgatcgaagagggcgcgctgctcctggactggctgcgccggcagggccacggccgcctgggcgtgggcgggctgtccatgggtggcgtgcacgccagcatggtggccgggatgtacccgggcgccgtggcgctgacgccgctgctggcgccgcgcagcgcggccagcgcgtactgcaccggcgcgctgcgccacgccaccgcctggccgcggctggccgcggaggcggagggccggggcccggaggtgcgcgaacagctggcgcgcgcggggcgagccaccgacgcgctgcgcgccgcgcgctacctcctggacgagacggacggcgggactgcgcggacaggggtgccagccggcaccgcgcccggccgcgcggcagaggcgcgggggagcgaggcgacggggactctggggaccgaggcgccgagccctcccggaacctcagacggcggggcctgggccggggtgggcgggctggcagagcggctgctcaaatgggtggccatgctggagaggagggaggagcatgcggccgccgtggccctccttgcgcaggtgctggaggcctttaccgacgtgtcgcgcttccccaggcgagcagggaagggtggaggtggttggggggggggtgttgagtcagggctgggcatacgtacgtactgttgccgtcggattgtgccaatcggggtcggtccgccggggtgagcgggccatccccccttgcatgcatgcagtaccctttggggccccccgttctctgaccgccaagtccacgcactcccgacccaccccgaacaacaggccgnnnnnnnnnngagggggggggatgttgagtcagggctgggcatacgtacgcactgttgccgtcggattgtgccagtcaggtcgatccgatggggtgaacgggccatcaccccttgcatgcatgcagtacccttccgcctgggcccccccgttctctgaccgccaagtccacccactcccgacccaccccgaacaacaggccgcgctgcccagaggctgcaattgtggtgggggcgacggaggacgcgtatgtctgccgcgaggcggtgctggacctgcaccacttcctggaggggagcgaggtgcgctgggtgccgggggggcacgtctcctccttcctcctgcaccaggaggccttccgctcggccatagcagactccctggcgcgcctgccggcgtgaggttgccgtgcgctcaacctgtgagcgcctgaatgaacactcggaggcctggcatgtggtgcgagccatgggatacatgaaaccacctccctctcctgcccaacagccgccttctccaacatccaaatgcacccgcatgagagctacttgtgtccctcgtgaaggtatgatgtcatgcgcgtaaactgtaaatcatagctggcaccgggaagtgctagtctggctggagtggtcgtggagtcatgctgagctcgtcccaagcacgtttgcaatggaccggccctcgacatccaattcacgtccgggatccgatctggaaggcctagcctcgatctgcattgactcacacccattgaagaattccagccggattctgagatggccgaaacggtgtcctgccgctccgagaagcaagcaagtcggcttgggggtcgggacgtgctggcggcattggtgggggcagcactggtggctgccaccgccgcagctcgacgggcatggaagctgggtcagcgtcgcaagcgtgtggtgcgcagttggagtagaaagtacgggtctgatcggtggacagggatgctggatgcagtgcttgatgatgggaaggttgaccctcagatcacatcacctcccacaggtcggcatccttcctgcccgctacgactcctcgcgcttccctggcaagcctctcatcccactgctgggcaagcccatgatcctgcacacctacgaccaggttgggagttgccccttggaacgtgctgttgctggagtagggctatcacttttgcgctctgttcgtgtgctgtctcgagaatcttcccaagacaatcctgacacaatctcccaagccttgctttcccaggcctgcaaagcaactaccctggatgcagtggtcgtcgccacggacgacgagaggatagcctctgtgtgtcgcgcgcatggagcccaggtggtgatgacacggcccgactgccccaatggtgagccggaagtacatgcttgattggggtgcagtgtactttatgggcactctgagcccctagaagaggatgtagtgcccgttcagaatggcgtggaggccaagtttcccccgtcatgccctttccccattcctcaaccctgcaccaccccagggaccgagcggtgtgaggaggcagtccaggccctgggcaagcagtacgacatcgtgatcaacatccagggggacgagcccctgattgaccccgggaccatcgacgcggtggtcaccgcgctccaagactcgccagacgccgtgtacaggtggggtggttagggagggtgcttgcaacccgggaccgaggcggttgcagagcctggcaaggcgggccccatggggcttcgggtggtcgtgcggatgctgtgatgcactcccggaggcccctgggtgtctatttgcaacgagccataccatgtccaggccgatgactgccaccaaagctatgttcccctaccctccgcatcccatccccgtccacaaccatcctcagcacggccgccacgcccctggcgaccaacgaggtggccctgcgccagcgtgtcaaggtggctactgacgcccagggctacgccatctacttctcccggggggtcctgccccacaacaaggatggcgttgtgaggtgggtggaggctgggccatggcgcctgggtggctacagctcgaggcctgggacacctgtgcagtcagggtgccgcttgtcgcgagttcacgccaagggcatggctggcaggcgggcttgtcccctgcctcccagcctgccagatgtgtgcggcnnnnnnnnnncttcacgccaagggcgtggctggcaggtggccttgtccgctgcctcccagcctgccagatgtgtgcggcttgcacgggactgcggaccatccataccccattccaaacattgcctctcaccacactgcaggccctacccggccccatggaccaacaaaccctacctcctgcacctgggcctgcnnnnnnnnnncgcctcttaccgcactgcaggccctacccgcccccgtggaccgacaaaccctacctcctgcacctgggcctgcagtgctacgaccgtgccttcctctcaaagtactgcaagatgcccgcgacacccctgatggtgggcgcgtctcagaggggtgggggaaggggattgcggacctggttctggcgccgcctgcggtcctggcatgctgttgctgttgctgtgccgtcagcagcatcagaacaaacccattccccttatcgcctgccaatgccaatgcaggcaatggaggatctggagcagctcaaggttctggagaacggctacaagatgaaggtcagcacctgatggcatgggctcctgctgggcggattctgcaccagatgccagcagtgcaagatggtcnnnnnnnnnntaccggatggcatggctcctgctgggcggattttgcaccagatgccagcagtgcaagatggtcgatggtgtaggcctgcagactccatgcatcccagcgtctgctcggtgtgtctgcaaacccaccctcctcacacctctcctgcccaaccccctcgcaacaggtggtggaggtgagccacagcgcgcatggcgtggacatgcccgaggatgtggcctccatcgagcgcctgttgaccgcgcaggccagtgcggtgggggcagtcgccgccgccgtccggcgagcgtagatgccacgtcaaacctgggtggtctgcttgcacaagggtttacaagagggcgtgtaaacgcgtcacatggattgttgatgcatggtacagctgcaaggagacgtgcatgggccgtgtccacggtgggcaaccccccgtctcagtgttgcagcgtcagacgctctcgacagtcagtgcacagggtttgaattcagtcaggggaggggtgaggggacatactgtgagtcggacacaaggggttgctcggcggcgcaggcctcgttgcgggtctccccgctcccagcgcctgcgcagagccccacggcgtcacaaggcgggctgtgacccttcctccatgggctcggcggggccgtggcgcatcagctcccgcagctcctcccgcagctcctccagggaggtgaccacgtcgggctccgcgccctcccgccccagcgccgcggcggcggccagcccctcctcggccgcttccagcgcgtcgtcgtactcgccgccgcgcgtcagcgcctcggccagcagcaggtgcacggagggcacgccgtcgttctcctccagcaggccgcccagcacgcccagcgtgctgtcccgctccacgtccagctccaggagcaggcgcgcggtctcgaaccggaactcaaaactgggcggctcgggctcgtccccggcgcccgccccgctcccgctgtcctcgctgcccagatcctcctcctcgtcggcgtcgccgccgccctcgtcgccgccctcgtccgcgccggggcggtaccacaggcccagcgactggcgcagcaggtccgcggccgcgtcggcgcgcccgcactgcagcgccagctgcgcggcgttctgaaagggctcggggctggccgggtccagcgcgcgcgcctcggccagcagcggctccaccgccgaggtcagccgcgcggcggcctccgggcccaggccgccggcctcctcggccgccgcggccgccgaggacatcacctcctcggccaggcagcagagggaggaggagagctgcgacgacagcgcggcgcggtggctcgccagctcgtcctcggtgtcgggcgaggcgatgagcgcgttctggtggtaaaagttgggaggggaaaggaagggggaaatggtcggtgagctcggacagaccagagccttcggtggtcggcaagcaggctgtcgatgccagggcacggcggcctcggcatgaaacaggtggatgatactgaaactaccaaagatgtggtggccggtcacgcgcgggctccgcggccggggtggggggctcttgagcccccggcgcccaacctcccccgtggcaaagaccggccaggccagctgctgtgcaggctttctttccaggacccatcagctgctatgtaaccgcattgattagggcggccgcagaaaagagatcccggttgttgagcgggtggttgctgacgcggagactgcacattcgcactccactcccaaccctcaaagctgaaaacatacgccctgacttaccgaacggtccaggtcgaccctcaatatgtcgacgcctctcctgagcgccgcttccnnnnnnnnnncgactcaccgaacggtccagttcgactctcaaaatgtcgacgcctctcctgagcgccgcttccgccagctcaccatgcagcagctggccaaggtacctgcatggtgttgacaatgcagggggggtgctagctcggatggagaactcaagaagagacacgaggcaagggcactcagaagcagctctggctgcagtcaagcaagtggcatcaggttgtcagaggtgaaggtttcgtcagcatgggcgtgtgaccctatgcagagatagaataatatttgcacgttcatcctttgccggagaagaagtgggtattccttgctctcctcatcaccatcaccatggctcacatgtacttttcaaatccggnnnnnnnnnnggaagggggttttccttgctcttctcatccccatccccatggctcacatgtacttttcaaatccggcgtcaggctgtacttcggcggccttcctgagcacgttgacggcctcatcacggctcccagtctccgacaagaacgctccgtatgcactcaggaattctgggttctgaggtcagggagagggtcgtaggccgcttatgctcgggaagggaactggtgggaagcaagccctcccctagctccacctgaggactcaaactccgtcacactcacctctggttcaagcttcaaggcnnnnnnnnnnnnnnnnnnnnnnnnnnnnnngctgactgcaggcgggcaagatgaactgcccgtaaacgcaggcgctccagcgatgcattcgcgcattcagataccaaggcatcgatgcaaatgatgtctcctccgactcaccactcccgccttgtgcgtggcatgcttcttgccgccgaacttcttgcccatcggcggggatgtgtgccgcgcaccagacgacaatgaccaaagtgtgtggaagccaatcagcttagagtatctatgtgtaacggaatacgaccatcttttaagtgagatcggcctgggtttaggtgcagnnnnnnnnnnaacgacaatggctaaagtgtgtgcaagccaatcagcttagagtatctatgtgtagcggaatacgaccatcttataagtgagatcggcctgggtttaggtgcagagcgattggcgccgtccactttctgggggagggactgttttgctgaggagggtaccacaacagcggtggggtaccgcggctcgaccacacgacacacgcacggtcgtgtgcacgttcaccctctcatggtgaacagagcgcgctcacacaaccccacgcgagttagcatcaaggcagagtgcttgcgattgacaacatgcacgcccacatatctggctgattcacccgtaatgggagccatgacaatgcnnnnnnnnnngcatgcacgcacacatatctggctaattcacccgtaatgggagccatgacaatgcccaaggcttcatgcggagggctcccatgctcctccgcatacgggcatgcagccgttggctggacaagagccgggtcccgtgtttccctgctcaccccacatgcacagtatgcatccagcacctctacgaaaccgcctgcagccctgccccccaaacccactgcccagcccatgagcacacaaaccaccaagtgcgccgctggagggatgcatgccgggggttcacgggacgagcggcccgtgttttggcagggcctgctgttgtagcatgtatctgagaggtcttccttcctcctgatgatgacatcggcttcccccatgctgcaccctcttttcctgctcctcccgtgaaccacctgtcacctagcaacctccacccccttcctgcgcaggcacatcacttggacctggcccgggctcatgccggacatgcgcgccgcctacctgcagctgcagnnnnnnnnnnagtgcatgccgggggttcacgggacgagtggcccttgctttggcagggactggtgttgtaacatgtatctgagaggtcttccttcctcccgatgatgtcatcggcttcccccatgctgcaccctcttgtcccccccattcgtgaaccacctgtcacctagcaacctccacccctttcccgcacaggcacatcacctggacctggcccgggctcatgccagacatgcgcgccgcctacctgcagctgcaggaggagacggggacgtgccgcatcaaccagacctactcccccgaggccgtgcgccaggcggcctttggcacgcggggcgccacgctggccaccgcgggccgcgtcgcgacggtggtgctgcaactgaccggcttcgccgcgcgcctggcctgggatcgggcccggggcctcaccgacggtgacagcgtggtgtcgctgcgcgcggtgcagctgcgccgcctgctcacccgtctgggccccacctttgtcaaggcggggcaggtgctggccaaccgcccggacattgtgcgccaggattacatgaatgagttgtgcctgctgcaggacgccgtgccgccctttccaaacgaccaggtcgggggggggcaaggaagggactgtgatgctggagggcaagtgccgtgactgcatgggcatgtgtgtggcagagcgggggtgacaaggagggggggtggggggtgatacaagtggcatgccggtaggcttctgtctgcttgttgtgccgtgccagccaaagtattcttagggactggactgagccaactgtgggtacaaggagcccactctccccatcctccaacgaaccgcaggccatgcgcatgatcgaggaggcgctgggccgccccatgggcatggtgttctccttcatctccgaggaccccattgccgcggcctccctgggccaggtgtacaaggccgtgctgcgggagacgggggaggaggtggccatcaaggtgcgtggagttggtttttgggagcaggttttcgtgctcgtcaccgtgcgacaagcggtgaggggcctctgggcccctgcctctgggacttgtgccttcatccaggaacacacaacgctcccatacaggtccagaggcccggggtggagcccacagtcctacgcgaccttttcttcttccgcatcatcggcggcttgctgacgcgctggtcgctgcagcgcctgggctgcaacgcggagctcatcgtggatgagtttgctgagaaactgctggaggagctggattacgtgcaggaggcgcggaacatcgaggtggggcagggtgatatagggcggggctctttcatagcgtggaaggcgtgtgctggccggcgcacttgagggcggtggcagctcttcgtccctgcgtacccagctgagaagtccctacctcagaatccaaaccccaacacacactcaggacttttaccgcaacttccaaggcgnnnnnnnnnnacctgggtggggggtggagttgagagcacgcgagggtttggcatttctgtgtttctgtctataaaggaatcaacctagtgcattgcctggctggtgggagtccagactgctttgcccaggctcccagccnnnnnnnnnnctgtccccgtgcacccagctgagaagtccctacctcagaacccaaaccccaacacacaccctcaggacttttaccgcaacttccaaggcgacccgctagtgaagatcccttgggtgaggaaggacctgtccagtcgccaggtgctggtcatggagtggatcgagggcgtgcggtgctcggacgtcctagccctgcaggcatccggcatcgacctggaggtgagtctgggtgggggtggaggtgggagcacgcgagggtttattatttctgtgtttatgtccatcaaggaatcaacctagtgcattgcctggctaatgggggtccagactgctttgcccaggctcccagcctggctcctctctacgtctgctgcatggctccatcgaggattggtccctctatgccccttcccacttgcagaggttcatcaggataggggtcatctccggcatgcgccagctgctggagtttggtctgttccacggcgacccgcacccgggcaacatctttgcgctgcatgatggccgcatcgcctacgtggatttcggcaacgtcgcggagctcaggtgtgtgaccgggctggagatgaaggatgcaggaccctgattttctcatacttggcccatatttaggacgtgcaggttgatgacaggagtgcacgtgccaaaaactagtgcagttgactatcattttcccgcggcgagacccaccccccccactcccgttctccccttctctgacagtcaacgcaacaaggaggtgctgatcgacgccgtggttcatgccgtgaaccaggattattcgggcatggcggaggacttcatcaagctggggtttcttgccgagagtgagcgctggagttgggagctgcgcgcctgttatggacctctacccaccattagatgatcagtgttgtggactggcgtggcgtgagggtgcagatgctttggaggcgctcaggatcaggagctggtcttgagacaccgaatcactccaatgcaatcatcttcctcacgttgcagacacggatgtgagccccattgtcccggccttggagcggatctgggcagactccatgggcaagtccatggccgacttcaatttccgcactgtgacgaccaagttcaacgagctggtgtaccagtaccccatccgagtgcctgagcgctatgccctcgtcatcaggtgggtgccgcagggactgggcggtgttgctgaggatgtgtgggcgctcaggaaaggctcagggccaacttcacaccctcccacctatatacacaggtccctgctgacgcaggagggcgtctgcctgagcatcgaccccaacttccagttcctggcggtggcatacccctacattgcccgccgcctactcaccgaccctgacccctccctcagatctcgcctcatccaggtttggagggggttgggacacattttgagccattgccgtatgccctgattgtaccagtagtccttgcagtcgggacatggggcggaaatctatgctgggtcccttcctgccatttctacttggttggatatttgaagtaagttggtagaatacccaggggtgatctagggtctgcggcctgagctgtcatatcaccacccgcactcatgcaggtgctcttccagggcgggaagttcaggtgggacaggctgcagaacctggtgaccctggcgcagagcgggacgggagctgtggcagctgacctcaccaccaccgtctcggatggcctcagggtaagccttgtggggcggtctagactggcggggtctgttgaattgtgctgggctcacaaaggcttgcaccattttgcaatctgaaaccctgcgccgctctccctctcaggtggttttgctggaccccaagctccgcgcccagatgatcctggcactcacagaggacgaccggctgcatgttaaggaggtgcgacatgccatggggtcgaggtggagaattacattccattcttgcgcgcaggccatctgcacaaggcctctgagccgtaagagcattccaccttctgtttattttacactgcggcccagaacctgtacacaagcctcctagccctccaaacccagcccatcctcgccctataggtgcaagagctgctgcggctggtgcagcctcagctggacattcctcaggccctgcaaagcactgctcgggagctgccgagcctggtccgtcagatggccctgtcatggtctcggcaggtgcttgcatccccatgaccagctcgttttcagggcagctgtggtggtattttttggccgagttttcctgcatccctggccgcactgtggcacaggtgttagtgagggtgagttttgtgcaccgtgagatgaaactgttcccgcacttgaattttttggtctcctgtggatgactggagcatcccatgtacacacgtaaggtcctagtgtgagtcagatccgtgcttgcgctgccatctgggcacagcagcagctgtgaggtgccgagtaaatagattggggaacggcatagtcagctatttgcatgccacaagagcacagcagtctctgtagtagtgcgagccccgaatacacaccagactcctggacatcaggcttcttcaacgaagtattgccatcacacaatatctttcgagataaccctcaaccaggtcagcagtgcaccttctaaccacagcgctctcgcccttttatacctcagtctctgtacactgtcactcgtcaagaatatcccgtcaagtgcctgggctgccttacagaaaccgtatctccaagtcaggcacatctcacacctcacttccttcttcgcttgctttgcttgtcccccctgggggttgcctgcgccgaggctggttcatccctctctgcctgcccgttgagcaggtgggcgtactcttccaagggcgcaaagtctgagctcaggtcctttgagcggcgcttgccaccccgtgctggcagggcctcgacctcctcgtcctcgtcctcctcatcgtcggcgctgctgctgctgctgctcggttctgccagctcaaaggggttgacgtcctctggacctgagactgtggacttggcacccctgcgcacagccttggagccaagaagggctgccacctcggcgtcagctgcatcctcgtcctccgatgacgagtcctcgcctgcttgttgatgggagcaggggagcgtgatgacttcagattcaagcacttgtcatcaacagcgggtagagttggggtgatggtggccatccgtcagtgcactggcgggttggagggcagctgcgctgagtcagagtcctgctaggagatccattgcactccaggcccccccgccaccaattctcatccaactcatgatctccaaaccccggagtccttgctccggctgcgcacccgagtcaggcaggctggccaggtcgtcgtcgctgtcgccatcctcatcaccagacgacatgtcggagaactctgcgccctccagctccgagccgtccgcgtcctctttgtcgtccccaccagcctcgccctcgtcatcacctccaacaacctcctcctctccgtctgcagactcctctccaccgtcgccctcctccagaccgccggcatcgctttcactgtcgctgtcatcctcgccccctgagtctgccatggcgtccgccagctgggagtagtcgtaccccgcggcgcggtcggggtcggccccgatgccctcttcgcccccctcctcctcgccctccaggtaggcatcggcatcctccgagtcggcgtcggacagcagctcctcctcctcctcccccgcgcccgccgcccgcgccttcctggccgcggccgccgcgcgccgccgcgctacccccgccaggctgtagtacttgaggaagaagacgtcttccggggccacgtccgcctcggacagttgcccaaagtcgggcgcccccgtctccgcgaccccgggcaagggctgcatggccgacccgccgcgcgcgcggccgccggccttgggccgccgcgcgatgaacttgtccaggaaggctgcgggggtgaggtcgcggagcgggtcgccgtcgtagaccaccgacgtgcccgccagcagcgcgcgggccatggccgccaccgaggggtgtacgtgggatgccaggcagtccagctcccagaggcaggacgcgtccgcgccagcgtacagcgggtcactggaaggaggtgtgggatttgagggattagcttggggaaagggggagtggagcaaagattgacagagagggtgtcatgcagggggttgcgaggagggcagtggcgcatgcggttgggggggtgctgcagtcctgggcacgccgccggatggcgggcgcagaggggcgcagagctgcttgatgcagctgttgctctggcatgcagctgccctattgccattagtgagcgcaccccagacccgtgtcactgacaccacagtacccgccaggggtcccccatcccccaccccctaccccctccgtctcagcctgctcaccgcttctgggcgtcgtatccgccttctttatctggccagcgtggggccgcaccgggatcctctttcctgacggtgtgcggcctggtgggctggaacccagcctcgccgccctcttcggcgtccttgaactgctccagatcgtcgccgctctcctccgcttgaagcactgcgctccacagccccggccgactctgcatgatggggtttggcaaggtgatgagcaatgctgcggcacggtgcttgtgggcgggagtcggtgctcgagggcaaggaaaaggcctcagccttctgcctcatggtagtctcagcaacacactccgagccaatgcaccagatgaggcccctnnnnnnnnnnagaaaagcctcagccttctgcctcatagtagtctcagcaacatcctccgagccaatgcaccagatgaggcccctctgctctgtttgccagtccgcacgtaagcatacaagcttagggcttgcgggttcccgaccctctggtcgctcaccttgagaacctctgataccaggatgagacatccgcaggcaaagttcgcaggagactccagggcaacctgtagcaggcgcttggcaaaggcacaggtgcgcttgtggctgacgtccgcttgcacggcctgtggggcaggaggtatggacagatggaggggggcgtttcaagaggactatcctggacattgtgtggcggggcggggtggggtagagacccctccttccaggtgagccagctcaccccagcctccaacccaagaccacacaccttgagcaggaggctgaggnnnnnnnnnnggggggcaggaggtatggacagatggagggggacgtttcaagagaactatcctggacatcgtgtggcgggacggggtggggtggagacccctccttccaggcgagccagctcaccccagcctccaacccgagaccacacaccttgagcaggaggctgaggnnnnnnnnnnaaaagcaggccgttccactggtgacgacggtcctgtagaaacctggcacagtgtgcccacccaggcagaatgcctggctggccatggnnnnnnnnnnaacattggcgccttgctggactttgtgagctccgagctggacagcacagagtacaggcccctgcaagcgaccaagagtaggcagggcgcagggctgatgtcacggaaagcaggccgttgcactgatgatgacggtcctgtagaaccctggcacaatgtgcacacccaggcagaatgcctggctggccatggctttccctgcataacacaggaaccgctcctgcatcccgctcacctgtagaagcggtctgaaagcgcattcctgctggacatgagctggaagaggagcagcaaggcctgcgtagacaccccaaaggagcgcgtgtggatgagccggaacagcgcgtctgccgggtggttgggtgatnnnnnnnnnnggccaccccgaaggagcgcgtgtggatgagccgaaacagcgcgtctgccgggtggttgggtgatgggtatggtgatggggctcgggaagtgtgtgttggctcctagtcctcaaaccagcacgcagcaacggctgcacagctcgtacaccgcctgccatccccacttcctccttnnnnnnnnnnaggctcctagtcctcaaacctgcacgcagcaacggctgcacagcccttacaccgcctgccatccccacttcctccttccctccccgataaatgcacaccaatggcaactcgcacctgcatgctgctggatgaggggctccacctcctcggccgggacaaaggggaaagcacggcgcacgcccgtcagcagggccgacagcatgcgcgcgtctagctccccggtctgcccagtcagcgcatcgggtgcgccgccttcctttccctcccccttcccggccttgctcttgggagggtgggagtgggaggacttgcccttgccgtgctttccccccttcctcttctggtgcttgccgccgtgcttgccgccgtgcttgccgccatgcttgccgttctgcactgcagcgctctccttctggagctgagggatgagggcatggacagagggattcgtgtcagcatgacagatgcagaggggggtgtgtttgtgctattttgcagtggccaagcgatttcaaagccctctccttcaccatgcacagatatcagcatctctgccacaaaaaggagcaatcaggtggaactcactgtcgcagcagtaccaattttgccgtctagaatcatggaaaagagggtgaagtacacatctatcaggcgccgggccagggctgggccgcctgttcatatcgagaaacgggaggaacgaggtggtatggccagcggtggttggagtgccagtttgatacagtgcctggtcacaccacattggggctcctgtcaggccactcctccctcaaaaatcaggcgtggactaccttgggtactgctgtgactcagcaccatttgattaaggtagacaacggcatagtatcgggccctgcatggtgggagggaagggggcgcttcagcagccatgccatgtgagtggtgacccatccaggatcctgcggggagtcctgggcacatgtgcagcccacagcagtaaccaccccaagccctttcttgccaccataaagacaaagtcggacccctcccttcaccgcgccgccgcacctgtcctggannnnnnnnnnggccctttcttgccaccatgatgacaaagacggacccctgccttcaccgcgccgccgcacctgtcctggaggcctgggcggaacatgaagcgctccacctcccggaccaccactaccttcatcatggggtgttccgtcagcaggcgggacaggaggaagccgaccttggaggccagcttccgatcgggatcgcccagcttgttgaccagggcggagagcagacgttgctcctgctccggttttttgctgcagagggatggcatttaggagtagggggggggggtctgaggcatctataatgtgtggtggggatctgaaggccgagaaggacacttctggggcagttggtctccaggaggcacagcagcagacaaagtacctcagagcattgtgtggcacatcggcagggatgcagcctcacaaaccaccatgtgtcagcacgcgacacatttcccccagctcctgcataagagctcccatgctatgctcctgcccccgcccccaagaccctcatcgccactctggggaaagccatcctttcagcgccccaggcgctcatccagtcttccacccctcctcctctcccttccccccatcgccccccccnnnnnnnnnnctgctcctgctccggtttcttgctgcagagggatggcattcaggagaagggggtttgggattgagccatctataatctgtggtggggatctgaaggctgagcaggacacttctggggcagctggtctccaggaggcacagcagcagacaaannnnnnnnnnccccttcctcccttccacacacctgagcaggtcgtacatggccttcacggacttgtccttgacaaactccaggttgtccttggacccctcctccaggatgtccacgaagcgcgcatagcgcttcttcacgcagtcctcgaagtggaggtagagcagcgccagatcgtcagccctcactcccggtgtcagcgcgcccaggggctgctgctcgaagaagcgcaggcgccggtccggcagcagcacggtggcgaagagctcggccagcgcgtccagcgtggcgcccaccaccgcgcgcgcgccgccgcgcttggccgccatgcccagcagcgtgtccagcgccgccagctgcgtcagcgcctggtcctgcaccatgaccgaggccgcggccacgcggtcggatgtcgtgcccgcgcgccgcacctgctgcagccactgcgcgtcggtgccatggcgccggcccagcgcagccgtcgccgcgccctcctccgccaccagcagcgcctcggccgccgccttgcgctcggggatgagggctgggtcggcctcgccctccgccgcagccaggcgggcggtgtggagggcggccgcctcccaccacagcgagggctcgtcgcgggggaggacgctgcgggccggggcggctgccgtgcctggagcaggaatgggagaggaaggtgggcagcgtgggtagggatgaggtgtgcgacaatgtcagcggaggggaggattggacttcttgtcatatacacgatacccaagtatcctgggccaaggcccaacctcagagcatcttacgcaccccaccgcccaccgttatgctgctgctgctgctgttgctgattgcggcccggggcaggggtgggaagcctgggagcgccagtgttgggcttgccagccacttgccgcttatccgcggggctgagagcaggcttagtcccgggcgtggccttgctggcaatagcagggacctcacgcgccttcgctgttgcnnnnnnnnnnacttgccagccgcttgccgcttatccgcggggctgaaagcaggcttactcccgggcgtggccttactggcaacagcagggacctcacgcgccttcgctgttgccttggcccctgtgccggcctcctccttggtgggtgtcttcggcttgactgccctgcctatccgctttttcgactttttaggatcaaagtcagagaaggcaccatcgccaccaccggcccctagccccagctcggccgcaaacgccctgaggtcggcattgaggtcccccgtctccgccatgcagccgttccgccaagacacagtcgggggaaacttacgccctctgcatcagggacggatagtaacaggaatctaaacatgcatactacttgtgagcgagctcgccatcaggatggctctccatagcactcctggcaccccgggctatgcgcgagtaccgggccagcaggcacagcacgagcatcgagcccgaaaaatatcccaggattcttacaaagaatgagcaaagcggtcgggcggggctggcttgatgatatcacgaactcgagtgaacttttatattgcttgtattgtacagacaaaccccaagtatccctttgcttttggtgaacccttcggagagccctagcttacgggaggtcccgggcgaggaccatgggcgtcgccagcgtggctgtaatggactccggtaccttctcggttccgagccgagctgcgctgaacgcaccgcgccgtcgacggcaggctcggggctggctcgcgcccgagacgtttgtgtttgacaaccttcctccgcaccagaaggacaaccaatacatccgtcgctactaccgggccaattattcctggaagcggagtctgctgagcctcttctccctgcacaacgagacgggaaacatatggacacacctcatcggtgcgcgcggaaggggtgttggcgcagggtgttggaggagtcgattggaatgcggctcatgaaaacagcctacgaagatatggtctgcgcactgtcaccaccctattctaacatcaagctcgacccttgcctttgcacccactttccacccccttgtccaggcgtggtcatctttgtctgcctgatctgcgccacggtcagggtcgcccccgagcccctggccctgggcagcagcgccctgtccaagctcgagcagcggctgtacgcatatggcaagaccaacctgtacgagctgctggagacggtggagtcgtgggaggccaaggtgctcaaggtcggctcctccggtctggggtccatcgaggagcggttgggctcctttggcctgcacaacctgcacgacctggtggagttccaggagacactgcgccggtatggaaagcgcggggtcaaggagctgtctggctttgggcgcctcatccggtgagcgctgggtttatggtgttcctgggtgaggtgtttggggttaccgtggggtgagcttccttgcctccttcttcagctggggcccacccagcgactgggagtgcaggcatcgagtagatgcatccctgggagagagtggaagagtgccgctccccacccatgaaccccgtgccggaggcccgcctgcccctgccgccctgcacccatgtcccacgcccgcgcagttccggttcattccttgttcaccccgccctggcaacggtaccaccccacaggcgcttctcccgcagcggcatggaggagctggccagcatggagcagcgcctggtgggcctgggtccgcgcgccctggccgacgccgacgaggcggtccagcgcgccctggcggcggtgctggacacgcagtggcccgcacggcgctggcccgtctacgttttcatggccggcgcggtggtgtgcctggccacctcctccctctgccacctcttcggctgctgtgcggctcatgtctccacccgcatctggcgcctggactacgccggcatcgccgtgctcaccgtcacctccttctacccgcccgtctactacggcttcatgtgcgcgccggccacgcgcgccgcctacctcgcggcctccacgggcctgggcctggccgcgctggccgtcacgctgctccccttcttccagcgacccagctatcaccgcgtgcgtgccgccacctttgccgcgctggggctgtggggagtggtgcccctgctccacgcctcgctgctcaacgcgggtgtgaaagaggtgcaggccgccatcaccctggacgtcgtcatgggcgtcatctacctggtagggtggtctgggtgggtgtctgctgggagggttgagagaggggggttgctcccttgacatcttggaatgcaggccgggttatgttgcgcggggtgccggtgtgcatgagnnnnnnnnnnaaaggggggtgctcccttgacatcctggaatgcaggccgtggtatgttgcgcggggtgccggtgtgcatgagcatagggtgttgggatgtcctcttccccagggggcaccgtctgtccaaaagctctgcagcggggcgcccgggtcccagattcgcagcgcagcgcacccacacctcccccaaacccctctgaaccactcacccaccttgcacaggccggcgccgcgctgtacgnnnnnnnnnntgcccgggtcccagattcacagcgcagcgcacccaaacctcccccaaacccctctgaaccccccaccactcaccaaccttgcacaggccggcgccgcgctgtacgcggcccgagtccctgagcgttggtggcctggcgcgtttgacatggtcgggcacagccaccagatcttccacatcgcggtggtggttgcggcctgcgtgcactaccgcgccacccgcatcctcatgcactggcgcgagaccacgggcggctgcgggccgggggggctgtcgccggtcagctgatttgatggggcatcggcccgattgagctcgggtgagccctgagcagataccacaccctctgaacacagacgactgggcgtccccagcgctcgctgggcaccgcaaggcgctnnnnnnnnnncctgacgccggtcagctgatttgatggggcaccggcccggttgagctcgggagagccctgagccacaccctctgaacacagacgactgggccttcccagcgctcgctgggcaccgcaaggcgctgcgagctgaggcttgccactgagacagcatgatgccggggctcacagcgtcctttctgccctgcgtccgggctctggcggatgcggtaaagaattcactctgggcccctgccccacccatgttccggccacagggccagaacgactccagtccattctcatcgcaccccttccttctcaatctcccgttcagcttgacagcccaccactgtttttgccgccataagcggcctcaatgcccggccgggcgaggtccactgttgtccactccaaccccttttggtgggggacccctcttcccctcccctcttgccatgcgcgccctgcannnnnnnnnnccctcaatgcccggctgggcgaggtccactgttttccactccaaccccttttggtgggagacccctctccccctcccctcttgccatgcgcgccctgcaggtgcactgttcccttccctgacccagcacggagacttgttatacacagtgacgattgtccagagccccaggcaaaagaagtgatgctcctcaataagtgggggaggaggcctcgggggaggccagcatgcctgccgccgccgctgccgcggccctccgccgcccccgcctgctgtctggctgcacgcgctggccctccgggatgacgtaatcggagctggggaccacgctgaccagcttgcggcgcgcgttgcggtcgaacaccacgacgccgtcgatgagggagtagagcgtgtagtccttgcccaggcccacattcttcccggggtgcacctgtgtgggcatggggcagtggccggtgagcaaggtgctgcccgcatgcaatgcagggtgccacggactcacgtgacccattggggggaaggaaacagataatgaggccctgtggcgccaccaatccaccaatccacagcacaggggttctgcggctcaaccacccctttcctcccatcacagagccccagaacgcagacctgcccacaccttggttccgagctggcgaatgatgatggcccccgccccgatggcctgcccgccgtacaccttgacgccacgccgcttggacacggagtccctgccgttcttcgtggagccagctcccttcttgtgtgccgcctcgatggtcatggggatcggcacaaagggagtcacacgcaacgacgccttctggtacatggacacggcgggccggcgggggcacgtggtcccgaagaaggaggttcctaggagcccctgcatcgcgccaggtgctcgagtgcaggtgcgctaccgaggtaaaggaaaatccttaaaaccgacctcctgatgccggtcaaattgtgggagctatttcaagaggttcgtatgtggtaagaaggacggtacgccactagactgggagcgctcctccagttcttgataagatcaaagaccacttcccgccacctggctgtgccgggtccgggcgcgggcacgggcttcaaaacgaatcgacagcaacagctgcgggcgtggccgcgaatgccggcctatgctccgcggcagtgcatggtgtgtacctagcatcatatccgcaagtcgttccgcgcagctgcgacgacccacatccgggatggagcccgagacgggcggggctccctccggggccgaggccctgagcgctggagacctcagaaatatgctcggtcagtgcttgaagctggcctccgagaacaaaatcacggccaagaacacctggggcctccctctcatcgagcacctggatgacctgatcaaggcagagccagacagcacaaacttccagcgcgccagtgtcaccctggatgccggagtcaagatctacggcacccgcgtggactcggtgcacacggagacctttaagatcttgggaggccttgggcgagctgctgcgcccgaggaggccctcgaaggtctgatgctgggaagggtcgaagtttggcatggctgctccgccgcagacaatctcagccccccaagccctttgcgatggcttcaggaactgcgtatctattccagactgaacccaaacaccctgcagatggcgcccagggagaggagggtgtgggcgagggcgcgacgagccgacgacgcaaggtcttggctctggatcagaatgccaccctggagtccagcccggacgctctgaatctcaagcagttcgacctggctttcgatgtagaccccctgttccaacaaacgtctgcacagtttgacgagggcggcgcccaaggtgcagagcgtgggggcaggtccatgggcatcgtgacttggatgggtgcggtggcttacccctgcttcccccttgtccgcctgtacctggtgtccgcaccgccttgatccccttccccaaccataccacacnnnnnnnnnnggagcgtgggggcgggtccatgggcatcgtgacttggatgggttcggtggctcacctctgcttcccccttgtccgcctgtaccttgtttctgcacctccttgatccccttccccaaccataccacaccccaggcctcctgctgaacacctttggggtgttccgtgggtgtgaggtcatgttcgactccagcgaggtcccggagcaggcgctggcgccccttgacccagggccgccacagcaggtgtgtttctttctgggggagagtcaggcgggtccgacctgcacattgccctgccctccttctagccagtggctcccgacagaactcccacgcctggggcccgcagctcgacctgtctgggctagagccggccctgacagcctggcgggacgagctggcccggctcggccccagcttgctggccgcacccctctgccccagcctggctcggatccaggagctggcgggggagccggcggcaccggtcccccaggccgccgcggaggcagaagccctggtggcgagcgcgctccagcccgaggcctcgggcgacgcccagggtccccagccggccgcatccgcggcgtcctgtgcaggggccaccgacgacgccatggcctatcacgacgacgccgacacgcagggagtttacgacgggcacgatggtgcgtcccggacgaggagaaggggaaggggcgttttgttgtcttcatggccgggatgagtggcgcactgtagtgttccggccttacatctccgagtcttgtcgtgtcccagaacgtcctctcccccctgatcccatccttggtcagacggtgatcacggtggggacgggggcggctacgnnnnnnnnnntgtgttccaaaacgtcctctccctcctgatcccatccttggtcagacagtgatcacggtggggacgggggcggctacgattccgacagcgcagccagcgaggctggggcggtgcacgtcgaccccgagcccggtcacaccgggggagagggcctcgcccccgaggcgctgcactggctactgcacggcggcggtcccggggccgagggcggacccgtgccctccggcctgcccagcgggacgagcaaggggtgggcgggggcaacgcactggaggttccggcctggcgccggggctgctgcggaaaacgcggcgggcgggggcggggaggtggaccgggggccgcggaaggagcggagggccgcctcggggtgagctcgagcgcgatgagttggtctggggatgccaagggggagtggctgggcgggaggaaggtttcacccggcccaggacgtgtcgccacgacaccccagccatggcatggtccccctttcacccacaaaacctggnnnnnnnnnnggatgggtttgtctggggatgccaaggggagtggctgggcgtgaggaaggtttcacccggcccagggcgtctcgccacgacaccccagccatgtcatggtccccctttcacccacaaaacctggtccaggaggagcgaacccctggactttgtgagcctgatggcggccggcccggcccccacctttgccatgctggcggccgagaagaaggtgccggcgcggagatcggccaagaaggcggatgcccagcgcctgctgcttcctgaagactatcactgcaaggtggggcagtcggcacggcgattgaaagaacactcacgggaaagaaacagcaagcggaaaggggaggtgcccagccgcagggtgctgaaggcactcgcccgcctggagaacactgaaacgtcacagtccccactctcgatggtgaccgatgcatcacatgttcctctgacgcaggccgagatgatgttccactacgcgctccgaccccgcaccctcctgctctccggcctgggtgcggggctgggccagggtggcgaggaggagccggggctccaggagtgggccgacctcgggcagggtggcgccgaggacgacaacgacgacgacgggcatggcgactttggcggctgggagccggcaggcggtgagtgctcgaagaggggggttggatagcaatagacaggccttgctgacttgctatgaaacaggctgcccggggccagcacaggccatgaacactgccttgcgctgcaatgtgcaagttgctcctctcagctcccagccttccttcccactggaacagccgacgctgacggggcgacgctggagctggtgcaggccgcccgacaggtggagaagggggacatccagtatgcacgagccgccaagcacgtgagacggggctcctgggtggaccaagctccctccagcagtgcttgatttgatatcggaggtagcgacgatgcaagggcttcacacctcacagtcgtccgccctccagctcctcggagtctgtgtcccgagtgtctctctgtcccagctcccagccccattgcccctcccagcatgcccctcattctccttgccccttctaaccccaccctgaccctctcgccctgccgccctccctcccctgcccaggtggacgtccgtgccctgaaggagctcatgtggggcggtctgcagcgccagctggcagccggccacggcgcctcgccggaccgccctgcccagctccaggccctgctgagcgaggtgccgcaggagtctgcagcgggcccggcggccgacatctccgtccacctctgcttcatctgcgtcctgcacctcgccaacgaacacggactggcgattcggggggtccccaccctggaccggctgatggtgtatggcacccgcccgaccgcggcggcctgacggagagcgcatggccaattcgtggtggggccgtgtcgttttggtgagggccctgccatgcatgaccctgacgaacctggacgccctgttgatcccctgccagagacgagccccgcccctcattccatctcccttgactacctctcttcaccataatcacgacgctgtannnnnnnnnntgccaacgaacacgggctggcgattcggggggtccccgccctggaccggctgatggtgcacggcacccgcccgacggcggcggcctgacgaagagcgcatggccgattcgtggtggggccgtgtctttttggtgagggccctgccatgcatgaccctgacgagtctggacgccctgttgatcccctgccagagatgagccccgcccctcattccatctcccttggccacctctcttcaccataatcacgacgctgtacagccgcccaagcgcacgcagcctcacttccggccgtagccataggtgttgtggtagccgcggccaggccccggggcctgctgcgcggccaggacctgccgctgccgcgctgactcagcggcctcccgctccagccgctccgtgcgcagtgccaccaggaggtccgcctgcgccgcagcatacgcagcctccccgtccccccgatcctcatcacgcctgcggtgtttcttgccgaccttgggctccttcttcctccttttacccgagcgcctgagggactgaggccgagggaactcgctcccttcccctcccctagatctcggctccgcgctgtgatcctctgcaatgagctcctcatgactcctccccagagcctgcagcgcagtcgcctgccaggtctggagatcggcaggtggtacgcccccgctgggaggctctgcacctcccttggtgtacctgggaaggcaagggcacggacggtgagcgctgggccccatgaacagtctatccttgaccatgcacggccgtggtacagcatgccacccaagcccccgccacgcctcaccatggctgggagctggagccggtcagaccatgggcaaatttgaagcgctcatcaaacttggcatccgacgtctgggtcttctggtcgcccctgtttgccacctttttacgcttctcagcctgcagaagggtgtggagatgaggccctggcaatcagaccaaatccaggctcagtcctggtgccccaggcctgacctctgcctcacgcacctctacttctgggtgcttggcctgggacatctgctcctccagggcaaagagattgaagcgctcagggggtgctatagcagctgatggcacgagtgcaggacaagggagtgcagttgccctgtcctctgtcgccggaccgccctgaagtcgttcacgattggagggtcctgtacttggcgacccggtgtcccctccggctagtggtccactaccacttgcctcgccagcacctggtcgcaaagcatcctgcgccccatcgtctggctccaccagcggcatctgcatggttggcagtgttgcacctggtgtattgtcgtatgacgagctgcccttctcagcagagacaggtgtgcagctgcatcccacctccagccgccacgctttcccatctcacgcaccccttgccgttgccgcgcccgagccaggagcatgcgatgccggtagtctgcttctgcagcctggtgtcgggtagtagcctcctcttgctctgcagcatgcttggcttcatcctcggcgaccttgaggcggttctccctgccataaacgttccacctcttctgaggcaggatgttgagtccgcctacaacagcacatgcggggaaaagagaatctgggtgtgatagacaagccagcggtatttttcaaacatggagtgtcacccatggcctccgtaccatgtcctcccatcggcaacgagctgcccaagcggtcgcagcgggtctatgagaaggccccgaggcctaatccggagcaaccacccatgcaatagcacacatgaagtacagaaacatctcggtggctgataaactgtcttcactcgccttcctactcgttcatgcagcagtctctgagatcgtggggcgcgagaactaggaaccgggaactcgcgatcgacagcccggaacgatatattggtgtccttttgggtgtcgtaatcccctgatcttacttcctgattggctgattccttaccgtatacctaatgatttttacctgatcttcctgggnnnnnnnnnngatgccctgatcttacttcctgattggctgcttccttgccgtacacctaatgatttttacctgatcttcctgggagggctctcttgtaaacatggaggcggtgatcgcgagactggaggcagtggcaacgcgtctagaggccacagatgtaaggatcgtacttcttcgatctggatttcatccatcgagcatgtcctcataatatttatttccctcccacagggacgcttgcgacagtctggtacatccacagcacacggcgtcccagccactgtctcagtgccacaaggaggatcgaaatccgctcctatcaccccgccgacctcaaagtatcaggatccagactccttttctcaagtgatcagcgcaacaaccgccttccttgatgtggcggaacgtatcgggggagaggtgggtggcctttgtttgcaagggattgtggttggactcctcccagctgtcacagacccctgcccaccggatagagacatgaccaataccgtttcagatcatcccagcccgcatcctttgccattctcttccaagctcaggttctcctggcttcgcgtacaatggcagctggtgtccagagcgtcaggaaagttctccctgcattccaggtgtgccgtgctcccagtggccccgaggagctgcagcagctccttgcaccggtagcaacccagctggaagccgcagggaggctggggtcgggatcccgctccccatacctcaatcacttcaaggtggtgggggaggccgcccaggcgctgtcctgggtcgcatactctggccccaactgcggtgaggaggagggtaagagggggagaagtggctgcaattgcctgctctataaccggcatggcgttgaaggtgtaatggatgccctgccttaccacgagcacaggcatgcgcagccccccagaccatgtgtcggatgccttgcaggctgccgaattctatgcaaacaaggtgagctgttttggggttgagctgatggcctgctctggcttcccccatgtcgtaagaaataggctggagcggctgcgccgccaatgcgtgtaatccaaggcctcctcctcccgtgttcgcccaggtcctcaaggactggaggcccaaggatgccgcgcacggggagtgggtagctgcactcaaagccgtgctgaaggccatgcaggtgggtctggatgccttgcgcgattcttgctgtggagcacaacagaatgtgcagtgagaatgtggaaggggttcctcgtcatttgttttcagagttcgtgtcggctcgtgggcccccacacactagctgacaatcaccacatcttccagccgaaacgcattcgcgccactcccccatcatgtcaggacttttgtgcggccgagtaccccaggggacctgcctggaaggagggcggcctgtccgccgcatgcttcctgcagggcgacagtggggcgccctcctccacgcgggctcccgcggcgcagcctccctctgcgccgcccgccgcggccaccacctcccagccaggcgccgcgcagcctgccaagcgcgccggccaggtcccgcgtgctcccccgccccctcctcctggccacctgaccaagcccaggggaggtcccgctgatgaggaatctagcaaggcctccggccccaccggcgtggctgccctcttcgccgacctcaaccgcggcacggccgtcaccgccgggctgcgcaaggtgaccgccgacatgaagaccaagaaccgcccggcccaggagggcgccgtgattgcggcnnnnnnnnnnnnnnnnnnnnnnnnnnnnnnnnnnnnnnnnnnnnnnnnnnnnnnnnnnnnnnngcgccgcagcgcgcggcgcccacccccgcggcccagcccccacgcttcgagctggtgcaggggcagaagtgggccgtggagcaccaggtcggggtgccagacctggtggtggcagacaccgagcccaagcacaccgtgtacgtgtacggctgccggaactccacaatacaggtgtgtatgtttggggggaagggggccaagctgacagggtgtggcgtggccaatgccggcagtgcccctgcgacgcttgagactgaacacgagcaccgtcgccctcgcatgaagcctggcctgtggtactaccctatccctcagcagacttgagcctcccatcccccttcccaatatcacccannnnnnnnnntcggaactccaccatacaggtgtgtatgtcttggggggggaaggggtccaagctgacagggtgtggcgtggccaataccggcagtgcccctgcgaagcttgagactgaacatgagcacgaccgccctcgcgtgaagcctggcctgtggtaccaccccatccctcagcagacttgggcctcccatcccccttcccaatatcacccaggtcaagggcaaggtgaacgccatctccctggacaagtgctcgcgagtgggcctgctcttcgaccgggtggtggcgtccgtggagctcatcaactcctcgtccgtcgacgtccagtgcacgggcggggtgcccacgctggccatcgacgcctgcgacggcgtgcaggtgaagaaaggggggcgcaggcaagaataggggggggtgcgttcacggagaggggaggtaccaatgaggatcaggatcgtggtgcagggttttcaaactgcggcttggacggagatcggcggcgnnnnnnnnnngggcaagaaaggggggggtgctttcaagggaaggggaggtaccaatgaggatcaggctcgtggtgcagggtttttaaactgcggcttggacggagatcggcggcgtcagcaccccagcccctgcttaccacaccgcattcccccccctctcccccccactccagctctacctgccgcgctcgtcgctggacacggatgtgaccacggcgaagagcagcggcgtgaacatcatcgtgctggcgggcgacgaggacggcggtaaggaggcggaggggcccgctgaggcggcggtgccggagcagtttgtgacgcgcttccgggacggcgcctgggtcaccacgcctgtcagccacagcggggcctagggaactgcggtccccttcctgatcctgctcagaccctggtttcgagcgcccctgggctgccctgtacacaacgattcggccagacaggtgcaagcggggctgggcggtgctgctcaaagggcaggcacacaacctcctcttcatctgcagccccctgctctgccattgcatgttccacaccnnnnnnnnnntgcgtcgccgccgtcgccgcccacggcctcggcgccctcgacctcgttctcctcctccagcactgcggggannnnnnnnnngacctcttcttcattcgcaggcccctgctctgccattgcatgttccacaccagccttcctttacagcagccgcgtcagaggtccatgggcgcggggccgtcgccgccctcccccggcgcagcgtcgccgccgtcgccgccgtcggcgcccacagtctcggcgccctcggcctcgttctcctcctccagcactgcggggatcaagggggcacagggcggtttgtagattgatggtgtgtgcgttggctgcaaggcccatggctgacgccgtcgccagctcgnnnnnnnnnngttgtagattgctggtgtgtgcattggctgccaggcccatggctgacgccgtcgccagctcgattcggggttggcttgcatgtgcgggtctgccatacctcctcacaccagcccccaaagcaggctgcgatgccactggccannnnnnnnnnctgcatctgcgggcccgccacacctcctcacaccaggccccaaagcaggctgcgatgccactggccatcgccccaggcccaccaatgacactcaaccccccgcgagcccctgcaagaccgcccacctgcaatgtatggctccagggtggcctcctccaggagggtgaagggcacgtcccgccccacaatggccaccgtgcaattcttggaggtgaggtcgccatcctgggaggaaagggaggggcaggaggccggctgagtgcagatggaccggacaacaccgggttggccctagaagcagtcagagaactcctggcttggcatggcgtggccacccactctgcaccacgcgcgatcagggcgtctgcaccacccagccagccgcggcatgacatccaaggtcgccagccgacaatcctctggtccatacctgcagggtggcctgcagggccagcagcgcatggcgtacaagctcatccacgctggcgtcggtgaaggtctcgaagctgcgctccatgtacgtcttggcggcctggcgaggggaggcgggggagaaaacgcaggggctcaagaccgttgccttcttcatgctgatccaacaggtgctccacctgtccaattacccacgagctcacaccctgacaggcagcacctgagatcgggcgcccatggcaaaggccctgtagtcatagtaattgcccgatggacagttgtagaagatgtgaggacctgcaagggggggaggacaaggagctgcattagcgtccgttaccttgcccagcaatgcggtttgattcagaggccaggtggaggttgcaatgcttgagccttcactgagcaggaactcaagggcccacatatatgcgcctccccatctcacctgactcgtcgacccccgccacaatgagcccaacaccatatggccgcttccatgacctctgcgtccccacctgttggagaaagcggaggacagtttgttgatcatgtgtgaacccatccctgtgccctgcagcagtggggcctgacacctgtcgcccccgcctgattagagccaaggtgcatacttgcaatgtcccatacacgttctcatccttccaagcaagagtgttatgtttgtcaatgnnnnnnnnnntccatccctgtgccctgcagcagttgggcctgacacctgccgcccccgcctgattggagccaaggtgcatacatgcaatgtcccacacgttctaatgttccaagcaagagtgttatgtttgtcaatgataccacagtgcgcccacatcagaccttcccctacctgagccttgtcagccagttggcggaccagacggcccagcggcatgggtgaatcaaacacaaatctgggatgtttgggcgaggggacctcagaagcacgaagaaagcaaaatcaacattgcaccagcatcctgcaaggcccacaatctgagtcgtccactctttgctccagcttcatgtccccccatcattcaatcttacctgtgattcaggcactcgttccgcatgtaccggcacaagatacgaccatcagctgtgagccccgagatggcaatccccatgtggtcatcaatctgaggaggaagacgagttgtggaggactgaggttcaggcatcacaggagaggggcacgttgaggagcaagcaaacaggaaaatgtcagactctccgctcctactccccaccttgaacactttgcgctggtaggaggagagctcagagggcgccctcttcagagtggccatcacagccacgtctttgctctgttgcagcatggtgaatgggaagttgctggtattgcaggctagttattgtgccacggcggcatgcagataacgacacctgcctcggcattcctacttgttgatggtaggccccagannnnnnnnnnaaatgggaggtcgctggtacttgcaggctagttatggtgcgacggcggcatgcagataacgacacctgtctcgacattcctacttgttgatggtaggccccagatcagggcacctcccaccttgaggccgaccgctgcagacccctgcttcaccgcctccatggcatactcgatctggaaaatgcgcccttgcgggctccatgttaccacatccgtgtcgtactgcgtgagggaggatgcgcagggtgagggtgaggtgatcgtgctgtgtcaggtgtcgggtctgagcaattgggcaggtctttgcacacctgattcctgaacatcctgcaggtctaaaagatccccagagatccgaaaatgaagtgagacaggagtcgggccccgtcctgcggaggacccactccgatcacaagcaggagcctggcaggccttcccaaatgaatgcggtaatcgcaggtggatggtgccaaccacaattgcagttccacggatcatgttccacttgctaggacggtcgtgttaagcccnnnnnnnnnngatacggtaatcgcaggtggatggtgccaatcacaattgcagttccacggatcatgatccacttgctaggacggtcgtgttaagcccgacggtggagcccggccggtgagacttgcgatcagcgtgttttgcatgctgtcggtgagctccaagggggtcacctgcaggtcgattctacacagcctctcacttgcagcgttgcagacgaaagttatgctcaaaggtacaggaatcccggtttcaagcaagttcagcacaacagcgacgctcgcttgctggctttgttggcatggcgctccgccgctcgttgcaagcctgcgcggagctgccccggcacgaccctggccagggtctgggatgcggtcgccagggccgtctcggccacgatcccggcagcggtccccacgggaaccacttcaaggcccggcggcgccagaccccgcagcgcagcaatagccctggcctccgtctgactggcggctgcctcgcggcaatgcgccaccataccgccaatctcctgctggtacagcacctcggcggcctcggtcagcaccgagtgtgggttgggggtaggttgtgggggaggggtctgccccgacgctgatgagtcggcgcctgctgcatcggagcttgcatcggctgtactgcctccaaccagctgttctgccacggctgggatcagggagaggcagatgctttggaaagaggagagtgcatgacagcacaggcttgtaccctgttcaaggatcaagagggcaggcattccagaattatattccctcacgccttcagactgtacggccgagccaggctacctgccaagcgctcatccagtgaggctagggcggcagcgcagcacgcgttgcccacttcctctgccacagccagtccgatgacatcagctgcaaagcctaccacctccttgagcttcacctgatgcaggggtatgcaaggtatgtctgtatgtgagagggattccttctttgggcagagtctgtcaccgcacagctgtctggcatttcaggagacgggccggcagttggcccgtctccccatcggccgcatgaaaacccttccctcccctattcaagcgcctttcttggcaagtgcacctgcaggctccccatgccgacctcctgttggctcactcaccacatggtcctcggtggagtactggtccaggaagcttcgctgaagctgcgcaagaatggggtcctttaccggggccgccggcacgccaggcggcacagcatggagcatggtctgcatggatggaaagggtgagtcccttgtcagcaggacaagcagaggtttgcctgacattcccggttggcctgcggcgctcctggttcgagcacacccttcccaactccatcccagccccttccgctcccccgacctgcgttccgtctggcacccgccgcggcgccgtcggcgtgatcttcctcgcggcccgcaacggcgcgcccgccgagtcgccacgctgactcagcaggnnnnnnnnnngcatcccggcttggcctgcggcgctgctggttcgagcacacccttcccaagtccatcccagccccttccgttcccccgacctgcgctccgtctggcacccgccgcggtgccgtcggggtgatcttcctcgcggcccgcgacggcgcccccgccgagtcgccacgctgactcagcaggcgctggcaccgctccgccccggggcagcacagggccagcaggcgtgggtctgccgttctggccatcgccgcaccggccgcgggctccggcaggaagctcgcacgcggtcccggcacggcgtcgagaccggccgccgcgccccgatctggaggaccgacgccctnnnnnnnnnnccggtcccggcacggcgtcggggccggccaccgcgccccgatctggaggaccgacgccctgcccatccacctcgcgccgtgcgttcccgccccccccgccgggccagagcgggcagtgcgccgcaaaggcgtccagcacccccctcaggcaccgcgcggcggggccgaaccgcgcgtccccgggcaagagcttcggggaagccgccaagcgcgccagcaggcgcagcgcggcgcggtagtgcggcgcggcgcgcgcctctccgtcccaggccaggaaccagaggtagcgcgtcacccagggcagcgtggcggggaggagggccgggtccgcgcaggccgccgccagcggcgtcagcaggtccacgccgtggggcggaggcggaggcgagcggggggtgacggtggtcacggggtcgccgccgggactcgcctcggactcctcaccaggccagcacccgccctcccccgccgccccaaccgcaaacgtcatgagcgagaggaaggcggcgaggctggcggccgccacggcctgctccgcggccgccggccccgcatctcccgcgcagcccccgcgccggccgc

SEQ ID NO: 42016 - DNA, 1129 bp, Chlorella protothecoides
  modified_base (125)..(134): a, c, t, g, unknown or other
  modified_base (818)..(827): a, c, t, g, unknown or other
ggggggggcggcgggggaatgcgcaccggccgagcaccgggtgtgcggcgtgtcgtgcggaaggggcgtccatgctgcccagggggtcatccacggcgtgtgttgggacgggggagcggcctcgnnnnnnnnnngcaccaagtgtgcaccgtgtcgtggggaaggggcggccatgctgcccagggggcatccatggcgtgtgttgggacgggggagcggcctcggtgtgtgaaggaatggcatggcgacgcaaggcgatggatctggcgagaggcctgcctctcagagccctaccgtgtgagggaacccctgaccctgacccctgatccacgcgggctgcggccgctgagcgtgcgtgcccctcccctccttctccctacagcgggacgtcgcgtcccacagggcacgtatcgtccagcagaagcagcggctggatgagctgcaggccgccaaggacgctgccgacgcggggctggccaggctcgaggtgcggggacgacctggctgctgccgttcgggaatctggtgcaccattccgcgcccctgcacggtcactttccacccgccactccgctgcccttgatccaggcggcgcatgcggctgagatggaagctgtgcggaagcagcacggcgaccaggagcgggcgtggaaggtgagaggacaggggctcggggccgaggcaggggcagcatgtgatgcatgtcgtggacaccaggctcagggtgtttgggagcgctgctgtccatcttgtaccccccttccgccgtgctcctgtctgcgcacgacgagctgcaagggcaggcgtgccaccgcatnnnnnnnnnngttgtaccccccttccgccgtgcccctgtctgcgcatgtcgagctgcaagggcaggcgtgccaccgcatgggccccagcccctcactgatccccacaaccctccttccaaggacccgccacccgccccgtctccccctgcaggagcgcgaacaggacctgaccctgttcatgcagctggtgcgggactacgacgccggccccgaccaggccctgtgcggggagcacgcccggtcggccgcgctgaggtccgacctggggcgggcgacggcggagctggcggcggcgcggggcgccgaccccg

SEQ ID NO: 42017 - DNA, 61 bp, Chlorella protothecoides
ggagtgggcgcccgtgaatggcggggggggggagaggatggccagccaagcattcgcaaca

SEQ ID NO: 42018 - DNA, 120 bp, Chlorella protothecoides
ttgcgcagactctgctcggcggcacgaagcgccggggaggcggcatccatcgcagggaccgtgcggaccgtggcggggccggccagcggatcggggccgaaccccgccatgctggccacc

SEQ ID NO: 42019 - DNA, 73 bp, Chlorella protothecoides
ctcaggtgcgtgatgtacgatgattctggggcggggggaccaggcccagggggagccaggatgagaggaggcc

SEQ ID NO: 42020 - DNA, 61 bp, Chlorella protothecoides
caatgtgtgagtgcgcatggcggcagcgggggcatgctgcgggatgcattcagcacggctg

SEQ ID NO: 42021 - DNA, 13965 bp, Chlorella protothecoides
  modified_base (513)..(522): a, c, t, g, unknown or other
  modified_base (1882)..(1891): a, c, t, g, unknown or other
  modified_base (2247)..(2256): a, c, t, g, unknown or other
  modified_base (3907)..(3916): a, c, t, g, unknown or other
  modified_base (5055)..(5064): a, c, t, g, unknown or other
  modified_base (5374)..(5383): a, c, t, g, unknown or other
  modified_base (5650)..(5659): a, c, t, g, unknown or other
  modified_base (8407)..(8416): a, c, t, g, unknown or other
  modified_base (8488)..(8710): a, c, t, g, unknown or other
  modified_base (9037)..(9065): a, c, t, g, unknown or other
  modified_base (9160)..(9169): a, c, t, g, unknown or other
  modified_base (10648)..(10657): a, c, t, g, unknown or other
  modified_base (11988)..(11997): a, c, t, g, unknown or other
  modified_base (12086)..(12095): a, c, t, g, unknown or other
  modified_base (12829)..(12838): a, c, t, g, unknown or other
  modified_base (12913)..(12922): a, c, t, g, unknown or other
gcggccgccgccgcgcgcgggcgccgcgccgaccgaccagcgcacctggtcgccgtggtagcgggtgtagtcgccctggacccccaggctggtcacgttcaggagcaggccgcaccagggcaggaaggcggcgccgcagcgactgcgcaccagtcgctcgccgccgccccagctggtccgcgtcttcagcgagttcaccgcgatgccgaggtccgggaagccgacggccagacgctccacgaaggcctcggccaccgcgccctcgctgctgagcagcaggaagtcgtccatctggcgcaggagcaggagcagggggcgctctggcggggccggggtggtggggtcgcggttgccagggggtggcaggggggcagggggggtgttgtccccggggcgccgcgcaggcacgggagtccctctgtcggtgcacgaacctggtacagaggttgcctcgccttgacaccctgccacccccaaccccaccggcaccgcctctcccagccgcgacccgannnnnnnnnnggccaggggggaagggggggtgttgtccctggggcgccgcgcaagcacgggagtccctctgttggtgcacgaacctgatacagaggttgcctcgccttgacaccctgacacccccacccccgccggcaccgcctctcccagccgcgacccgatggaggcctctgcagcctgggaagcaggccctccctcgcagcgggccgcccgcgccagcagggtgagtcgccccctggccgccgccgcctcctccagcgcggcggcctcggcgtgggccaggtacatgcagcagaggagggtggaaagcgtggagccctggggcacgccccgtgcctgcgcgtgccagcgccggcgcagcctgaccaggttgcattgcaggtgctggctcagcagggccagcacgctttggcgcgtgacggtgcccacaacaccgccggtctgcacgccgcgccccgcaccgaggccgctccagagcacgtgggtgtgcccggcgccggggccggggccggggccggtggggtcgtctgccggcagagcgcagcggcgcgagcggacggtcaggctgccgccggcgcgcggcgtgatctcggtgtactgcaccatggagtagcgctgggaggtgagcaggcccgcgacgaggcggaccaccgcctcggcattcatgttgtcaaaggcgcgggagacgtccatggtggccaggaaggcgcggggcaccggctctgccgcggccagcgcgccggcctgtactcgtgccgcccgccagcgtcgaaggacaggctgcaggcggcagtaggtgtcgttcatgccgaacaccgagccccccagcacccagggctgccgcacgatctcacatcgcaggacctggacagaattgtgatggcggagtgtttcatggagggggctggacgggtggaggtgtttgcgcagggtgcttggaccgtgattcccctctctatccttccagacaccacgcgacgtcccctccctcaacctccctcccatcaagaactcacctggaagacgtcctgcagcgtctcgttcacagatcggaacttgagcacgacccggccacgcctgtccctgtgagcccccgctcgcggcggcacgctgaagcccaccgtggagggcttgcctaggttggtgatgacacgtacacctgcatcgcgacatttgacagagggagagaaggtcgtacaatcggcccggtggaagaaatcatccttgctggagttgtcaccatgcaatcgctcatcctaacattgctgctatgcctcaccccgagccccaaaaaccgccatgcctggcctccaaggagtgcgttccaaataccatcggctccacaccagccccaagcagaggagaaagnnnnnnnnnngtgcctcaccccgagcccccaaaaccgcaatgcctggcctccaaggagagcgttccaaacaccatcgactccacaccagccccaagcagaggagaaagccacacgcctcgtacccgctctcttgggcaggaagcgcagcctcgccacgcccagggaccgcagccgcagctgctccagggcatgcaggcgtggtaccacccggtactgcgaccgcaccaggtcgtccagcgtcgtgcgacgcagcctcacccacaccggtttcctggccggccggggagggggccggggggtggagaccggtgtcggacatctatctgcgtcgtgtttgctcctcttggcctgggctgcctgacatnnnnnnnnnngagggggcggggggtggagtgcggtgtcggacatctatctgcgtcgtgattgctcctcttggcctgggctgcctgacatgcactccccccccgctgcaccttcccttcaacccctgcgcacccaaaccccctctctcctcccacctgaagtagaagacgtggaggcgcgcgccgtcgccctccgtggcgtagaagtggcagcgcaggagcgggatgacgagctgcgtgaacagccaggcaatccagttcaccaggcgccgcctggccgcccacgctgcgctggcgggccggcaggcccccagccaggggaagtcggagaccttgacgccctgcagcgctgcatgcaggctcatgccctcgtatcggcgcaggcccacgaaacgccgcaccgcggagcgcagcgcgcgcagcgtgcggccgcggcccagcatctgggccggcacgatgcggcgcaggcaggcccagaggaatgcagccacccgggcgtgggagacgcaggcgtcagcggtggacaggcgggccggcgcggcgggcgggggggcgggcagcaccgtctcgcgcacgccgtggggcgtgcgcagctgcgcggcagctgccgtgcgcgcctttgcgccgctcggcgttcgcagcgtgaggtccagcccgggggagggcagcgggacgaactgggtcggcgggggcggcgggggcgcctccggcgtgggcgccactgccgggctctgagcaccgctgcaaggaccctcgtggggcgagacggggaggccagtccccagcctgggcctctttgggggcccgggtgtctcgtggggggacgtcaggagcggcggggggggccgcgcgcggcgcccctcccggcaggctgctgtgctcgcctgggtggaaagcagggagcgggggttgccgccgcgcagccccgcgttgcgagaggcctcgcccagggcggcgtgcacggcgtccatggcctgctccaggcgcgctgtgcacgctgcgcgcaccgaagtagggccaggcgcggtggggggtggggcgcacagggcggcgggcagggggcagatggattccagcaaagcgccgaaggggcacctggatgcccgcactgcgatgggaagagggtagggcgttggggggcagtttggcttgcagggccaagaggggcttggcgagtacgtttggtatgtctacaacggccagagcatctgcccacttcagcggcagggcgattcatactcatctgggtagcaacatggtagcagtgcacaggtcctcctggccctccccaaacccccaatgcccctcaggtcatacctgcaagtcgcgccagcaatttctcgatggtggcctgggcttgaggcactcgacccctcagcctggccgggactgcaggcggtggctgccggctgtggtagctggtgcaaggctgaccttggaaaatgatggagtacaggtggcgccctttcttgggctgcttgctcagctgcctcaggacatctgcgtggcggattggtgggggcatgatgacttgtaatcacctggttgggctcgacattggtagggatgatggcttaccggccgcagccactcgtcaccctgaactcacaaaaacacaacaaccctggacgcacgctgtgagggcagcccggcccgccccgannnnnnnnnntggattggtgggggcatgacgacttgtaatcacctgattggtgcccgacattggtagggatgaaagcttacccgccgcagccacttgtcatcctgaacccacaaaaacacaacaaccctggacgtacgctgtgagggcagcccggcccgccccgagaaggtggcgctgtagaagatgagctgtcggggcagctgcatggccgccaggcgctgtgcgggctggaagggcgatgcacgggcttgctgcgcatgctgtggccgggagcctgcgaagccaagctgagggccgcagggaccctcgggcccttcctggcactcggccgggaggacctcctgggtgggagggacgtcaaacgagccggtcgacgctgcagctgccctgcgaatggcctcccttcttcgtctccagctggatggtcgcctggacggggcggccggtctcctgccgcaaacctgctctatcccagtgggtcccagcaggtaggtggtactgtcctgggaggcagccatcgtctgttggggcgccgatgcttgttgaggcgctggtgcttgttggggcgctgctgcttgttgaggcgctgctgcctgacacggcgctgtcgcctggccggtgccaagtgggtgctcaaactgctgacctggctccagctttgcgctggcgggtgcgcccggcgcccttgcggcctcgggcctccggccaaacacgctggccctggcaattcgtgccataggggggcccgtcagctgcaccaccgtgccgttgggcacccggctccacatgctgcagtgcagcaggaggtagagcatcagggtgtccccgatgcgactaagcagcagccgccagggctccgaggccaggccgaggccgagactgcccaggctggcccggccaggggcctccgccttggctccggcgcagagcacgttggcgcgggtgttgggcgagagcagcagccggcccaccgccagacgcaccacctgccccacgtgggtcgtcgagatcgaggctgggtaaggcgagggccatatggcaaatgggctgccaagggagcagatgagcacatcgcaaggggctgtcattgtatcaagtctgtaatactaggggcaacacgacaggcacaatgctgcacataggatgcnnnnnnnnnngagggagcagatgagcacatcgcaagggactgtcattgtatcaagtctgtaataccaggggcaaaacgacaggcacaatgctgcacataggatgccatccttactaacggtatgctattccgagcactcatctccctggttgactgttttcgtacctgttcctggctcgagaactgcgccaagccaaagtcgggcccaaggtccggagcacccggacccaccaagcaccatgttgaggacagcagaccacgtacgtattcatttggatcataagccttcgcaagggtatcgcaaagggaattggcctggnnnnnnnnnncgaggaaagcagaccacgtacatattcatttggatcacaaggcctagcaagggtatcgcaaagggaattggcctggggcgaggcttgcgagagccggatcaggaggtcccggagtgtgagcagcggctggttggggtacaatcgcagcaacaagctcggtgccctggggcacccctgcagactgctatcacgttccatgtgtatatcatcttttcatcccagtgaattgattggacatctgctctcaagggtgttgatatgcatttnnnnnnnnnntacgttccatgtgtatctcatcttttcagctcagtaaattgattggagatctgctctcaagggtgttgatatgcatttcgagtgcgacctcagatcacttaatttttgcgcgcgcgatttccgatcccgtctacagtgtacggtcgtcccaatgaatgaaaggtcacggcattgtggcccgctgaaggaacacgcatctacatgggtgtcgatacagagcatatcaagacttgatttctctgctgcctacgaggggaggcggccaaacacccccggccggttgccatggtcttctacttccagccgcggggatacggccctggcaaggatgactacctcatctacatggtgatctagctgcgtgattggagtctcagtcaatgctgctggtatcagggtgcatggtactcaagcattccctgactacacgggtcgatgtccgcatgcatgccatcctactccggtctacccctccccattcacccagggcgccgacaaattcgagaacgagcacctgatcaggcactctctccccatggacgtttggtttcacgtggacagcctgtcttctgcccacgtgtacctgcgcctccccgagggtgtggccatccaggacattccccccgacaccctggaggactgcctgcaactggtgaaggccaactccattcaggggaacaagcagaacaatctgcatgtggtgtacacccccgccagcaacctgaggaagacggcaggcatggacgttgggcaggtgggcttccaccaccagagtgcggtgatccgggtgcccatcctgaagcgtattaacgagatcgtcaaccgtttgaaccgcaccaaggaggagcggcacgtagacctcgaagctgaacgggccgcgtatgaccgagaacagaggggaaaggaaaaggcgcgactacaggtatggatgcgtttctgtgaagcctaagcaagggacgggcattgatgtggaagggatgttctgagatgctgcccaaggcttctgcattgggcagcgtctctgcatgatcctcctccttgcctgaccaggcaatgcgctgtacggtagctgtatgcagcatgcccgctcaggctgtcaatctcgccacctggttgccctgctcaggaggaggagagcagagaaaaggcgctgaagaagcagcagcaggaggaaaaggcgcggagatcctacgacgccatcatgcttgaggaaaacatgaagaccagcaaggatatggcccagacatatgagaatgttgaagactatgaggtgaggatggtcgagtggtcatgccggtaggggaacaggagacgcctctcaagcctgcagcgagctgcttgcttgtctgcgacaccccagctggaccagcccaagatgagcccctgcactcacccacatcccaccccgccccactccgcttgccacaggacaacttcatgtagaccacagcttgtgcttcagtggtctctcatcatgggacccatttgcttccctgcttccccctgtcctgtttactccctgggtgccatggcctgttgccacacctgactgcccaccttgcagtgtcaagcacacatcacaccatgcgagcaggtgggggcgggaaacccatgccaccaggaggtggtggaggaaaccccctgaacccaactggcgggggccggggagggaagaagccaggcatgccccccatgggcggtctgggggggaagggtggaaggtgcccgtatggctggggcgcctgctgctgctgcggcggctgctgctgcacctgtcccgaggcatgctggggcttgaatggcacctggaagctgtagatcttggagtcggggtccctgcatgccatgggagaggtggagtggtgctcaggtttgaaggacaacggtgcatggcaaagacaaggagcagacatgtgtgtcgggcaatggaacaactataaagtgctcccggcagcggatggccagctgatcctgcaccaaccatttcaagatcgttcctcgtaccagtgactgaacaggcggtcggtctggtgtcggtccacctccagggtcggcaccttgaaggcaatgacctcgtaaggctctgccgcaaagagtaggtactggtaatgcttgtcccaaggctctttccgctgctcatatgaagacatgaagcggtggcgaggcttgaacccctcctcgatctccgggtactcaatctgcggcgtgtagcaggcaatgtgatataggtgtggactgggagatgatagcgctgggcatgcactcactgaacgcggttgcaggaagccctgctcgtggtagcgaggaatgcaactgtatccactgcgccctccaatgacacaatccctgcccaagcgctctaaggggcactcatcagatctccctcaaggcctgggccctaagacttccttgcacctgaaacaaaagggcccgggcacccagctctgggtcaaactccttggtcacacgatagccaggcctgccaatcttcactgttttccgaatcgcgactcggcgctggggggcaggggcaatctcttgctccgcggcttcccttgcagcacgcttggccagattctgctgatgacgcttgccttgcgtgtgagccaggtagtttccctcgttggtgtggagggtgtggcacagccgacactcgatctgcagaagggtgggcaccaggctcggaggcaggagcgtcagggccatgcacaacttctcatttgaccctccagccccaacaacttcctnnnnnnnnnntcctaagacatccttgcacctgaaacaaaagggcccgggcccccagctctgggtcaaactccttggtcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgggcttggaggcaggcgtcagggccatgcacaacttcacatttgaccctccagccccaacaacttcctgagccgcatgctcatctagtgcagttatgcaccggctcgtacagcacgtcaacctcacctggcctagatgattgcggaagtagtaagggtccttggcaaggtctatcgtctcaagtgctagccgacggagacgctccctccgatccacagcctggtcagaacgaaacaagcagaatgatgacttgagggtccataacctaccgggaaggagggcggtggcgacgtgcatgttccagtgagtgcaatcacctctcannnnnnnnnnnnnnnnnnnnnnnnnnnnncagacaaaccatcgtgcaccggtggcgcacctcctagcagcaggccagccgatacgtaaaatcatgcagcaatcagaggctgtgggaccattacnnnnnnnnnngcctgttggcacgggacagctccaattcggtagaacgagcaacactctgcgtcggatggtatcacgctagcgatatcccaaaggaatttctgcaaggactaagctttctaatggctggcgtgcatccgagggttcatgagttttcgagagggagacctggggatctgaactgagagagacaaaccatcgtgcaccgggtggcgcgcctcccagcagcagacaagccgatacgtaaaatcctgcagcaatcagaggctgtgggaccattacgactgattccgcatttagaaacgcgttcatatagtcttcgtcattccaattgcatccctcgggtaactatcgccggcccacgcaaccagtgcacggcgtcgctggggagacatccaaccttcactcccacaccacatccagcttcaccgatcatcatcgattgaatcatgagtgtgctgcagaagatcaaggatatcgaagatgagatggccaagacccagaagaacaaggccacggcggggcacctgggcatgctgaaggtgagctcaaacagtggacgactctcgttcgtgcatgacaccagcgacattcactccagcccagtaatgtgacgtgtgagctaccctcgacaggccaagctcgccaagcttcgacgagagctgctggagccttcaagtggtgctggcggcggtggcaagggcgatggctttgatgtgaacaaggttggggacgcaagagtgggcctggtggggttcccatcagtgggcaagtccacgctgttgaacaagcttacaggcacattctcggaggtgagagagactgactgagtccagttgcattgggtggtggcggtggggtgcccagggcaggggatggtgatgcagagatgggcgaggtgttggtgtgaagggtgtaggataatccgaatgttaccagaaggagaagaagagcgggtcgcacgaccgactgatgttgtcagaggcaacctcttgctcatctcctgctcgtagatggtctcggcatgacttcccagccttcctgtgcctccaaacactgcaggtggcttcctatgagttcaccacgctgacctgtgtgcccggggtgataaggtatcgtggggccaagatccagctgctggatctgccagggatcattgagggggccaaggatggcaagggacgtggcaggcaggtcatcgccacggcccgcacctgcaacctcatcctgatcgtgctagactgcctgaagcccatcactcataagaagctcatcgagcacgaactagaaggtaggcgtcgcgacagcttccatcaagggaaacagctggcagggatccttgggatgggtacgccacccgtcccacaatccttgcacaactgcatctgtgcaatgtgggacactgcgaggcatggtcggatgctcgccagctatatccctcaggtgcctgggccctcacgcttctatccaggctttgggctgcgcctgaannnnnnnnnngactgcatctgtgcaatgtgggactctgcgaggcatggtcggatgctagccagctataaccctcaggtgcctgggccctcacccttctatccaggctttgggctgcgcctgaacaaaaagccgccggagattaccttcaagaagaaggacaagggtggcattgccttcacatcgaccctcgccaacccaactcttgatcttgacggtgaggcgcgggcttgaaagcttatgtgggtgctgagcaggtcggcgggcgacaggtcactggtgcaaggggcctggcaagatatgctcccatgccgtgtggccctgcgaccctctggttgccccgtttgcacccccctgcagctgtcaaggcggtgctggcagagtaccgcatccacaacgccgacgtccacctcaagggcgactacgatgtggatgacctagtggatgtgatcgagggcaaccgaatatacgtgccctgcatttacgtcatcaacaagatcgatcaggtttgccggattgggggggatgggttgatgcctggtgggtcaccgcccgagtctgttcccaggtctggaatatcaatagtctcccgcgtatctccctcccagatcaccctggaggagctcaatgtcctggatcgactgccccactactgcccggtgtgcgcctaccacgagtggaatctggacggcctggttgagatgatctgggagtacctggacctcctccgaatttacaccaagcccaaggtgtgctgggggagggttgggcgtggtgtgtagggatggcagcgcaaccaggtttgatgtggggatgaggcagatccaaccaggcgtcgtgagagaccggtggggatggtctcagcgcagtaagaggctggcaggaaggacgtctggccagtggatggcttgtggggcctgcccagtggaggcattgggcgtcctccatgctgccactgttctgttcctttggttccgccggtgttcggtcccccatatgatcgaagcctgtgcccacaccctcatctaccgtgacacagggcaagcttccggactacaacgaccccgtcattctcccagcggcgcacagtagtgtggaacacttctgcaaccgcctgcacaaggccatcatcaagcagttcaagtattccctggtctggggctccagcgtcaagcaccggccgcagaaggtggggaaggagcacattctgcaggacgaggacattgtccagattgtgaaacgcgtgtaagcagcatgagcgaggcctccttgggggtggggctatcagcaacgtgttggtgtctggcgcaagtggcagaggactgtttcaccgaacacagtgnnnnnnnnnntctccatgccgcaactattctgttcccttggttccgccagtgttcggtcctccatataatcgaagcctgtgcccacaccctcatctacnnnnnnnnnncaaagcggctcgtaaaatgggatcaagcatgattcatgttcaaatctagtgcttgaacgattcaatgatagcgcgaatgtgctggcatgctccacagagccttccagttcccattgctatacaagcgagatcagctcgagaaagggaagggcagcaactgctagacccggggaccagaccacagactcctgttcgcgccgggaaaagggcgccaacacaaaggcgccaagctcgggtttgatcgtgtaagacacagacgagatcggaagacgtaaaaaggaaggccagcctcgagcgtgcagggccccgtcgaaacccttcccgccccttgccagggcccagggacggaatctgggtgctatgcaggccagcctgccctgcgaaccaggcccggaattccagtgaccccacgggactaacaacaggggtttggacacctcgccgcacccctccccacccacaacaaggcaccctcgaccaccccattccaccgcggcctttccccccttgactgttgggcgtggagatggaggaagctccccagttgcaggagccggggccagcccaaggtcccccactgaaggggcccaagatgaagaaggcgctgcgtgcgtccatcgagggcggtgggtctccggtgagtcatacacgaccttcgtgctggaggggtgttttgcgaggtagccatgctgccgtggcccatcgcgtcctcctgtctgcgtctcgtcaggacnnnnnnnnnntggttgtccgagcagcgccgccacaccccatccgtgactggccaggaccctccttcatgcccacatctcaccccnnnnnnnnnnattttgcggggtagccatgctgccatggcccaccgcgtcctcctgtctgcgtctcgtcaggacaggccaccccaggctggatgcaggggcaggctcaagtgttttgtggttgcctgcatgacactatcgcatgtggcggccacccccagcagtccttcgtagatgaccggttgtcctagcagcgccgccacaccccatccgtgaccggccgggaccctccttcatgcccacatctcacccctgtcgcactccccttgaccctgtcatactcgtttcaaccctgacgcactcaatcccagcccctgatgcactaacacctcaccaccctgacatactcgtcccccctacctccccccaaccctccccaggctcctgccgccccccgcccggagcgtcccgagggttacagccgcaaggccaagtcgctgtcgctcctgtgcgagaacttcatctcccgcttcggcatccccggcaccgtcattagcctggacggcagcgcgcggtcgctgggcgtggagcgacgccgcatctatgacatcgtgaacgtgctggagtctgtcaaggtcgtggaaaaggtgcagaagaaccagtatgcgtggcacgggctggaacgcctggcgacgtcgctggccgagctgcgcgcccaggcggaggcagagctggcggaggtgggcgccggtggcgacgactcgctgacggggctggacgagcgcaaggagaagtccatgacgcgcctgtcccagcgcttcgtccagatgttcatgctgtccaagaccaagtcgctggggctggacgaggcggcacgcgcgctgctgggcggctccgaggacgcggggcacttcaagaccaaggtgcgccgcctgtacgacatcgccaacatcctctccgccctgcacctgatcgagaaggcacacgtgggcgagaaggggcgccccggcttccagtggctgggccccgaggcggtcatcgccgcgcagcgcagcttcgccgcggcgctggccgccggcgacgcgccagcgcacgccgcggcggaggccggcgac

SEQ ID NO: 42022 - DNA, 69 bp, Chlorella protothecoides
agacatgatgtcacgcccacccacactcacacacacacaccccgtcccctttgcggcaccatcccgcga

SEQ ID NO: 42023 - DNA, 61 bp, Chlorella protothecoides
atggaggggtggggtgggaggcgtggcaggggatcaagcgacaaataggcaggcaaagaac

SEQ ID NO: 42024 - DNA, 78 bp, Chlorella protothecoides
agcggcggaggcaagcacccttgaggaaaggtatggggtagggggtgtctcttaaagaggggggccccccccttgatc

SEQ ID NO: 42025 - DNA, 61 bp, Chlorella protothecoides
gggtcagaacggcacagcacttggcacaggcgtgtgttgatgtataatgcatagtattacc

SEQ ID NO: 42026 - DNA, 61 bp, Chlorella protothecoides
cgccgtggatgacgcgctggcctccctgcttgaccacccggaccccgtgctccaggcgagg

SEQ ID NO: 42027 - DNA, 76 bp, Chlorella protothecoides
cgcgatctcggggccgatgcctgtgttgggtggggggcggggttttacaaaggatcctagccacagtcgcaactca

SEQ ID NO: 42028 - DNA, 61 bp, Chlorella protothecoides
tgtccacgcctgccgtgcacgacaggctggggcaccgcatcagggcttgcacgatgctcag

SEQ ID NO: 42029 - DNA, 79 bp, Chlorella protothecoides
gcgagctggcatcgacgcggggtcggcgatccaagggagcggtgcaggaccaagaccccttcccatcctccaccagccc

SEQ ID NO: 42030 - DNA, 66 bp, Chlorella protothecoides
tggctgcagcacccctcggggcgacagggggcagcctcacactgtcagcagcagcagtcgcaccac

SEQ ID NO: 42031 - DNA, 68 bp, Chlorella protothecoides
gtacgccaggacctgtggagaaagggggaatggggggttgatgctggtggggaagggtgggcaggcag

SEQ ID NO: 42032 - DNA, 76 bp, Chlorella protothecoides
cagggcatgccccgagtggaaaactgggatcgtgccccggcatcttctccgacgacgagggaacgtgcgccagcgc

SEQ ID NO: 42033 - DNA, 100 bp, Chlorella protothecoides
cggacacggtcacgtagcgcccgctggcggtgcaggcgacggccacggtgcccgcgcccagcaccaggctcgaggcgcaggtggtggcgtcggagccgtc

SEQ ID NO: 42034 - DNA, 108 bp, Chlorella protothecoides
agtagcacacctgctggcatgggggcagcggttgactggtcaaatccatgcactccatgaccttgacccaagtccaaaccatccacgcctccctccctgcaggcacaa

SEQ ID NO: 42035 - DNA, 61 bp, Chlorella protothecoides
agctccttgatgtgcaccgccagctcgcggggctcccgtgcgtagtcagacacggtccccg

SEQ ID NO: 42036 - DNA, 61 bp, Chlorella protothecoides
gatgtgcccccggcgacgctcgactggcggcgacatgctgcaggcctccagcacacccaca

SEQ ID NO: 42037 - DNA, 76 bp, Chlorella protothecoides
ccagcgccgcgtggaggcgggggagggcgaggaggtgctggtcgacgaggcctctgcggctgcaaagccagcggat

SEQ ID NO: 42038 - DNA, 61 bp, Chlorella protothecoides
ggccagctgccacgccgtgcgtggctgggggccacccccgtgcaaagcccagccgggcggg

SEQ ID NO: 42039 - DNA, 61 bp, Chlorella protothecoides
cccgcagcatcacccactacggcggctccccggacggcatggatcccagttctccgtcctt

SEQ ID NO: 42040 - DNA, 63 bp, Chlorella protothecoides
cccccccccccccccccccccccccaaccacaccacacacctccaggcggcggcggtggcgct

SEQ ID NO: 42041 - DNA, 61 bp, Chlorella protothecoides
acgggtatgccttggagtgggggatgagagtggggagtgacatggatgctctccagatgag

SEQ ID NO: 42042 - DNA, 71 bp, Chlorella protothecoides
acgcatgcttggggacactccagtggcccccggagcccccactccaaagtggcacaccaagtcctcacaca

SEQ ID NO: 42043 - DNA, 61 bp, Chlorella protothecoides
tctccctgctacaaggggatcagtgggaggggatgctcatggatgcggccgtggggatggg

SEQ ID NO: 42044 - DNA, 89 bp, Chlorella protothecoides
actggggcggcgccagagcgggcagagccgtgtgctgggctccagcctgaaggtgggtggtgggagtggggaaatgatgggctgggaac

SEQ ID NO: 42045 - DNA, 64 bp, Chlorella protothecoides
tacctttcccctgaccattgatccctgccccccccccccccccttgtctcaggctgcctctcaa

SEQ ID NO: 42046 - DNA, 61 bp, Chlorella protothecoides
cgcctatttgggggggaaagtgggggggggggatgggacttacagcgtgcagagtgcggcg

SEQ ID NO: 42047 - DNA, 108 bp, Chlorella protothecoides
tgaagtgtcttgcataccatggagatcaaggttgggcgctggctgggatcgacctggaggtacgtgcgcttcgaggagcgacgtgctcaggcaatggttgctcagacc

SEQ ID NO: 42048 - DNA, 78 bp, Chlorella protothecoides
ccgcgcccgccgcgcttgaacctggaggggcggtcgatgggtgttcgaggttcccggtgcgcgcgaggggttacaatg

SEQ ID NO: 42049 - DNA, 144 bp, Chlorella protothecoides
ccgacaggtaggtgtgcagcgcttgatgcgatgtgggatgcggcagcaaagcgcacgtgtcacacgcataaaccaatcatcaccaccctcgttctcaggcgagcgaggcgctcggtctcttcaccaggcttcaagccctgtcgc

SEQ ID NO: 42050 - DNA, 86 bp, Chlorella protothecoides
cgtggtcatggtggtgggcggctgcgtggagggcgtgccccccgccgccaacgtggcgggggacctgctggccacgctgggcgacg

SEQ ID NO: 42051 - DNA, 63 bp, Chlorella protothecoides
aggaggagggcgaggacgagagggaggaggagcgcgaggacgagagggaggagggtggggctg

SEQ ID NO: 42052 - DNA, 61 bp, Chlorella protothecoides
ccatgccaaacccgattgcagagtggctgggggggagattcgatgtcggtcgctacttcca

SEQ ID NO: 42053 - DNA, 61 bp, Chlorella protothecoides
ccctggagctggcaaggtcggagagcctccacagatcggcgcggggggtggtccctccagc

SEQ ID NO: 42054 - DNA, 181 bp, Chlorella protothecoides
gagcacagtgcagtggcagaggtcgaccaaaacctggcgatcggccagggggagagggtgggtgggagtgccctgggtactgtcaggtgggcgacggtgccggaattgtcagaggtacccatgggggaaacaagcacccccttcgatagggaccacgctcgcttgctcgtgacgctccagg

SEQ ID NO: 42055 - DNA, 7807 bp, Chlorella protothecoides
  modified_base (144)..(153): a, c, t, g, unknown or other
  modified_base (241)..(250): a, c, t, g, unknown or other
  modified_base (2435)..(2444): a, c, t, g, unknown or other
  modified_base (4913)..(4922): a, c, t, g, unknown or other
  modified_base (5254)..(5263): a, c, t, g, unknown or other
  modified_base (6738)..(6747): a, c, t, g, unknown or other
  modified_base (7219)..(7228): a, c, t, g, unknown or other
cggcctccagcgcggcggccacgcccggccgccgccggtcctggaggaaagcgcggaggtggcgggccgggccctccagcaccgcggccgccgacacggttcgccgccgcggccgcggcagccgcactgggctgcggaagtccnnnnnnnnnngggtcggcggccgcgccgggggtgcactcggcgaagccgtggtccgcaccggcgccggttcccgaccccgctccagcgccctcccccnnnnnnnnnntcgcaggccgcgccgggggtgcaattggcgatgccgtggtccgcaccggcgtcagttcccgaccccgctccagcgccctcccccccgctgacgccgcggcccaccccgccgtcgccggaccgcgtgcggggggtcacgacacgcacgctcccgcactcctccccccaggagatgtgatgccccgcatccgggtcgggtcccggctgcagtgccagctcgcgccggtacttggcgcgcagcacgcccagcgcgctgtgccggatggtgcgaaaggcgatggctgcggtgtcgatcaggcggctgccatccagggacatgggggccagggcctgcagcatcatgtaggcgtcgctggactcccgcgtcgcacagatggccttttgttaattgggaggaggggtcgaaaggggagcgcgggtggttgggttggggttgcagggggcgtgtgggtgagaagggcgcacacatcgcagtgctggctgccgccaagaaccatgctcgaagcgtgtcatgcatttggcggggtttggggggcgccagcgagggggttaacaggctttcctccggcccccagcatcataccgccccccctacctggttgtagatgtccacaagggcgagggcggtgcggaagaggactacggggctaccctccaggaagagcaggtcccagacgcggaggcatgtctccaggggcagggagttgacgaagatgcagaggaaccagtgcagcgtgaccgagcccaggtccacctccagcgcatccaggtggcgcgcggtggccgggtgcgcaccctgcaccaggtgcgccaggatgcgcgcgtccagcgcgggcacctccatggccgcgtcgaagtagcccgggagcacgcgctcgaccacggcggccaggcaccagaaggccccctcctccggcaggaagaggaggaaggcagcggccacgaagttgaggccctggcagtagcccaccgccgggttgcgcgccgcgtaggccgccagcacgcggcgcagcgagcgccggccgccggcatccattgccgcgtggcccgggaaggtgcggtgcaggtccttgtccacctgggccagccactcgccgtggtcgggggacaggcccgcggaggcggtgccggaggccgaggagggcggggagggggcgggggcgccgggtgcgtagctcgactcctcagccgcgcccaggtcgggagcggcggctgctcgcgcctcgtcgccggcgggcgaggggccgggctgctccggagatggctcagcgattccactgcccattgctccgcccatcgcgccacttgtcgaccctccctctgcagcatccgccgcatcgccccggaggacgccgtaggccctccccggccaggcgccgtcgtcgggggacagcgctggggcgtcggccagggcccgggcgacgagggcggcgtactcccccggccgccgcagctcccgtgtacgcaggaggcagggccagagcagcgcgcgggcgtggcgggggatgccggcctgcaccagggtgcccaggcgcaggcccgggatggacgtgctggggtagtcggagggcgaatcctgctgctcctgccaggagtccagggcctcgaggaggaggtcttcgtcgctggcgacgggcctgccgcaccgaagaggacagagattggggtgggtcggtgaagtttgctggagaaatctcaggagtcccaggggcgggctccggcagtagcatcagctatgaaagatctggctggtcacaaaccgagatgcacagccatgctccccgtttcagggcctgcaacacataatcttactgtgcaatgcacaacaagtatccacctacctggagctctgttgcctgaggtctgcgaggaaggccgcccatcgagcagtccgctcctcctcctcctccgcccatgagggttcaaactggtcgtacagctccgcaaactcctcgcgtatctgcaaggggtggtcattcgatctgaagatacaaattgcatgataacatgccctgccctgcgcattgactctgccaccgcacctcgaacccgtaggcgtcgaggcgcttgactggcctgtgctcgggggtggcgggttgccactcccctgcatactccagggaatccatgcccctgctggctcctaccctctgcccatgtgtgttcgagtggggtagtcgaggtcnnnnnnnnnntccctgctggctcctaccctctgcacatgtgtgttcgagtggggtagtcgaggtctcacagaagggatgaatccgccactgtggggcccgcacaagtcagctgaccgagtcggatttgaggggtgggccctgctttccatcgcgccctccctcaccattggaatctcaggcctcccgtcctgaaacagagggcccctacttctgaacaccctccagcacttttggacggggtcccgataattagaacactctcgctcggctttggtcagaggtgattcccggatttgccatctctcctgccccaggtccgagtgagggagggcagaatggcagacgacacggcctctgggtcggtggatcccagcaaggagggagtggcgccggaggaagacttcaatgaggcagacatggatgcggagctgacggaggatgaggccacccaggacggaccgatctatgacacggacgccgaggaggtggtgagtgggtgcggggggcaccgctcacccagcccctgcgcagtgctgcttccgcatggaaccatctgcctggattcggtcacgaatccagatcgtgcccgccgcctcgtgtgaccgtgcccgggctttcattcgaactttcaaactcgatcgcgcaggccctgccttcggaggccgcccagcttattgccaagaaggagcgggagcgtctgaagctgcaagataagctcaggcgcgaacagctggagcgcgtgcgggaggagcagaaccaggacgccgctgccggagatgtgcgtggattagctttttgggtgggggaagggtgggagggggtgtggcagctcacagagggtttctactggcctgcagcagtcgcttgccatgcctgcatgccgccgtagtgagggtgggtcaggcaatgcagcctgccactccgactgctgagctgccggccagattgtcgcccccatcgactcccatgcgacttactcccacttcctgccctctccctcctctccaggctgcacgcgggcgcaagcgcctggacttcctgctgcgccaggccgaggtgttccagcactttgcccccgcggcggcggcgggggcgtcggccaccaaagcccgcaagaagaaggggcggcacggcgcggcgctgaccgaggagatggaggacgaggagctgctgcgcgacgaggagagcgcggagcccggcgcggtggggcaccgcctccaggtccagcccagcgtgatcacgggcggcacgatgcgcgagtaccagctgcagggcctgaactggctgatccacctgtacgacaacggcatcaacggcatcctggccgacgagatggggctgggcaagacgctgcagaccatctccctgctgggctacctgcgcgagttccgcggcatcaccgggccgcacatggtcatcgtgcccaagtccacgctgcacaactggctgaacgagttccggcgctggtgccccgccatcaaggccgtcaagttccatggcaaccaggagcagcgcgcggcgcagaaggaggaggcctgccagccggggcgctttgacgtggtggtcacctcctacgagatggtgattaaggagaaaaaccactggaagcgcttccactggcgctacatcatcatcgacgaggcgcaccgcatcaagaacgaaaacagcatcctgtccaaggtcgtgcgcacgctgaccaccaactaccgcatgctgatcacgggcacgccgctgcagaacaacctgcacgagctctgggcgctgctcaacttcctgctgcccgaggtcttctcctccgccgagaagtttgacgagtggttccagattggcgcggggcgcgaggcggaggcggaggtcgtccagcagctgcacaaggtgctgcgccccttcctgctgcgacgcctgaagtcggacgtggagaagagcctgccgcccaagaaggagaccatcctgaagatcgggatgagcgacatgcagcgcaagtattatgccgcgctgctgcagaaggacatggacgcggtgacgggcggcgcggaccgctcgcgcctgctcaacatcgtgatgcagctgcgcaagtgctgcaaccacccctacctgttccagggcgcggaaccggggccgccctacatcacgggcgagcacctggtggagaactcgggcaagatggtgctgctggacaagctgctgcccaagctgcagagccgcgggtcgcgcgtgctcatcttctcccagatgacgcgggtgctggacatcctggaggactactgcctgtatcgcgggtaccagtactgccgcatcgacggcaacaccagcggcgaggaccgcgagagccagatcgacgactataaccgggtgagtatgtagggaggagaagggggtaggacagggggggtagtggtagtgcgagggcttgatatgttggcgggtgagtccagtctcgaactttacaagaaggacggcagaggctggccaatgccnnnnnnnnnngatggtagtgcgagggctcgatatgttggcaggtgagtccagtctcgaactcttcaagaaggacggcagaggctggccaatgcccaagtccttgcggccctgggtcaggggtcgcgtctcccattccatgaggctcgacctcccgtcgcccgtatcctgaacccaactcctcccagcgacaatcatcccctggaccctgttcttccttcgtcgccttgcttcagacgagcacaatcaccttcatatctccaaaccactgatgatcacgcaggagggcagcgagaagttcgtgttcctgctctccacccgcgccggcggcctgggcatcaacnnnnnnnnnntacaccgccgacatcgtggtgctgtacgattcggactggaacccgcagatggacctgcaggccatggaccgcgcgcacaggatcgggcagaagaaggaggtgcaggtgttccgcttctgcgtggagaacgccattgaggagaaggtgatcgagaaggcgtacaagaagctgcgcctggacgcgctggtcatccagcaggggcggctggtggagggcaccaagggcgtgaacaaggacgacctgctccagatggtgcgctacggcgcggagatggtgttcagctccgaggcggccaacatcaccgaccaggacattgacctcatcatccagaagggcgagtccagcaccaaggagctcaacgacaagctgcaggtgggtggctggttttggggggggacagcagcccccggcatcaagtcggaacacgccatggaccccgcccgacctcaccccgagagctcccaccccccgcaccttcatccatccgcagaacttctcggacgatgccatgaagttcaccatggacggcgggctgtcggcctacgactttgctgacgaggacaaggagccggagaacacggatcagctggaccagctgaagcagctcatgggtgggtctggggcgcgcgggggggggaggcgcgccagaggtgtgaggcagtgtgggggtgaggggtctgtgtgagtacaggtgtggcgtgtcaagaagtatgccctccaccagcggctcggcgaccccatctcgacgtctggcacgacaccggatgcgctgcacggacgcagcgcacgcaccgcgcatgttccccgtacacaccgcacgagcacgccccaggctgcattcccactgcttctttaccctcgcgccgccccccccccccaccaccatccgtaccaggtgccaattgggtggaccccccggagcgcaagcgcaagcgtgtggtgtcgtacgcggagaacgagttcttccggcaggcgcagggcaaggaggcgcgcccccgcggcggcggtccccgcctgcccaagatgccggccctccaggacttccagttctttgacaccgctcgcctcaccgagctgtacgacgcggagcagtcctacgagctgcacaagcacgcactggcgcagaaggaggcggcggcgcgggcccagggcgccagcgaggaggtgatcgccaaggagatcgcgcccggcgaggacgacccgcagcccctcaccccggaggagttggcaggtgtgtgggtgactgtgtgtggtgggagtgcgtctgtggcgggagggagacatggtggggcagtgggagggtggatggaagcgaagaggctccacggggccggacactgccatgccacagcgcgtcctggcaagcaacagctatggtgagcgccggcatcgccccccccccctacgcgcagagcgggagcagctgctggaggacggtttctctaactggaaccgccgcgacttcaacgcgtttnnnnnnnnnnagggaggcatggtggggcagtgggagggtggatgcaagcgaaggggctcgacaggtccggacactgccatgccacagcgcgtcctggcaaacaaaagctatggtgagtgccggcatcatccccccctaacgcgcagagcgagagcagctgctggaggacggcttctccaactggaaccgccgcgacttcaacgcgtttgtgcgcgcctgcgaaaagtacggcaggacgcagctgtccgacattgcgcgggaggtggaagggaagaccgaagccgaggtgagccggttggtagagggagtgcttgagacaggggaagggggggaatggtgagtaggtcttctcaatggactcagggtgatggaatgagggggtgtccatgctgccgccgcccgtgcatcacagtgttcacacccgcaaacaaactctgtgctgatccgatttctaccaccagcatccgcatcgctattcctgnnnnnnnnnnaaatggtgagtaggtcttctgaatggactcagggtgatggagtgaggggtgtccatgctgccgccgcccgtgcatcatagtgttcacacctgcaaacaaactctgtgctgatccatctcctaccaccagcatccgcatcgctattcctgccctcccactccctggtcattttgccgtgaccaccatcctctcctcccaaacaatcaaaccccacgaaaaacgcaggtgcgcgagtacgcggcgaccttctggtcccgagtgggcgagctgaacgacgcggaccgcattctgaaaaacattgagcgtggggagcagcgcatccagcgccaggcggacatcatgaccgccatcgctaccaagctggagaagtaccgcaacccttggcaggaggtgcgcatcgcctacggcccggccaagggcaaggcgtacacggaggaggaggaccgcttcctggtctgcaaggtgcacgagctggggtacggcgcctgggacgagctgaaggccgagatccggggaaactggaggttcaggtttgactggttcttcaagtcgcgcacgccgcaggtggggtgattgggg

SEQ ID NO: 42056 - DNA, 106 bp, Chlorella protothecoides
ggcagactgcgttgatgtgggagggaggctatggactgtagaaggtgtattggtgggaatgggatgtggtggtggaagaatgccagctgatgcgatcagggcgatt

SEQ ID NO: 42057 - DNA, 69 bp, Chlorella protothecoides
cgccctggagctgggctggggatcggaggaggcgtcggagagtgcgcctggcggggcaaggtgcgccgc

SEQ ID NO: 42058 - DNA, 64 bp, Chlorella protothecoides
cgcgatctcgcccggcaccagcgcggcggcgggcgacgcggcggccccgggggccgcgtactgc

SEQ ID NO: 42059 - DNA, 110 bp, Chlorella protothecoides
gggaggagcatgggttgtgtgaaagggtgatgggttgtggatcccgatagaatcccggggagcaacgccaccatcagctcgacgattcgttgatgtccctgggtgctccc

SEQ ID NO: 42060 - DNA, 15759 bp, Chlorella protothecoides
  modified_base (517)..(526): a, c, t, g, unknown or other
  modified_base (732)..(741): a, c, t, g, unknown or other
  modified_base (832)..(841): a, c, t, g, unknown or other
  modified_base (1388)..(1397): a, c, t, g, unknown or other
  modified_base (1710)..(1719): a, c, t, g, unknown or other
  modified_base (3405)..(3480): a, c, t, g, unknown or other
  modified_base (4570)..(4579): a, c, t, g, unknown or other
  modified_base (5341)..(5350): a, c, t, g, unknown or other
  modified_base (5632)..(5641): a, c, t, g, unknown or other
  modified_base (6085)..(6094): a, c, t, g, unknown or other
  modified_base (7158)..(7167): a, c, t, g, unknown or other
  modified_base (7595)..(7604): a, c, t, g, unknown or other
  modified_base (7779)..(7788): a, c, t, g, unknown or other
  modified_base (8358)..(8367): a, c, t, g, unknown or other
  modified_base (8614)..(8623): a, c, t, g, unknown or other
  modified_base (8843)..(8852): a, c, t, g, unknown or other
  modified_base (9107)..(9116): a, c, t, g, unknown or other
  modified_base (9569)..(9578): a, c, t, g, unknown or other
  modified_base (9991)..(10000): a, c, t, g, unknown or other
  modified_base (11295)..(11304): a, c, t, g, unknown or other
  modified_base (12307)..(12316): a, c, t, g, unknown or other
  modified_base (12809)..(12818): a, c, t, g, unknown or other
  modified_base (13074)..(13083): a, c, t, g, unknown or other
  modified_base (13730)..(13739): a, c, t, g, unknown or other
  modified_base (14074)..(14083): a, c, t, g, unknown or other
cgggcatgctctccgccaagctgtcggacaacgacttcctgggtgccaacggcgcctgatcggctgctggagctctctgcccgctggcatggtggacgctggccgatgccggcctttttaaccgtgattctgcttgattagagaacatcttgaaacatgacgtgctgccttcctgcagaatgccctgctctttcttctcaccgggcgaatcgtgctacatgctgcgatgtggcaggggaggaaaaggaaaagtgctgaggctctaagggcaactgggaaacaggggctcacgtgcatggaatggcacaggctttagcccacgccgagggccgggcgacctggtgggtacattaaggggttgtgtgacgaacatgcgccagactggcagaaggaatacattgtgctggagaaagaattaggagggcgagcacaggaaaagggggcgttcaggctttcctcggcctcttgccggccccagccagcttctgcctgcttagagcggcaggggcccgcaggnnnnnnnnnntccggtgtgaagagagagcagggcaccctgcagcaaggcagcacgtcatgtttcaagatgttctctaatcaagcagaatcacggttagaaaggccggcatcggccagcgtcgaccatgccagcgggcagagagctccagcagttgatcaggcgccattggcacccaggaagtcactgtccgacagcttggcggagagcatgcccgnnnnnnnnnncctgatctggcatgcacaatacgagcgtttgggcagcggttcgcagccatggggcacttccccccgcgtccccagacgtactgggtaggannnnnnnnnngctccagcgcggcctccagatccttggcggcggcctccagggcggccgcgtccttgctctccacgctcagcaccaggcccacgccatcggcctgccccgtcacctgcacaggaggaaaacacagcacaggcatctgatctggcatgcacaatacgagcttttgggcagcggttcgcagccatgggggcactgcccccgcgtccccggacgtactgggtaggagccgcaggacacatttgggccgtgccgctgagcgaccgccttcagggggtcggcgatggcggtctcgtcgtcggttcggaggcgcaggaccacggagtggaagggcgccagcgggctgcttgcctcgtgcgaggcacgcaggtcagccttcacctcctgtgcaggggcggggggcactgtggcttcagggtgggcaatgtggcttcagggtaggcacacggcatgggaacggaaattgggaaaagaagaggggggggagtgagcacctcggggaccgacattgcaaggcatacccattccattcaaatggctgaacaaagaaccnnnnnnnnnngtgtggcttcagggtgggcgcacggcatggaaacggaaattgggaaaagaagagggggggggggtgagcacctcggggaccgacagtgcaaggcatacacattccattcaaatggctgaacaaagaacccgctgcatgcatgtcattggcagccaaacatcgcggcccccgatgcacaaaatctgcgctcaccggccacttctcctgcagcaaggaggggatgccaggcagggcgtagacgttccggcaccggaccaggggaaagggggagagcgccccgctgcccgtccggaattcaatcagggaggtctcnnnnnnnnnnctctggccgtcgcgcagctggtactgcagcagcaccggcagctgcccgcagtaccgcacgcaccccgcgcccgggtcgaaggccacggcggccgcgagcaggcgaacgccggctgccgcggccgccaccacaccctccgcatacacagggtcgcactcgtggcagggggcaaaggcgacgcagtcgctgcgctggacgaggaacagcagcgcggcctgcccgccggcgcgggcaacggccatcagctcgctgacgtggcgctgggctcgggtgctgaccgtgtctgggaacagggcgagacgatccccggcctgcacggaggagcatgcatgagggcgctgacagggacgtatactctacactgagagcataaaatctcgctcggtagcagggttttgtgctcatggtgggtctgtgaacaagaaaatgctgcacaatgtacgctggcatcagctatgcaactgcttatgaccaactcagcttgcactatctcaggtgcagcagaaaacagattaccccacccagagcatcaaacaacctcacaatgcacctcgcttgtcgcagccagggtcacactcttgacttccacatggcactgagtgttagacttgctatgctgaagcaggaagtcgaccctggaagcgccattccttccaaatctgacctctgaggggggtgaaacttatacagacatgtggatcttgcaggctgaggaaggaggaccactagaggcgttgccgcactgtttgcagcccccctctcgtccctctgcatcataggttgcacacgagtgccacagaggaggcaggctgctgtttgaccatccattgaattccacccgggtcaacccctcccagtcgcatctctgacctggcgtgatgttgtcatagtccggcaagccagtcaggcagtgggtggagaggagctccttggccatggcgttggctcgggcgctgtggactcccacccataccgcctgggaggtgggagagtgatgagatgcactgggcgcctgcctcttgtgttggcaatgattgaataatccgaccaaagtgcagggtgatgaaatcgaaacaagatgtggtcgtccaagctggggcctgcatgatttattctgtcctctgacccaattgacaggaggcttcacacccagcggtgcctgtctaagcccttcaacgacgacacagtgtaccatcgcacctccttctgcaggtggatccattccagggagtgtgcgtatttgcgcttaaggttagcggagagggacagggcgacgcgggagggtagctcatccagcaacccagtcatggggcccgtgttgggtacatgtatgacggcttgtgtcgtggatggcgccgcatcttcatcttgagcatcgactcttagctgcggcaggaattggaggattgggctagcaatccaaggaggacccaggatgcagatcgatctttgggcatgatgcccttttcgatccaatcagccgccacctgtgctcctcgcgcacctctacatcgcccagaaagcgcttgtaccgtctgagtagtctggcagggaccatagtctcataggtgaggagggaggctggctcgatgctgccgagagcgggtttcgcaccggtcagctgcacgaccgaggtgtgcctcatggcccggccacagagtatgccgtacgctgtgcgcaatgtgnnnnnnnnnnnnnnnnnnnnnnnnnnnnnnnnnnnnnnnnnnnnnnnnnnnnnnnnnnnnnnnnnnnnnnnnnnnntgcatctcgaacgccggcgactgacagtccaaaagcaaagcgtgtcgggagccgcagggaggggagcagaaattactttatggtggattactgcggcacccaaacgctgaattgcaacaatgctatgcttgttaatgctttgatcagctgactaacgactgaaactggcagggatggccctatcccattcgagtgccagtttgaaacaactcctttccagcagcacgcgccacacggacccccgaggctgaataattccaacgcttagcaaacagcggacgacatgattgcaggcccctgaaaacctggcgcaggggttattgatacacgagtattcatttcctggggagcactctgagtgatcgcgacgccaggggcactgccgcaaccgtagcgaggtagttgtgtatgctcgctgccagtcgcctgtgccaaacacgtgtactgcgtcacctagcgcgccggttacctttggagagagagtgtgcaacaagtctctcttcttgtctagatactctcggacaggtaggcgtcccagcatattctgcaggctgaacaggatcgcggcccgcccctaaggatgccaactgatctatctcgacaaccaaattgtgcagaagacatctaccagctactttcagaagcttagcatggccgctaccatgaccgacagccaggtaagggatgttggcactggcctgttttgccactccctacgccttgggggtacatttccgatctgagcactgccctttcctgcctcggcgcaacttccgcgtaccatttcaacaggtccccgccgcagctgccgctgctgggaagtcattggcgaccaagaagatcgtcttcgtcctgggagggccagggtccggcaagggaacgcaggtgggcccagggccgtgctgggtgtcattcgctcgaggatattgcatgtatgcgtccagcacagtacgcgtccagcccaccacgcttataccttgaaggcgtagttgtcaaaccatgcaatggaccacaatccccctgacctggttttacacctccctccccaccccacccccgctcccagagcggcaagcttgtgaaggagttnnnnnnnnnntgctcgaggatattgcatgtacgcgtccagcacaccacgcttataccttgaaggcgtagctgtcaaaccatgccatggaccacaatccccctgacctgtttttacccctccctccccaccccaccccctctcccagagcggcaagcttgtgaaggagtttggtgcggtacacctctctgctggcgacctcctccgcgcccacatgaagtctggcacgcctgatggccagatggtggcagacatgatcgccaacggtcagatcgtgccctcacatgtgcgttttactcggggagaaggcgcactggtggcctgggccggcggcgtctgcccaaggcatgcattgctgctacccagcaacaatgagggtcaatgcctggagttttgatgcatgccagtgtcctgtcaggtgcaagaatttcatgccaactaatgaacccctgcctcttacctactgctgcaaatcaggtgaccgtcacactgctgaaggatgccatggaggcgtctgacaagagcctgttcctcatcgatggcttcccaaggaacgaggagaaccgggccgcattcgaaaagcaggtacatgtgttgcgctgcctggcagaggctgatggaggggcggggctggatctcgagttggcgagaaatcttccctgagtcagcatggtcatgcacatctccccaacttaatttctgcgcccagctcgccccttttccgactagctgacgccttgcctacccaaaccccactccttgcagctgtccatnnnnnnnnnnactggatctcgagttggcgagaatcttccctgagtcaacatggtcatgcacatctcccctacttgatttctgcgcccatttctgccccttttctgaatagctgacgccttgcacacccaaaccccactccttgcagctgtccattgccccagtgcttgtcctcttcttcgactgcagcgaagaggcacgtgcagggggagggtgggggaggggtatgtatacgcgactaccgaggctgtggggttgtgagcgttgacgagcgtcatggatggccacagtgtnnnnnnnnnnggggtggaaggggtatgtgtacgcgaccaccgaggctgtggggttgtgagtgttgacgagcgtcatggatggccacagtgtagtggatgcacagagacacatgggccccagcacccccatgcctggcgagctggcaccggttcagtaccaaaacagtccctcaccacatgtcacaggtcatgatggaacgcctgctgggacgccaggagggcaggaccgacgacaacatcgagaccatccacaagcgcttcaaggtgcgctggcgggggggtggaaccgcacgggttcccctccgcataccagctccgcggtcagccaactggaagggcgccaggacactcgagggaaagtcaacaaacctctgcccgtcaattccctgcaggtgtttacggagcagtccctccctgtcgtggagcactatgaggctctcagcaaggtggctcnnnnnnnnnnatatggaaccgcacgggttcctctctgtataccagctctgcggtcagccaactggaagggcgccgggacgctcgagggaaagtcaacaatcctctgcccgtcaattttctgcaggtgtttgcggagcagtccctccctgtcgtgcagcactatgaggctctcagcaaggtggctcgcatcgacgcccaccgcgaccccgaggaagtctaccgtgaagtgcgcaggctcttcgaagagctctaatgctcttgggtcggcccttgtcctctatacatccactgaatcgacccatctgctgtgccgtgaacgaatgtgatgtgtccctgtgtagaactccctgatatccccagcccttgctgctttcagcaacacaggatgcaatcgagatcttcggattcgtttggccggacattgctccgtgcacgacgtcatgcacgccatcggggagcgatcccaggcaagatgttgtctgcgccgcactgcagtttcactgaaagggtttagatgaatcgcgacctacttgcatggctgtgcacagccttcttagcggtagggtacctgcacctctgccggctcatcggcagccggggagggctcccccgatacctcacacgcaagatcattcatatcggtgagagtgcctgagacatcatccgtcttattcccaggatcctgaccctcaggcgttatcaagctggagcaacgaaattatcgagatcactttcagaggggtgttcagggtcctgcccagggcctgacatacaactgccatgacatgcaacccttcattcatgaccatatcaggtacgggaccaatcttcatgctgtgctggcccatgtactcggagtcccactggagctcggtcctgtgttcatcggtgcctgccctcgccacgctgcaattcctggcggtcggcagcggctggatctctgaccccaagctggtcgccacctcctcggtatggtgtgctggtgtggtctgggaactccaagcagccagtctatgccgtcaaggataccttgcatcccggtgatgaccacccctgcgccgcctgcccaaatgnnnnnnnnnnactggtgtggtctgggaactccaagcagcgagtctatgccgtcaaggataccttgcatcacggtaatgaccacccctgcgccgcctgcccaaatgacaaagagccacctacatactttcacaaaccgatcagatcccaacgtgcccaaccccgtgcagcgaaccgggctgagacaggagctcctgaccgggccggtcctgtatggcctggcgcacgtcgcggctgccgcgctgggctggcggcgctcgccgaccgcagtggtcgcgctgtgcgcgctgtgtggcggcgatggcgcagctgagctgggggggcactggctgcctcgcgtcgcgctgccctggaaccgccagaaggtgcgccgaacgatagggatggtctcaccgaggggaggcccagcggcctgcattatctcggcaccctcccagctnnnnnnnnnncccctggaaccgccagaaggtgcgccggacggtagggatggtctcaccgaggggaggccgagaggcctgcattatctcggcaccctcccagctcatgagggcttgctaaggtgccacgccggcatggcaccctcctccactctgttccatctccagacgctgggcggctcgatcnnnnnnnnnnatgccacgccggcatgccaccctcctccacgcttttccatctccagacgctgggcggctcgatctccgccgctggcggtgcttttctcctcagcagtgctatgctgtccttcttcggagggctgggcttcctgtaccccccgagtccaaagctcctgctcggcgcagcccttgcggcagcaggtgtggagtccctaccactaggggcctgggacaatgctgctctgcccctggccatctgggtatatggtgtggcggcgggctggcagtgattgcctctgcagggttaccacctggatagacttctgaaagtctttggcctggcatcccttgatctctggcataggtgtaccacccttgtggctctacagcattgtgtgatatgcattctgagaatttttacgtgatgagcacgtcctttgctctcaacaagctttgcaattttgtacccccagttgaccatggcatactgcaacagaccgagcggcttggaagcccgctgctgcatggagtgcaccgcagcctatcccttatagtattctgtactgtccaatccccagatttcctcctnnnnnnnnnnaaccatggcatactccaacagaccgagcggcttggaggcccgctgctgcatggaatgccctgcagccaatcccttatagaacactgtactgtccaatccccagatttcctcctgatatccaagccactcctgcccacagtgattgtggcgttgtgttaccataacccagttctatgcgtgcacagacctctgcacagctcagctgtattctccccgtgactatgcaagctgggaaggagcagggcannnnnnnnnnacgttgtgttgccgtaacccagttctatgcgtgtacagacctctgcacagctcagctgtattctacccatgactatgcaagctgggaaggagcagggcactcgggcgttccaaaacgtgttcgccacatgggccgccacatggggaaaacctgcttcattatcgaggcaggatgcccccccgacacagattgagcaggcgctcgaagacagggccccctnnnnnnnnnnacacatgggaaaacctgctccactatcggggcaggatgcccccccgacacaggttgagcaggcgctcgaagacagggccccctgcttctcgaatgccacagtggagatactcgttggtcacccactggtgcatgccattgatgcgattggcggtctcctgcgaggacgcaagggtggtgggaggttggggaatgccttgcagcgcagcgaggcccacaggggggccacccccctgcgtccccgggtccctgtcgnnnnnnnnnncatgccttgcagcgcagtgaggccaacagggggcccacccccctgcgtccccgggtccctgtcgcccggctgccccacctgggcgagtccaaaattgacaaacatgtcctcgtagtagagcacgccggctgtgggcacggtgttctcctccaggacatccacatcgtacagagttggccagtcctccttgctcgccaggatgtctgtgaattgccacatgcaaagggggcgtgaatgctccgcagcatgcaagctgatgtatggggttatgtacagacccacctgatgagaccaatacagcatgttcattattgacaatggccctgcggcagactttgcaatcctgaacttgtggcctcgatgcagttcgctccccaggccccaaatctggtagttagctccgtcatcccacacccctccatgcctcacacctgcagcctccttcatgggtcnnnnnnnnnnaaatgttccgcggcatgcaagctgatgtatggggttctgtacagacccacctgatgagaccaaaacagcatgttcattattgacaatgtccctgcggcagactttgcaatcctgaacttgtggcctcgatgcaattagctccccaggccccaaatctggtgaatagctccgtcatcccacacccctccacgcctcacacctgcagcctccttcatgggtctgagcccggcgattgcctcaaacatccaggagaacaccatctcgcctttgaggggtgatgagatggcagcttgaaatgtcattctgcagtccaggagcagaggagctggagaattccccagcacatcacccggacggcagcctactcctcgcaccacaacaccccccttacccgtgaagttgacaggctggcnnnnnnnnnnatactcctctcaccccaacaacccccttacccgtgaagttgacaggctggcccgcctgtgctgcctgcgtggcgtcaaaggcgtcggcaaactccccgctggccagtactcgctcggcggcccagttagaggcagccccctggcagtagatgctctcgtgcatgatggcgtacagggggttggtgtcccagctcatccacacatcaaaatcctggcgcacaggagggggggccatggtgccaggtggccaggtggggagatagcagaggggggatcgatacccaagactctgcctgtatgctccagcccaacgggcgcttgtaaagccatggtggctccaccacattcgtcacaccaggttcttgcaagcccattcccgggtcgaaccaccccaaccccccagaccttgaggaacttgcggctgagctctggcccatcaaaactgccttcaaagaggtagtgcaggcgctcgaagccggtgctgaagcccatgctgtgcaggcccagcagctgcaggctcctgaggggtggaggtgaaggaatgggtaaaggtagattcgagcaagggagagccattcgtgcatcaccctggcgcacatcacgatccccgaccccaacgtgttctgttagcggagggttgactttgatgcaaatgccccccgctcccgcgtcccgcccccccctcacaccgcccccatccctgtactgagaccacgggccacccctagccctctcacctgggggtgagcaggttcccggcgggtgtactcaccccccctcccggggcggccgccaggaagcgcaccaccgccccaatgcgcgcgacgtccatgggaaagcgtgaatagtacttgcgattctggagcaggacccggagcgcgcacgcccggtacaccgcctcggcggcgcagggggtgtcgatgcgcgggggtatgcctcccgtgatcaggcagtcgatcaggcctggaagtcagcgtggggtggggtggggggagtgtcagtggaggaccggcggggaaccttcctgctgtgcatggtcgacgtgcatgccctggcgtgggtgtttgtggctgcatgccatcagggcgactcagccccttcccgtacagacaaggcatcccttcccatgcacagcttcccgcatggccatgaggggaggggtgcagctccaggggcaggcccgggatgggcggcatcacctcgccccgtccccacatgcaccaaccccagtcacacaggaccaggctcactctctggggcgagggagaggtaggtgacgcagcagaacccgccannnnnnnnnntgaccccacaggcaccaaccccgatcacacgggaccaggctcactctctggggcgagagagaggtaggtgacgcagcagaacccgccaaagctctggcccaggaccgtccagcggccgtcgtggtttgttcccggcaccagcaccatgcggatgacctccgcgtcggccacgatgctgtccgccctgcacgccaggcaagtgatgggatggcgccactggcatgcaggcatggcagcgccgccggaggtacagtgtggcccgcaccgccacctcagcgccctggtcaccacgcccacctgaagtgcgtcaggtgcagggcctgcgctcccgcgtccccgagcctctcgatattgccaggggtgatggggctcgacaggcctgtgccacgctggtcctgcatgtttggagggaaagacatgtggggccgagcgcatgagacatggcggtgggtgccatggatcgcaggggctgcgtcgcgcgaggggaggaacaagcacgcccgttgcagagcaccagagcccaccatgagcacgatgcggaagtagttgcaggcatgcttgatccacccggtgttgtccaggggtcgtggagcttcgaaccctggtcctcctgcactcggctcgaggtgggaccggggggtggggcaacagcgagaggagagggatccttggtgagagagagagtcttacccatggatgcctgctgctgtgcaccattttttcacgtccctgaaccctccctggccagacagaggggcgcaccttgcaggtacagcaggtacggcaggttgtggtcgctgaccttgttcctgtgcaccagtaccctgcagaagacatccacattgccagggtggagacctagagggcatgggtagggggctggcatgacgctgggggccggagatgaggccggcacatggcacaagccggtgtgggcaggagcatgtggcagccactggcagcctcacagggcccctcaccagagtagtccaggggaagggtnnnnnnnnnncggcacaagcaggtgtgggcacgagcatgtggcagccactggcaacctcacaggccccctcaccagagtagtccaggggaagggtgaatgtgtgctctgtgatgcacagtcctggcaccgagaaggtggggcccaccttgtgctggtggcagccagcggtgcgggcccgcttcacaaccgaccctgtcatgggctgggggtggggcgcaggcgacgatgcaccggctctggcgcgtgtcagtctcgagatggacgtgaatgatcgctggcagatgcttcgcatgagctccgccggggactggtgatggtatggcagcagcagtacagtcctgaaaccctgtggggaccctgccttggcgatcgatcaggctgggcgtgcgcctcaggtggccaatcgacctccaatcctgaaaattcgcgcagtgaaggacagaagtcttgaccagcaggccggtggggcgtcgaggggcttggtgagaggacagaattcatnnnnnnnnnngcctgaaaattcgcgcagcgaaggacagaagtcttgaccagcaggctggtggggcggcgaggggcttggtgagaggacagaattcatgggtccctccccccgcgtgcgcaaggtgtcgacttccggaggtactcgacaccttgcagagcgcggtgttgtgctggcgttcaagcttctacacaccaacagtataacaacttcctgtttttcaatagaaatcattttttcagccagactgtgcatctcagccagtctnnnnnnnnnngcaccttcctgcttttcaatagaaatcattttcttcagccagactgtgcatctcagccagtctctggtgtactgattacacaagggctcgcatgactcccaacacggcaaacccacctgccatcaccaaagtgaaccgatgctgaatgggcgaggctgcaggccgtgcatattcatgagcagccaggtatgcagagatgcacaggcagacggctgtgcccgtcactcgacaggacaggcagtcatgtggcttgttgggagcttcctttgccgctttctcctccataatcctctgctcgacagggcctacttcttcttacccttgagtgcctcacgcgccttcttcagcgctgcctcctcctccttatcgataggaatgccaggcacgggatgagtttgcttcaatgtatatgtgcagacatgacacacaggcgtcgattgcgcccaagccctgctcaccttcttcttcttcaggaactccttgtcgtcttcgtcgtaggtcttctcagactttggcttctacggtgtcggttaggaattgcggtttgcactggtcttcttccttgcaccacgagcacgcacgagcaggggaacactgcggcttatgaccagtcgcaccctgccatccagaaggtcaaacccccattnnnnnnnnnnccttccttgcgccacaagcacgcacgagcaggagaatactgcggcttatgactagtcgcgccctgccatccagaaggtcaaacccccattctcaccttcaagggcttcgccttgcctccttccttgcctgtaatatgtcgaatgtggatgtgtgttgaacatcacaggcaacaaagaccaactgcgtgccacacagcaggcgcccgtattcaagactcaccaaccatgtcaatgcgactttaggctcctgcgacacgctttgaattaggttcttaaaattgcgacggggaatggcatcccatagtttgactcgtccgcttacttgactcccggcnnnnnnnnnnaactttaggctcctgcgacacgctttgaaataggttcttaaagttgcgacgggaaatggcatcccatgctttgactcgtccgcttacttgactcccggccgtgtcctcgaaggtgagcgcgcctccgggaactccacatctgtgcgcagggcgcggacacatcaggcaacaaccaaggcctcattgcagggccagcacgagctggtagagatgctggcgggatggtttgaatctcggaattgaatcatgcttgtattgcaaccctaagagtcggtggacgggagatctctgcgggtcggactcaaagtcgttggcagggccacagggccatgtaggccccctgggtaaccctgtgtgaaggaggtgtcgagcgccaaacagaagggtgctgcaaacctttcgcacggcgtggccaccagcatggccaagcgtaaggcagcctccatgtttgagcgcatggaggagctgaacaggggtttcctgttggacgcctcctcagcccacgcggccgccgccctgcaggcgagctgatggggtgggggcgtttcggcaggggaccatcctttggatggatgacacagggtgtggatgcgggatatcctcacggtcgcgccaccaaagaccttgttcggcgcggacgtgaagctgctgttgatagtgggggcacagcccttatgccccatgggcagcttttgcgagatgcaccttcgaccccctccaacacaccacacatctcccctcccccccgacaggcgtctgccaagctggccgccgccccgccagccccgagcgcgcccgcccccgccgcccccggcgccgtcatcaggcccctccgcctggacgcgcaggaggccgcccgacgtcacgagcgcagagcccgcttccaggaggagctggcggtcggcgcgcgggcagccggcgtgggccagcgggagacgctggtgcaggcgcggcgcgcgggcgccgcggcggagggtcgtagcaccgccctggagcgagagttcctgcgcctgaccgcgctgcccgcactggaggacgtgcggccgccggggttgctggccgagtccctggcgctggtgaaggcgcgctgggtgcaggtgggtcctgtgcgagggtgacaacagcacgccgctgtggctcctgagtgggtgtgaatgatgtggagcgaggccgtcgctgggggacggcagcacgtccatcgcaccctgtggccagccgtccctttcccaggcctgcccgtggctcggggtcaggcagggagccggcctcccaccacggaccacctccacaccccacccatccacctgccatccgacccgcaccctacgcaagcacaggaccacgactatgcctacgcgtgcgcgcagctcaagtccatccgccaggacctgaccgtgcagcacgtcacctccccgctggcggtgggcgtttacgagacgcacgcgcgcgtggcgctggaggcgggcgactgggccgagttcaggcagtgccacgcgggcctgctgcgcctctgggccgacggcgcggaggaggtcgtgccggtgagcagcgtgcggtgcccggggcgtgtggagtgatgcggggagggttggaggtcgcacgtgggtggggtgtgctggcagaggggctggaaaacgtccacatcattccgatccgctggtgcctcggagcacacg

SEQ ID NO: 42061 - DNA, 61 bp, Chlorella protothecoides
cagacgggttctgcctcctcaccgccaccttcccttcatccacatcgctcgcagcgagcga

SEQ ID NO: 42062 - DNA, 61 bp, Chlorella protothecoides
aaacatcggcggccgcccatcactcagcgcaccccccccccactatcaagccccacccgag

SEQ ID NO: 42063 - DNA, 176 bp, Chlorella protothecoides
ggcttgtacttgaacaccgtgatctgcgcatgcgaggaaacgtgtagcagggctgagagcgcgacattgggacaatcggagacttgcgacgcgagcaaccagggggtgcatgcccgcccgcctccaccttgcctatcccctgcagccatcacccctgcccactcagtcacccacct

SEQ ID NO: 42064 - DNA, 61 bp, Chlorella protothecoides
gttcaacgtgacgctggacgacgtgcgcggggtggcggtgcagagccggcgcgagctggag

SEQ ID NO: 42065 - DNA, 77 bp, Chlorella protothecoides
ctcgtccagaaagcgatgctcagcacacatacataggtcccctaaccggcaatggccacggcaaacccacctcgcgc

SEQ ID NO: 42066 - DNA, 97 bp, Chlorella protothecoides
catccggccccaccctgcgagcgtggtccgagtgggcgccgacggctgcagtctgtgcctgtccgcggaggggcgggagcacacctttgccttcgac

SEQ ID NO: 42067 - DNA, 61 bp, Chlorella protothecoides
cgcctgcaggtccagcaccaggcggtcctgggtgtcgtagacctgcgggtaccgccgccgc

SEQ ID NO: 42068 - DNA, 75 bp, Chlorella protothecoides
tccgcctggggcagggtggtcgggaggcttttattttaagaatcaaaagtcatgtgtcctgccgcggcccccgcg

SEQ ID NO: 42069 - DNA, 79 bp, Chlorella protothecoides
gacgtaggcggagcccctgcattgggatggcagggggtagggggggacggacctttgtgggcgagtagttatggagagg

SEQ ID NO: 42070 - DNA, 68 bp, Chlorella protothecoides
catttctcaggaagccccagcagccacacttactgcagtccgtgcctggtccctccaggcctttcccc

SEQ ID NO: 42071 - DNA, 61 bp, Chlorella protothecoides
cagtggtgcggtggacgtggaacaggcgggggtgagccctccttcaaagtccaaatcacga

SEQ ID NO: 42072 - DNA, 72 bp, Chlorella protothecoides
aacacagaattaatacatccagtatagattctttctacctccgcgctccatggatgttacattagcggacca

SEQ ID NO: 42073 - DNA, 73 bp, Chlorella protothecoides
gtaggatggtacagaacaagaccaccgatagggcgagggactggggttttaggtacggtgccaggcggcgtag

SEQ ID NO: 42074 - DNA, 61 bp, Chlorella protothecoides
gcggcgctttgggcacgggctggatgttggcggccctcagggcgatggtctccaggaggcc

SEQ ID NO: 42075 - DNA, 61 bp, Chlorella protothecoides
gaggacacgccgctgctggcggtgtgggggttggaggcgctggcgcccgcagcggcggggc

SEQ ID NO: 42076 - DNA, 65 bp, Chlorella protothecoides
acagctcctctggaccctgcgacgtttcagaaggacggacgttgggggcatgggcacttggggca

SEQ ID NO: 42077 - DNA, 61 bp, Chlorella protothecoides
cgccccctgcaccctcgccgcccgtcccagttgacagcccgcggcccgtgcgcacaaacac

SEQ ID NO: 42078 - DNA, 125 bp, Chlorella protothecoides
ggcgtcggccaggttggtgccgatgatgccgctggggccccggctcagccagcccacaacgaagaggccggggacggcgggggcgtccgccgccacgctttccagcacctggcccatccggttgg

SEQ ID NO: 42079 - DNA, 17379 bp, Chlorella protothecoides
  modified_base (885)..(894): a, c, t, g, unknown or other
  modified_base (2374)..(2383): a, c, t, g, unknown or other
  modified_base (4037)..(4046): a, c, t, g, unknown or other
  modified_base (4951)..(4960): a, c, t, g, unknown or other
  modified_base (5362)..(5371): a, c, t, g, unknown or other
  modified_base (6852)..(6861): a, c, t, g, unknown or other
  modified_base (7815)..(7841): a, c, t, g, unknown or other
  modified_base (7912)..(7921): a, c, t, g, unknown or other
  modified_base (8421)..(8430): a, c, t, g, unknown or other
  modified_base (8925)..(8934): a, c, t, g, unknown or other
  modified_base (9001)..(9010): a, c, t, g, unknown or other
  modified_base (9603)..(9612): a, c, t, g, unknown or other
  modified_base (9897)..(9906): a, c, t, g, unknown or other
  modified_base (10275)..(10284): a, c, t, g, unknown or other
  modified_base (10505)..(10514): a, c, t, g, unknown or other
  modified_base (10966)..(10975): a, c, t, g, unknown or other
  modified_base (11092)..(11101): a, c, t, g, unknown or other
  modified_base (11164)..(11173): a, c, t, g, unknown or other
  modified_base (11351)..(11360): a, c, t, g, unknown or other
  modified_base (11663)..(11672): a, c, t, g, unknown or other
  modified_base (12382)..(12391): a, c, t, g, unknown or other
  modified_base (12631)..(12640): a, c, t, g, unknown or other
  modified_base (13086)..(13095): a, c, t, g, unknown or other
  modified_base (13865)..(13874): a, c, t, g, unknown or other
  modified_base (14273)..(14282): a, c, t, g, unknown or other
  modified_base (14709)..(14718): a, c, t, g, unknown or other
  modified_base (14980)..(14989): a, c, t, g, unknown or other
  modified_base (15733)..(15742): a, c, t, g, unknown or other
  modified_base (16476)..(16485): a, c, t, g, unknown or other
tcaccgccttccggacctggatccagaaaaaggctgggggcgggccctttggcccccaggacgagggctggctggcacgggcgggcccccgcctgggtcaaacccagctgctggaccactgggagtcgcactgctcgcgctgcgagagctgccgcaccgcggagcagcgcctgaaggtggtccggggggtggcggccgcgctgggcgcgctgtgtggcttggccacgctggtggtgggcgggctggcctgcgttggggccatcgacggcatcgtctccaccttctcctcaacctccctggccgccgtggcgggggtgacgggcatgttctgcgccgccatgggcctcctcgtggcctggaccaccaacgtcctgggcaggttccacctggggcggcacccgctgccgcgcaacctcgtcccgggcgagtggcaggcggcggtctgatgctctgggccggagtgggggtgaagcgctgagggccgtgtggccttcccccacgcagactattatgcagtccaattcttcatcagcgatccatggcttctggcaattatcacctgcgacttctcccaggcaaccgcattctttggcccttcttccaagccagtgtagaatcaaaagtcatcttttcgacggacagtacaatcccattactttgaaatcactttgtaaacgccattgagattgctgcatgagctggtaacatccatgcagggacgagttgatgcacatgctgtgctgcagctagcctgccacagacagtgctgtaattacaacatccctattttcgaccccggaagcctactggctgcggagggggccgggcccttcctgcttgatagccacctctctcaccggaatccccctctttcacaaaccatcnnnnnnnnnnttgctgtgctgcagctagtctgccatagacagtgctgtaactacaacatccctattttcgaccccggaagcctgctggctgcggggggggccggggcccttcctgcttgatagccacctctgccaccggaatccccctctttcacaaaccatctgtcatcatggctgagtctcttaccctccgcggtgagctgcacggccacaggggctgggtgaccgccatcgccccccccctggaccccaactccgacctgctggtgaccagctcccggtgcgcggggcagagagcaatgcttggattgtgtaatttatgcacccaagtgtcctcgccgatggggaagaggggaattgacagcatcagggggggaggcgcccctccggcccgccctgcggctgccggcactgcccccgatccctgccttgcgtgaggcggcctcaggcgcctgattaacatccagattgcgtaaaatcctcaccttcactccccaccccctctccatcgcagcgacaagtcggtgatcgtgtggaccctgacccgcggcgagaaggaggactacggcttcgcccgccgctccctgcgcggccactcccactacgtccaggacgttgtgctgtcctccgatgcccagtacgccctgtccggatcctgggacgggaccatgcgcctgtgggacctgaacaagggcaccaccacccgccgcttcctgggccacaccaaggacgtgctgtccgtcgccatctcggccgacaaccgccagatcctgtccggctcccgtgacaagtccatcaagctgtggaacacgctggcggagtgcaagttcaccgtggccgagcccgcggggcacaccgagtgggtgtcctgcgtgcgtctgtcccctgtgtccaagccgccgctcatcgtgtcggcctcctgggacaagacggtcaaggtgtggaacctgcaggactgcaagcttcgcgacaccctgtccggccaccgcggctacatcaactccgtcaccgtctcgcccgacggctcgctctgcgcctcgggcggcaaggacggcgtggccatgctgtgggacctgtccgtgggcaagcacctctactccctggacgccggcaacgtcatcaacgccctggtcttctcccccaaccgctactggctctgcgccgccaccgaccgcggcatcaagatctgggacctggagtacaagtcggtggtggacgacctggacgcgccgctggagggcgtggaggccgccaagcagcccaagcccgtgtccctggcctggtccgccgatggcgccaccctctactcgggctacaccgacggcgtcatccgcgtctgggccgtgggccgcaggtgaacgcagaggagcggtgggcgcggggtcggggcgtgacgcacgccgtgcgtgtgccaggccccgcgcccgcccacgccgcacacgctgcgccgccggcccgccggtgcctgcctgccctgctttgcgtgagcnnnnnnnnnnccgccgcccatgctgcgccgccggctcgtcggtgcctgcctgccctgctttgcgtgagccttcgccaggacttgtgattgaccccatggatcaatgtactgagacgcttggcgggccatgtgaacacgacaggaggcctttttagtcctgaaaagggggaggggccccaggggaagggaacgagtggcctgcaggaaattggaagtggggggtagctgctcatgcccgtacacacccccggttttcccgcgccgggcacgcttcgactcatgacgcgattcagagggtggaaaaaaatcacccaccatgcaaacacgttcctgaagacccaccacgcaatcacgtccccggcagccccgccctcacaagttcctgggtgtgttgggccccgctgtaccaaggcgcccaccgcgccctggggctgacgggacgcttgcacgcagcactcccgctgtgaccgccgggagggtgtccagccccgccttcgactcgaacaaacactaacgcatatagaagtaaccacctcgtttcgccgatcgggctgccaggggaggtgcagccggcctggccgaggggcatggccttccaccacggccccaagtggacgccccaggacctggatgccgccgccctgacggggaacgagggcgccgaggtggacatggagcgggtcctggtggaggacgatggggcccgcctgctggaacgtgaggcccagggggaccaggagggccaggaggcgccggcccctcccggcgcgaggaggccatcgaggtgatcaagctgctgacctccggcggcctggcgggggccatctccaagacggccactgcccccctcgcccgcctcaccatcctgtaccaggtgacgcgcgcaggggtcgagtggtgcctcgctggcgcggccccatggagcgtgaggggcatgcaccatcgtgtcctcacgatccgccgctgtgccgggctgcgttgttcttcgatgagctctgtctggcgcacctcgaccagccggcgatgaagtgctgacaggagcatcgcctggtccgctccagcaccgtcccccacctcccaaacacctctggaccccccccgcctccccaggtcaaagggctgagcgcacagacgatgcaggggtcgcccgcgtccggcagcgtgctccgcgccctgcgggagatggcggcgcgcgagggcctctcctcgctctggcgcggcaacggcgtgaccatcgtgcaccgcctgccctactccgcggccaacttctgggtgtatgagcaggtgaatgagcagtggaagcacatcatccccgcccaggggaccctggccgcggcggacgtgacccggcgctttgtcgcgggcggcatcgccggcctcaccgcctgcaccctggtgaggcgaggggatgagggggggcctggggaaggctggacctcgcaagcgtctgggcccctgtgctcaggcccgggcagcgctttgacgcctggagcccggtcaccacccctctgccggcaccgctttccgacaaggagcaccattgtgctctccgacctgcccacaaatcccccctttccatcaccccccccccctcgccctcccactcaactcccaaaaggcgtacccgctggatctggtgcgcacgcggctggcggcgcaggtgnnnnnnnnnnttcccccctttccatcacccccccccctcaccctccctctcaactcccaaaaggcgtacccgctggacctggtgcgcacgcggctggcggcgcaggtgggcgcccccgtctactccggcatcggcgccacgctggcggccatcgtgcgcgagggcggtgcgcgcgggctgtaccgcgggctgggcgccacgctggcccaggtggcgcccagcctggccataaactacgcggcctacgagacgctgcgctccgcctggctgggcgggggcgcgccggggtcacggggggaggtgccctccgtccccgccacgctggcctgtgggtcgctggcggggctggtgtcctccaccgccaccttcccgctggacctggtccgacgccggctgcagctccagggcgcgcacggcgcggccgacgtctatgcctcctacgcaggcgtcttccgcagcatcgcggcgcgggagggtctgcgcggcttctacgccggcatcctgcccgaatactacaaggtcgtgccgggggtggccatcgccttctgcagctatgagctcatgaaacgcacgctgggggtgcagaccaacgccacgcagcggtgatcccccttgggatggaaggttgacctgacggggggccacagcatattggcggctggaggtggcccccctccaaccgtgcttgtcctcggcccctgacccaccgaggctcgggctactcctcttcccccgagctcccccggcccttttgacactgacacactcctcagaagcactacaaccagatgcctgtggtttcctctgtcttctcaactggatgccaggtcgaggtcacgcagcttcagaggccccttgcctccagacctctttcccacttgtcactatcattcatcacaaccctctgacctccannnnnnnnnngtgcagcttcagaggccccttgcctcaagacctctttcccacttgtcgctatcattcatcacaaccctctgacctccaccctgctcttctgccagcggcccttgtttctccctatgctcgacccagcaggtcttggaggtggcggtgacacaccgtcttgacccccattgattgtcgcagtaatccggtaaacaaatctgcagtatcagggggggccaaggaacattttgacaccgaagagtgctatacaatgcacccccgaaggctttgtgattcgagtttgaagaagggcaagaaatatttgccggtgggagcctgacccatgtggctaaagtttatgaaatcagcctcggtgcttattgaggaccagcgagggaagtctacgtcagctggcactatgtnnnnnnnnnngcgatgcttattgagcaccagggagggaagtctacgtcagctggcactatgtcattgctacttcgtggcgccatgcctgccgtctcgcggcctgctgggcgcgcatgcagtgccttcagcgcctgaatctgccgctgcatctgatttgccggcaaggatgggctcgctggtcctgcttgtgcgcggcctggcatccagggtcttgtggtacagggcacctgcagtggggtggggttgagctctgcatgtgtcgagtcatagcccagagggccctttgtgcaattctcaccctgtcccggcccagcctgggctcacaggccccaggtgcaggccgatgctcgctgtcaaccaggaatgcgctcagtcaaacagagtcaggataggaatccctccacattcaccccacccttccatcccttggcctcactttcccccccccaaatcagacacacacgcatacccaccaaacacaacgcaggcggcggcatactgctgggcgctgaagctgtggccgaacagcaggcccgacaggaggatggagagaaactggcgcgtggtcatggcggcggccacgagcagcgcaccgtgccgccggatggcgtgcgtgatgaagagctggcccgcggtggcggccagggccagcagcgccgcggcgcccagcgcgcgcgggtgcgctgcgaagaaagcgagcgcggggcgcagctcccccttggccaccaggccggccagggccaggagcgccgaggtagcggccacgtagaggacctggttgggcagggtgggggcgtgcagcgcaaagagccgggcctggaaggtggaggtgaagccgtcgactgtcaggtaggcggccatgagtgtcaggccccagggcgtgctggcatgattggtggcggcagaggagaggccagcggcggcgggggagacggcgcctgcgcgattcgcgcccacaaaggcggcgcagccgagtgtgacggcggcagcgcgcgcggcgtcccgcgctgcgtaccgcttgcccagcatgactcggccccagagcatgacgggcagcattttggcacacttgcccagcgtctgcgctgcaaagctgacgtggcgcaaggcctcgtactggcagaaggttgcggcgacgttggaaagggagaccgcggcgaagctggtgaggggggcctggggggccaggggatgaccgtggtactgcaaaggaggagaggggtgtgggtgtattctgaccctggggctgcagttagtcttgggaattctgtgtgatgaagcatgtgagcatgccgaacgcagccgtcacaacagggttgggcctggatctggacgggctctgcgcggcgtctgcgcccagcctgcagtacacggtgcaagcagccccaaacccttcccacagccgcccacaagacgcacgagggagagggagagggccactgcgcaggcgacgaggcggttggccaggaccagtgccaggctgtgggtgnnnnnnnnnnaggctctgcgcggcgtctgcgcccacactgcagtacacggtgcaagcagcgccaaacccttcccacagccgcccacgagacacacgagggagagggaaagggccactgcgcaggcgacgaggcgattggccaggaccagtgccaggctgtgggtgaacggctcgccatcaaacggggactgcatgatccgctcctgcgtgggagcaacagatgagggcagagtgcctcctggcagagcttggcaaggggttgggcatgggggcggcaggctgatctccatcgtgactgctgcgctgccgtgcagcagtcacctgtcaggagttggctaccctgaaggcagaccttgcaaattccatccccaatcccagccgcacctgcagcaccccgtacaacaccaggctgccaatgatgccaccgaagcaccagacgacatgcagagcgtcggtgctggcaaggcgcgaggaggtgtgcttgtttggggacgacatccccgcgtcgccccgtcggaggcctgcgcactacggtgtgactgatttcatcgttgctaaaatgtaatgattgatcacgctccacatcttgggcactggtgtgtactgcagaggggtatagggttttcgatggacagcccatcgcgcgcgaagccgattttggtggccagtcacctagacaacacggtttaacacagaaacgttgttccactacctcaacaacagtccaaaaacatcttggaatgctcatgggcccccgattcacaccacctccgtgttcagatccacgagacacattggagcaagtctgactggcactcgtacacaaccaagcctgccaataaccgcactgtgcacgaactggcctggaatggcgcagcaggagaccgtggcaagccctgccttcccctttaagggagcaaaacgagcaggtgacgcccgaagtggggctcgaacccacgaccannnnnnnnnnnnnnnnnnnnnnnnnnnaccaggctgcggcgtatgcttggttttcgagtttgacctcgaagtgcccgagctgcactgatatgatgatnnnnnnnnnntgagacaggtgtcccggtggcgtaccactgcaagtgatgcgccggagtgagatcttccacggtatggaggggagagtctgtttccacagtcgccgacccatgcacaatgggcagccaggctgcgacgtatgcttggttttcgagtttgaccttgaagtgcccgagctgcactgatatgaggatgtcgcattgaaggagtccttgttgtttcaattgctagcccaggcaaacccctggactcacgcagaatatacgtatagagttgcgtgttctctcattgcggatcagatattgtgtctctgagttggcaagcgaagacacaccatgcctggccctgtagaggaatttactgaaacgtgatccctcctaatcttggcagcctggtacggattgggcgcaccaattggagcccgataccttgattttctttggattattctctcatactggtgtctttggcgtgtcttttccaggtgcatcataagcaggcacctttggcnnnnnnnnnngacgtacagagttgcgtgttctctcattgcggatcaaatgttgtgtctctgaactggcaagcgaatacataccatgcctggccctgtagaggcaattactgaaagttaatccttcctaatcttggcagcctggtacagattgggcgcacgaattggagcccgataccttgatttattttggattatcctctcatggtggtgtcctccttggcgtgtctttcccaggtgcatcataagcaggcacctttggcaatgtggagggatgggcacgtgctgccatactccactttgttctcctccaccagagtcttaacccatactgcacagcagttcctagggaactgccggcgatgggaccggctgcatcagtgcttccatggccgtcagccatctgtggatcactgatatgcactattcaccccaccagtggggctaggaagtggtgggacaatccctgcattttagagaaagggaaggtgttaagtctgctgttgnnnnnnnnnncgggcacgtgctgccatactccactttgttatcctccagagggtgtgcagaacacattgtagctggnnnnnnnnnncctgtatcgtcaggaccagactctgggcggcatctgggtggagcatccaagggtagcactacaactttcggcaaaggtccctacagagggtgtgcagaacacattgtagctgggtcacaaaggtacccaagcgactcccttcgaccacctaatgtcatgaactcacgcaatggcgtggtagcttatgttgtagtcgcggaatcggtccgggaagtcacgtaggaggcccaagaattccgcaggctgcagcttctttcgctcaggccagcccatttccttccgcacgatgttgtggatgacgatggccaaatccctgttggaatacgtgggattgacattcaggagctccgtcagcttgtccgtcacccaggaagacagatgggggcactgcctggtgtcctcgtcgtggccggtgtgggggttatggcggtagatgataatgctgtctgtcttcctctgcctcagcgtcttgatgacgaacttgtgctggcagcccgtcttaatggacatctcccgaacctcatcggtaggctgcagccgcaggttctcggtcgaccgtgccgtcacgatgggcatgtcggggccccgggcgnnnnnnnnnngttctcggtagaccgtgccgtcacgataggcttgtcggggccccgggcgcaggtgaagtacgccttcgcggcccaattctgtgacaaacgtcaaggaaagagaaaataatgtagtatttgcaagcgcagacggttgcaggttctgtttagcagcagcatacgcaagtccgatggggtctgcattgtgaattcgtaccctgtcaggacggcggttctcacggttaaagcagtcctgtactggcgactctcgacgtgcaggaagtcactgatgcgatctgtaggtannnnnnnnnngcctgcattatgaattcgtaccctgtcgggacggcggttctcacggttgaaagcagtcctgtactggcgactctcgccgcgcaggaagtcactgatgcgatctgtaggtattctggcctgtgtcgaggaactcccgtcgtacttacccttctcagtgacgccggctgcctccaagtgggccattgtgaagtaccctggtgggcattcatacagtttgggcccggaccgcattgcatgaggtatcaatgatttttttgtgcttcgaatatggatgtgaaagactctccgggtgtatgctctaccggggttttcataatgatcttagcgggatgtggagggcctaagactcgtcatgctgagcatgaggcnnnnnnnnnnattcttttgtgcttcgaatatggatgtgatagactttccgggtgtatgctctaccggggttttcaaaactattatagcgggatgtggagtgcctaagactcgtcatgctgagcatgaggcgatggcatgaagctcggccgcgaccgatatgactgcccctagcctcagcggggccccagtaactgcacggatagtcgatatgggtcgcaagattatcaagnnnnnnnnnngagcctgagcggggctccagtaagtgcacgcatagtcgatatgggtcgcaagattatcaagaagcagctgaaggaggtgctagttcagcggaaggtcgtgcaagcgcccaaatccaagcccgtcaccaagcgcaaggccaagaagcaggccgtcgacctccccaaggacccccaggcagaggctgatgcgctggaggctggcctcaagtattacaagcggacatccggcccctccagcaagaccgccgacctcatttctcaggtgccgggccagtgtcacctgagtgtggtgttcagcatgccagtgtgctgtccttgctctgggccaaggtcctccagcaagggtgcaggtgcgcacacaccccacttgaacgccacgcctccatactgttgtagatcctgaggccatcggcttgagcatcaaccagtcagggactctggaaggatgcgcnnnnnnnnnncgggtgtggtattcagcatgcaagtgtgctgtccttgctccgggccaaggtcctccagcaagggtacaggtgcgcacacaccccatttgaacgccacgcctccatactgttgtagannnnnnnnnnatcggggtggggcagcgggcccactttgcagcctcagctcccctggggcgagccccgggcggnnnnnnnnnngtcggggtcgggcagcaggcccactttgcaatctcagctcccctggggcgagccccgggcggcggcaaggcgtgcgctgggttgacaccccagtttcggggccggcagcctgccagaggccgcgccagggcatccgacggcggggatgccccgggcgccgctttcctgcgccagttgnnnnnnnnnncgacaccccagtttcggggccgccagcctgccagaggccgcgctagggcatccgagggcggggacgccccgggcgccgctttcctgcgccagttggccgaggcgctgcaacaagccacgggcgccccccctgccggccacggggcgtcggtcagcgtgcgaggcgtggcattccaccccccaggtgggtgtgaattcgagggggcttgccctgcatgtgtggcccagcttgctggtgcaaccttttcgaggtctcgacatgatgcatggcgtgggcgctgctccacacgcgtcatgtttggcnnnnnnnnnntcttttcgaggtctcgacgtgacgcatggcgggggcgctgctccacacgcgtcatgtttggcgtgcagtcccccctcgtcagctcgcaacccacactggttcgcctcagcccagcactcgtgcgccccacaatctcgcaggcgcggcccggccgctgctgacgggcgtcagcctggacctgcccgccgacagcctgagcgtgctttccgggcccagcggggcggggaagaccacgctgctccacgtgctggcgggcctgtcggaggccacggccggcaccatcctgctgggcggggccgccgccccttggccggccagccccgcgcccgccgccgcccctgcccgcctgcgtgccagcggcgtggtcttccagttcccggagcgccacttcctgggcagcacactggtggaggagctgaccctgggctggccggagacggggccgggacgcacccggctggcccagcgcgcgcagcaggtgctcgccgctgtgggcctatcgagcaccccactccaggccaggctgtccagcctcagcgacgggtacaagaggtgggtgtggggatgatgggactggtctcgtgggtggatacaggaggggagtagctgcgcggctgtttgtccggccatctttggggagggacacctcgagcaatcttccatggccagcgtacgatatctcgtggaggcggtgatctgacggtttctcnnnnnnnnnncaatgggactggtctcgtgggtggatttttggaggggagtggctgcgcggctgtttgtccggccatatttggggacggacacctagagcaatcttccatggccagtgtacgatacctcgtggaggcggtgatctgacggtttctcagggtgtagagagcattgtttatcgattttaaacccttgaatatccatgagaaaacttgcgaaatctcgcggaccttcgcaggagggtggcgctnnnnnnnnnnctcatcgaatttaaacccttgaaaatccatgaaagaacctgcgaagtctcgcggaccttcgcaggagggtggcgctggctgtacagctgatacagcagccccggctcctgctcctcgatgagccactggcgggtctggactggatggcgcgtcgagatttgctgaccctcctccagaaactaaaggggcagtgcaccatgctggtggtgagccacgagatcgcggagctaactccattggctgacgcggtgtggaggctgggagacggtggacgaggcgcgtaccggctggatcagtcggccattacggcgctgaaactcacctcaggagccgatcaaccctgattcttgcaaataaggacctgaaatttgaagttgatttctcagtgctcatagagaaggtgactcaggaggtagtagccccgaccgactcagcctcgtcagccnnnnnnnnnntgacctgaagtttgaagctgattctcggtgctcataggaaaggtgactcagtaggtggtagccccgaccgactcagcctcgtcagccccgttgccgagaactgccccacgtgaactgggttattcacatgggtagtcagccccaccaataattttcgtaacacctcttatacaatcgcaccagccatcaccacttccggaattgcaattgagcccacaacatctcccagacacctttaggactttgttttgtggtggccacatacatggagaacgacagccggtgtccgccaacgcccgtgcgcaccaaggtgtgcatcaaggcccccctgcgcattgtggggttcgacacctctccgacctcggttatatgcacaccacggcgagaggagggtgcggcaactccgcatcccccggaatccgtcctgggcctggcgttgagtcgggagcgtcagggcttcccccgcctcaccatcgcctgcccgtccaagttcgacacgtccgctatgaagaagtccaagtccacggccgacttgtaccggcacatccaccacttcgaggcacgcaccccacgccacgctgctgcctccgcctctggctcccctcccggatcacaacccagcagctgctgctcgaatcccatccgcattccttcaaggtgaggtttggaggggtctagggggcatggcgtggctgggaacgggccctggtgtggcgcatggcgcggcgttgcctgtaccgcgctgcctcgccgaggcccagcgagccagnnnnnnnnnnagtggcgtatggcgcggcgctgcctgtactgcgctgcctcgccgaggcccagcgagccaggacacctcaccggaagcctcctcccttgccctggctgcagtccctctgagcttcgacgtcgccacagcacgaggagcttcacctgtgcgagcgtgacggaggagaccctgcctgcctcggggcatggctatgtcggcgccagaagctgggcagaagctgccgacgcctgccctcccacatgtctagcggccgacccccacttcctcccgccagacgcacaggtcaaggtgtgtttggaaagcgatacgggactgattcaggcgggctgtagtgcttgtgaacaccagaatagagtttgcccgcattgaagcgcaccgcgctgctctctccagtcattcnnnnnnnnnnggatacaggactgattcaggcgggctgtagtggttgtgaacaccagaacagagtttgcccgcaccagagcgcaccgcgctgctctctccagtcattcatccagcactttgcatctcacccacttccttccccctcccctgcagcagccaaaggtatcaacactcgtcctgcccctcattgaggagggtgatccagtgctgcgcgactgtggcttccttgccaagtttgacatggacgacgagcccagccttgcatctggctccacgcgctgggccctgccccagttcgcctgagaatccaagccaatttttctagagtgataacgaataactccttgctgctcactgatttgcccaacctgtagactcctgcatactgctgtaccctcatgttgcttttcgcacccctgtcaagacccatttttggnnnnnnnnnncattgctgtacccttatgttgctttcgcacccctgtcaagacccatttttggccttgaaaccgccaccacccggcaatcttgcgctccgacatacttgtcaccattcatacctttcatggccccccagtctgcaactgcgctgagtgtgatgatagaccattttagctgagggaccacgagaggctaaggaaggtggcggggctgcacgcctggtgctagcttacaaaggtgtagtgcttccacctcccatggagggcccgnnnnnnnnnnttcttagctgagggaccacgagaggccaaggaaggtggcggggctgcacggctggtgctggcttacaaaggcgtagtgcttccacctcccatggagggcccggctcgctatctcataatcttgaaccaaaaccatgaatgaaccctgtgggagcgggtgttgaagcaatttcgtaagtcaagagcatcctgccgatcgcgtcagagtatcctgagccgggccaagccttcctggtaaattccccaagatggtaaattctgtctttcttcttagacgcaaccttgatggggagagtgttcgcctctacgcccctgcaacctcgggaactttgatggcgtcacgagaggttggtcacgaataactcgggaaagacggggtcccacagggatgacgctggtggaccctcccccacacccgccaccccgggcccgtacggcctgacttcttgggttccgcacgtgcctctgacgactagcaacagaccattgctccccggaatcgaagtagtccttccattacaacatcgaggtgagaacctcgatctgtgcgaccctgtactgaagggcgaattgtccttgcatgacgcgcaacctgggataatccctgcgatccatagccgtgcccgctcgaacgctgccccgacgcccccagcccccccctcccccaggcgcccccaaaacatccccaagcgtggtgtgtggggagagaccccccccctgccccccaggagtcgggcggcatggnnnnnnnnnnacccctcccccaggcgtccccaaaacacccccaagcgtggtgtgtggggagacccccacccctgccccccaggagtcgggcggcatggacgccaaggttgtcgcacacgacagcggttcgacttccaccgccagcggaggcgctgggcccaaggaccccctccgcccagcggtgcaggcgtcctggatgctctcaggcgacaccgccacccagtacgggaagagtgcggacgcacccctgcccgggctggggtcccagccggaggcctccgtgggcttccaagccagggtccaccagggcatgggggagctcccggggccctcctccaccgcgaacattccggtcctccccgacattgcccggctgaaggacagtaggagggacatccctctcacctgccaggtgctggggtgtgggcagagcctggtgggccacgccgattactaccagcgctatcgggtgtgcaagccgcacctcaagggccccgccctgatcgtggagggcctcccgcagcgcttctgccagcagtgtggcaggtttcacccgctggatgcctttgatggggacaaaaggtgtgggcttgcagttggagtcgcggggaggggggggcggggtgaatattcaccatgaatcgtgagctttgcgatctgcgtcgctgacagtcaatggtgcctggcgggtgttatttctacagctttgacgccagtgctgcacgccttctgtgcctgacgagnnnnnnnnnngggtgaatattcaccatgaatcgggaactttgtgatctgcgttgcttacagtcaatggtgcttggcgggtgttatttctacagcgttgacggcagtgctgcacgccttctgtgcctgacgagggctctggaacccattctggggccatgcgcccagggcagtcccaggccgacacacagcctgcccaccaccacacgacgacccccgcaggaactgccgggcgcggttggagcagcacaactcccggcgccgcaaggtgttcaccacgactcaggccagccggaggcctgctgggaagcgggaggagcccctgcactccgctggccccaccagcggcgactgggcgggggacgcccacctcgccagctcggccccctcccaaggtgcggctggtgtgtgggatgagagtgttttgggtgggaggttgggggcctggccagggcatcactctgcgtgtggctgcacgcgcgggagatgtcactcgtgagcaggtcgctccctcgtagaaagacaggtgcccctgtccacccttgccgccaccgagccgctgcagcaggcccctcccatcttcaagcaaaccacaacgccgtgtccacctgtccctccgcgccgcagacgtgatgcagcctcacctcgccggcctcccccccagcctcatcatggacctgcaggccgataacctggcccaggaaagcatggcgcagcgccaggcctcatcagagtccgccctggtgagtcgcacggctctgctgccccagcaacagatgttgacagtgcggatgtcccacgtcaaaggcccccgccagcctccgaagaacgctcgtgctgcgctctgcaagacacagacatccgcccagtccactccttgggagcacaatccatgtgcaccccccc

SEQ ID NO: 42080 - DNA, 15981 bp, Chlorella protothecoides
  modified_base (479)..(488): a, c, t, g, unknown or other
  modified_base (687)..(696): a, c, t, g, unknown or other
  modified_base (810)..(819): a, c, t, g, unknown or other
  modified_base (1091)..(1100): a, c, t, g, unknown or other
  modified_base (1856)..(1865): a, c, t, g, unknown or other
  modified_base (2077)..(2086): a, c, t, g, unknown or other
  modified_base (2746)..(2755): a, c, t, g, unknown or other
  modified_base (3344)..(3353): a, c, t, g, unknown or other
  modified_base (3788)..(3797): a, c, t, g, unknown or other
  modified_base (4125)..(4134): a, c, t, g, unknown or other
  modified_base (4623)..(4632): a, c, t, g, unknown or other
  modified_base (6476)..(6485): a, c, t, g, unknown or other
  modified_base (7020)..(7085): a, c, t, g, unknown or other
  modified_base (7744)..(7773): a, c, t, g, unknown or other
  modified_base (8202)..(8403): a, c, t, g, unknown or other
  modified_base (8534)..(8543): a, c, t, g, unknown or other
  modified_base (8900)..(8909): a, c, t, g, unknown or other
  modified_base (9937)..(9946): a, c, t, g, unknown or other
  modified_base (10277)..(10286): a, c, t, g, unknown or other
  modified_base (10662)..(10671): a, c, t, g, unknown or other
  modified_base (10981)..(10990): a, c, t, g, unknown or other
  modified_base (11598)..(11607): a, c, t, g, unknown or other
  modified_base (12245)..(12254): a, c, t, g, unknown or other
  modified_base (12736)..(12745): a, c, t, g, unknown or other
  modified_base (13356)..(13365): a, c, t, g, unknown or other
  modified_base (13645)..(13661): a, c, t, g, unknown or other
  modified_base (13790)..(13799): a, c, t, g, unknown or other
  modified_base (14460)..(14521): a, c, t, g, unknown or other
  modified_base (14778)..(14854): a, c, t, g, unknown or other
  modified_base (15689)..(15698): a, c, t, g, unknown or other
gcgccgacgcgcaccgcgaggccgccatctgggcgctcatcaacctggcctggggcggcgaggacgacggcggcgcggcggaccgcgccgcgcgcatccgcaccacgggcgccgagggcgcgctgcgcggcctgcccccgggcacgggccaggcggtgctggagcgtgcacgccaggccctggacaagctgaagctggagccgctgctgggccggcgcgggcccagcgatagcctggcctgggaggccatggcggacatggaggatgagtagtctgatgcgcgagctcggaagcggggccggcgaggcagcggttggaaagcgcggaggagcgtgtgagcgaggcccccgcagcctgcgccgccgctggacacagggcctgctcagcgtggctgcgcccaggggcgccgcagctcgtgggtcccaccccgttccttgcccagtctaccccacatcccgccgccgctccgcctgccccannnnnnnnnnggcgtgctcggaaggggggccggcgaggttgcgattggaaatggctgaggagcatgtgagcgaggcccccacagcctgcgccgctgctgaacacaggcctgctcagcgtggctgcgcccagggacgccgcagctcgtgggtctcaccccgttccttgcccagtctactccacatcccgccgccgctccgcctgccccannnnnnnnnngtaccatcctgtccccagcgccccttcaagccgtttctgcaccctgagcccgcaccctcttgtacccagccatcggcacacacgacgcacacggcctgctcctgtacagacgcnnnnnnnnnnttaccatcctttccccaacgcccttcgagccgtttctgcaccctgagcccgcacccacttgtacccagccatcggcacacatgacgcacacggcctgctcctgtacagacgcgcctgccatcagcattttctcctgaccacgcaagtcaatggtggctgtacacaccctggtgccgctcggcaccctagcgtcgaaagggaccaattgctgcagcccacatgcgtgagcttggttcgctggtgcaagatgacccacgtcaccagcctatcgnnnnnnnnnnaccgctcggcaccccagcgtcgaaagggaccgattgctgcagcccacatgcgtgagctcggttcgctgatgcaagatgacccacgtcaccagcctatcgccgagccgcccgcccatcccgccagtcgcgggcgccagacaggcccaagcgacgcagcgtgacgcacagcacgaccacggggacgcaggcagccagcttgatcgccgcggtcaccaggaaggtggcctggaaccccagacgctctatcagcacgctgttgggaagggggcacaggggtggggctgttgatggggtgtatactcagcccggcacagcacagggcggtcgaatcactccaccgtccacacaaaaggccagtcagctgcccctccacacgcgccccgcctcaccctccgagggccgcagagccactccaggagaacatggttatgctctcgaaggcgttcaccttgccacggtactgcttgggcaccacttccatgagcacgctgcgcatgaggggccgggtgctgttggccagtgccgttcgtaggaggtgcacggtcagcatggcgggcgccctggctgtggaaatgaaggccatgctgctgagcaggcccacgtcaaagagtctggtgcagatggatacctgatgatgggtgggcgattggggtgagggaggggcggtgggtgcaggatcatgtgcttcaccccagtgcgtgggggtctagagggcagggcttgcaccaagagtctgcaggtttgcgactgttggannnnnnnnnnaggtgagggagaggtggtgggtgcaggatcatttgctacaccccagtgcgtgggggtctagagggcaaggcttgctccaagagtctgcaggtttgcgactgttggagccccgctcccccgccaagcctctgccacggtcaagcccccaggccttcttcatgaattttatgaacccaagaactacctcacctccaccctgccgaccctggcannnnnnnnnncccaggcattcttcatgaattttatgaacccaaggattacctcacctccaccctgccgaccctggcagcaatgcgctgggcggccgcggcggcaaaggctacgccgcagggcgccgcagctgccacggccgccacggtggccggccgcagcctgcactgctccaggaaaaatattgcaaagaactttaccgtcatgcctgaggccagcccgctgagcaggtccgacagggtcagcagcagcgtgacaaagacggccggtgggcagcaggaggtaggttgggcggcaggagtggagaggagggggaagtccagctcactgccagggtcaatcacggtgtttcgctccatgtcaagctccgggtctgggccgtcggtgcacccctccgcattggaggttggcgcaccgctcgcatcagggagcctgccaggagaaaggagcgctgaggatccttttgattgtgaggaattcgcaccgcatggcaccttgcagatgtcttgtcctggtctgcattcacgtgcacatcaagacagggcaaggactcttttgctgtccattgcagcgtatgccaaatatctagcacacaccgtatgatgctcactctcccctcctcattcattgcgtacaaacgaaacccttcctgcagctcacgtcacggcctnnnnnnnnnntaaatatccatcacacaccggatgaagctcactctcccctcctcattcattgcataccaacaaaacccttcctgcagctcacgtcacggcctcgctggcatggcccagggcaaggtcgtcgttgaagaagagcatcagcaccaggggtgccagcatgaggagcaggcctgcctcgaccacggcccggcagtcccccgtgcgccagcggtttcccagcctcaggaagacgaagaaagaaagaagttgcccgcttccggcggcaagcacggtcacgatatactttttggtgtacagtgaactgctcatcgttggggatggaggggagggggatgacgagtgagaagggtgctgccactggaaaggttggcggaaatctgtcccagatccatctgcaggtgtattgctgatcccagaagggaataacatgcttcaatccgagcgcattcaattcaagtggctctgtcgctacactgatgagttcccaatccaacgcaaacagtgggagcaaccccttacctgcggcccgcctcgacgctgtctgcgaagatggactccatggccacagagtgaatgccgcggtagatgcccnnnnnnnnnngtccaacgcaaacagtgggagcaacccctcacctgcggcccgcctcgacgctgtctgcaaagatggactccatagccacagagtgaatgccgcggtagatgcccagcaggccagcacacaccgcaagattgacgatcgtgggggccaggctcatggtggtagccagggtacctgctgcaagcagccccagcacggctccagagcgtaataccatgtcccgccgcaggatgtcacacagatagccggcaggcacagcggcggccagctgcagatgtatgcatggattgcgggtttacagttcatatgctctgtactttgaggacagagatgctccttccgtcgacgatgcacggtactaccacatcaatggggaagcaaggtgttccaccaaccatcattgggccaacctgtgagatgccattgatgccctgaatnnnnnnnnnngtttgaggacagagatgctcctttcgtcgacgatgcatggtactaccacatcaatggggaagcaagttgttccaccaaccatcattgggcaaacctgtgagatgccattgatgccctgaatgatccccacagtggaggtgcgtctggagatgaggtagatataggctgacaacgcgtcccctgaccgaacagaagccgacaggttctcaaaccagctccaccaaaaggtgagctgtaaggtgacgtgggggacggggatcaattttgccatcaggggattgagctttgtgagcgacctttgagaatcaagcatgccctgcaaaccttnnnnnnnnnntggggagcaatctttccatcaggggattgagctttgtgagcgacgtttgagaatcaagcatgccctgcaaaccttgacattgtgattgagtggcatcttaagctcccatggcgcgacaccagaataggtggggagcctctgcagccggcaatgtccagcttgcggcggtaggcatattcaagcctcccaaacttcagtcatccgattgttcagaaagaggtcgccttggctgtgagtcacaatgtctaatgtgatactatggtcgtttcattcacgggcatctacaaatcaaacctctggcgtaggtatacgtttgccgatgacttgggttccgcgtggggctgtttattgtccaggttcaatggaagggatccccatgctccccttttgcatacttccttgtgcaataaatattcacaataaaaatttgatcaggccgcacttcatgcatccattctcagagcttgagatcgattcgtgtcctcctcnnnnnnnnnnctattgtccaggtcccatggaagggatccctatgctccctctttgcatacttccctgtgcaataaatattaacaataaaaaattgatcaggccgcacttcatgcatccattcacagagcttgagatcgattcgtgtcctcctccacgttcgccgagttctccttgtcgtcctgaacattggtggggcaacaatatgctctgggtgtgacagctacccacaaggtcccatatcagacgaataagaaggagccctcaagtccccaaggcaactttgcactccacctcacctccaaagctcccaggtactcgtatctgaagatgaagcccaggcccagtgcgacccacaagtgccggcaatcagaggaaagggccacgctggtcaccggctcgtgcagacgcacaggctccacagctgccaagcacttgccagtcgcagtgcaatgaacgaacgaccgacccagcatgttaccctgtgggtaattgtacaggagcatcaagagttgactgctggcttctggaaggcagcgtatgcagggatgactcaccgtttggaaaccgctctgccctgctgaacatatttctctttccacccaagcagcatgctttttggcttggtttagagcatcaaccctactttgaatcctttcacccaggcctccccacactcacaactgcaatgtagttgccatctggtgttgcagccaagcctgagcccgggtacgtgccatctgggacccgccaggtggccactggctcgagagagggccaggaaagcacggccatccgaccgtctgctgccttgatcgccaggcggcctccttggagaggtcgctgcgaggagtgaggttggagctggggtggcacactgctgcctaatggctctggaatcactggtcttgaaggacaagcagcacaagcttgtatgcatcacaatcggtttgggcagcatagaggctactaaacctcctccaccaagggaaggtagaaagccacggtacctgagccccctacagagctggctctacacaccaccccgcccttgcataccaggcaatccagggcggcagactggaagccagccttgctgggaaggggcaactccgtcttgtcccaggcagtatcagcagagccactgggagacagtttccacagcttgccacgacgcgtgcccactaagaggcactccccatctgggctccatgcctgccactcagatgcaagcaggggaggcgagcagtcatgatgttgccctgcgctggacacggccagcagaattgtccctgcaggggccactcctgcctacccacgcaagacagacccaagccgcacagggaacatcaaccatccctgagcacctggcaccaagaccccgtcctcaccagactggcggcatgcgaggtgctgcagggtcctcgctgtcgctccgatccgaggtcccacagtgccacggaaccgtctgaagaaagggccgccaatgctcctggttgggaaggattggcagccaggtctgtgacagctgccacatgcccctgaaggagcgtcgtcacgcgcgcctcagccatggagatgatggacacagcggcatcgtccccggcaatcgccagccgtgcatttccatggcagcctggctccgtcgtctcaggcatggggtgcagccatgtagctgcccgcaggttctgtggcagggatggcgacgaggcatgaaatggggcatctgtgggaagggacagtcagggcactggtcctttatggtgctctggtgacatggtgcaggcgggcagcgagcgagtagggccaatcatgtccgcagccgcaggcaactcaccccgccaggcgtgtgggcnnnnnnnnnnttctggtggcagggtgcaggcgggcagcgagtgagtagggccaatcatgtccgcagccacaggcaactcaccccgccaggcgtgtgggcggtggcagagttgacaaactgcacggcgacgctgacgtgatcggccaggtgggtgccatcatacaccgtagcatggttcgagccgatgctggctaccaggtttcctgccccaggagtggcactgcagcatgctaggcctgtcacggctcctccatgactctcctgtcgtcacagaattggacagggccagtggtgagcaccatggggaattggctgcggatgaatgcaccctctaagttgagcagaacaacagcatatacaatgccgccccctcttcccacaccgtctcgcaccttgatgacggtcttgaggcgcaaatttgccagcgcatgtcttcggtatgcatcgagcccgcccagtagcttgacctcggtctcccgtgctctgttcgactgcgtctctccctggttcatcggcagcgcattcagaacagggagggggggggnnnnnnnnnnnnnnnnnnnnnnnnnnnnnnnnnnnnnnnnnnnnnnnnnnnnnnnnnnnnnnnnnngtacgcgtcaaactccttttattggttttcggaacacagcataccgccgctggatgcagcgtcgagtttccccgtacagagttggtgtggctgcgttcgaaatgtcgaattacgctccaggagtcccagatcgcgcgggatctaaattagtaaaatcccgacgacagatcgccgacccccccccaagactgattattcacatctaaaatcctcaaatcagttgcaaacaatgcgcggtgtgcccccgctactcgaacccctcggagggccccttcaccattgccgacatagtggccgccaaggccacagtccactgtacctactacaataagcctgtggcgcaggcaaccattcctccggagtgcgtgtatgacttcctgcacggcgagggccgcatggtcaggacatccttccatctgaaggcccaccccgcaaaccaggttcgaattcgaatcacatccaatggaggcccgtaggatgagcatgcagcccgtcccctttccgctgcactcagtcccagctcttcaacacacacgcaggactggttgtcaatcgagtgcttcaggtgcgcccgtggtcccataaagctcgagtggctgatgaaaagggcagcgccagccagcgtgaagggcggacgagcctgtcgcgccgccgctctnnnnnnnnnnnnnnnnnnnnnnnnnnnnnncgaggggcggacgagccaggggagcctgtcgcgccgccgctctgagcagaccggctgcccgcatacatttacgatcaagcagctgaggcaagactccaagaagagcattgtcttctaccctgacattgggcattcgggccacagtgacgccactttccagtgtctgcgcctgtcccggtgggccgtcgacctcgtggagtctctgctggccatcaacccggcctttcgcaatcccagcattgttgcctcggtgcgagaagctgcgcaaggcagggataagtttggccgtctacaccagtgtggccgaccacttggccttccagcaacaccacccaaatctgcaccagagggattactcgagcaccaacaaggagattgcgtgagctgcaaggtagggttgctcggtaccaatcacctgcaccttggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgagggtggcctccaccacatgttggcagctgtgcaggaggacaagccggctccagcaaacagaggtgagctgcgagatgtgctaggtgttgctgtgccagcagagtgccatccgagcttgcatcccnnnnnnnnnntgttggatgggtagccatgcagtgtatggcctggcctctggatgcctctatttcagaggagaggctgtcctcacagacgcccccccccttccttgcagcgcaaagccttcctagtggtcgcgatggactcgggaaatcgggtgcacaacgggtctgtggcgctgctgcggcatgagcgagtggagggcatccagtaactccgcgcggtgcgcaagaaaaggcaccgtggccgcgggggtcgtggcggcaggggcggcgccaccggcgagatcggtggcgctgctgctgctgccgacagtggcgctgctgctgctgctgctggaggagctgacggtgctgccggcggaggggctgcannnnnnnnnntgcggcaggagccggtgccagtggcagaccatcacttgggatcactcccgaccaggtcacaacatccaaggagcctgacaccaaaggactggacagtaccattggcccacaccctgtgggcagtaacagcaatgctccaccactgctcagcatcccggacaacccggcgccttcacccaagagcgatccagaagtcaaagagaattcaggcggctggcggcacgggttcttctagtcatggagaagggagcgcaggaggagcgcgctgcactctgcaagtaccttgtggaagctaatacacctgtgctgcttggtcggctgataccattccctacgagcggcacgtcaggtgcaaagcacgccgcatccgctcccaccttgagaggggaggcggcacgaggcggccgactgcttcaatgggcatatcaaggccgagggtgaccttgcacctggtgtgattcccatctttgtacttgaatagacaatcaagcacgtaggcagtgagtgtgtgtgttgggtttgggggggggggggggggggggggcccccccccccccccccccccgcgttccactgtaatgcccgttgatgaagctgtacacatggagtagatcccgccctcgatcgggcaaatgatgtcccccctcgtccaaccccttgcactagcaaggccccgacaggaaagcgggagacaccgtgcacgaccgatgcatgcccacggcgttctatcgctctgtactcgatactcttccgtttctatgataatcacatatagaatgctgcatcgtgcgatgctttgtaacccctgcggaccacggcaggccttctcgtaggggtgagatagatcgggccctagaagggactctcggaagcctatagaacaatacctggcatttgtgttcatgactcaaagatgaatgggctacagtggcacctgactgagcgattagtactatctcaggatggccgatctgggactcctggagccagtccaggcagatagtgaaaacatcagcactgccaacaannnnnnnnnnaccgaggtggtggaagcctgcaaaatttcggctctttagcctctgacgagccagtctaggtagatagtgaaaacatcagcactgccaacaagactggccgtatcgcttgtcatatccgtcgttactgtacctcggtaaattagcagaattggaacatgttccaacggcccacccacctccccatgatgtccaggcgccaaaattcgccacacgtggtcttgtaccatcaggttcgacatgtgtatctgccagagctcatgcccatcaaaagatcgctttgttaatttgtaatgggtccggaagtccgcggggttgacgtggtggagaatgnnnnnnnnnnagttactgtacctcggtaaattagcagaaacggaacatgttccaacgcccaacccctcccgatggtgtccaggcgccaaaatttgccactcgtggacctctaccatcaggttcgacaagtgtatctgccagagctcatgcccatcgtcagatcgtcttgttaatttgtaatgggtccgtaagtccgcggggttgacgtggtggagaatgggtccctcgagtcaggtcgagatgtcccggggttgtttggccacaaaggccagcgtcgacccagcctggacagcgccggacctgctcgtaagactgtcaagacggcgttcgtccttccactgaagaagaaaggccatgtttaccattacaggtcggttcgaccaagnnnnnnnnnnagacctgctcgtaagactgtcaggacagcgttagttcttccactgacgaagaaaggccctgtttaccattacaggtcggttcgaccaagagcttacatcgtagcgacaacagacaaggttgttcgatcctgccgcgaaattgtcgtatagcatgggatctcgtggatggatttgcaatcttatctttccaggttacaggttcgtgacacccttccttgtcaatcagccacctgctcgtttctatatcgcttttcatcgtcttctccgacccacagtaagcagtcgagcgaagcaagtacacggcgaagcnnnnnnnnnngtagcatgggatctcgtgaatgtatttgcagtcctatcttccaggtcacagcttcgagacaccctcctgtcaagcagccacctgctcgcttctatatcgcttttcatcgccttctccgtcccacagtgaacagtcgagcgaagcaagtacacggcgaagcccgtcgtttgccgagaccccgcccacgtcggctcccagacgcgccatggcaccgtgagtaccggaaacgtacagtgggtgcagtttaatgaggagattggtggtgggctgtggtggtcttggcgaagggagcgggtgggaatgtgtcctcgtgtgcatggagacatggcatccggttcgtcgtctgtatcatctgtcctcctccccgacatgatgactcagcgacgggaacccccccacctgccacagggagcgatctgtgatcaagaggctgaggcccaacaactgggacccctctcaggaggtggagtggaccgaagacaagaaggagcttgccagggagcgcaagaaactggtcctggatatacccgagttccggcagtggcgccgtccttttgaactcgacctgttggaggagcagcgcatctcggaggaggcgaggcgtcaannnnnnnnnnccaagaggctgagccccaacaactgggacccctcacaggaggtggagtggaccgaagcccagaaatgggatgccaggaagtgcaaggaacgggtcctggacatatccgagttccggcaatggcgccgtcctttcgaactcgacctgttggaggaacagcgcatctcggaggaggcgaggcgtcaatcgctggcgactcgacaggaggctgctgccgccgctgtggaagccccgaggtgaggaagaatgtggtggtgcaatgtgctgggtcctcggggagaagggggggtatacccgggagatctgacggcagtacaattgttggtatacacaggttggcctgatgggtgcaccccttgcatcggccgacagctttgtcacttctgctctgcacatgtcttgcagtgagttgggtggacacactccacccttcagtggcgtgcctcatgccaccggcggcactgcagtggaaccttcgacggggcgagtggatgacggcgggccctctacaaggcaccccggcacctcctctgaccaggtgaatcgattttgattgagaagggtgaatgcttgtggcctgtcaaagggacggggattgataatgacggttgcatgttacaaggccaggcttacatctgnnnnnnnnnnttcgattttgatcgagaagggtgaatgcctgtggcctgtcaaaggggcggggattgataatgacgtttgcatgttacaaggccaggcttacatctgattctggacgacacaaccccccccctgacaagcctccgacccttatcctgggctactctgtgtttcgaccattgcagatccccggcctggcccagcacgattcctcctccgatgaagacccccccgctgaggtcgtccaagaggagcagcggcttgcggaagctatcttcagcggaggggacgaggagttgtcgggtggcaccttgccagagcaagtactcaacgccagggtgagacctagcatctgacggggttgggccgtgtggagctctcctcggttgtcgttctgtagactctcggcatggtgcgaggcagaggcttgtggcctttacaggtgtacacgagcacccaaatcccatgcatccatacactcctcttgggacacnnnnnnnnnngtcttcggcgatgcgcccgccgagcagacgggcggcacctcgccagagcaagccctcgacaccagggtgagaccgggcatctgacgaggttggagcgtgtggtgctatccttggttgttgctctgtagactctcagaatggtgtgaggcagtggcctgtggcctttgcaggtgtacacgagcacccaaactccatgcatccatacactcctcttgggacacacaggatgccgcggtctctgtggccgctcgcgaggcgctgaggcgccgaaaggcaaagcgcgagtggaagaagctgcagtggaaggctgactgggctgcggccaagaagcgtttgatcgaggagggtgtagagataccccagaaactccgcgcggtgcgcaagagaaggcatcgtgccggggggggtcgaggcggcaggggcggcgccatcggcgagatcggtggcgctgctgctgctgcagacagtggcgccgccgctgctgctggtggaggggctgacggtgctgccggcggaggggctgcaactggcggaggcgctgctagcgggggcgccggcgccagcggagacccgggcggcactgctgacccggccaccgctgctgctggcgnnnnnnnnnngggggcgtgggcgccggcggagaccccggcggcgctgctgacccggccaccgctgctgctggcggggggctgggcggcgctgctgctgctggcctggttgctgctggtggtgggggcctggtcgctgctgccgaatggggcctagccgccactgctgcaggcgggggagcggacgtcgccagaggcgaagccacttctaccggcggaggcgctggcgctggcgccgccacagacccgcttctgccgcatagagatcgcctcttcccgctcagtccaggtnnnnnnnnnnnnnnnnnacagccatgtgatcgtgaccctcacgatgctgtgggaggtgctcaaaagcatcaacatggcatgccggggccaagtcgctatgcgcacgggcctgaccctgcccggtcgtagtgattgataagcgtatnnnnnnnnnnaggggcgcgggcgctggttgaggtccgggcggcgctgctgacccggccaccgctgctgctggcggggggctgggcggcgctgctactgctgtcctggccgctgctgctgctggtgggggcctggtcgctgctgccgaatggggcctagccgccactgctgcaggcgggggagcggacgtcgccagaggcgaagccactactaccggcggagtcgctggcgctggcgctggcgacgccacagacccgcttctgcggcacagagatcgcctcctcccgctcagtccaggtcgtgagggttgttaggtcagacacgtgactgtgaccctcacgacgctgtgggagctgctccaccgcctcgagatggcatgccggagccaagtcacaatgcgcacgggcctgtcactgccccgtcgcagtgattggaaagcgtatacattggacgggttgagatatctcgggcggggggtagcatgatcggaattgcagtgcgagtatgctggtgagagggatgggaaccctgtctatccatttatcaacaaccccattacacatggactttgttgcttcttgattttttgcccataactttcctgcctgctcggagtgttagctcctgccatttcctccaggcatactaaacacaccctcctcacctcttgcnnnnnnnnnnnnnnnnnnnnnnnnnnnnnnnnnnnnnnnnnnnnnnnnnnnnnnnnnnnnnngcgaatgggtcgctctgggcagcgttttggtcgatcggcaggaggtccagcgcaatgggggcctcacggtgcacttggaatgggtgtactgccatcaacttctcgattttgagaggtttgaagagggcagcttgaggttcagcggcacctgggagaccgacgggtacgctgtcaatgtcaaaatgtggcggcccagcaccgacgtcaccccatctcgcccgcgcttttgcccgcgcttcgcctttggcgcagggggnnnnnnnnnnnnnnnnnnnnnnnnnnnnnnnnnnnnnnnnnnnnnnnnnnnnnnnnnnnnnnnnnnnnnnnnnnnnntgtagccgtccgtctcccaggtgccgctgaaccgccagccgccctcttcaaacctctcaaaatcgagaagttggtggcagtaggcccatcccaagtgcaccttgaggccaccgctgcgctggacctcctgccgatcgaccaaaacgccggccagagcgacccactctcccggggtcagttcctgggcgtaaaaaccgagcgcacagagggcctgcaagaggtgaggagggtgtgttcagtatgactgaaggaaatggcaggatctaaaactccaagcgggcaggaaaggtatgggcaaaaactcgaggagcacaaagtccgggcgcaaggggttcattgatagatagatccagagcagttcctgtccctctcgccagcatcctcgtactgcaagttccggtcccccccccccctccacacaccccgagatgtctcacctcgttcaatgggtacgctttccaatcactgtgacggggcagcgacaggcccgtgcgcattgtgacttggcccgggcatgccgtgtcgaggcggtggagcacctcccacagtgtcgtgagggtcacggtcacatgtctgacctgataaccctcacggcccgggacgagcgggaagaggcgatctctgtgccgctggagtgggtctgtggcgtcgccagcgccagagcctacgccgcttgcagtggctttgcctctgccgacgtccgctggcccgcctgcagcagtggcggttagggcccctttggcagcggtgacctggcccccaccaccagcagcagcaaccaggccagcagtagcagcaccgcccgccccccgccagcagcagcggtggccgggtnnnnnnnnnnccagcgccagcgccagcgcctcccccggttgcagtggcttcgcctctgccgacgtccgctcccccgccagcagcagcggcggccaggcccccttcggcagcagcggccaggccagcagtagcagcgccgcccagccccccgacagcagcagcggcggccgggtcagcagcgccctgctggcagtggcagctggagcatcgggctgctttccagccggctcacggcgctacccggtcttgcccgcagtcttgggtttcacagccccatccttcacgggcgtctt

SEQ ID NO: 42081 - DNA, 4904 bp, Chlorella protothecoides
  modified_base (112)..(142): a, c, t, g, unknown or other
  modified_base (1018)..(1027): a, c, t, g, unknown or other
  modified_base (1299)..(1308): a, c, t, g, unknown or other
  modified_base (1677)..(1686): a, c, t, g, unknown or other
  modified_base (1781)..(1790): a, c, t, g, unknown or other
  modified_base (3061)..(3070): a, c, t, g, unknown or other
  modified_base (3491)..(3500): a, c, t, g, unknown or other
  modified_base (3907)..(3916): a, c, t, g, unknown or other
  modified_base (4087)..(4152): a, c, t, g, unknown or other
  modified_base (4237)..(4246): a, c, t, g, unknown or other
  modified_base (4837)..(4846): a, c, t, g, unknown or other
tggccgtgcgcggtctgcgccggccgtacgcgccacgcgcgacgcagcgcgctgcggcgcacgcgcgcgcgctggcaggggccgtggcggcctgcctggacggggcggcggnnnnnnnnnnnnnnnnnnnnnnnnnnnnnnngggccgtggcggcctgccaggacggcgcggcggccgcgcgagagctgcacctcctcctcgcctgctgcatgaagctggaccgcgcctgggccggcgagagcgaggcagtggacgccgagctgtggagcgccaccgctgccgccctgcacattgtcgtcggggcggtcacccgggcgctcatcgtgatcgacgccttccgcagcagtcaggaagacagcaaggggaatggcagcggcgaggcgagccaggcagccacgccgagcgagcggcggagcgctgccgttcgatctcccaccccagaggccgtgctggacgtcggggaggtggtcgctgccgcgcgcaccgccgtgggtgtgctgctgcagatcccagaggcgctggccgccgccgaggccggcaggacggccctactggccgggcggacagccgcgctggaggccgacgcggcggcagcggcagacggcgcggccgacgccacggagcagatggcacacgaagctgcacggcagctgggcctgcagggaagggccgccgcggacgccgcggcgctcgccgccggcacctggaaggccctgcagctggagctggaggccgagggcgccatctggcgcccggcccagagcgctgcgctctggcggctggacacgggctgggaggacggcggccgccggcgccggcgcctggtacgcctggtgcgccgcccgatctactgcgacgaggcggggcggggcgaggaggaggtgttggaggatcgctccggccggtctggagtggggaatgacggcgaggaggagggagcggactgcccgatcacgaccccggcgccggcagagcccacacccactctgggccgcctggtggctggcacggtcatgnnnnnnnnnnaactgcccgatcacgacccttgcgccggcagagcccacacccaccctgggccgcctggtggctggcacggtcatggaggtgttggcgggcgagcagggggcacttgctgaggtggaggaggagacgggtgcaggagcgcgtggcgaggagcacgggcccgatcgaagttgcgatgtggatgcgcagtcgtccatgtctttgcgcaagacggcggtgggcgggcagggcccatcgcagccatggggccaggacggcaccgaggatcagcagcnnnnnnnnnntcctgcgcaagacggcggcgggcgggcagggcccctcgcagccagggggccaggacggcaccgaggatcagcgggaggccgcaagcccggcccgcccgggctcgggcatgcctgcgctggtcaggacggcgctcaccgcgctgccggcggcctggcagagcacgctgactggcggctgccaactccccgacctgagctgcgagctggtctggccggggggcgccttacccggctgcctggatcttcggtctgcggctggaagtctgcgcttctggccgagcgacactggcgatctttgtgcggggggtgagggcacagatactggtacccaggagcttgccgaggaggcagaggagaccggcgccgcannnnnnnnnntgatgtggggtgtcaaggtggaaggagaggatgggaggggatggtggtaattgttggaatgcggcatgttccagtgcccctgctggggaccggtnnnnnnnnnnggagggcaccgatactggtgcccaggagctcgccgaggaggcagaggagaccggcgccgcaggatggcgctggcggctggaggaggtcgccgccatccaccacacgcgccacctcctgcaaccagttgccttggaggtcttcttccggggcggcagcgggcagggtcccgtgctgctcagcttcccctcgcagcgtgcaaagcgtgccgcctgcgatgcgctggcacgggcgtgcccccaggcccaggtcctagacgaccggcgtaagaaggaaaggggcgctgagctgcagggagcctggtgcaggtgcgatgtcgatgtggggtggcaaggtggaaggagaggatgtgaggggatggtggtgattgttggaatgcgacatgttccagtgcccctgctggggaccggtggcggtcagcagtgcacccttggtatcttgagggaggatgctcaccctttgagaaggactgcattaggggagagcaccaatgttacacttctcaatctttcagcaacgccaatgaagaacatgggaccatctggtcatccatgaagccaagctccctgtcccctcgcttgctccaggtgggaaatgagcacctttgactacctcatggccctcaacaccctggctgggcgcacctacaacgacctcaaccagtacccggtgagggtgggtgtcaagaatcactgttggcacgatcaacttgcatgtgtgactgggcgagcggtccacgccccaggctgatgccagagctcaagtaccccgctgcaggtcttcccctgggttctggcagactactcttcccccactctagacctctcagacccgactgtataccgtgacctgaccaagcccataggtggccggctaaacttgagcattctggttgcagggtggaccgttcatttgtggtgcaagcacctccttcctgcttttattcgctgctgcaaccatctcccaggctgcccactgggatggtatcagccatgatgtagtgatttgacgatcctccatccgtctctcgctgctcaggtgctttgaacccacatcgcctcgcctcccttcgggagaggtctgcatcgctgatccatgatcccgatgtgcccccatttctgtacggatcccattactcctccgctggatcggtgggctgggaacacctgttgtcgggatcatgtgacgtggagttgtgcctgacacaccataagggaaatgcctcgtgggagttccagagagttcttgtggggccacagggtcactcagacgnnnnnnnnnnttaccttgtgggagttccagagaattcttgtggggccacagggtcactcagacggcacatgcagattccctggtccaggggcaccctggcaacccaatcctctctccatcttaatcccaggtcctgttctatctcctgcgactggagccctttacgcgccatgcacgtgcgctgcaaggcggtcgcctggaccatgcggaccgcctcttccactctttggaggcaacatggcagaactgcttgaacagcacttcaggtgaggtgtgggagtcgtcttgcgacaagcaacagggatgtaggtggagggatgccctgcttgcttgattgtctgtatggtagcccgttggccagcactccaaaatctcagcatatcttgaagggtacagctgagtgcaacggcatgtgcatcatggaatgggcnnnnnnnnnngttcatcttgcgacaagcaacagggatgtagatggagagatgccctgcttgcttgattgtctgtgtggtagcccgttagccagcagttcaaaacctcagcatatgttgaagggtactgctgggtgcaacggcatgtgcatcatggaatgggcaaccccagaatgtatctgcatgcagcctcactgcatgcataatgtcctctccgccaaccattcacaaccctccacacactgtctgcagacgtgaaggagctgactccagagttctactatctaccagactttctagagaacggcaatgcgtaccacttgggcacacgccaggtgggatgggcaaagttgttgatgggctggaggaggagagatccgcgtgctcaatgcgctgtgttgatcttgggctgtatccannnnnnnnnntgaagtatttgatgggctggaggaggagagatccgagtgctcgatgcgctgtgttgatcttgggctgtatccaagtggctgctgtccagtctgaagcatttccctgtctccaacctttttactgcttgcgccctttcctccaggatggcgtgcggctgggggacgttcagnnnnnnnnnnnnnnnnnnnnnnnnnnnnnnnnnnnnnnnnnnnnnnnnnnnnnnnnnnnnnnnnnngtggatagacttggtgtttggttgcaagcagcgaggtgcgtgggtagatcagtggaacatgtgagggtgtctgtgtgtgcatggnnnnnnnnnnattccctgtctccaacctgtttactgcttgcgccctttcctacaggatggcgtgcggctgggggacgttcagctgcccgcatgggctgggacctcgccccacaccttcatccacgccatgcgggaggcgctggaggggccccacgcctcagcctccatgcaccactggatagacttggtgtttggatgcaagcagcgaggtgcgtgggtggatgtgtagaacatgtgagggtgtctgtgtgtgcatggcagtagatgtgccagctttgcggcttgctgtgttttgagggatgatgagtgcagggatgcatgcctgtgcagagcacgcatccataccctgctcccgaccccttggtcaaatcccaagtccataaacataccccctcgaccccaaaatatcaggccctgccgctgtggcggctgacaataccttctactacctcacctacgaggatatggtggacctggatcgaattgccgacccggtgcagcgcgccgcggtggccgctcagatccggcactttggccagacgcccagccagctgtttccccggcggccgcaccccccccgccgcccgccccccgccccctnnnnnnnnnnagctcctgacccctcggtcaaatccaaatccataaacataccccctcgaccccaaaat

SEQ ID NO: 42082 - DNA, 68 bp, Chlorella protothecoides
gtactcgataatctaccagtgcactgacaactcaacataacaatctgcatcgcgcggcgcgttcgcac

SEQ ID NO: 42083 - DNA, 61 bp, Chlorella protothecoides
gtcgaagggctccggcatgggatccgaggggggcgcaagacgtgggagggggggcgcacga

SEQ ID NO: 42084 - DNA, 62 bp, Chlorella protothecoides
cctcattcaaacgtcctgaggagaacatccaacccccccccccacacacacacacacctgcc

SEQ ID NO: 42085 - DNA, 71 bp, Chlorella protothecoides
ctcagggcctccctgttttccccgccacaggcccccacccccatggcgacgctggagccatacagtaaccc

SEQ ID NO: 42086 - DNA, 61 bp, Chlorella protothecoides
ctgcgcgacaccctcgagggcctgatgcaggccgaccttgatcacgccacgctgggcctgc

SEQ ID NO: 42087 - DNA, 64 bp, Chlorella protothecoides
cttgtgcgcctcgtaccacaccgccgcgctctccttcgtgaaccgcgccctggagaagcggatg

SEQ ID NO: 42088 - DNA, 26240 bp, Chlorella protothecoides
  modified_base (111)..(120): a, c, t, g, unknown or other
  modified_base (423)..(432): a, c, t, g, unknown or other
  modified_base (2352)..(2361): a, c, t, g, unknown or other
  modified_base (2916)..(2925): a, c, t, g, unknown or other
  modified_base (3577)..(3586): a, c, t, g, unknown or other
  modified_base (3833)..(3842): a, c, t, g, unknown or other
  modified_base (4399)..(4408): a, c, t, g, unknown or other
  modified_base (4673)..(4726): a, c, t, g, unknown or other
  modified_base (4883)..(4892): a, c, t, g, unknown or other
  modified_base (4978)..(5013): a, c, t, g, unknown or other
  modified_base (5482)..(5604): a, c, t, g, unknown or other
  modified_base (6337)..(6346): a, c, t, g, unknown or other
  modified_base (6633)..(6642): a, c, t, g, unknown or other
  modified_base (7894)..(7903): a, c, t, g, unknown or other
  modified_base (7984)..(7993): a, c, t, g, unknown or other
  modified_base (8305)..(8314): a, c, t, g, unknown or other
  modified_base (8578)..(8587): a, c, t, g, unknown or other
  modified_base (9464)..(9481): a, c, t, g, unknown or other
  modified_base (9697)..(9706): a, c, t, g, unknown or other
  modified_base (9769)..(9778): a, c, t, g, unknown or other
  modified_base (9853)..(9862): a, c, t, g, unknown or other
  modified_base (12496)..(12505): a, c, t, g, unknown or other
  modified_base (12667)..(12743): a, c, t, g, unknown or other
  modified_base (12857)..(12866): a, c, t, g, unknown or other
  modified_base (13030)..(13039): a, c, t, g, unknown or other
  modified_base (15336)..(15345): a, c, t, g, unknown or other
  modified_base (16598)..(16607): a, c, t, g, unknown or other
  modified_base (17353)..(17362): a, c, t, g, unknown or other
  modified_base (17837)..(17846): a, c, t, g, unknown or other
  modified_base (18475)..(18484): a, c, t, g, unknown or other
  modified_base (19162)..(19171): a, c, t, g, unknown or other
  modified_base (21041)..(21050): a, c, t, g, unknown or other
  modified_base (22287)..(22379): a, c, t, g, unknown or other
  modified_base (22450)..(22459): a, c, t, g, unknown or other
  modified_base (23502)..(23511): a, c, t, g, unknown or other
acgagaagagggctgcgctggcgccgggcgtggccccccaggcccgccgggcggctgtgcgctccgggtcggctggggttggaggccgtgggccgagcgacgcgcgcgccnnnnnnnnnncggccccccaggtccgccctgcggctgtgcgctccgggtcggctggggtgggaggccgtgggccgagcgacgcgcgcgccgcggcggcggggagccagcaggaccgccgccaggtctggcccagcggcgccgctgccacatggtccagatacacctggacagcgcgtcgattggaggggagatcttggggatgcctgaggggcatgcttggaggatactccaacatgcggcgccctctccaattgcacagcaggtttttggtccggttcagcgcattgagggcagcgccacatgcgacacgannnnnnnnnntgaggggcatgcttggatgatactccaacatgcggcgccctctccatttgcacagcaggtttctggtcccgttcagtgcattgagggcagcgccacatgcgacacgatcacccaccctccaggtagtccagcccttctatccccacgtgcatcgacacccagccagcccacccacaggaaacacacacctcgtacgccctctggaagggctccaggggcagcgtctccatggactgtgccagctcgagctgcgcgggggaggccagctgctggcagtcgccggggtcgcgtgggccaggcccctccacgcaccgcatggccccggccagcgtctccacagggcgctgcagcgccgccgtcagggtcagcaggtactggccccacgccagttcggcggcccggcgggcgtggggcagccgcaccggagcgcccgccgcctgctgctccgccgcgctcgcgtcctttgccagggcggcggctgtgtgaatttgtgtgcttgtgttcgtgaagggtgacaaggagaacagcatgcggatgctggttggacaagatggcctcacttgggttctgagtctccgtcatgacctttgagtgctgaggatggagaccctgcacctcggcctaagcctcccagatccctaatgcccccctcctccctcctccccattctgcacacaggtacgcaggcccccacctgccgcctggagcgtctccaggttccccgtctggcccaagagggacaggtacagggccagcgtcttgtgcgcacgccgccagaaggcgcggctgccttcctccaggccgttggccgccgtgcgcggtggcgggcggcccgcgccctctaggccatcttcatttgccatggtgccgcgttctgagccatcgcgtgattcaaaagcgccgtatgtatcgacagcctcgccaccctcgggcatccctcgaccagccgtcgcctcgtcccagacgccctcgccgccagcccgccgcccttcatccgcctgcaggaggcgtgcgcgccagtcggcgcccctgcctgcgccctcgtcaccctgtgcgatggggaacatattgaagacaaaggcctgcttggccttggaaaacagcggcgcgagctcggccgccgcggccgccgcctcgccgcgcgccgccagcaggcgcgccgccatcgccgcggcgaggtggtggtgccggtcccgccccaggcaccagcgcatcgccgccagagcgtcgtcggcgagcgcgcgttctacaggcgcgccccccgcctcggactcgcgcacagcgtccgggtcaaaggcggtgagcagcagggcgcggcgcaggcgcgcagcctcctcgggcccgctgccgccgcgcttcgcacccggcaggagcagccgagcccgcgccgcgtgtaggcggaacaccggctccaccaggccgccgcacagctcttgcgcgctgcgcgcggcggccgcgaagagcgccagcgcctcgcacggccgctgcgctttccatgtgcaccgagccaggcccagttgcacggtccaggcgcgggggtcgcgctcgagcgcgcgccggaagtgggcgcgcgcactgcgcaggcgggagggatcggacggcgggccgttgggccgagacgcgagagggtcgctccagggcagggcagcgctcaggtctgccatgcacctgcgccaagaggtgggggcgggaagaaggctgacgaggagggcttcgatggccctgctcgatgtctttggctacggtgaggggatgcagcgacctttactttggaatggcgcctgggactgcacctcaaacatcttggcaaggaagtggttgctgcctcaagaaacaccgacgccatgcaccggacttcgcagcagtgagccttccccccgccccaaacagagccccacgctggagaacaccgtgaccacnnnnnnnnnnccgcagcggtgagcctccccccccgccccaaactgagccccacgctggagaacaccgtgaccacaagcgtcacacgcactcttcggccacgagcttgagcaggtctgccctggcctccaggtcgtacgtcacgtgggccgcgatggcagcgcacacgcgggtcagccagcggtaccggtcggccctgcgaccggcgagtggacacgtggtcgttgctccatgacagactcggggcggatgcaggcatcctggtgctcctttgtcgcaggaaggatcagagaaacaacacgtcatcccgcaagtgcaaatgagcagccaagcatccgatcctccctgtacactctggccatcagcccatcgttgcgtctcgcctgggccaatgagcttccgcagacagccactggtctggcgtgaacgtgatcgtggcctctgtctgcaggggaggaaggcggagggacggtgatgtgtaggtgcagcccgaacatgttccgggaagtgccaactgtgtctcaagctaggatgccgatctggagcaactcagcatgccccacactnnnnnnnnnnagtaggtgcagccggaacatgctccgggaagtgccaactgtgtctcaagtttggatgctgatctggagcaactcagcatgccccacactctccagcatccaaacaagcccctcaccagcagtcgctccgaggcggccgcatatgcgtcagcgagcagcttccatccaaagtgggtttcgtccggcgagtacagcagcgtgtgcttggcgagctggagcatcccctccagctccgcatccaccgccggatccagggcgcggccagcgggtacctttggcacatggtttcgagggattggggtgatcacccgagctcagaggcgtacgagcccatgctcacggccacagcgcaggttcatgcaagggggtccgtgcacttccccagccatgactcacctctgcctcggggctgatccgtgtgaggaggaagtagaggccctggcgcaccggatccgcgcccgtggccgctgcagacgaaggaaagaaatccctggaggacggcacgatgacctggggaatcctgcttggccccccagcccattgccctgcagacgctgcagccagcacgccgcctcagcatccagccggtattgacacacagcacgtccgcaaacccaccctcccggcgcgcaccggaggatggcaggggaggnnnnnnnnnnctgacacacaacacgtccgcacaccctccggcgcgcaccggaggatggcaggggaggcagtgtgctggggtcgaggaggtaggcacctgcatcggcctgcagccccctgccctccagctccctccaccagtgctgtgcagcggccaggagctccacgggaggagccccgatctgccggtgcacggccctcaggaagcctggatggggttggtactcatgtaatgatgtgaggcccaggccaggcatnnnnnnnnnnttgtgcagcggccaggagctcctcgggaggagccccgatctgccggtgtacggccctcaggaagcctggatgggcttggtacttatgtaatgatgtgaggcccaggccaggcattgtcatggcaggggcagtggggtctcatcaagtcgcaaagggaacgtcaagcaagccgctggcactcatgcgacggccagcgtccgtgcttttggtcagcacgctgacagcagtacccctcagcagcccccttccaacccgtgtacaggagcgccgcgccccgcaccggcatgtcgtgtcaacgcctggcggctcagcccctccagcattgggaacaccaggccccacaccgctctgatctccgcttccccaaggactgcccagtcctcgcccgggtcgtcaaacgcctttggcacagtggggagggtttctgttggcgaggccatgcatcaatgcttgagaactgaaattagccctcatcaacaaagacactgccgtgggccccagagcatggcgccccgcctgcagcccgctctaccagcagccacgcgcgttaccttgannnnnnnnnnctggcgccccgcctgcagcccactctaccagcagccacgcgcgttaccttgaaggcgcctgacccccaaaccccctcgtcctggtccagctccgggaagtccagcgcgcagagccagtgcaggcaggcccggatgccctggaccacctgctccagcagcactgcattgcatgaggagggggagtgcgtcagggggcttacgctagactggctcaatccacggcgcggctggccgaggcagagcccgtgagacatagtagacctgnnnnnnnnnnnnnnnnnnnnnnnnnnnnnnnnnnnnnnnnnnnnnnnnnnnnnntctgcgacagaccctgcaccctcctccgccccccttccagatccccttccttggtcctccgcatcaacacccatatccagacagcatcccacctgcatcggcggcatctacctcggcgcccgcctcccagctgcctccaaggctctcccagatgaannnnnnnnnncctgcgacagaccctgcaccctcctccgcctcccttccagatccccttccttggccctccgcatcaacacccatatccagacagcnnnnnnnnnnnnnnnnnnnnnnnnnnnnnnnnnnnngccccctcccccgcggcgagcgcgcccgcttcccccagggcgacccccagcgcgctcagcatgctgaccaggctcgccgcaccctcctcccgcctgaccattcggaagagctcctgcacaaccaccgcgaggtctgcggcggcggcggcgcgcagggccgtcgctgtgaccccgctttcctcgatggcatctgtcgcggccgctacggcctcggtgccctgcccccctccgctggccagggcctgcaggcagcccagcgcgcacagcgcgacgcacgtcgccatggtgtggtccggcgcggcggcctccagctgcagcccactcacgctggcgggcagggcgagctccagcgcgcacagcgcgcgcgcgccgccggccagcgtgcgcagcgcgtcggcgtcgcccagcagcgggacagggggggtctccgctggcgcatctaagcggcggtcccgcgccgccccgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggacagcggccagcaggtgcaggtggcactgcagcacgcgctccgagtcgcccaccgcctccgccgcgaccagcagccgcgccatggcctcgcgccagcgcggcggccgcggggggccacgcccggtgtcgaacgatggcgcctccaggaggacaggggccagcgcggcgaccacgccggcctcgccctccacgcccagtctcccctcggctgccgcgtccagcaggtcgcggatggaggcggcgtgcaggcgagcctccaccgcggcgggggacagctccggggtcaggcggcagtgcggcagcgggaccacctgagcggggccggctcgcagctcggcacccgcggcctcaaaggcagagcgcgcggcggcgcgatcgccccgcgcctccagcagccgggccctggtccaggcgaggcgcgcggctaggcagggcggagacggcgcgccttctattgcacgctcgccctcaccagccggccaggctccgggcatggccgtggccgcccgcgccagcaaggcatcacagggctccagcagccgcgccgccgcgccggctgcggccgcgccgtccgcccccgcctcggcctctgcgcgatccaagaagtactccgcgagcaccaacgcgacaggcggctccagggcgtctgcgcctagaccctgggcgccgactacgtgcctcgccagcgccagcacagcgtcccggccctcgggcggcagcgtggccnnnnnnnnnncgggcgccgacgacgtgccacgccagcgccagcacggcgtcccggccctcgggcggcagcgtggccagggcctggtgcgcagcgcccaggcgcgccagcacctccacgcccaggctcagccgatcccagtggggcggggcggggggcgggggtgcgccgggtgaaggagtgctcaggccttgcgcgggccacagcagcccctcgagaccctgtgtggatgttggcattggtgcagggggggcgccaggcccggcgccacgctcatcttcttccagggctccatcccnnnnnnnnnnagggccatagcagcccctcgagaccctgtgtggatgctggcattggtgcagggggcgcgccaggcccggcggcacgctcatcttcttccagggctccatccctcgccgttgccgcctcaccatcgtccctcagcgcatcaacacgtgtggggccagggaaaaggcaccaaagcgcccccaacctcgctcggccctcgtcctcggcgccctcgtcgccacccggctgcgactgggtggggtcgtcgcccaggccccgcgccctgggtcaggtgggatgagcggtgggcggccgggaccaggggcggaaggggatggtaaatgccatgccccatcttgacacacccgcaagccctcacctggacctggtcagcttggcaggcgcggcctctgtgccgccctcccccgccggctgggtcgcgtcgccgccgcctgcgtcgacctccgcatcaccctcctgccctggctcgccaggcactgcacccggcgcccccatgccgcgcgggctctgctcccccgccgtatgcccctccgttctctcccgctccagcaatatcaatcggtcggggccctcctcgcacagcgcagagccggcgcccaggaaggcggccacctcgagcagcacgggggtccagtcgcggggcaaagccacgctgcgcacgctgggctctggcagggggcgctccgcctggtaggccgccggcagcgcggcgcggaaggccgtgggcgccgccgcgtcccagcgcctgcccccgacagagcggcccaactcctcggcccaggcgccgtcgcccacgtggctggcgatggccgccgccttggcggccagggtggggtgggccgggtccagctccagcccggcctcggcagcccagcgtgccagcggccagcgcccctcccgccccgccagggtggtcaggcggctcagcaggaccgcgtcgggggggcccaggtcgcaagcctggcacaggcagtctagggccgcggggccgccgccgtccctgccggccagcagggccgccagctgcctcagcgccagcacacgcaggcgggacagctgctccacaccccccctctgcaccgccggctcgcgcaggatgccccgcagcagggtctgggatgtttgatgggtcagggggaatgtagaagggtggtacgaggcgggatcaggttggatgatgcgttctgtacacagatatcgcaggagaaacagtccgcccgtctggatccttggcgaccccctccccagctcacnnnnnnnnnnattttatgggtcatggggaatttagaagggtggtacgaggcgaggtcagattggatgatgcgttctgtacacagatatcgnnnnnnnnnntgtgccgatacacatacacacacacctcggcctgatcgagcttgcccagccttgcatggtttagggcggattcgaaggcgcccaggatccgcatctccagcgcctcggccgtctcggcaccccgcccatggggcccgaggctggcgctgttgatggccgcgaaggccttcagtcgcaccatctgggaattatttcgtcacaacatgacggtgatgggtgaatcaagcatgcaggtacccaagtgatggctaatcagatcacattgcaccgggacttgctcatttcgtattctcggggcgcgcgcgcgacacnnnnnnnnnngagtcgcaccatctgggaatgatttcgtcacaacatgacgatgatgggtgaatcaagcatgcaggtccccaagtgatggctcatcagatcacattgcaccgggacttgctcgtttcgtattctcggggcgcgcgcgcgacacatcagatcggacggttgtagatgtacatgtccacaaggacgtgaagcaacaagggttcgacatttgcccaggcgggcatgcacgccgtgccgggttcattctggtacagttgggtacagtgnnnnnnnnnntaaaagctcgacatttgtacaggcgggcatgcacgccgtgttgggttcattctggtacagttgggtacagtgtctgagagcgaagaccaaggcacctcaccggacgcgcatgccgcaggcctccatgggcaggcggtacagcctccccgggacatagtttgggaccacctgcctcatgtgatcctccgccaccagcctcagccagccctgggagcccagggccgggagcacgccctccggcaccaggccgtgccgcaggaagtgctccacatccgcctcgtgccccgcgccggcgtcggccagggcgggccccggcgtcacccggtactcgtgcacacgtgggaggtgggacagctcctcatcgcagcgcaccacctcctccaggcggagcaccctggcgtggtctcggtaggtgatggcccacatgtggggcccgtatccctccgccatccacaggccggccaggggccggtcctccgccgggccctgcacggcaccgggcacccgcaggccgtagaggcacacgtccgcgttctcgccccactccttggtcccccggctccgccgcctggagctcgtctgcatggtgctctgcacgtaggcgctgtaggccgcatcaaagtcggggtcacccaccccggcctgcgcaggtgggtacagggatgggggtgctacatcggtgatggcatgctggtgctgttcgggccctggagtagtcaacgggaccctccctgagctcagacaggagccttcgtaagagcaccagtgagtcatgtgcgtgcagatgcaccagagccccgctgtctccctctggatgagcagaaacggggcaatggcttcttcaacagtccttcctgcaggcaccttcccccacatnnnnnnnnnnnnnnnnnngccaggatcctggagccgtcgtctggcaggctgaactccagccccttcctgcccttgctgcatggcgcaccaatgaattgttgtgaggcagagtgggggggctggcagacgcaccatcgagcatcgagtgtgcatgtaacgcagcctctcgagcatgacacacgcaagcagatcccgcaaacaaaccccctccgcatcactcaccccgggtggatnnnnnnnnnncccaaaggatctgaacactcaccatgtggtttgcgtgtgtttgaggcacgctgacaatgcgannnnnnnnnnggtgcggcgtctggtgttggttggagaccatgctgcaagagggggacccgagtgtggacacgcaggcacggattnnnnnnnnnnacatgggggggctggcagacgcaccaccgagcatcgagtgtgcatgtaacgcagccactcgagcatgacacttgcaagcagatcccgcaagcaaccccccctccgcatcactcaccccgggtggatgcagccccactgctggcggcgcatgggcccctgcatgacccggaagccgtcgatctccaagccctggggcacaagccggaagcgcacgatggtggcctcggggatgacctcgccgttccactcgcagcagcggctggtggtccagaagccgcagatgcgctggtagtggcgggccagcaggtagacacccctgttgttggagcgggcggggtctggcgttggttggagaccacgctgcaaggaggcgacccgagtgtggacacgcaggcacggattcccaggtcccctcctcgcatcctccagggctcccctccccacctgtaggtagtggggcacaggtgggagttccagggcagctccgccttgtaccgggggttgagccagtcggcggggtcccgcaggctcaggtcacggaacaggtccaggcacagatgcttccagatggcttcattcagcagcgcgcgccggacaccggagctcagcgtgaggcaggaggtgcagtcccgcaggccgaggtggcccagcacgagggtccacacctccgggctcagctcctccaggcacattacgcccccgccgatggcgtgtcgatgttcgttgccctactcgcgcaagtgggtcaccccgacctggggaggggcatgcctaagagtccggcattcctgcccccggtcagcaggggagtggcgcaccaggatctgacggccgcgctttcgtccaactggttcaaatcgccggcacctggcaacaccaaacacaaccagcaggtgactcagagcggtgccgtccgtccacccattggccaatcaaatgataggcttctacaacgcaagaacagtgcagcctcatgcacacaatgcctggtccgcgctgcggggctcaaaattcgaggtctgcgagagaggcgatgcgcaggaggcaggcgctgtcctccttgctgacaggggcgttgccgggccgcagcgtcagcgccaccctccacccagcagcgcccgccgcgcgtgcctctgccaggctgtcggtggcaaagagcacctcgtccgccgagtccacccccaggctcagggcgatgttctcgtacgacgccgcctcaacctgcatgtggtagggatggatgtggagggtggtctggtagaatgtgccatgtgcagagcagcgccacacaaccgtgctcgacctttacccacacgagccagacccgggcccagcacctccccaccttggcgccgctggaggtgtcgaagaagccggagaggagggggcgcaggtcaccatcagcggtgtgcccgaacaagtctcgctgggcttgcctggcaaggggaaagattgggtgaagcggctgatgcaggcctgctccctcctccaggctcccttccgacacatgccacatcgacagcaagtgtcctctggaagcctgtcgccctcttgaagccgccacccacccgcactgggaccatcctcaccaccctgaacccacctggagcccgaggagtagatgtagagcttgatcccggcgcccgcccagcggcggagggccggtgcgacgtctgggaagagcgggcacgtcagctcccccgtcgcaaacccctcggtccagatgtggccttgcagggtcttgagcgccggcgtcttccggtccgcatccatctccgcggccgcccacgccgccaccgccgcgacctcctcggccgcgtcgccctcccgggcggcgggcgccaggccggggatggccgacccgttgacctgggcaggtggggagggaggccccggtgatacattgcctaggctgttgcggcaggtggatcgccgaccccgctcaaccacccacgagcctgcgtggccacaggcgctaccgcctgccatgcccagcaggacatgagctggaaccctcaagccaggccctccaaataatacatcccacacagccaaacgcacctgctgccgcagctgctgcaccacggcctcagtcgcgggcgtgccccagctggcctccagatggctcctcagccgcacacgcgcataggggaacagggtggcggtgacataggagatgggcgccacggtgccctcgatgtccagcaccacagcgcggggcacgccacgcgctgcacgctttggccccggcgcggacacatcgagcggcgcggcaccgggacgccccgcatcttcgacccccacggcaggccggctggcgtcgaggcccagctggcgcaggcgcacggcggcctcgaacaggtactcgtagcactcggcctgcgtcttggcctggatccagtcgcgaccccagacgtagacgccgtggcggcggaccagcactgcgcgggtgcgggggtaggcgcggatggcggcctgcagccgctccgtcagctcgcactcccgcgccgtgttctctatgatgggcaccaccagggtgtcgaagaagccgtggccctcaatgccctgtttggattatgttggggggggagaaagaatacatagctctctgaggcatgagaccagaggggtctnnnnnnnnnncatgttgggggggaagaaagaacacactgctctctgaggcatgagaccagaggggtctgaacgagacactgcaaggatcagatgtttgcggcaagcagcgctccccgtgtggctgtgagctgatgtcaaggtgcttaccccaagggacgcacacgcacacannnnnnnnnnnnnnnnnnnnnnnnnnnnnnnnnnnnnnnnnnnnnnnnnnnnnnnnnnnnnnnnnnnnnnnnnnnnntgcagcaccgcccccgctcctgccaggtcgtacgcctgggttggggagggtagggagccaggattgcttgcagagccgacacaccatgcacaccatgaccgaaaggcgaatgannnnnnnnnncaggatcgcttacagagcggacacgccatgcacaccatgaccgaaaggcgaatgacactcctgaacccagcgagagcaccacccccagccatctctacaaccacatgtgactcaatctgtacactcaaagagtcaacctcacccttaccgactggaagaggggnnnnnnnnnnggagcaccacccccagccatctctgcaaccacatgtgactcaatctgtgcactcaaagagccaacctcacccttaccgactggaagaggggggcgcactcgctcagcttgggaggtttgtaggggggccctcgtggctcaggggtgtgcgtcacattacccttcaggtccagcacgaacatgtcctccggccgcatgcgctccttctgcacaccagagggcgccatgaccagggcgtcccccgccttgatgctgatgccaccaccggtgccgctcacatggcccccggcatacatgaccccgcacaggtcgcatatgaggtgcttcgcttcctccacagtcgtcatggtggcgttctattgccttgaggttgcttctggagtgaaggattgctcaccgacgagttgtgaaattgataccgggttggcatctttcactagggcgcgctcaaacacatatgacagcgaaggaggttgatgatcgccaccatagatggcttgcatgagattgacgtcgcgatctggtgttgttgttgacatactgttagcttgaagaatgtgtaattgggtgtaacgtcgggagcgtctctccccagcctgcctggaccttctcctgcctgcgatggcagacctgcagaacacgcacacacaagccctgaagctgatcctgtccctgcgaacagggatcgagcgcctggaactctccctgcatgtaagagtgaggcgtttggcatggttacgccggtattatctccctacggggtcttggtcctcaaccaccccacccccgtaccctccagaatggccgtgccatcccactcgatgggcaggtcaaagacctagagcgacaattggatcaactgcaggttggcatgtgttcttagggatagcgtatggcttatttcctgtcacatgaccccttctacaccacgtgacatagcgccctttccctggagctcagtccacccgcctgtgcatacacagcgcctggcgcaggacctggagtcgcagtggcgcatgcagggtctgcgcgatccccctgcgcggcgcgaggtctggaagcgcaaggtggaggcggtggtggacgaggcggcttccttgggcctcgccctccgccgctgctgcgaggccagccaggcaaggcaggccgaggcgacgcagcgcgccgagctcttccagggcgcctcctcctcggggcaggtgctggctgacatggacaccgcggcgcggcgccacctggcaagcagcaagcgtgtgctggaagaggcctacgccacgggggcgggggtgctgggctccatgtccagccagcgcgaaactctcaaggtgagagggcggattttgtgtggtagggtgggggtggaggggggcaactgatctggggagcctccttcatgcatccagccccagcgctgcgcctgggtccagtactacaggaatcgattcccttccccaccctggacccccttcccacatctagacggcccagcgccggctcctggacgtcatcaacagcgtgggcctgtccgattcactgctccgaatggcagaccggcggcaccgcatggacaagctgctggcctacggcggcatggcggccacgctactgatggtggtcctgctctactggtacctgaagatgtagaggatctcgccagcgggaaggtgcagggatgtgcggcggtgatgcgccatacctggcgtctccagcccggtgccgtacgtccacacatgctagggccggacatggagtgaggatccttgaaagccgacatgaccctgggccccgtcgacgctgcgcccggatccctgggagggagttggcacgctgcggccccctgcggacacaggtcgggtttgctcggctgtgtccgactccttgacatcctcccgctgcgctgtcgccaatgaccatctgggatgcacccaatgtccctgttcagtggaggcgtcagtcgcactccccacccttcctcgcaggggtgctcccggtgtgaggcggccatgctgttgtcgttgcagcgatgtcctgggcttccccctggcgccagcatttccaccccctccaacatcccttgaatgcacctacccacttgctcccagctgcgctgtcgtactcctattcttgcaaacggacgaccgtaaaacattgaacacaaacccacgcgtccagtggaacctcacagtccccacaccgcctcatacaacttggtccaggggctgcagaccggcagggggtgcacaggggcaggcgccacatactgcgtcggggcgagggacttcctggtcactgcaggtnnnnnnnnnntgcctcatacaacttggtccaggggctgcgggccggcaggggttgcacgggggcgggcgccacatactgcgtgggggcgagggacttcctggtcactgcaggtctccctgtcgcggcggcttctcgcccggccctcccttctgcggcctcatccagctcggcctgccggctggcatccacggcccggaccccgacgatgacggaggacgacacctggctgccgtcccgcagcagggcccgctgtgcgccttgcggcgtctgcgaggggaaaggtggggtgaaggctcatgctgtggccccagatacaggacagaggtgggacgcacagcccattcccattgccatcgatcccgccgtccacaacccagcacctcaccgcgaacttcatgtggagccagttcacgccctgcccgtcgccgtaggtgccccagtgcagcaggtccccgcaccgccccagctctcggagcacgtcaggtaggtcctcaggcccaaacccgaaggttgtgacccagcagccggcgtagggggcaggctgaggggcggggcgcagggcgccggcgtcggcgtctgcccggccgggcgagcaggtgtccatgggagctgggccggtccctgcctcaccgccgccggggctctcgtccatcaggctgctggtggggggtgggggcggggtttcccgtgccaggccgctgctggaaggggttagggagcgccggcgtgtttgggcgggggtagcgtcccaccgggggccccggctggcctgctgcccaaacagggaccccgacgctcgaggtgagcgcaggccgccacgtagatcgggggtcctggatccatcccctgttttcagagaggttggggtgaacagcaggctcacagggccggtggggccgctgtgcgccccagccatcccgtgctggtgtcggcctcctcttcgatgcgctcgatcgatggcacctggatctcttgaaaggcgcagggtctggcctgtacggagattcctcaaatgttatagtactgtggcagacaagctgtgcagggccgcacggactcctttgagtgggtaggggtttcgaacgaacttcgcgccctgacgtggacgacgcacttcaccgatctcgtccatctccaggtctggtacaccaggcgatacggtttcatttgcagatgctatcaacccccatacatgcaccacttcgacatcccatcacactccgtccgcgaggcacaagtcagcctactaccactgctgcacnnnnnnnnnnagacgcacttcaccgatctcgtccatctccacctctggtacaccaggcgatacggtataatttacaaaagctatcaccctcatacatgcaccactacgacatcccatcacactccgtccgcgaagcacaagtcagcctactaccactgctgcacgcacccccacccaccttccgcgatggcggggtatggcatggggggttatgtaggcaacacccatgacaaggcccgcatcacacggcaggagaaggaaagggaggaggccaagcagaagttcgaggaggccaagcgcaaggcagaggagggtgccggtctgaggaagtttggggcagggaccacagaggtacggcgctctcgagatcgattgttaggaggagtaatgtgctgtcagtatacgcttcgatagacattcaagaagcgaggcatgctgccgcctgcgaacccttacaccgtcccaccctccacagacactggagacagcattcaagaacgagacggtgggactgttcacacgacaagagtttgtcgagaagagagctacaattggagatcgactgcaggaagagaagaaaaggcaacgagctgcagaggaggaggctgagtggcaggtctgttggagggatcatgtgctgtgcttgctgcatggacaggaggtttccaaaacgtcgagcatgaactggaggctcagacctgaagctcaccaccaaaaataatggcgcatgcaggagaaagagcgacaaaaggctgnnnnnnnnnnagttacaaaacgtcgagcataaattggaggctcagacctgaagcccaccaccaaaaatgactatgcatgcaggagaaagagcgacaaaaggctgtcaaggccaagaaggaacagaaacataagctgtcctttgctgaggatgaggaggagcctgaggggtcggatggagggagggatggggtgtcgggtcacgccccaagcacatcggtgagtggtgaagggatgtgaggagggtaatgcagaggaatggcccaatgcaagaattgccgatgccatgagcggagaatgcctgtctagaggctttgcatgattgttggtctcagtgtgggcatgagtgtggtggccgaggccgccccctggctgctgctgccaatcaacctcccctggccgccacacatgcacctaccaccaggcagccaatgacagcaacggtaccccaggcgtcgctgcggccccagcccaggggcccacgagnnnnnnnnnnatgtgggggccgaggccgccccttggttgctgctgccaatcaacctcccctggcccccacacatgcatccaccaccaggcagccaatgacagcagcggtaccccaggcgccgctgcggccccagcccaggggcccacgaggcgacgctttgcgactctgggcaaggatccgaccgtccggtccgactttcttcccgacaaggatcgggaccgcgaggagcaagagttgcgggagcagctcaagcaggagtgggaagagaagcaggtcggacatggtgatgtggcaggggtgggcgcgtcgccgctggggctctctgagacgctgcgacacctggacgacgactctatgtctcttcccagcaccccccttcccactcgccccttttaaaacaggaggccattcgcgccgagccactggacatcacctacagctactataacggcacggggcaccgcaggagcgtgacggtgaaaaaggggtccaccatcggccagttcctgaaggccgtgcatgagcagctggcccaggagttccgggagatgaggtgaggggaatgtggcgtggggtgggatccaaggaggctggcagcggtgtggtgccttccacccagcatgtgcatgggagacttnnnnnnnnnnaaaatgtggcgtggggtgggatccaacgaggctggcagcggtgtggttccttccacccagcatgtgcatgggagacttgcctggagctgcttgggtgtttgcatcgttgagatccctctgccctccaacgacctgcctcaccgcatgatggcctccctgttttcaaacccaaccatcttttaatgacatgtgatgcatgccgctccgccgtttcgcaggacgacatcggtgagcaacctgatgtacgtcaaggaggacatcatcctccctcacaccacctccttctacgatctcatcttgaacaaggtgcgcggcaagtccggccccctcttccagttcgacctggtggagcacgcggtggcggcctttgaccccagggtcaagtcccaggactcccatgcgggcaaggtggtggaccggcactggtacaccaagaacaagcacatcttccccgcctcgcgctgggaggtgtttgacctcgacaagctcacgcaggagcgggatacgtgaggtgttgagccaggcatggcctgcatgtggcctcctgctcaggcatggtgtgctttgtatatgcgcatggcccatgcccttgtccgcgtgtcggtggcagcaccttttaaacgcagaccaccccagcctgatgcgcctggcaccaggcctgtcagcatacaaatacannnnnnnnnnctgtgctttgcatatgcgcatggcccatgcccttgtccacgtgtcggtggcagtaccttttaaacgcagaccaccccaggctgatgcgcgtggcaccaggcctgtcagcatacaaatacaaaagccgcaagtggatttgtaaaactttaatccgaagagacgatacttcaggagagagacgacacggttgcgagattcataccagttctcaagcaggctttgcagcgcctccaatctattttcgttcgacacggcactgcgcttactgcagcccctgtcagggtccctgctccagggtgttgacccaggtgaggttcatgctcagctgtccgctggagaccccctgcagcggccacgtgccggtcacccgccggcggctcacgacctcttgcagcggcacggcgacgtggccctgcgatggtgtggtgttgtgtttgtgagagaagatgcgggcttggcaatgcaggcgacgcagcaaggacgagtcgggttgcaacccaaagagcaagactctgttctaagagtttactggatcgtgccacccagagattgccacacccacaacccctgcctccctcacccacacaacagccccccctcccctggagcaccccgacactccatcaacccaccttgtaggtgggcttcagaatgaggtgcacagtatagaggtccacccggaccaccgcatcctgctccgccgcctcgtcgccgtccaggatcagctccagcttctggtcgaacacggggttgcgccggttgagcagcttgctccggctgcactccgtctcgcggctgtgggaacccaccgtcaaccggcagcgcatgttcttggtgtagccctccagcccctcggaggccaggtcagtgccatggtccaggtgcacgtagagcacgccgccagagaagacggagtgcagcgcgcgggagttggcgctctgatcccggtggcccccggcattgcgggagggggcccgcccctctcgcgccgcctccatcgcgcgggcgatgtcctggcggtcgaagcgcgtgaatgccacctgcggtgttttgaggagggcggggggagggtggtgctgtgtatgatggaggaatgtgccttcacgcccagaaagaaagaatggtgcgcgaggcgatcgccaaattagaggatgaaggactggcagagcaggagggccgaccaggttcagcagcggcttgcacgctcgccgagggccgcagcgaggctccctccctcaaaacccagccgcactgggtttggccggtacgcctgctgacaggcatccatgacacagggacagggagcgtgcctgcaacagcatacactagaaaccccagggttgtcacgactcaaacggcatcctcaacacccttggacaccgccttgcctcaagaggctactgctatgccactcccccccccgccctcaccctgatgtgcagctcgcaggccttgcgcaggttgaagatctccagcgactgctcggccaggcgccccacccgctgccgcgcgctggtctgccccggcgcggtctccggctcctcctctcgccacagcggcacgccctcgccggcctcggcggcatcgtgccgcaccgcgcccgccttcttgccctcttcctcgcgggcctcctccccccggtctccattactcccctcactctccccccttccttcatctgccgggcgcgcaggccccgccgggccggtgcgcgtggcatggccgtccaggtccagccccctgcccgactccccgcccacgcccggggtcgcggcgacgcgcgcctgcgcggcggtgaaccccacctggtcgttacggtgcttgcgctcacgccgccccgtccgcggcacggtgaccaccaggtcccggnnnnnnnnnnatcgctgcggtgcttgcgctcacgccgccctgtccgcggcacggtgaccaccaggtcccggggctgggacaggtccaggtccgccagcgccagctccacgcggcccacctcgtcgtcggcgcgcagcgcgtcggcgtccagcaggatgaggcgcagcgactggtgcgccacatcgtgcaccgtcatgcggaaggtctcgttccagcgcgggtggcgcgtgcgcgccttcacgctcgtgttcagcttggtgccctctgccacccacagcttgacgaaggggtcggcgccgccgatgaggtccatgcgcggcacgcccgtggcctccttgatcaccaccgtcagcagaccctcgggcagctccgccacgctgtcgtcggcgccggggtccagcttcaccacaaagccgtcggggtaggtgaagggctgcaggacggtgccggagacgaagccgttgatgaagtgctccaggccggggatgaagagtgggttcacgccgtagctggacacctgtgagtgagtgtggacttggtggtcgtcagggggggatgacaatgagacaccggggtcttgggcggaggaggaggtgcgctgaccctgcaagcacccacgatggcagctgctacagagagtttgcagcagctgggctgcaagcccgctggtgcagggacatccgatcatcccaggcctccccaccacgaacatcacagcatcctggtgcccaagatgcctgctcaaccccttcacccctgtctcccccacccccactccacaacagctcatcctcacaccttgtagctgaaaacgggggtgcccaggaaggagaccttggccgcccccaccaccgggatctcgttcagcaaggggcgcagctgggtcctcagagtcccagacaccacaaggtccttgacaaacacctgtgtgggtgtgtgaaaagggacataaagtgaaacgagtggtgcatagcaggctcgggggggggcttgtctggtgcactctcactgcaatgagcccggcttggcgtccaggaaaacctggcagcctgtgcaggcatgccgaggtaagggtggggattcgacgttgacatgcatataggttcatcctttcctctgcaaccccgccctccctcacacactgaccctgacgatggagcggcgggtgatgaaggcggccagctgcccgatgatgggcagccgggcattctccggcagcacttgtatgtccatcctcactggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcacgggccacacgggagaggacgtggggctaggaacgccccagacctaggtgtgggcgacttgcatannnnnnnnnnagcacaggccacacgggagaggacgtggggctgggaacaccccagacctaggtgtgggcgacttgcatagactaccgcgatgccactttgctctgatgactgcatcccatggcaaataccaaccctcacatctcccaagccggttgcaggcttttgtccaccacgccatgcgcatgcagcaataaactcgccttccatcttggacgaccaggtgaagtggaagtccaccatgaccctgtcggtgcaagtatcctcgtcccgcgcataggcccggaccccggtgatcaccgggggctgattccccagcgccagccccttgacggagatgcccgaggaggccagccaggcggggcgccagaaggtggtcccattcagcagcggctctaggttgccgtccagcaccgcccacttggtggccgcggcgtcgatctggggccagagacccttgagcgccacattggcccactccatgcgggacacgtcggggtaggccagccaggcgggcaggtcgccgccgaagagggaggacagggtggcgggggacaggccctcgcgcgccgccttggcaagaccctccagcttggagcgcaggctgctggagcgctgcagcgtgacccagcccgccaggaggcaggccaggcaagcgacggcgcccagcaggaaggcggcactggggctgagccagggcgcagggtggtgggaggcggcgtgcatggagtgcagcatcgccgagatgtcggcggtggtgcatgcctccttcagggctggcggcagggagggcatcctggctgcctccgcatggcatggtgggggcagggtgggtgagaggtgcttggttgtgccgcttgtgggaagggaggttgcacgggtggtactcgtggatgggcccccgggaggactggggtgggtactccccaagccacatgccaggtggacagcgatgggagcgccggcgcgtaagcaggcaggcccggccagcacgcacatgcgtaccccactgatcgatatcatggagatacgcagaggtggtgggtgaactaggnnnnnnnnnngagcatgccggcccggccagcacgcacatgcataccccactgatcgatatcatcgagatacgcagaggtggtgggtgaactaggtaccaacgcacctgtccaaggacctcgctgggcgtcactggggtagtacgtgctcggactccgaggcttctagccgacgtgaatggagcgccagcagcccatgcccaggtcgtctttctgattggtatatacactgagtaaggacacaacccagatgggttccggcagggacaagcgcaagaaggccaagggaggtggcaagccgggtgcaggagccgagaagaccgcccgcaagtccgagcagaacgagggaaaggcagtgcgcaggctggaacgcaagacgcaggtgggatgcctgagctgcaagtgactcccaaccagatggtcctggctgtatacggatcggctgtctcccgcgttgttgccagggatgggctgctgactgcacgatccgatggaagttggtcggtactccggaacttccctgcagcagccgggaggttttgtgcaccactgtcccacgtggcccctgatactcacgccagggtaagcgtttcttcccttgaaatttcccatctgaacaccctcataggggggtgaggacgacatcgatgccttgctggccaagttcaagcttgaggatgctgcagccacagccattcgtgtggagccgggcgtgcgcccatctccacgcgtctatagcaccttcaacctcctacccagccaggtttgaggtgttgagcggggaggcttgaatgggacggcacagccaggagcatgtttggtcattcctcgaccgtgccccccagcagccgtcaggaacccccgccgtcaccctggccccagcagaaagagaacgagctgatcctgtttggtggggagtggtacgacagcgagaaggacaagacccatgtgtacgccgacctcttcgtgctggatgtggaaaaggtggcctggcgtcgcatcgtgtcgcccaagggcccccttcctcgcagctcccaccagagcgtgatgaccaagtaccacatgtacgtgtttggcggggagttcaccagcctcaaccaagagaagttccgccactacaagtgggtgcactggggaggatggcgggatttgggaggggggagggtcatggtggggttcattgagcttagcagctggggtgtgcttgggggtaggatcgtcattttgtccaaggggaataccgactagctcacaccagggcatatactctctgtttgggttctggaatggtccatccaagtcagtgccagacacacagctctgccagctgttgagggcattgtattttgggctctcaacctagcttgtaactccgtatacagtagccaatgtttcatgcctcatcgcacagccaccgacccaccccctaccacctgcctgccacgatcgcagcgatctctggcgcctcaacctggccgactggtcctgggagcagctgcccggcaggggcggccccagcccccggagcgggcaccgcatggtgctgcagcggaaccgcctgctgctctttggcgggttctgggacgcggggaaggagcccaagtattacaacgacctctgggccttccacctcaccgacctgcagtgggagtgcctgggtcccaccacgcagaccggctccagctggcccagcccgcgcgggggctgccagctggcagtccacggcgagctccttttcgtcttcggcggctactcggtcctcccccctcctggtgtgtgttgttgatgcaaggttggcatgggcatgatgaacatatccctttgggaggaaggtgcgtatgagcatcactcaacgactctgctgtcccaggattgctctgtgtctggtgctgctccaacacctgcactccaacctccgcgtggctgtgacgcaagtgcctgctcggggacccctctcgctggaaaccaggcctcatcaataatctcccccctccccccctccttccatccatgcaccagacaaggaccccgccgccaaggccgccaagcgcaagtcggccggtgacgacgacgacgagggtggaaagggcgtcgtgcatgacgacgtgtggtgctacgacaccaagtccggcgcctgggagcgcgtgaggaaggcgggcatggcgcccagtgcccgcaccggcttcggcatggcgcggcacggccgccgcgccgtctacttcggcggagtggtggaccaggccggcggccgcgaccgcgtctactccgagctcttcaatgaggcctaccagtttgatctggagacgcggcgctggttccccctggccgtccgcgcgccgcgcgggaagagggcgggcgcggctgccggcggcgccgacggcgcgcccgccctcgcggacgggagcgctctccaggtcacgccggcgcagcgggcgcggttggaggcggcggccacgtgcatccaggccagcttccgcggatatgcagtgcgcaaggcctacaccgcctacaagctgggcggcgcggtgtcggagctgctctactcccccgcgctctatggcgtggacgttggcgcgtcggccgacacggtgaagccgcgcgcgcgggccgcccccctcatggccgtggctcgcaacacgctctggctcctgggcggcatggtggaggtcagggcgcaaccctgggcagggggggatgggggagccgcgcctatgtagaggggcttggggctagggggctgg

SEQ ID NO: 42089 - DNA, 72 bp, Chlorella protothecoides
gtttgtgtgtggcgaggagggagaggggggggtaggccgtgtggaagtggggaacgccagtggagtcaaacc

SEQ ID NO: 42090 - DNA, 80 bp, Chlorella protothecoides
gggtcgatgccgacgtacaggtgtacctcggcatcctctggagggcggttccgcctgcaaattttgttgaggggtgtggt

SEQ ID NO: 42091 - DNA, 4615 bp, Chlorella protothecoides
  modified_base (324)..(333): a, c, t, g, unknown or other
  modified_base (423)..(432): a, c, t, g, unknown or other
  modified_base (3408)..(3417): a, c, t, g, unknown or other
gcggcgtgcaggccctggcctgcgccggcgccggggtctgggtcggcacgctggccggcgcgctgtgcctgctgtgtgcggacgacggcaggccgctgcgcggctggagggcgcaccgcgccgccgtcatggcgctggccgccggcccgggccgcgtctactccctcgccgcctcgggggagatcgtcgcctggccggcggcgctggccagcttgcacagcgccgctgtcccctctgcacagtgggtttactttgggggagggaatggtttgtgggaggggtcagcgtgcatgtgttttgtgttttaccatgggagctatgtcnnnnnnnnnngcccccccccaaaaaaactctcctccaatagacggctgtggagggaggtggccgccacaaccttcagccggcgcagcctgcgtgccctgnnnnnnnnnnagttttttgggggggagggaatgctttgtgggaggggtcagcgtgcatatgttttgtgttttaccatggaaactatgtcttggtccatgcaagggcctgcatgctgcccaaatgtgtgctcatctggaggcaggcaggcggaggccaagggcatgtcggcgtccacctcgcccaccttgcctgagtccgctgaggtgtgctctacatccctcatcgcccccgcccccccccaataaacatctctcctccaacagacggctgtggagggaggtggccgccacgaccttcagccggcgcagcctgcgtgccctggccctgacctggaacgtgaacgagtgcaagcccgacccggactcgtcgcaggtgttccgccacctgcgccgcgcggcgacgccggcgggcggcggggagggcccggccttggtggctgtggccctgcaggagattgagatggggagctccagcgtggcgctggcggcggccaaggacgccatctcctaccgcatgcaggagcgaggcaacaccaacgccaagttctggagcggcgccgtgctgcgcgcgctgggcggggaagccgcctggcagctggtcggcctacgccagctctccggcatgctcgtcctggcctacgcccgccacgacctcaaggtgattgtttggtgggtggaatggagggagttgggaaggaggagggtgggagggctgtattttgtggaggcatccctggtgaggaggtgggcggcctagaagatgtcgggacaggaggaatgagcttgagggtgcaggccacggataccgatgctgcgcctgcgcatgccaacgggctctccctgggccaccatcataccgatccaccaccatcgacacccccctccacacacacacgcctgcgcaggagtggctgggggaggtggccaccgcctcggtcgcctgcggcgtgctgggggtgggcgggaacaagggcgccgtggcggtggagttctcgctcttccgccacaaggtcgcgctgctgtgctcccacttcgccgcccaccagggcgcggtggaggcgcgcaacgccaactaccaggccattgtgaaggcgctgaccttcacgcgccgcgcctggctggccgacgaggacgtggacgaggcgctggcggcgccggggggcgccggcctgggcgatgggggtgagccgggcgatccggtcgggcgccgaatccgcagcatgaagactgacgcaggcactgtcgtctgtcccttctacgaccccctccccggcctctcagcgctcactcacagcctcccctctcaccttccacggcccagatgaagcggaggcggggacgtcgggcccccagctcaccacgctggggcccggggccagtgcggcgaacctggccgaggccgctgcggcgcaggaccccttggtgcagggcgacgctgttcagaaggcggaggccctgatctgggcgggggacttcaactaccgcatcgacggcccctacgaggacatccgggacagggccgtgcgcaacgactgtgccagcctgctgcccctggtgaggcggggaggaaagggggcacgagtggggggtggtcaactactgtgtgggatggtgggaactgaggaataaagcccaggtcctttcaggagcatcacagcacaaggagcaagtagagacttcagcagcagaggggtgcgggcatgtgttgatggcaggcatgccaagcgtgcccttcctcccctctttctcttcatccgctccctcttcctgccttgccaccccaggaccagtgccggcgcgagatggcggcggggcagaccttccgtggcatgcgggaggggcccatcaccttccgccccacctacaagttcgacaaggcctcggccaacccctttgcctacgactcgtcggagaagcgcagggtcccggcctggtgcgaccgcatctttttccgcggctgccccgcctttccctccccagaggtgcggggctacttggggaggggtggggttctcttgttcaggtccatgcgcttctccagccccccttattccccctccccttgcagcccttgcccgatgagcgagacgcctgggcagatcaagccacggcaggcccagacgttgtgctgatgacctgccacgagtatggctgctgggccgacgtcgccgagtccgaccacaagcctgtgtatgccctgctgggcatagacctgtcggtgaacgactgggaggcgcggcgtgcgaggcgcaaccagatcctggacggcctggcagaggaggagatggcggggcgggcgccgctggacgatgaagacgccgtgaagttgaccccggaccgactgcagctgaggggcagcgtgggcaaggtgggagcctaggaatggcgccaagcggggacccatgcgctgattgcaggaggggctcggaccccttgcaattctcgtggcggctgttgagagtggggatgtggggcctggcatagcagcgccaatcctctggacccgaccccctacaacacccccgaacaccataccccgtgcagtcctgtcagctgcagaacagcctggggcgcacgctccgattcagcgtggtcgtccccctaaggtttcttgaggaggggctccgggtcttcccgctggggggagccctgccacccgacgccacgctgcagctgcatttggagtttgaccccgggagcggggctctgcacaagaacagagaccttgtcgcacggctgacggtcgtcgtgtcggaggagggcgaccttggaagccagcctggacagcacgcgtcccaactcctgaccctccctctggaagtctcggtggcgccacccctctactgattatgacagatatatccaccactattgctctcccatactccttcagacttcagtgatccaagggtgaaaatccgttcacaaacacccatgcgctttgaaaaggcgaagcaggctggtggtgagaggcgcaaggctgatnnnnnnnnnnagttcacagacacccatgcgctttgaaaaggcgaaccaggctggtggtgagaggcgcaaggctgatccatatgaaaggcctgtggaaacgaatcatgccgagcgtcaggccttctggggatccacaggttctaggaggctcgtacgcagctccccagggctgagcgccgcctgctccgggaagctgagcggctgcgagggttccgccgggagcctgtctgcctccccatcctcctccccctccgtgctgcgaacggtcatcccgctggccttcagcatggagatcatgtcctgggaaggggtccgcactgggagatgtgaacgagccgccacctcctagaccctgcagtcctttcgcagtccttttgcaatgcaacaacatgccacccagctccctttcctcctcatgcaaccccctcacccacaccggaccccaccctcgacacacctggtagctggtggcggtcgcgcttgcgctggccttcagcgccgcatccacacgccgcgggttcaccttggactcccgtttgaacttgttcttcaggtggggccgttgccggccggggaacaggtggctgatcagcgtgaagtccgtcccaaactggctgagtgcctgcgcggcgtgcgggaggagggggaggtggggctgcggtgcggcgtagcactgggagacagggggaacggcaaggaccaggccatgcgcacaaatcgcatcagcgggtggccggacttcccacacccactccagccgcctgagggtctgcgcaccggcgcgcatgcaccggggctacgctggttgagttccacgattcccctggggcccccccggcatcccaggccccagggcagtcctcccgccccttccctgccccgaggctcccaccttgtagaagagctcggtgtcctcagccccccagcgctcgttgtgcaggcggttggcgtaggtgtaggagttgaggcggaagtgctcgtcggtgaccccccgccggttctccacccgctcctgcgcctgcaccgtcaggctggcctcggcgatgacgatgcggccgtcggcgcccaccgccacctgcggcaccagggagcgcggaccggcgccgccctcgggcccctccgcgccggggtccggggccgccggcccccgacgccctgcgcctgggaggctgggccccagcgcatcgggtgccggccccgtcggcgcc

SEQ ID NO: 42092 - DNA, 119 bp, Chlorella protothecoides
gagaagggggagagaggggggcgggggggggacacccacccacgcatccagccgactggattgtgcccctcgatcgccagtcacccatccccaccatcccgcccccacctaccgccaga

SEQ ID NO: 42093 - DNA, 61 bp, Chlorella protothecoides
acgtcgcggtccgacatcgtcggccgcgccacgccggtggcggccgcgggggcctcggccg

SEQ ID NO: 42094 - DNA, 74 bp, Chlorella protothecoides
gctggcgcgccctacgctctgcgacaggggaggattcagacacccagttgatgtcggatggtagaactctcagt

SEQ ID NO: 42095 - DNA, 110 bp, Chlorella protothecoides
ggacacaaacatctgcgagagggtgtggagtgtgcgtcagggcctccgacagggtgctgctatctagaatcaggtgttatccaggcagggcagaacaatgatcaccatgc

SEQ ID NO: 42096 - DNA, 83 bp, Chlorella protothecoides
cagcagccgccacaaccgcatgcataggtacaggtcgaagggcgttcaaggggggcaggagggagggggtcctcggggatctg

SEQ ID NO: 42097 - DNA, 416 bp, Chlorella protothecoides
  modified_base (111)..(346): a, c, t, g, unknown or other
tctccagcctgggtccccagagcgcgcgcgcgatgcgacactgagcaccgaaatggccgcgagagaacgcccaccattctcccactcaaggcctggcatactgagtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgctccattgtgctctacctcctccatccgcacgaaagtgcttatcccagagctctcatggcagcatt

SEQ ID NO: 42098 - DNA, 8102 bp, Chlorella protothecoides
  modified_base (185)..(287): a, c, t, g, unknown or other
  modified_base (800)..(809): a, c, t, g, unknown or other
  modified_base (1468)..(1477): a, c, t, g, unknown or other
  modified_base (1547)..(1556): a, c, t, g, unknown or other
  modified_base (1640)..(1649): a, c, t, g, unknown or other
  modified_base (2542)..(2583): a, c, t, g, unknown or other
  modified_base (4913)..(5047): a, c, t, g, unknown or other
  modified_base (5112)..(5121): a, c, t, g, unknown or other
  modified_base (5186)..(5195): a, c, t, g, unknown or other
  modified_base (5402)..(5426): a, c, t, g, unknown or other
  modified_base (6067)..(6076): a, c, t, g, unknown or other
  modified_base (6474)..(6483): a, c, t, g, unknown or other
  modified_base (7073)..(7224): a, c, t, g, unknown or other
  modified_base (7299)..(7308): a, c, t, g, unknown or other
  modified_base (7712)..(7721): a, c, t, g, unknown or other
gccgcgggcgccgcacagcgcccgcgctctgcgccttcgggcgccgggccggcgggctgggccgggctgggcgatgcgctgccggctgtcgacacctcggcctacagcgacctgtaccgcgatgtatgttgctttgggtcttgggaggtggacagggtggtagagacagacttgagcacccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacctccagctgcccaccggaaccgctcctccctccccgaaacttccaggacgaggccggcgcggcgcccgctgacgagccggaggagcggcgccgcctgcgcgcgcgccgcgtcgcggagaagcacgcgcgcatggcgcggggcctggccgaggcgcgcgcgcgcgagggcgccgaggccgccgagaaagcggggcgcgtggcgctgcgcgacacgctgggcccggagatggagacctggacggcgggaaagcgagataacatccgcgcgctgctcagcaccatgcacaccgtgctgtggccggacagcggctgggagcggccctccatctccgacatggtggaggatgccaaggtgggacggtgtttgttatggggggcgcatgggcgggttggccttgggtgaagaggctgagggttgggctctgggcgagcccgcacggaaaaatgccctgcacgttgctaccttccctcgattatcataccaccggctgctctccctccccagtgcnnnnnnnnnngcgccctgcacgtcgcaaccttccctcgattattataccaccggctgctctccctccccagtgcctcccctccacccccaaaatctcccccaaccccctcaggtgaagcgctggtacatgaaggccaacctggtggtgcaccccgacaaggtgcggcagaagggcggggacgtggaggctgttgcgcgcgcagacatggtgttcgacatcctcaaggccgcctggggaaagttcgaggccgcccgtgcgcggtgacgggggagcgggagccccttgcagccgaggcagcgtggaaggagccggcctgcacttgctttcatcctctccccgccatccccactccactgggcattgcttggtcggttgaacgaaaacatgatgattgcagtgcaccttgcatgtggcgccaaactgagatgcgcctgtcaccggggcaggcggcagggcaaggagggaatgagtgcgtgtgcggcagcggcagcatggtacatgggggtgtgggattgacagcatggggatcgactcgcagccggggagcacgactatcacgacccggcgtggaggccagcgcgcctggatttccccttctggggctctcatcctcctttccggtcgaagcttgggcgcgagcctgcctgggtggcatgcagcgcccagcnnnnnnnnnnaaggctctcatcctcctctccggtcgaagcttgggcgcaagcctgcctgggtggcatgcagcgcccagcnnnnnnnnnngtggcgatgatgttgtgagggcagggatcaaggcaggcgctcgacgcaggcagtgcccggacctgctctctgcatggagggtgnnnnnnnnnngactcttccgacctctgcctgcctacgccgtctcccctgcccgctgggccgccagggcggcgatggaggcggccagctgctcccccacctcctcgtcctccatgctgtccaccaacgccttgtccaggtcgtcaaagtaggggtgcaggagggcgtccttggcctgtagggttggtgggtgtgtgaagggggtgagtgtacggcgatgatgttgtgaggacagggatcaaggcaggcgctcgacgcaggcgctgcccggacctgctctctgcatggagggtgcccacaccatccggcgcctcaccgtgatgcgcttgacggggtcgtactcgaacatggccttcatcaggtccacgcccgccggctccaggcgcgggaagagctgttggtatgggaggatatggatgagggtggttggggggtaggggagaacagtgagccgtgcgcatgccatcgccagcctgcgacgaaccactgatgcatgggtttcagaccacgccccagtcatccccgcatcatcgccatgccatgacaagaaagcaggactcttgagatcccagccctcaccaggtccaggtcctgcatcttccactgcgggaactcgtgccagtcgcgcagcttgcccacgcccggccaggtggcctcgctgggggtgcccagcagcttgaagatgtgcagcagctgctgcagctcgctgtcgccggggaagatggcttgctgcgcggaggggtggtggtggggtggggtgggctctcgggtggccagcgcggctggaggatgcatgcctggccagtgctgccggtccgaaggccggtctccaggagagtcggggcagagtgcggtccacaccaccaggagcgcgaaatccccccccccccccggggcccgccaannnnnnnnnnnnnnnnnnnnnnnnnnnnnnnnnnnnnnnnnngctcaacccaacccacctccccataccctctcgcctccctgtcctcaccttgcggaccagctcggcaaagatgcaggcgacgctccacatgtccaccgccggcgcatagcagctgatgcccagcagtacctcgggggcgcggtaccacagggtcacgatctcgtgcgtgtagcacttgatggggatggagaaggcgcggcccaggcccaagtcggccaccttgagcaggggatggtctggatggggcccttcctccaccagcaggttctggggcttcaggtcgcggtgcatgacaccatgtcggtgcatgtgggctacgcccttgagcagctggtacatcatgctctgttgttggtgaatgaggggggggaggggggggtccccatgagaggagcactcggtgtgaagggccaggggtctgcctgaatgtgtgggtgcattgcccatgctgtgcaccaggcagcaggagagtgggcactcgagccagcccttccgcgtcaaacatccatcaaaccacccaccttgatgacgacgagcgagagggggaaggagggccccttccccagacgatccatgtactttttcaggtcggtgctgcagtactcgaacacctgcagggagagtgggcgaggggcaagggccgaggtggtcagcaggtgcatgcccagcaaccgcgcatgtccaggaggacagtggactgggcgatgcatgcttgagtacattctttgcagggcagtccagctctttcccactgcatagcggccttcgcaccaggtagaggcagggcttgttgttctcctcgatgtgctctacatccagtagcctgttggggagttggggaccgaggaacacatttcttcctcccttccgcctcctccaccagcaggcccaggacaggagcacacaggcacctgcatgcccctgagagcttcctacctcacgatgtggttgctcttggagagcatgaggagcagggagatctcacgcagggcggtggatggcacaccttcctcttccatctgtggggatcaggatggttcgaagtcctttgcagacagacgtaagatactacctgccgggttaccccctgcccttgctgaagcaaaagtttcccgggcacgtacctcgagtcgggtcttcttcagagcaaccagccgattggtggtgcggtccttggccttgtacaccttgccataggtcccttccccgatcttttcgagcttgatatagttgtcctgcaccattggattagatgggatgtcgctggtcgagcctgattcgcaacttggccctcatgcggggcggggttcgaagacgcaccatcgttctggacgcaggccgcaggggcaggttccagtcgcggagatcctctctgagcctttgcagatctttctgctgatggcgcaccgagaacaagacgattctcggtctctgagggcttgaacgcgttgcgatagctgttcgtgccggcgagcagggcacctgttgccttgaaacatcaaatccctgggacaatcgaatgccggctcccgctcaacaaaactcaggtacacaaaccatgctgtctggggagttaaacagatgggctctgtcttgaagtgcacccacacatgatcccggcagtcttaataagacgcccatcttatcatgcatgccctgtatcatttcagctccctccatgggtcttcctgtacagcctgtcgcaagtccatctctgaccctctttcgccgtgcctgtgcagccaaattgataataacccataaattaacccgaaggcacctgcagattgacaatcgactgaggttggctgggtgggctggtgacagttggggagtgcactgccacctgaaccacctgtggcgacccattccaatcattaaccctcaaatcggctcaggaaaagctttctgtagcatcataccatctgttgaaggtactgagcggcaaatggtgtccagagaatctctggttagacttgccgctgtcacatttgagatattcatgcagtttgaaagattcctggatcaatcagatgcctcctattggtcccaggagggccattgtccctctgccgccctccttgagccggcccgccaataccaccgaccgtcttcagcaccggtatatccattccgaaggatgggagcattggtcgaagcctcctgagccctgcctgcccctgttccggcctagccggtaaggctggcgggagaacctagagtgtgccctaaggcctgctgcagtgccctttaccctcgcagtcaatctcagagacaaccagggagaggtatcgtggatagtgcgcccctgaagccctgatttgtgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcatgatgcaacaaatgcgtgcaagtactaccgccacgccccggtgcgcaaaaccttaccacnnnnnnnnnnaatcatgatgcaacaaatgcgtggaagtactgcagccacgccccggtgcgcaaaaccttaccacnnnnnnnnnnggagtgtgccctaaggcctgctgcagtgcccgttaccctcgcagccaatctcagagacgaccagggagaggtgtcgtggagagtgcgcccctgaagccctgatttgtgcgagcccaagccctgacgatggagcagtacccagatcacgagtgagtcagggtcgcacccacgttcatccctgacacccgtatggatgcgatgcactcnnnnnnnnnnnnnnnnnnnnnnnnnccccgctgtcctctccccgcgcaaccagtggccctcagttccggggcctcccatccggcacggccatggctccgccgcacccacctggcgatttcatggggggccactaccctgtgacggaattgcgtcgcaatgcctcggtcccctccatggggctgccccgccagatgcccaggtccatcagcatgtgcctgccgcccggcaagcgcgcctttgccgccgagacggagggggtgcagagttgggacgagtaccagtccatccgcgacgcacaggccgcgcgcaggcctgcagcccggcgatgcctggagaacaccctggagatcgcggccagggcgcgctccttccccctcacacgcggatactccaggagaggtgagaccagccgccggcaggggctgctggggttgattcaatgcatgcatggggcccttggtgctcaaatggtacgctcaggtctgcaacgatcgagaaggcagacctgagctcattgggcatgccatgggtcctcttcaaaaaacccaaggccgctctgctgcctgctatgtgtccaaccccctgcatgccccgccagcaccacagcgccgtcaccgcttccaactacgcgccgttcaactccccagggtccctggacgccctcnnnnnnnnnntgccagcaccacaccgccgtcaccgcttccaactacgcacttttcaactccccagggtccctggacgccctcaacctgcccccttgcgccagacggctggagcccgcctttgcgccggtgcagcccgaggagagggacctcaagctcgtccccctccaacacctcctcctctcccccgccgccgccgccctttccaccctggacgtcaaggccatcatctgcaaggtggggccccctgggcgtgtgtttggcccctcacagtcgcactctgggccaggcggggtgcaggcgtgtcggcttgcttcaagccacctgagtctctgttcccctcagcttcacaagtatcccctcctttcctccccgcagatcgcgctggacctggacgcgctgcacgcccnnnnnnnnnnacctctcacagtcgcactctgggccaggcagggggcaggcgggtcggcttgcttcaagccacctgagttgctgttccccgcagcttcacaagtattcctcctttcctccctgcaggtcgcgctggacctggacgcgctgcacgcccagcgctcgctgcaccgccacgtcagcgtggcctgcatcgccgtccccgccacgggccacctccctgcctcgcgcctgctgccgcacggcgccaacatccggtgcgagggcggcggcggcaccgccacctgccccgtcgcattccagggcatggagccgtacctggcgcccgagctggccatggtggctgccggggacgatgcgcgctcgcccgccatgcacaccccggcctgtgagtggaggggtcctgggctgctgcaaccctccttgggattgtgactgggatggcggggccttgggtcaatggtgcacccccaagcgcgccaggctcgaggcctggctgtgtgcatgttccgccgtagagtcccatgcggaacccccactcaaccccttgccacaggtgacatgtggagcctgggcgtcgtcctgtttgtcatgctgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagttgagggagctggggacgggatgtctgtggtttcttccgagaggccgtgccatgtgatgggtggcgaggnnnnnnnnnngcgccgtggagtcccatgcggcacccccacccaaccccttgccacaggtgacatgtggagtctgggcgtcgtcctgtttgtcatgctgagcggcagccacgtgccatttgggaaccgtggcctgggccagaccagcatccccaacatgccgggacggggggagagcgtggacgccttgcagtcctggctccaggtagaaagaagggagttgaggcagctggggacgggatgtctgtggttttctcccagaggccgtgccatgtgatgggtggcgagggtgcgggcactgcgggcagcctgtttgggaccacgggcctgtggatgtgtaggacctcgactggatgaatgacgtgcagcgtagatgtcctcgcccgtacatcccagaccccttcccacatccctgnnnnnnnnnntctgtggatgtgtaggacctcaattagataaatgacgtgcagcgtagctgtcctcgcctgtacatcccagaccccttcccacatccctgtccaccgcacctccatcagaacccccccccacacacacacatgctccacaggagcacctggagtgcaagatgggcgtggtcaacgccatggccagggccggcagcgacacggcggcctgccgcgacatgcgcgtgctggggttcgaccccggcgccgtggacgtcgtgcttggcctgctccgcgccgaccccgcccagcgcctctcggcgcacgccgtggcgcgccacggctggctcgccgaggtggcggccgaggtgggcgccgccgcatgcgcggggcggcgcccagacg

SEQ ID NO: 42099 - DNA, 1296 bp, Chlorella protothecoides
  modified_base (133)..(308): a, c, t, g, unknown or other
  modified_base (470)..(655): a, c, t, g, unknown or other
ccggccccccacctccaccccccgcacccccaccattgcagggagggccgccacttcaacaaggtgggtgacctgctggacttctggcagcggcacggcctggagcgtgccttctgccggccccagtctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgctcgcgctgggcggtcgcccccccgctgcgcctgggcgcgggcggggccgacgccgcgaccgacgccgcgaccgacgtcggcaacccatccccccaaccgcccctgcgcgccgcggcgctggcgaccgacggcgcggctgtgctggcggcgctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcggccgagcgcgtggccttcctgtccgacgccgcgctgctgtgcgtggggcgccacgctgctgaccccggcgcctgccacctggccgtgctgcagcggggggccgacggaggctgggcgcgccgcgccgcgcgcgacgtgccgctcgcccccgacgacccgaccccggccccggccctcagcgccgacggcagcctagtcctgctctccctctcgtcctcggcaccgcggcccctggtcctgcgcgctgattccctggccgacgcccggggcctgggccccggctgcgccgccgacgcatggcccggaaccggccccgcggcgtcaaggccacctccaacctcaccccccaccctggcggtgtcgcccaacggctgctacgcggccagcgccagccccgggggcgtcacgttgcgcctgctgcccctcttccgcttccccacgcccgagagcggcatgccgctggcggtggagctggccaagcgcgccgcgctgtgcgcgctgcgctccggcgccacctgggacctggagcgcgcgggcgcggcgctggccgccgcgtgcgggccctccccgctctccgtctacctctcgctggtcgacgcggccgtgctggcgacgcgcgccgcgctgcgcgcgccc

SEQ ID NO: 42100 - DNA, 61 bp, Chlorella protothecoides
tatagatgcgagcgccgcgccggccagcagtgtgaagaggtgggtgcctagagcccagcct

SEQ ID NO: 42101 - DNA, 110 bp, Chlorella protothecoides
ggcggtgaccctggtgtcgccggacaatgcggggccgggggcggacgcggtggcccccgacgccgacgccatgcggcgctgccggcacgcggtggcggcggtgggcccgc

SEQ ID NO: 42102 - DNA, 64 bp, Chlorella protothecoides
ggctccaccccacccgcgcacgacacccccgccccacctggtccgggattgtggtgctgaaccc

SEQ ID NO: 42103 - DNA, 61 bp, Chlorella protothecoides
aggatggcgctcgggagatgctgaggcgggggagcaccctggcctcccagggatgtggagg

SEQ ID NO: 42104 - DNA, 66 bp, Chlorella protothecoides
gactcaacaccttccctttctctatgatgctgccaatgtcccgccacttcctagctccactggtgg

SEQ ID NO: 42105 - DNA, 76 bp, Chlorella protothecoides
ggcgataatgtggtgaaagaacggtactcacttgtgcgcgccctttaggggtggacttgggcgcgagctcggagga

SEQ ID NO: 42106 - DNA, 102 bp, Chlorella protothecoides
attgtgaggtatggccatctgctcgtggcaccctgggcctgggattgggctgggggtgctggccacgccataccctcgctgcgactgcgcacccgccgagca

SEQ ID NO: 42107 - DNA, 111 bp, Chlorella protothecoides
caccgtgaccacgatgatggtgacggcgatgatgaagtactccagcgggccctcggcgaacaggtccagggggaagccgccgttgtccacgatccagcgaatcatgagcac

SEQ ID NO: 42108 - DNA, 105 bp, Chlorella protothecoides
cccagctggaggactcggtgacgcgcaggctgccaggcgcgcgcggccctgcggccagcgtggcgcgcagggcggccaggcacccggggacggagaggccggcgg

SEQ ID NO: 42109 - DNA, 76 bp, Chlorella protothecoides
acctcctcccactgcacgcgcctgctcgaggtcgctggcgccggctgcgccagcgccctcgccggtgtcctcgccg

SEQ ID NO: 42110 - DNA, 70 bp, Chlorella protothecoides
ccgcgtgcgtcaccaagttcggtgagaaggggtgggggggtgggggggttgattcttcggggacacttca

SEQ ID NO: 42111 - DNA, 61 bp, Chlorella protothecoides
gtaggccggcgcctgcacggccgccgcgcctgtggccgccagcgcgttgtgcagcagctcc

SEQ ID NO: 42112 - DNA, 233 bp, Chlorella protothecoides
ccgacgcagcgcagggagaccaggcgggccaggcacgcgccgtcgtgcgcgtgccgtgcgtccatggccgtccccgggcaagtcaggtggctgaggtccaggcgctccagcgcgggcagcgcggccgccagcgccagcggcgcccagccgtcgggcagcgccgcggcgtgcagcgccagcgagcgcagggagcgcagcgcgcgcagcgcgcgcagcgcggcagcgtccagcgc

SEQ ID NO: 42113 - DNA, 61 bp, Chlorella protothecoides
gagatggggtgaggggtgggccaggcaggcacccgccgcatcgagtatctccagagccacc

SEQ ID NO: 42114 - DNA, 72 bp, Chlorella protothecoides
ctgaggcaatcatcctccccgccctcaacaatcaccccccccaaaaatcacctgcagcgcggcctccgtgca

SEQ ID NO: 42115 - DNA, 75 bp, Chlorella protothecoides
tgaggcctgccggcctgaattcatggcccacgcatgaccctctgcctcatcgctcccctgcgcgccaaacgctgc

SEQ ID NO: 42116 - DNA, 61 bp, Chlorella protothecoides
ctggccgcggctgtgcctgcgccacctcctgttcatctgggagagccttggaggcagctgg

SEQ ID NO: 42117 - DNA, 61 bp, Chlorella protothecoides
gcatgtgcttctgcactgccccgggccagatgcagtctgcgagtggcgacgggatccgcag

SEQ ID NO: 42118 - DNA, 105 bp, Chlorella protothecoides
gctcggtgacccgtgccgaggccagccggctcaccccagcaccagctcgtccgaagctggctccgtgaccccacacacaccgccccttcccacccccacatgagc

SEQ ID NO: 42119 - DNA, 61 bp, Chlorella protothecoides
gtggacttgccggccctgtttgcggcgggggggggctgattgggattcggcagatggatgt

SEQ ID NO: 42120 - DNA, 4990 bp, Chlorella protothecoides
  modified_base (146)..(333): a, c, t, g, unknown or other
  modified_base (1082)..(1091): a, c, t, g, unknown or other
  modified_base (1367)..(1376): a, c, t, g, unknown or other
  modified_base (2504)..(2513): a, c, t, g, unknown or other
  modified_base (3533)..(3542): a, c, t, g, unknown or other
cctcgtcccgcgcggcgtcggcccgcgcggccgcgcgggcgctctcgccgcgctccccgtccagctcgcgcctcagcgcctccgcctcggcgcgtaggaggctgatggccacgttgttctggtcgaacacggtctccagcgccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgacggcagcgcggcagggaggtcggcgccgggggacgcggtgccagccgccgcggcgggcagcagcagcgggggcaggcggcgcggcgcggcgccgccgccgcccccgccctcaaacctcccgccctcaaacctcccgcccgcatccagcccggcgcagccctccaccccggtatcggcgcggcgcgccctcagctgcagctccgacaccaggcgcaccaggcgcgcgttctcctgctgcagcgcgcgcaggtcgccgcccgactcctcgttcaccactgcgcggttgcggatcttcttggcccccgacgcgaacagcagcgtgctcaggctctccgtggccgactccgcggcaggggtcacgcatgccaccacgctggtcttgctgttcccgcccagcgactcctgcagcaggaaagtgaggcgcgagtcgcggtacggcacgtgcaccgcggggcgcttctggcgctccaccagcgcggagatgacgcgccccagcaccgtcagcgacttgttgatcgaccgcgcctccgtcagctggtcgccgcgcgcgccgctgcgacccacccgctccgaccctgcacgggtgccgacgagggctcacttctttgggtgggatggagtcggaggtgcgagtgtttgtgccagggccatgtcgaggtgcaggccatgcgtgttttgctctgccctgtggtaccgttcaggcacccttcctcaggccatggaccgtggtgcgaagactggcnnnnnnnnnngggggtcacttctccgggtgggatggagtcggaggtgccagtgtttgcgccagggccacgtcgaggtgcaggccatgcgtgttttgctcggccctgtggcaccgctcaggcacccttccccaggccatggaccgtggtgcgaagactggcgccaggatgccacccactctgcatcactcagcctcaccttcacccaccccccaaccccccaaaacaccaaagatcccgaccccttcccctcccaacatcccacccgccaggtctatgaggttcagnnnnnnnnnnccacccagcctcaccttcacccaccccccacccccccgaaacgccaaagatcccgaccccttcccctcccagcatcccacccgccaggtctatgaggttcagcttgctggtgcgggtgctggtgatccccgtgtcggcgcgctccgtggcctcaattgtgcaggtgaacaccgagtgggaccggctgctgcgctcattcatgcgcgtggccgcgatgtgccggttctcgctgccccgctggatcagcaccatcacgtcgtcggctgtgggggggcaggggggaagggggtggctgaagggttgtgcgtgtgtcgagaccgagtttcccaggtgtcatttgccacatgccgtggggctgatggtggcctcgcagagacccgagcgccgtgggatgagggtggggcacccctccgatccagcccccttcataccaaccagcctgtcacttgggacagccattccatgcttccatcacctgctgttgctggctacacccccagccccccctctcccctcctctccaaggcctcaccattgagcacgttgtgctcgctgaggtcctggacgtacactccccgcttcacgtcgccgtcccggatctgcagcgccggccccggtgccagcaggtctgtgatctcctcgttgtagatctccaggaaggagcaggagatgcggtagcgcagcgtctgcggcccctccccccgctccacgtcctcgatggcgcggaacagggcggcgaagacgcgcagcgtgaggccgcagtcggggtgcaggccgccggcctcggaggcgcaggcctcgcccatcatggtgtgggtcttgcccgcccccgtctggccgtaggcaaagatggaggagttgaagccggccatgcagtgctccaccaccggcgcacccgccactgtgcggggccgagagcgggtgggaggggtggggaaggggggtggagtgggcccatgtcaggggctccatgggcagacggggcggtggcgacaggcggggggaggtgtgggcaagaggcgggctcacacgctgtgaggaggtctttcttgtccggagggtcacaccgggaggaacctcccacctccgcccatgcccccacctgcgtacacctcctcctgcgtggannnnnnnnnnctgaggaggtctttcttgtccagagggtcactccggggggagcctcccacctcggccatgcacccacctgcgtacacctcctcctgcgtggactcgcagccgaagacatggtcgtagctcttcaccaccggctccaggcgggagggctcggtgaggaccagggttcgtggccccacgagggagagggcgggggcgccgccctcccgctgctcgcggcggttggggggccggacccggaccatcacccgcacgccctcccccccgctggcaacctcctccccgctggcgtcgtccacgcagctgctgacgctgggcgcgggggaggccaggagggagggcgagggcatgctgtcggccgagggcaggctgcgccgcgccatcctcaggcgctcggggcgccccgtgctcagcttggaggtggatgagcggagagtgttgccggagtaggccgggcctccacgcaggggtggggtgccctgtgccgggggggaggattcatggtgtgagtgggtgcccggcgcgctccttcctcgggaatgctcgacctggtgggcaagccggcctgcacaccctcgtacccggtcgtttgcactgtgggaaaagaataaaaatgggggactgggggatgtggcatcctggcaggtgtccgcgctgcctggtgtggccatgtcgagctcggcccgaggggggcgggctggaagtgtcggtcacagatcggagggccctcgtgcgctcgtcatgcagggagggggtgggtttgtataccggtcggcatgttctgaagtttggtggcgcccagcgtccagattcggcccgtgtgcccgtggatctggcaaggcggggacaggtggttatattgaaaccggcgtgctgcgcatgccgtgatgggtccgaactccgcgaaactatctccaaactctcgctcgccacactgtgctggcgccaacgaataccaaggataacaaaaaagggatcttcaatacggcaatgcagattttgttccatttcattttcctctgnnnnnnnnnntcgccaacgaataccaaggatctcaaggataacaataaaggggtcttcaatacggcaacgcagattttgttccatttcattttcctctgctccttctggcacccacgaggggcagttggatactctggccaggctgacgactggaacctcccctggggttcagcttccgtgataccaaaacttacataccctacagatctggtgtcccgcacgggccgcgcccgtcgggcgcggctgcagcacttcaatacacggagagagcatcgttctactttgaggcagcgtgcgcctgggcacggcccgccctcccagggtcttcctgtcgttgtacttcagggactgcattgtccattcttcactccaccgcggtggagggttgggccccggccctcccgctgtcctcaggccatgggcttggggctggagggggaggtgttgaagtcgcgcttctcgaagggcacgcccagctccagcagcttgctgaaggcctggcggggatgatggggtggcagggtgtgtgtgaggtggcgacggtgggtgcggtgcggctgcaggcgtggccacgctgccgcagtccctgcatgcccctgcaccggggcagaggggggcccatgctcccctgccaagcccccgtcacttcgggcctcatgcctcaccctccccgcacaaccacgagaacccaccgcggcaaagtcctcgaagaacttgtcctggtccttggcgtacaggtccacgtactgcctgaacttcttgtcccagaccatccacatgtcggtgggcagcatcatgagctcccccgtcttgtcctcgtactggatgggtccgttccacttcttcttgtgccacttgcccttcagctcggtgaagtagccgttggagaaggtggtgggggagaaggtccaaggccccacgaacccggagcggtcggcgtggcagcgcccgatggcatgcgcgcccatcagcgccacgatctcctggtcgttgaagcccatgcggtagaagacgtcgcgcacgtgcttgttgtcgcgcgacgcgtcgggcaggcgcccgtccggcagcggcacgcacccattctcctccttgtcggagcgccccgggcgccacttgatctggggcccgcccatggcctcgatggccaccacgccggccagggtccagaggtcggagtaggagatccaggggaacttcttcttgatgggctccaggatgtcgcgcgcgtcgcccagccccgcgttggccccccagccggactcagggccgaagcgcatggtggcgccgttggagccgcccgtgttgtcgttcttgtcgtaggtgccgctggtgtgccaggccaggcgcaccagcacggggccgtagctgccgtcgtcgtactcatcgttggactccagcacgtcctcgatggcggcgcgcaccgcctggtagtcgggcttgaagtcctgtgggagggg

SEQ ID NO: 42121 - DNA, 16677 bp, Chlorella protothecoides
  modified_base (369)..(378): a, c, t, g, unknown or other
  modified_base (1168)..(1417): a, c, t, g, unknown or other
  modified_base (1551)..(1560): a, c, t, g, unknown or other
  modified_base (2018)..(2027): a, c, t, g, unknown or other
  modified_base (2255)..(2264): a, c, t, g, unknown or other
  modified_base (3142)..(3151): a, c, t, g, unknown or other
  modified_base (3228)..(3237): a, c, t, g, unknown or other
  modified_base (3561)..(3570): a, c, t, g, unknown or other
  modified_base (3818)..(3827): a, c, t, g, unknown or other
  modified_base (4423)..(4432): a, c, t, g, unknown or other
  modified_base (4569)..(4578): a, c, t, g, unknown or other
  modified_base (4751)..(4760): a, c, t, g, unknown or other
  modified_base (5595)..(5604): a, c, t, g, unknown or other
  modified_base (7295)..(7304): a, c, t, g, unknown or other
  modified_base (7930)..(7939): a, c, t, g, unknown or other
  modified_base (8410)..(8419): a, c, t, g, unknown or other
  modified_base (8878)..(8887): a, c, t, g, unknown or other
  modified_base (9601)..(9610): a, c, t, g, unknown or other
  modified_base (10069)..(10078): a, c, t, g, unknown or other
  modified_base (10734)..(10743): a, c, t, g, unknown or other
  modified_base (11011)..(11020): a, c, t, g, unknown or other
  modified_base (11388)..(11397): a, c, t, g, unknown or other
  modified_base (11454)..(11463): a, c, t, g, unknown or other
  modified_base (11984)..(11993): a, c, t, g, unknown or other
  modified_base (12741)..(12750): a, c, t, g, unknown or other
  modified_base (13068)..(13322): a, c, t, g, unknown or other
  modified_base (13393)..(13402): a, c, t, g, unknown or other
  modified_base (14680)..(14689): a, c, t, g, unknown or other
  modified_base (16113)..(16122): a, c, t, g, unknown or other
  modified_base (16294)..(16303): a, c, t, g, unknown or other
cagcgcagcagcgcgcgcggcgctggcgggcctgctcacccccacgctggcggcgcgggtggcagaggcggaccctcgaccccttctccgggacctggccgccggcgtgtgcacgcccgaggcggtgtggagcgccgagatgcgcgccgagctggagacggcgctggaaggcatgcgcgccggcgaggggggcggggatgccttcgaccccggcggcgcgcccgacgacccaggcgccagcctggggccgcaggtcgcggccgccgcggggcacgcctacgccgcgctggaccgccagctgctggtggcgggcgtgtttgtgcgcgtgtacgtcgcgtcgccggggtcgcgcgtctccgaccccgccgnnnnnnnnnnacctacgctgcgctggaccgccagctgctggtggcgggggtgtttgtgcgcgtgtacgtcgcggcgccggggtcgcgcgtctccgaccccgccgccctctgccgtggcctggtcacgcacctggcgcgcgccgacctgggtcaaatggcagaggacgcgctgctgtgcctgcgtgcgctgcgccagctgctggaaggcgcggcgcgcctgctgggcgtgctgtccacgcgcgccgcggtggagccgctcctgcgctgcctggcgtttggggtggacgccggggtcgaaggggaggggcatgccaggggagccccgggcgcgagcatcggcgcgccctcaggcgtggcgggcccccctggacccgcccctcacccctccctgcccgacccaccagccgccgccgccctggcggaggcggcactgggcgtgctggccacgctggcctcgcacgcgggctgcgtggacgcgctggcctcggaccgagcgacgcagctggcgctgtgggccgcggccgcgccgcccacgccggcctgccgagacaccgcgctgcgcgtgctgggcgcactggccagcgcgcccgtcgcggcgtgggcggccgccacgcgcggcggcgccctcttcctgctctccatcgtcctggatggcggcgcggaggcgggcaaacgccgcagcgccgccgcgctgctggccgcgttctccactcagcccacgcacggcgctcgagtgcggctgctgctgggccgcctgctccctcaggccatcctcgccagcctgctggtgggtatgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgcggcgcgcgcaggcgtcgacggggacgctggactgggcgcccgaggagggctatgccgtcgcctaccccgggctggaggacgaggtgtttatcggcggcgtctacgtgcgcctgtacctcaaggatccgnnnnnnnnnnttcgttcctccctgtcatgcgcggtgctcgagtcccctcggcagagggtgatccttacagcctccatccccccaggctcaccgccgtaaacccccatccatctcctcagggtgaccccgccgagcaggccctggcgacgctggagtccagctgcgagacccccgcctgcatctggaacccggccatgctggcgagcgcgaggagcgaggtggggcacctggtccgcgctgcgcggcgtgcgcaggcgttgacggggacgctcgactgggcgcccgaggagggctatgccgtcggctaccccgggttggaggatgaggtgtttatcggcggtgtctacgtgcgcctgtacctcaaggatccgcagtacccgctcaggtgcgtggggcgcttggtgggtggtgctgcgggagtgggtgtgcagtgtgtcaagggggtgcaccggccggaatgcagggcannnnnnnnnncggcgctgggtgggtggtgctgcggaagtggatgtgcagtgtgtgaagggggtgcaccggccggaatgcagggcaaccagcgcgcgacccgctcgcgaggtgcagtcgcggggacatccgtcttccaatcgaagtctccctgttgatgccagacgtgtatgtttgactgtggggccatcgtggagacctgcctgcaacattccttggctgattcgcccctccatgccnnnnnnnnnnagggacatccgtgctccagttgacgtctccctgttgatgccagacgtgtatgcttgactgtggggccatggtggagacctgcctgcagcattccttggctgattcgcccctccatgcccctcgccacacacaccgaggactccttcgtgctacattccccctctcaacccctgtaggtcgcccaaggacttcctccaggcgctgctggaccagatgctcgcggcggcaacgcgcgcccccgcgcagggcgcctgcgcggccaacgcactggcctccggcccgggggccccgggcgccgcgcctgcacccacacctggtgctggggccctccgccccgcaaccgaccccgccgacctgaccctgctgctgggcgccacggcctgcgcggcgctggacgtctacccccacctgggcgacggcctggtgcagcagggcgccgtggacaaactggcgcgcgccctggacgcgcgtacgcccgccctgggcgcccggcccgacctctttgcgttcgaccccgttagaggcgtggacgccgtctccggcgccatcctccgcctcctccacagggtgagaggggtgggcgggggtgcctggtcgccgtgccccctcgaatcccaccaaaaggcctggcggggtgtggcagcaccaagccgaggatgcacagcagcagcgggtcctcttgcgtgggtggcacggtgccacgtggtgcaggcctcagggtccggggtccaccaccccgcccaggactctccccaagcaatcctcatcaatgcaccgaatacttccgccttcccacgcagctggtcgcgggcacggccggggcggaggccctggcgcggaccccggtcccggccttgcccctcctgctgagcgcgctnnnnnnnnnnagggtccaccaccccgcccaggactttccccaagcaaccctcatcgatgcaccgaatacttccgccttcccacgcannnnnnnnnnctcgagaccctgctgcgtgcgctgagcccctcctcacgctcccgcgactccctggtgggggcagccctggcacgcaatctgccccagaccctgctggcacgcctgggggaggcaccccagcccgcagaccaggtagaggagagagggggggaggaattgtgggggtgcagctttacaaggagcctgaaggacgaccgtcagccaggagacctttcaagggactgactctgcgggtctgtgccgacttagttgtgtgacgggccacaggcaaccgtacgcagccccaagattcacgtctcccctcccctactccccccccccccnnnnnnnnnnttctgtgccgatttagttgtgtggcgggccacaggcaaccatacgcagccccaagattcacgtctcccctgccctaccccatcccccctttaaccctcacgccaggatgcgcaagtggctcgcgtggtgatcatcgacgtcctgcatgccctggcgaggccggggcagcatgaggcgacagtggcagccgtgctggatgcatcgggtacgtcgacattgaatgatgggcatgggaaaaagccggctgnnnnnnnnnngcagtggcggccgtgctggatgcatcgggtaggtcgacactgaatgatgggcatgggaaaaagccggctgttgacagtcctgctgatgcccggcactgtgcctatgccaagccaccatgctcctcacgtgcctccaactcttttctttccatcatccctagcagaggtgtggagcatgtacgcgcaccagcagcacgacctcttcctcccctccaacaccagccggctgctgcagggtggcggcggcgcagcggccttgctgcagggagccaggacctttgccctgcccgcaccatccgcaacgccgcccgccaaccgcgcagggatgcggcgaggaggagatggcgaggagagcgctggcggcgttcaggcgatgcaatcgcctgtccagcctggtgcaggggtggaggcaagcgaaaaccctccgcaagtccattctggattcagcgacgctgcacacactacaacgaaggagagtccagaacgagctcaagactttgcgccgagtgccagcgatcctgtgccgtcactgagcgtctctgcccctccatttggcgtgcctgcgaccacaggtgctgctgagcctggcgtccacnnnnnnnnnnggcgtctctgcccctccattcggcatgcctgcaaccacaggtgctgctgagcctggcgtccacggaacacgattggcagccagtgatgatgcatgtgcggccaagcaggtcgactcggccacaagtaaagacagcgnnnnnnnnnncggtgatgcatctgcggccaaggaggtcgactcggccacaagtaaagacagcgctgctggacatctgcaggaccagcagaaggcaaccccgcaagaggcagaggccagccaggaggaagcagtgggtcctgagcagccggccggcaaacaggctccttcgccagttgcacccnnnnnnnnnncccagccaggaggaagcagcggatcctgagcagccggcaggcaaacaggctccttcgccagttgcaccctggagcagagacatgggcccattgccagcgagcctatcacccaccgagggaccccaggtggcagcagaagaagtccttcagacgaccacaacacccgcagcaaggcccttggtggggatcacagagggaggtcctgccgccagcccctctcacccgaaggaacctgccgagacccctccaggcgaccgccctgctcccttggccatcaaccaggagccccaggaggcatcccaaggcatggcgtcgcccagcaccccagtagctgccgcacaggtacaggagtcacccacggccgacctgagcacacctctgcgccgatcgcgcctgactagccacgaccggagtgagagtggagacatgtcaagggcatccctcaggagtgctggggcgagccctttgggatagcgatggtgcaatttgagccgcttttgcaaatgcatccctcttgcgacctggtcttgctgcatgcaccgacatgtagacagagcagcgactgcttcacaggactttgttgtgggctatgacagggcatggcctgcctggcaaccagggatgggtatgaggtcggcagaaatccccatcaagcagtgaactttgtatgttgccatgcttagagaccaaggaagggatgccatgcacgaccatccaaagcagcatccagtgaggcctgcagctgctgcacatcattgttctgggcgtgagattacaccatatcctctgtcaaaataatgtcattcaaaggtttctttcgagtgcaggagcatgnnnnnnnnnnggaggcctgcagctactgcacgtcattgttctgggcgtgagatcacaccatatcttctgtcaaaatgatgtcagtcaaaggtttctttcgagtgcaggagcatggacaaggggggcatcgtgggcggcactggccccagctgccagtcgaaggaggcacagcagtaggagatcagtgtctggtcagcagtgctgctgttgcagggcttcgtcctctgcgccttgtttcaaagcgctccgtcagcaactctcatgctccaaacgctcatccatacacacacatgccagttgcctctgcctggcaaatcatgttagacggggggaatgccatccggatcctgcagccccctgaagtccagctgcagagccaggaggtgcagggggctgtgctgcccctgggcatagcacagctgcgccaggcgggccgaggcggcgtccacggcctctgcctggctccccaggccgccccaggcctcgcccagcgtcgccgcccaagcctcagagccgacacgcgaccgctccgcccgggccagccagcggcggacacgggccgccagctccatcgcttctccaagcgcggcgtccgccgtgctgcgcacgcccggcgcggcctcgaatcccgcgatcccgatggccacgtcccgtgcctgattcctcaccgcctccagcagccgctgcaggtcggtaaaggcctcgggggaggcgcggcggaggggcagggagggggaggatgtcgaggggtagggcgaggcctgatgcgcttcttggtccagggccgtcgtcgagcagtctcggtctggggcgccgtcctcggggcctgggagttcatcgtcgctcgcctcctcgggtgatggcctcgagctggtgtccagattcttgtttaaacttggttcaatggcccgaggagaccctctgggggtggtgtgcatcggcgctcctgtcgcctcgtctgcagagcatgtgagttgacgcaagcgagtcaggtaggaagtcatagaaagaccagcccgcccctgtcgctcagtcgctgcacgccagcttatactgcaagccagcaagattcctcaccaccaacagaacatccaccgacctaccttccatgtcgtggctgtgcaggcgtgagacgctcaccgagcccagttcactggaaccttcagtcgccagcttccgcacctcttggcgcgagctggcggcgaggcgcgccgccaggccccgccacgcctcgccctgactgcgctggtgcaggtagttcaccagcgcggcgcagagcaggccggcacgctccaggcccaagcgcaggcggcgcaggcaggcgcggccgggttcggaacccgccaccgccccgcgccgccccagccgcgcgaggtgcaggcgcagcgggcgcagcgcgtgctgcacccgcctgacacgcaggtgcacgtcgaaggccgccgagaaggcggcgcgcacctcctgtggcggcgtgaggggagcgtggggtggcggggcggagtcgcagggcgcttgactctgccagatcagtgttgctggccgcaaggcgaggccgccaaacctgccgccacccagtgcccctgaaaacaaggcgacagtcacccgaccaaccagcaaaaactcatccaccctatcgccttcgagcatccaacccctcaccctgcccagcacatgcaacgcagtacctctgtgagcacggcnnnnnnnnnnctgctggccgcaaggccaggccgccacacctgccgccacccagtgcccctgaaaactaggcgacagtcacccgaccaaccagcacaaactcatccaccctatcgccttcgagcacccaacccctcaccctgcccagcgcatgcaacgcagtacctctgtgagcacggcggagaggggccaggtgacggtgtagtcgagcaccaggccgcccagaggtcccaggcagtctggcgccaggagcggcggcgagtgctgcgccgctttcattgcgggccggcgagcgcgccgtgccggcgagcccagattgcccgcggcgacctgccccgccaggccggcagcagcggcggggtcgtgccgcaagcgcagccgcgtcgcgcgggggtcgcccgccgcgccgctggcccgaagcgagtgcgccaggcaggcggcgagggatgatgacgtgatcggctccagggcctccagtctgtcgctgaggccggcgaccagcgcatcggcccagtcccccgcgcccatgaggaagaaagagctaagggcctcgatgtggtccaggagtctcagctcgtccagaaagtaactgggtgtggtgtgttgtttttgggaggggtgcttgtgttggtctggcnnnnnnnnnngaagggcctcgatgtggtccaagagtctcagctcgtccaggaagtaactgggtgtggtgtgttgttttgggaggggtgcttgtgttggtctggctggtcgacagaggttgtgcatgctcaggcatgaagcgcgcagcctctgcaatcccaaagccctacccttcctggccaacattccccgcataacccatgtcgaacgagcggcccccgtcagacccacaaccaccacgaacagcgcacacctggtgcaagtccggctgacggcccggtgctgcgaaagcacaggctccacaatccaggcctgcatgacatcctgcagcgagggcaggggcggcggcgaacccttcgcatccgccgcaccgtccagcgcctcggcattcagcctggaaagcggggcgcaggcgtccaggacagcgcaggggctgccctctcgcaggccgcaccgccacgcgccgacctgcgggctgctcnnnnnnnnnncacagcgcaggggctgccctcgcgcgggacacaccgccacgcgccgacctgcgggctgctctccgcgctgctactgccgtttgaaggcgacgcggcgggtgggtccagaggcggagccttccctgaccccgagcccacggcgccgagcgcgtcggcggccgcccgcgcgcgctctgcggcgtcgcgacgctgactcagcgcgcgctccgctgccgctgccatgctggccgccgccctcgcggcgcgcgtgttgggggcggacaggtgctcccgctggcgacgcagcgcctcggtcagccgcgcgctctcggcggccgcggtcgccagcctgcaacgtcgtgggtgcagagggtgcattgatgcaaggggtgatgtgtgctgagcgcacggaagaaacagctcagagatagcaccccagagcacccacgctgcctgccagcaacttccaataagaaagcnnnnnnnnnnatgggtgcatagggtgcattgatgcaaggggtaatgtgtgctgagcgcacggaaaaaacagcttagagatagcaccccagagcacccacactgcctgccagcaacttccaataagaaagccaggccaccaacatcaaccaccccccacgcactgcttcgcgcgcatggcggcggtgcgtcgcagcgcggccgcagccacggcacgctcctgctctgatctaccactcgccaggcgggccagccaggcatccacggccgcggctctccgcgcctcgcccgccgcgttggcgcggcgcaggcggtccaggtcgtgcagggtgaggggcggcgaggctgtggagggcagggacccctgcgccaggcagtcgcggtatcccgcgcccggcccgtttgctggagagtacgcgtcgcctgccccgggagcagccgcgaggaggtcggcgagcaggcttccggagacctcgcctggcagggaggccagcaggcgcagctgcaggccccccgccagcaagggccctcggatggaggacaggaaggagggtgggtcccctggcaggacatgctctggtccggccatctcgccgctggctctgtcattctcacccatagacagcgctgtcgccgggagggcgtcctcgaccccgccctccctctgcaccaactctgggcgccagggcagggcgtcgacagactggcccccggcgctggccagcnnnnnnnnnncgacagcgctgccgccgggagggcgtcctcgatcccgccctccccctgcaccaactctgggcgccagggcagggcctcgacagactggcccccggcgctggccagctccgggtcgggcgcgcccagcccgtaggcccagcccagggcgtgcgcggcatagggctcgagcgcggcgaggaaaacacggcgcgcgcacccccccgcgtcgtctcgcgcgccgccctgcgcggcggcgtgcaggacctccagcagagcggcctggtccggcgcgtgccgcgccgtggagcacagcgtgcacagcagggacagcgtgcggcgcacgcctcgcgtgcctacctccacctgcagcagggacagggcggggtcggcgccgcggcgcagcgtgccactcgcatggccatcggtcgcattgccggcgcccacgccgggcccgccgcccgcgcccctggtcgctcgcannnnnnnnnngctcgcatggccatcggtcgcatcgccggcgcccgcgccgtgcccgccgcccgcgcccctggtcgctcgcacgcgagccagaggcacgcggccgtgcctccgccccagctccagcagggagtggtccagtgcccgcagctcgcaccgcacggcggccaggaaagcgcggcccacgggtccttgcggcacgctggccgagctcttgtcgtcgtcgtgggtggggtcggccgagcccttgccgccgtcatgtcctgggccgcgcgtctcgtcgtcgacgtcctgccccttgcagtccgtatgaatacccctgacagaaagcagggcctccacagcggcgcgatctcgcgcggcgacctgcaggtccaccaggacactcagggcggcagggagacgcggtgctggcgcctcggcccgcgcctcggccaggccctcctcgagcccagccagtgctagcgtggagcctcggagcgcggccaggcccagtgccgcggcctccgtctcgcccagcgtccacagcgcggcctcgggcaggggcgcccagccggcgttgatgtccgcgcccggcccgtctcgcccgctgccgacgcggcgtgggccgacggcccaggcgccgtcggtgtcgggtgccagcccctccgtccccgggtcaaaccccnnnnnnnnnnaccactgccaacgcggcgtgggccaacggcccaggcgccgtcggtgtcgggcgccagcccctccgtccccgggtcaaaccccgtcagcgccccgggcgccgagtccaggcccagcaggctcagcggcaggcccagcgggggcggggaggcgacgctggacggctgcgccgccaggcggctgggcagggtcagcgcgccggggcgctgaccgctcgtaccgctcgtactgctcgtactgccgtccagcgcggcctggctcagtggatcnnnnnnnnnntagcgcgccggggcgctgaccgctcgcaccgctcgtaccgctcgtaccgccgtccagcgcggcctggctcagtggatcccactgcggccggttactcagtctggccgccaggccgtgcacgccctcctgcccctcgaaggccgcgtagggcaggcgcagttcggcgggcagcagcaagctcgtcggaccggcggcggtggtgagcgcgtcggggtccggggcctgcgtccacagccgcgccgcctcggcctccaccagccggccgtgcccggccctggcggcatcggtctggaagctgaggctttgccggcgcaccgagggcgaggagccctggcgcgtggggggagggcggggaagggtaggtggannnnnnnnnnagctgcaactgcatcgacactacagtttttcagcttgcaagctcctccccaaggagnnnnnnnnnncggcggcctcggtctggaagctgaggctctgccggcgcaccgacggcgaggagccctggcgtgtggggggagggcggggaagggtaggtggagagcacagatggaggaccaacagcccctccttgggggaaggaagatccatgcgagtctggggaaggggctggttacaactgcatcgacactacagcttttcagcttgcaagctcctccccaaggagcaggaacgtgctcctgaggtgtgaaccattgaatgcccaggactgcgaggagagcagcactctgccacacctggagggagagcaggaaggcgaggagggcaggctgctcctgcatgggtatggctgggggcgcgccgacttcccgctggatgccggtgcccaggacatggacgacctggcacctgcattatgaaggggtgaatgtgatgcctccctggctaggcgtgatccgccaggcgtgcatggcttccagcccttcaggtactgtgctttgacgaaatgagctcatgccccacgttcacnnnnnnnnnntgccagacgtgcatggctttcagcccttcaggtactgtgctgtgacgaaatgagctcatgccccacgttcactcatgcagccacactctcaccccgccccatgccctgaccccacctctgcagctcagcccaagttgcctggagcctgcgtcccagctcctcgaacccctcgtcagcgaggcgatcctggctgtccctgagcctctcctcgaggtccacgattggcacggagggtgggccctgcgggaggggacagggacccacccctcggcaccgatccagcgacactcaggtgccatcatacacgcccttccactccggacgatgcttaccgccctcaggcccagcagcaggctgtgtgccatcctcctcgcagcgtttcgttgagactgggttggagactcgtcaggcaccatgcatcgcacgaggtggctcagcaggccggggtaggccaggtccgccatggcccggttcccccctccggcctcgacgcgtcagacgccctggtccctgctttgacccatgccagggatgcaactcgaggttctatgtatcggagctgtgatgcggttgctcattcaaggactcctcggagggagcacggggcgttcctatgtcatactcggtcgcgctcgggaatatgcgtgccagctcgccatcttttgaaagcgtgttgtgcggtccgatgcacaccccttataacacccctcccccccaccccacccctggatgtcgcctgctaaccctnnnnnnnnnncaaaagcgtgttgcgcggtccgatgaacacaccctgtaacccccctcctccccccccacccctggatgtcgcctgctaaccctaaccatttcaacgggctgacttacaaaagggatagcatgcacttcgtcgcggtgctgctcaagttctctggcaggggtcgtgcagtatatgttgactcatgggggttcgtggccatgggcaggggcagtgcgcgtcccactccgaaacatggggcgaggcgcggcctacgcatggcgtcatcactgctggggtcgaagacatggatggccggggggtggcgcagagggctgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgggtgtggtgatgccagagggcagccgtggaaagtaggagcactccagagatccacatgcatctctnnnnnnnnnngtgatgggtgtggtggtgccagagggcagctgtggaaagtgggagcactccagagatccacatgcatctctcatctgccagcgcccacgtccagggactgcatcttcgtccttccttcctgctcgcacgcttcccatgcagacaagctggcacccgcatgggagggccccccgggaacaagcccgcggttcacaacctcccacccccaacacacaccaaacctcccgcccctccttaacaaaaactcatccagggtctctcaccagccagtccgcacaggcctgggggtcattgtggaaagcgcggagcgcgcgccgcgcgtcggacacgacgctggactccggggagtagtagtcccagaggccgtcggagccgaccaccaggaactcgtcgcggccgtccagcgcgcgcaccgtcacctcggcgtcgcccaccagcgggccgcgcgggcgccccgcctcgtcgcgccacttcaggggtgagcccaggtcccagtcgccgatggagcggcagacgttgatgtcggaggcgaggatgaagtcggccgacaccgccacgcccgcgtcggcgaagcgcgcgcgctccccgggcacgtccgggttgtggcaggtgttcagcgcctcccccgcgccgcgaacgctgagcatgcccttgcagtcgcccacgttggcggtgtacagcacgccgtcggacagcacatgggccaggagcgtggtgcccccggtgctcaccgcccctgcggcatacagcccgtgcacgtgctcgtccagcgcgcgcacggcggaggagagcgcggcggccaggtcgcgcgcggcggcctgcgccgcgacgaacgcgcggggcagctcgtccctcaccgccgcggcgacgtggtgcgcatggtgcccgtctagcacggccaccacggtgcagcgcgggcggcccgccacggccgtggagaagaggatgtggcggtcgtcgttggaggcgcggccaccggcgtcgcacgacacgccgcagcgcagctggcgcagctgcgttgtgtggggaggggggggttaacaagtgagaaggggtaaaggagctgcagggacgtatgaattaccatcatggaaggaaggggaaaggtgaatgggtggagcggcattagagcagaggccagggagtgtggtgtctccttgacaaggggaggcgaggcagggagaggctacagggcctgcaggcacacaaggtggccctggcccctcacccttcccaagcccgtcgccaccaggatctataggaaacaccatattaacnnnnnnnnnncccctcacccttcccaagcccgtcgctaccaggatctataggaaacaccatattaacaatgaaatgggtgcttccacgcctggagcacctcaggtcgtgcacggaggtccctcctcccacccccgcacctcaacatcccctccgaacagctgctggacggggttgggcaggaggccatgctcggaagcagggtcgggggtcgggcggcaacaactgccgttcaggatgctgctgggcgaactcacggcgaatggcgagtcctcgcgattaacgtctggcagggaaaggccagagaccatccggcgggcgtctaacaccgggtgaccagggggcgggcggggccacgatgcattgttttgtaaatcagcggtagaggtagcggggttctattggcagagggtgtggatgggcgcgcccctccttccgactggaaccttacgcgcatatccctctgccgaagatgcagggaacgagagggaggaaacgtggaaagggtggtcaaggggcgcaccggttcgaggggggtccgggtctgccatgccagcctgatcgggaaggctcatgaccgagactatccacaatacccgttcatgatattctctcgtgctccgcacatcgggacctgactcgctgggcagtccctgcggaacagggctctgcacaaaaatagcccgcaagcgacgcccagtcattacgacagagccgaggctcccacaaaatgcgtgaaatcgtccatcttcaagtgggtagggagtaaatgggtcaagccctcgaattaaagtgcggaacgccaaacgtcgcctgtcccagagggttcagaccccaacgacgttcacctagtcgatccgacactccgtaccctccccaccacaatggcaggttggccagtgcggtaaccagatcggtgccaagttctgggaggtaagagtggtatcggggacgctatggctgtactctcgtgggaccaggctgtgggtcagatctccgccttgggttccggatcctatcctcgatccatctccccccgacaggtggtctgcgatgagcacggcgtcgatcccaccggaacggtacgatgagtacacgggccaccgaaggtttcgagacagagaattgatgcttgggaaagactgaacctttcacctggtctcaccttgctcttccaatgccgacctcctttcccccggcgacagtatgccggtgagagcgatctccagctggagcgcatcaacgtgtatttcaatgaagccactgggggacgctatgtcccacgcgccgtcctcctcgacctggtatgcatcttgaccctggctgaggagttcagggttgcagtttggtccacgcagggaagtgggacaacaacatgcttgggtggatgccctgcaaacttgccccttggtggccctgcgtcgcggccgaacatnnnnnnnnnnaaaatgggtcaacaacatgcttgggtggaggccctgcaaactcgctccttggtggccctgcgtcgcggccgaacatgggtccttcacccccctccaacgcacaggagcccggcacgatggatgccgtgcgagctgggcccttcggccaggtcttccgccccgacaactttgnnnnnnnnnncccgatcgctcctgcactccggttgtcgcatacctcatacccgccctcacccgcccccccacattcaccaactttctatccacagtaaccagatcggcgccaagttctgggaggtacgcgtcgaatggcgcacattgggcttgtttaggcgcaccgcacaggcacctgcccacctgggtccatggccgactcacaatccccatttcccttccccaggttatctgtgacgagcatggcatcgctcccgacgggtcatacgtcggagacagcgacctccagctggaacgcgccaatgtgtacttcaacgaggccaccggcgggcgcttcgtcccccgcgccgtgcttctggacctggtgagatgtcgcggcagggg

SEQ ID NO: 42122 - DNA, 74 bp, Chlorella protothecoides
gcacgcaggcacagcagcgcgtcctctgccctttgacccaggttggcgcgcgccaggtgcgtgaccaggccacg

SEQ ID NO: 42123 - DNA, 79 bp, Chlorella protothecoides
caagacagacaacctgcgattccaggcgcgcgggtggcaggaggagtgaaatctgtgcatcgtgttgtggggatctgct

SEQ ID NO: 42124 - DNA, 550 bp, Chlorella protothecoides
gcgtcggtgggtgggcgggtgggtggagagggcctgcgactggtgtgcggggcgaggcgcggcagcaggcatgtggcccgacgccagccccagggaccagggactgccgtgccgccacccaccctgcctcaccgtcaaaggtgaggtgtttcttcagcgaggcgtcgccgctggaagaaaccttggcgggggcggaggggcggttggcatggccaccctggcgcgccttgaccctcaagctcgcgggcgtcgactgtgggggtagtgggtgtggtgtgtggggggggtgggggctcggtgatgtcgtgggaggtagtctacacacgacgtatcgatcatgcacgcagtaccctgccccggcgtcgggcggcgccacacgcacgctcgggacccccccgggaaccctcctgctcacctccagggactccagctggcaccagcgcgctcggacctgctgcgcggtgcggccctccatgaagcggctgatgaagctccagctggcacctgctcggagacaggtaaaaggatggggccggggggggggggggcg

SEQ ID NO: 42125 - DNA, 61 bp, Chlorella protothecoides
acacacacgcccaacacacacacgcacccaccacacacacacgcacccaacacacacacac

SEQ ID NO: 42126 - DNA, 79 bp, Chlorella protothecoides
ggtcttggcatgcttccgaaggccccgctacccccgccatgaaaccgtgtgcagcaactgacctgacgatggcggtctt

SEQ ID NO: 42127 - DNA, 61 bp, Chlorella protothecoides
acaggatggcatccagcccttccggctgggggggggcagattctgggagcttctcggccag

SEQ ID NO: 42128 - DNA, 4475 bp, Chlorella protothecoides
  modified_base (126)..(280): a, c, t, g, unknown or other
  modified_base (377)..(386): a, c, t, g, unknown or other
  modified_base (474)..(517): a, c, t, g, unknown or other
  modified_base (1139)..(1148): a, c, t, g, unknown or other
  modified_base (2184)..(2193): a, c, t, g, unknown or other
  modified_base (3061)..(3070): a, c, t, g, unknown or other
  modified_base (3441)..(3450): a, c, t, g, unknown or other
  modified_base (3688)..(3697): a, c, t, g, unknown or other
  modified_base (4292)..(4301): a, c, t, g, unknown or other
  modified_base (4390)..(4399): a, c, t, g, unknown or other
ccgggcggggaccgccccgccgcgccggagccgtgccccggcagcgccgccgcggcggggctgcgcatggggctgcggatgggcgaggccagtggcgagatgaggtcgatggcgccggcgatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgaggcttggcaggtgtgcgccgcccgggccggggtcggggcttgggcttgggcgcggggcggcggccgccgaggcggggcggtcgcggggggnnnnnnnnnnccgaggctcggcaggtgtgcgccgcctgggccggggtcggggcttgcgcttgggcgcggagcggcggccgccgcggcggggggggcgnnnnnnnnnnnnnnnnnnnnnnnnnnnnnnnnnnnnnnnnnnnngggggctcgccgctccttcttcctggcccgcacgccgccgctgggggtggtccgccccgccgtgagcgcccgcagccccagggctgcgcaggggagggggatggaaggggatgaggcgagtcttgggggaccgcgaccgtgaggccatgcccgaggcttgctggtgaggaggggtgcacaagaaaacatcagagggccccccccaccgacggtcacacccaccttccaacagcttccgacgcagccagttgttgttgaagctctgcgtgggggacccgtacactcgctggaaggcggcgcgcagctcccgctggcccatggtcctgcttcagcaggagggcgagggggacagcggtgttttgacccctgtttttgagagatgggggcccgcagcaaggaggtgctgtaccgagggaccctggcccaacagtggctggcgctctggtgcgtaccggcatacaggtgggatgcaatcagaaacgtgcacaggtcctacacatcctgggtcaagcacgggtctgatgcccaatgcatgatggtgcagcgccctcatgccaaccctcaggattccacatcatgcgactccaacctgcgccctcgctgcgcccagccacccacaccnnnnnnnnnnagccctggcccaagagtggctggcgcactggtgcgtaccggcatacaggtgtgatgcaatcagaaacgtgcacaggtcctacacatcccaggtcaagcgcggttctgatgcccaatgcatgatggtgtagcgccctcattccaaccctcaggatttcacagcatgcgactccaacccgcgccctcgctgcgcccagccacccacacctgacagcatgccgggcggcttccaggctgctggcaccaaaacgatccaggacgctggccccccgctcctcctcaggcagccagtgccgtgtgaggtggtgcagggtgggccgcggcgcagcatccacctccatgcctggggcatcaggcccctgagggctggcctggaccctgctcgactcggtgggggaggtgtccagctctgacgtgggatcagtcccggcctccccatcctcgggtccgggcgtccgtccctgccgtggctccggggaagccagtgtcggccagctgcccgagcaggacccggcgggtggctgcaggggtttccgtcacaagggtcggctgttcacgcgagtctaatcggcggtactgccctcattcctggattttggagggttggagctggtgggagcggcccggaatgtttgggtttggggctcgtcccgcctgcgtggtctgtcgagtgacctggccgcgagtgcgaggggcagggaacgtcccgcgtcaatgcacaggaaaacccaagtaccgaaagcgcggcgcactgctttcgaaggtatggtgtgtcactgggtgcctgggaagggcaggggagcgggcccgggatgcagatcacttctgtccgaggtggaaagtatcgcgacccacgcgcgaccatctcgtggaccatagggccatggatacgcattaagcgatgcataattttaaaaggcatttcaatgtgaagaaccgaggtggagtgtaagcggtagctggctcaagcacttcgcggggtcaacaacaggctggtctcaacggtcttggtgcacccccataccgggactcagcannnnnnnnnncgagcgatgcacaattttaaaagacatttcaatgtgaagtaccgaggtggagtgtaagcggtagctggctctagcacttcgcagggtcaacaaaaggctggcctcaatggacttggtgcacccccataccgggactcagcaaggcaatatatgatgatcatgacataaaaagcacgatgatcaagtctcgcaagtatggagtggcgtcctcttacgcaaaaagtgcgacactgagcgtgctatcttaacgggcccgcaaacgcagcgcggggtggtaccggtacacgcagtacacagcagtagccacagcttcaaatgccgaggatcagcccgacgtacccatatactttcttcccagcatactcgtccggcccaggccgggataaacaagcgccgtgtgcgtgtcgcctgcaagggcccgacacaggcctgcagcgcggggctgggcccacggagccgcgcgcctggggagcgccagactgccgttcgtatggccatggaagtggatgtccccaatgccatgcctccttggggacaggctcctgccccggcggtccccgccaaggctgtcactccttctggaaacagttatcgccagcgggaggcgacccagtttaggggtgtcacgaagacctccgggactaattcggggctcgagaagtttgacgtgcagtgagtgcaggccggcaatggcatgcacgtggtagaggggtggcctgggatgatggagaacgctgtcgccctccttgtcaaaacccacttgcgggtttccttgtggggacaaccaggaggcatgctggcagcaggtcacctcccatcattgcggctccagtctccccctgatcccagttccacgtcccaccaattnnnnnnnnnngtcatcgcagctccagtttctccctgatcccagttccacgtcccaccaattcaccccaggtttgtgttctgcgaccacggcacaaagaagcaccccaagatatatggatttgggagtgcaggggcggctgcctgtgcctttgacattctgacctgcaaacgagcgctggagaaggggaggacggtggctggcgtgctggggagcgcagtggtatgtagagtgtggtgggggggtgagttcatggacggcattttggcggcacggtctgggaaaggtcatggccatcacactctctggccgcgagccaaaccctcgatgtgtccctagcactctgcctggcgaccgctggggtgacgcccaagggcccactnnnnnnnnnntgagccaaaccctcgatgtgtccctagcgctttgcctagtgaccgctggggtgacgcccaagggcccactcacttgcccatgacgccttctgcgtgcggtccggcacccatcaaggcactcccttccgctcgatcacggtgcagagtctggccacaaatcacccgtcaactaactaccagaatgatgagctgctgacactgctgtcaagcatcacacgagacgacgtcatctatgggnnnnnnnnnntccttccgctcgatcatggtgcagagtctggccacaaatcacccgtcgactaattaccagaatgaggagctgctgacactgctgtcgagcatcacacgagacgacgtcatctatgggctcaaaatctgtgcgaagaaagggtatctgctcggcaggtgagcctggtcccgtgggaggggttctcccgcatgcgccacgccggtcggaagggatgcgcagcacaacaccgcgtctcatctccgagcgcttgaggaaccctgccctccctccccaaagccaagagaatccagccccttacccctgcccccttgtacaccgtctaagctcgctggtcgaagagttgagagatggcgtgagcacggcccagagagaggcggcggagcgcggcaagcagggcgaggcgcgccagagctacgagccgtccgccaaggtgcttgggtgtggagacagggagggggcctgaccccatcctgcttggtgcaggcgcagcgattcctagcatggagcgtagctcttgtctggccatgctctgcactggatgcgagtcgtttttgcccaaggcacaccctctaaaatcccccccccctcctccacnnnnnnnnnnatagctcatggcaggccatgctctgccctcgatgcgagtcgatttttgccaaggcacaccgtctatatccccccccccctctccaactnnnnnnnnnnaggctgcccccggcgagaggaagcgccgcgcgtctggcggcggccgcggcgccgccgcggccgcggcggcggccgg

SEQ ID NO: 42129 - DNA, 80 bp, Chlorella protothecoides
gatcaagccagagcccctcctctggaccagtacctctctcagggatcccagcattcagcacggcgatgtcgaggcccccg

SEQ ID NO: 42130 - DNA, 61 bp, Chlorella protothecoides
tcttggcgggcttcttgccgctggcggaggggtcactctcatcgtccgcctcgtccgcctc

SEQ ID NO: 42131 - DNA, 61 bp, Chlorella protothecoides
ggacggagcaggtggggaggagggtcggggggggcaacctgccgtgccacggggcctcgcc

SEQ ID NO: 42132 - DNA, 61 bp, Chlorella protothecoides
gctggcgctgcgctgtctgcgtggctgggcacaggcctcggtggtgaactgcgcgacgctg

SEQ ID NO: 42133 - DNA, 61 bp, Chlorella protothecoides
taccggatgcctggagaccgggggggagatggggattgggggtgcgacagggggggtgagg

SEQ ID NO: 42134 - DNA, 61 bp, Chlorella protothecoides
cgtgcgcccccccgggcaccacgcggagagcggcaccgcccagggcttctgcttcctgaac

SEQ ID NO: 42135 - DNA, 79 bp, Chlorella protothecoides
gcacaagagcttgagcatcctgtaccaggcttcccactcacgttgggatcccccgtgcatattctccaaccttccacat

SEQ ID NO: 42136 - DNA, 71 bp, Chlorella protothecoides
cgtgactcggacaggtgttggggtggggttttttgttgcttgggggggcgctgggtggtctctgtgagggg

SEQ ID NO: 42137 - DNA, 72 bp, Chlorella protothecoides
agtgcgtgttcctttgtgcagggaaaacggcagcagcaatcatgcaccgccgacagcgatgcaccgatccct

SEQ ID NO: 42138 - DNA, 61 bp, Chlorella protothecoides
agacagcccggtcaatcctgtcgaatggagcgaaaaggggtgtggatggtcttcaacaagg

SEQ ID NO: 42139 - DNA, 61 bp, Chlorella protothecoides
ggccagctcctcgccgaccacctgcatcccctccaccaggccgcctggcggcaggccctcc

SEQ ID NO: 42140 - DNA, 61 bp, Chlorella protothecoides
gtccactccttcgacagggtgcctggggcctggccgagacagctccccaagctaggcaacc

SEQ ID NO: 42141 - DNA, 76 bp, Chlorella protothecoides
tacgaatgatgcaacacagtgtgggatgggacactacaaacaggagccctgtgagcaccgctccgcttcaccccac

SEQ ID NO: 42142 - DNA, 409 bp, Chlorella protothecoides
  modified_base (126)..(312): a, c, t, g, unknown or other
ggtgaggggtggggtgggatgcatgcaaaattgcccacactgggccgtggtacacaaggaaggccagctttacttgggcaccgggtcaccatgcgctgcagaaggcctcccctgggagaagctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgacgacgccgggcgcaaagcgcgcaaagcgcgccgcgtcctgccgcgcgccgtccagctgccgcgccagcgtgctcgacaggccctgggtcgc

SEQ ID NO: 42143 - DNA, 76 bp, Chlorella protothecoides
gcgagggcatggtgcagagggcacaggtgcattgtgaccccttcctgggtcggcgtggcggccgcatggcattcca

SEQ ID NO: 42144 - DNA, 61 bp, Chlorella protothecoides
caggtgctgcagatttccgctttacggcgggatgctctgccgtacaggcatcgatgaagat

SEQ ID NO: 42145 - DNA, 61 bp, Chlorella protothecoides
cgggtcgctgtccccgtgctggcaggtggggggagcgtccctgaagcccgagttcgaggac

SEQ ID NO: 42146 - DNA, 61 bp, Chlorella protothecoides
tatgcaatacacgcccgctccagaaggcggaccgcacacgcagatgaaggaagccgggacg

SEQ ID NO: 42147 - DNA, 111 bp, Chlorella protothecoides
gtaaatcagctatagactagtaatggtgcgtaatcgttgtttatgtagctttcgggcgacacgctggccgcgtgccgcatgtacgcgattcaggtgttggacggggcagct

SEQ ID NO: 42148 - DNA, 117 bp, Chlorella protothecoides
gtcgtgtgtggggagggggaccgtggggagcgggtccccgcagcatgcccctccccggcgcccggggatcgccctggaccctggcgcggggcgcgccgcgccggctctgcgtcgggg

SEQ ID NO: 42149 - DNA, 61 bp, Chlorella protothecoides
gtaggccggcgcctgcacggccgccgcgcccgtggccgccagcgcgttgtgcagcagctcc

SEQ ID NO: 42150 - DNA, 72 bp, Chlorella protothecoides
ttgtcgatcttggggtcgggcggggggggggcggcatcagcccacagcctgcaggcactgctgctggggcca

SEQ ID NO: 42151 - DNA, 65 bp, Chlorella protothecoides
ctcgaccaatatatctccgagacccccagaaaggcccccatactcacctcgttcatccctcgtat

SEQ ID NO: 42152 - DNA, 61 bp, Chlorella protothecoides
atcatggagcagtggtggggcaggcagagggttgggggaggcagttgggttgggtgtggac

SEQ ID NO: 42153 - DNA, 61 bp, Chlorella protothecoides
gttgcggctgatctcgtcgtcgctggcgcgtgtcgtctccttgatgcgcgacagcatgacg

SEQ ID NO: 42154 - DNA, 72 bp, Chlorella protothecoides
gccggccccgtcctggccgcggcagacgggtctccgccaattggcgccctgcaccttccccagccggggccg

SEQ ID NO: 42155 - DNA, 73 bp, Chlorella protothecoides
cgcagcgcatgcgtctggggtgggaatgggcgggcggactgccaggcaagccaccacctgcactgcccctgca

SEQ ID NO: 42156 - DNA, 72 bp, Chlorella protothecoides
gccagaggcagcgggtgctgtggagggacccgactagcccgcagcactgagcgagctgggcgcctggggtgc

SEQ ID NO: 42157 - DNA, 68 bp, Chlorella protothecoides
ccctaaccctaaccctaaccctaaccctgaacctgaaacctaaccctaaccctaaccctaacctaacc

SEQ ID NO: 42158 - DNA, 63 bp, Chlorella protothecoides
gactcgaggatgctacatcatgcgatccccaccccccactgagcagtggtgccagagagatgg

SEQ ID NO: 42159 - DNA, 61 bp, Chlorella protothecoides
ctttgcgcagggctgtctctcacaggcgggggtctcggagactgaatcagcatggctgcca

SEQ ID NO: 42160 - DNA, 61 bp, Chlorella protothecoides
atggttaccatggccacagccaggcgcccgccctccgtctgcgcccctgcctcctctcatc

SEQ ID NO: 42161 - DNA, 63 bp, Chlorella protothecoides
catcagctcggcccatcctctggcccgcctggtgcccgccttctccatgccctgtcctacggg

SEQ ID NO: 42162 - DNA, 155 bp, Chlorella protothecoides
gggggatcccaggctgcacggtgacgcgcgaagccagtccactctcacaccccgcgagccccaccttgagggggttggcgtggaagatgaccccgtccagggccatgaggttggaggcctcctcgatgctgcgcagctccaggaaggcgtacgtc

SEQ ID NO: 42163 - DNA, 78 bp, Chlorella protothecoides
ctcaggctcgagatcacggggagctggggccgggcgcagggtgcgatggcgcagccgggatcagctgcccagatccaa

SEQ ID NO: 42164 - DNA, 61 bp, Chlorella protothecoides
ccacaccacaccagaacagcacacaaccaaacccccacccaacagccacctcacccgcgga

SEQ ID NO: 42165 - DNA, 140 bp, Chlorella protothecoides
gctgccgtacagggcggggtggccgtcaatttcggtggggacctgggcgtaggggacgggacgattatgggggggtagagaacggggcaagccagcatgtgctgggtaaaccttctggacccagtgcaggctcaagactc

SEQ ID NO: 42166 - DNA, 159 bp, Chlorella protothecoides
acagcagggattggcccaggagcttcgacaggggcggggcaagaaaccccaccatctgaggccaaaggtcgccgtccaattttccaacatgggccggtcaggagcaggcaaacccaatgctcgaacagtaaacatgctcaccctgactggtttgcggct

SEQ ID NO: 42167 - DNA, 61 bp, Chlorella protothecoides
aaccttccagctcgacatcccccggtctggctccatgcggatcagtatcacatcgtagagc

SEQ ID NO: 42168 - DNA, 61 bp, Chlorella protothecoides
gcaccacctcccaccgcctttggcggcgcgtccgcggggacgctgtccttgttcggcgccg

SEQ ID NO: 42169 - DNA, 128 bp, Chlorella protothecoides
gcaagccccgacgcaatgcaccttcatgccgaggaacaagggacctaaggaggcaagcagtagcacctcccgccggccaccgcacatgcagtacaatccagggacgcaccgacccaggctgagtgtca

SEQ ID NO: 42170 - DNA, 61 bp, Chlorella protothecoides
gtccggcacggctactgaatcctctgcgaggaacgtggccccacctcttcttcctgactgc

SEQ ID NO: 42171 - DNA, 61 bp, Chlorella protothecoides
cggcgctgctgccgttgtacagcggcagggtcagcgtctccaggccgccgccggtgagcgg

SEQ ID NO: 42172 - DNA, 61 bp, Chlorella protothecoides
attcccaaaggtgctggggaagctgtacccgcggctgcggctcggacccgatgcggcgggc

SEQ ID NO: 42173 - DNA, 64 bp, Chlorella protothecoides
ggccctcactgtcttcaacctccaagtgggaatccatcaacccccaaccaccaaggaaatcctg

SEQ ID NO: 42174 - DNA, 125 bp, Chlorella protothecoides
cccaggcaacaggcagcgaccgacagtcgacggacgtgatgacttggaaggccaccgaccgtgcccgtccccaggtcaacctcaagacttatccatcgaccgccgcctcccttcctctcaccccc

SEQ ID NO: 42175 - DNA, 62 bp, Chlorella protothecoides
cccccccccccccccccccccccccttcccttcttcataaaccactcacgacgaggcccttg

SEQ ID NO: 42176 - DNA, 61 bp, Chlorella protothecoides
aacccacgcctgcctcctggcatggtccaactccaatgggaccccagccactcctcaccgc

SEQ ID NO: 42177 - DNA, 64 bp, Chlorella protothecoides
cccacccattactgatgccccctcccccctcattttcccccattgccacacaacctaccaccca

SEQ ID NO: 42178 - DNA, 66 bp, Chlorella protothecoides
gatgaccgtgcaaggacgcggcaggaccggggcacgagctcgtcggtctgaaaacagtgcgtatgt

SEQ ID NO: 42179 - DNA, 107 bp, Chlorella protothecoides
ccgctgcccacctggcgaaagggattggagaggaggtgatgtttgcaaggcgacctgccactcggcctgaccccagcaaaaggctccctcggcctgcgtcttctcag

SEQ ID NO: 42180 - DNA, 80 bp, Chlorella protothecoides
cctgatcctgagctgcagggcctggggatgccgtgcgggtgcacgacacagcccccagccgccgcaggcggcggcgcacg

SEQ ID NO: 42181 - DNA, 157 bp, Chlorella protothecoides
gggcaagggccccaaggttcctagtacaatttgttcacaagcccaccattcggcggctagcggccacatgagggtgtccagggatccgaccctgggcctgccctcaccttggttcctcccctgcacggcagggacgccacggtgtgggccaatcgct

SEQ ID NO: 42182 - DNA, 65 bp, Chlorella protothecoides
aaatccatggtgggggagtggcggcggcgggggggggggatgggggggggggggggggggggggg

SEQ ID NO: 42183 - DNA, 4450 bp, Chlorella protothecoides
  modified_base (1850)..(1935): a, c, t, g, unknown or other
  modified_base (2317)..(2384): a, c, t, g, unknown or other
  modified_base (2466)..(2482): a, c, t, g, unknown or other
  modified_base (2618)..(2780): a, c, t, g, unknown or other
  modified_base (2836)..(2845): a, c, t, g, unknown or other
  modified_base (3408)..(3438): a, c, t, g, unknown or other
  modified_base (3876)..(3885): a, c, t, g, unknown or other
  modified_base (4048)..(4057): a, c, t, g, unknown or other
gccccgccgccttcgcccccggcgaccttgaccggctgcgtgccgaggacgaggcgcgcgccgcgctgctggcggagcgcgcccgcctccaggacgagcgcctggaggccagcatccggcgcgagcaggagcggctggcgcgcgagcgcgagcgcgtggatgggcgcgtcgcgcgcgagcgcgagcgcgagctgcagcgcctggaactggagcgtcgcaggcacgcggagaagtcgcagaaggagcagaagaaggaggaggagcggcgcgcgcgcgaggccgcgcgcctgaagctgctccaggtttggtgtggtcgtgggctttgagtggacgggatgtggggagtggtgatcccagcggtggggcaaggggcagtgtggtggaagctgcagataaatgagcagggtctcatggacatgtggaaatggttctcagctggagcagcaatggctggctggtgggtactctgttggtgacagctgtgattgcagttgcaccatgccagcaatcccatccgtgcatgaggcgggtcatcgcctgacgcatcacacctgccgcacctcctccccgctccccaccatccttaccaccaccaccacccataccacctcttccttccgcaggagaaggaggagaagcggctggcggcgctggcggacaaggagcggcgggcggaggagcggcggcgcgcgctggaggagcggcgcaaggaaaaggaccagctcaaggccctgcagcagcaggagaaggcggtgctgcgcctgcgcgtgcgcgactttggcaccgggccgcgcgacgacgccgacctggagtgggagaacctcattgccgagtatcgcacgacgcatgggtgaggagcggggggcgggggggagtggggtgtatcaggtggacttgcaggagtggggggactgttggatgagctgacttaggtcggcaggcgggtgcggcacccgagctgagacggtgcctcgcatgcagcaatgccacgccggtcctcacacttttccggcgcagcgcccgcgctcaccgctctctccatcctccccacaggctgcccgaggacgactttttcccctccgagggcgacccggcgccagagggcctgccgcccctgccccagaggccgcaggtgtgaggatggtttggcgtcgtgggttttggtttggccggggtttggcggcgggcggactggcgctggcagggtagatggcagtgtggttgccacactcccttgcaaagcactagccccacgtaaaggcagcgcagggactcctgctccttcaggcaatcaaagggcccttctcacctgccaacccacaacccaccccccaaacaaaaccaaaacacagtggccgcctgctgacgtggccctgattccggccttcccgcctgagctgggcgggaccgaggccggccccggcctcctggaggcctggtccttcctcacctccttctctggtgagctggggctggagcctgcccccctggactccctgctggcggcgctggcccgcggctcgcgctcgcccgcgctggccgccgtgcactgcggcctgctgcgcacgctgcaggcggacgcggaggaggcgtgggcggctgggcccgcctccacctacggcgggctggagtccagcgcggccgcggcgcgcctgctggaggaggcctgggcctggggcttcgaccccgacgcctggcgcgcgcacctgggcgccgccacctggcccgaggtcgcgcgccagctggccacggccgcaggcctgggccggccgcgcccgcgcccacgccgcgaggagaagcccaagatgggacgtgagggcgaggacgtggccgacgacggcgcggcgggnnnnnnnnnnnnnnnnnnnnnnnnnnnnnnnnnnnnnnnnnnnnnnnnnnnnnnnnnnnnnnnnnnnnnnnnnnnnnnnnnnnnnntcggcctgggcacggtgaaggccgcggcctgggccgtgctggccgaggtgggcgccgcggggctgaaggtggacgagatcgcgcggcgcatccagcgccggggcctgcgcgacctgcgctccagccgcacgcccgaggcctcggtggcgggggcgctgggccgcgacgttctcttcgcccgcgtggacctgggcacctacgccctggccgccatcgtcgcctacgaagcgtgaggctttgtcttagtttttgttgtcgtgggtgggtggggtggggaggtctcgtgtgtgtgagaatgtgtgtgtgcgtgtgtgtgttgtgctggaggaggggcttgtgagcgacgaaccacctctcgaggggccctcttccccaccgccgnnnnnnnnnnnnnnnnnnnnnnnnnnnnnnnnnnnnnnnnnnnnnnnnnnnnnnnnnnnnnnnnnnnncgccgggggcaaggagggcgccgcgccgcccggcgtggccgtcgagcccggcgacgcggcggcgccggcgggggcggggggnnnnnnnnnnnnnnnnngggcctgtcctcaccgcgagcgggaagggtggaggtggtgcagtccgaggcgggggaggccggcgagggggccgaaggggcccagcctggaggcgaggacgccgtggaacccgccgccgcggaggaggaggagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaagtgccctgcccatgcccatcgtacgcctgtccactccttacagtcaccgtcnnnnnnnnnnacccagcctggaggcgaggacgccgcggaacccgccgccgcggaggaggaggagtactcggacgacgacgaggacggccaggtgggcaggttgtgctggctcgaaacgcagtgaagcaggggaaggtcgggaggggcggctggcaagcgccctgcccatgcccatcatacgcctgtccactccttacagtcaccgtccccgccgcccccccaaaaaaaaatttcatccaggacaagaccgaggagggctccggcgccggctgggtggaggccctgcagcgctgcgactacgacgcgctttcctgggagcaccgtgtggacatgctgcgctcgctgtgcctgctggcgatgcagacgccctgcatccgcgacaccatggagcggcggcaggaggagcagcagcgcctcaagcgccaggtctgggaggacgccaaggtggagaagcggcggcgccaagtggaggccgccgcgcgagcgcgtgccgcggccgaggaggcggcgagggccgtggagcggtaccgcctcgccggtggcggcggcgcggccagcacagcgggctcggcnnnnnnnnnnnnnnnnnnnnnnnnnnnnnnnctgcacccgtgccgggtgagatggccgggccgccacaggaggagccgcacgcgggtgcggaggccgcggatgcatacgcagggcaggccgtggaggccaaggccggggagcctacgcggcaggagcaaagcgacggcccggcgcccatggaaatcgacggtacggcgcccgaggctgcgagtgcagcgcttgtagaagcctcccccgtgaaggccgaggacggggctggagggaacgccccggcgccgcagcagcgactgccggagggggcttccccgcccgccgccggcgcgcgggaggaccctgcgtccgaccaggacccgggcgccgtcgcggagcgggagcgcgtggcggcggccatcgcggccgcggagcgcgcggcgacggagcgcgagacagaggaccgtgaggcggcgcgcgcgcggcagggggcgcggnnnnnnnnnngcgacatggagcgctgcgctgtgcggctggagcctctgggcgcggaccgccgcttcaaccactactggcgcctggtggtgagcctgtcggggtatagggagagcgggggagggggggtgtttaagagggggcccggcggggcggcgcacccctcggcgtgctnnnnnnnnnngggggtatagggagagcgggggaggggggtgtttaagagggggccggcggggcggcgcacccctcggcgtgctgcggtgcggggtacctgcgcgtcgcagggcttcgaccagccctcgtccctccccacaccaccaccaccgcccactgcacgtccatgtcccgagccgcagctcccgggatcagcggaccacggcacatccatcacctcgcccgaccccggcgcgggccgcatcttcttcgagtcgggggaggacggcgcgctcagcatcgtgcgcgacgcggcgagcctggacgcgctggtgggcgcgctggagcggcgcggcgcgcgcgaggcggggctctacgcctcgctgctgcgccaccgcgacgtgctggcggctgccatgccccc

SEQ ID NO: 42184 - DNA, 66 bp, Chlorella protothecoides
ccccaccccacccacccacgacaacaaaaaacaaggcaaagcctcacgcttcgtaggcgacgatgg

SEQ ID NO: 42185 - DNA, 7617 bp, Chlorella protothecoides
  modified_base (116)..(125): a, c, t, g, unknown or other
  modified_base (207)..(216): a, c, t, g, unknown or other
  modified_base (639)..(648): a, c, t, g, unknown or other
  modified_base (2183)..(2192): a, c, t, g, unknown or other
  modified_base (2425)..(2496): a, c, t, g, unknown or other
  modified_base (2591)..(2600): a, c, t, g, unknown or other
  modified_base (3797)..(3806): a, c, t, g, unknown or other
  modified_base (3879)..(4078): a, c, t, g, unknown or other
  modified_base (4178)..(4187): a, c, t, g, unknown or other
  modified_base (7095)..(7104): a, c, t, g, unknown or other
  modified_base (7177)..(7186): a, c, t, g, unknown or other
  modified_base (7488)..(7534): a, c, t, g, unknown or other
cggcgcgcgcccctcgccggtcaagtcggcacacggcggcgtgcagggcggcgttgccgcgcccgtgacacgcgcgtcgcagcttctggacgaggaagatggggacggcgcggcgnnnnnnnnnnaaatggttctggttgggttcatgggagggctgctggtgccctggggatacgacatgcccaaggtttcgcctgcaatgtgcannnnnnnnnngcacggcggcgcgcggggcggcgttgttgcgcccgtgacgcgcgcgtcgcagctcctggacgaggaagatggggacggcgcggcgacgccgcaccgcctgagccgccgctccgcccagcgcacctccaccgcccaggccagggtgggttggctggtggaatggttttggttggggtcatgggagggctgctggtgccctggggatgcaacatgcccaaggtttcgcctgcaatgtgcagtacggacaggggacactgcaatggcttaccgacgcaccgtcatcaagccctgcctgcatgcatgcatgcggggcgcacatggcctgcgccctctcaccccctcccccgctctgcccccaatacaaaccaaacccttgaactccaacctcggcacaggcggcggtgacgagcgcgcaggacgtgnnnnnnnnnncacggacaggggacactgcaatggctgaccgacgcaccgacatcaagccctgcctgcctgcctgcatgcggggcgcacatggcctgcaccctctcaccccctcccccgctccgcccccaatacaaaccaaacccttgagcaccaacctcggcgcaggcggcggtgacgagcgcgcaggacgtgaagcccaagaacgtggcggggagctccaccagcggcgtgcggccgcagcaggccatgcgcctggcgcgcatggagaagtacatccggcgcaacgcgctgcaggtcaccttccgcgacgagctgaaccaggcagagcggcgggaggtggtgaactcggaccaggaggccaagaagctggccttctacctgttctggaacgtgaaggccgactacgggcgcagccacatcgtggacgcggacctggcggccttcgtccccgctcgcgacgtgcgcctggccgcggagctgctggacgccgacggcgacggcgtgatcacctcccaggacgtttgcgcggccatcctgcaggtcttccgcgagcgccagaacctggccgcctccctcaccgacaccaagtcggtggtgggcaagctggagaccatggtgggcgtggtgctgcacatcgtcatggccttcctctacctcgtcatcttccgcgtcgacgtcatgaacttctacctcaccttctcctccatgatcctggccttctccttcatcttcaaccagagcctgcgcatgatctacgagaacgcggtgttcctcttcgtgatccacccctacgacatcggcgacaccctgctcctggacaagcaggcctgccgggtggatgccatcaacctcacctacaccaccatgaccgacccctccaacgcgcagctgtggtaccccaacgagaagctgcgcgccgcacccttcatcaacctctcagcctcggggaaccggtgcgagaccctggccgtggcggtggacgtggacacgcccctgggcgtggcggaggacctgcgcgccgtcgccgccgcggtcacgcgcctgcagcccaaggaggtggatggcgagccgggcgtggcgctggccgcctccccagaccccctcaagtacgtgctggaggtgagctggacgctgagccacaacggcgtggacgcggcgcgcggcgcgcgcctgcgcaacgccgtgcatgcggccctcttcgcccgcctggcggagctgggcgtgcgcagcagcgccccgcccccccgcgcgcccgggaatgacgcgtacggcgcgctgagggcggcgccggttcacgaggcggcgccggcgccctccagggaggcgacgcaggcgggcgctgcgcaggcccgggcgcaggccggcctggccgccgccgtgcaggcggcagaggcgcagcagcggcgggggagcccaggcggcgccctggagcgccccgtgtgaaaccctgtgcagagggtggacgtgggtatgccctgacccgatccgacggccgctgccccagcgccgatatcctcgccccgctcgccttgcggaggcccgcnnnnnnnnnncgggtgggcgtgggtatgccctgacccgatccgtaggccgctgccccagcgccgataccctcgccccgctcgccttgcggaggcccgcgcaggttgcaatttccgacccccttgtcactctctgcgtggcccccttgatgtccttgcttcgtgacagaatatttgctgtcaatcccctcactttctaaaccctgctcttgtgggcgacctccccccccccccccgggggggannnnnnnnnnnnnnnnnnnnnnnnnnnnnnnnnnnnnnnnnnnnnnnnnnnnnnnnnnnnnnnnnnnnnnnnaagcctgcaagccacacacaacctttcacgtactgcacctggctcctgcacccctcctgaatatcatcatcttgctgttgccccgccgactcccnnnnnnnnnncgctgtcaatctcctcactttctaaaccctgctcttgtgggcacctcccccccccccgcggcaggcaaccgctctcgctccacctccttcgtactcacgcctccttggcagcctaccgggacgagcctgcaagccacacacaacctttcacgtcctgcacccggctcctgcacccctcctgaacaccatcatcttgctgttgccccgccgactcccttggggcctgctcatcgcccgctgtaagcattcattacaagagggatgacagcgctgtcacccgtctgacactgggcaccacactggaggcttccactgcgggttgccattccccatccgacgctcatggacacccccgtctcagccttcctccacggccgtagggctggttgcgctcagggcatgagggagtgctgcacggactcggcgtcgatcttcttggccgcctccgggaactcctccaagtactcgtcgatggtcatgctcgacaccttctcctgtgtatgcggcaggcaagggagcatgagccaaccaaggcggtgaggcagcagaggggaggtgtgagcaagggtgtcaacttcgtggcagcatgtttttggaatgttgtctgccgtttgcatcgccttgagccttcttcgcaccggaagacctcatccggctcagatccaagccacaacatcccctaagcatccagacccctctccaactccccatggtaatgaacaaacgacccacaacccggactcttggtgctcgccttgatgcgctcggtcttcgcgacctcgcgatcgatgtcggccacggccttctcggcctccgcagacagggcagccgcctccttctggaaggcctcaaacttcttcctcacatcctcgatggtggcactgttgtcaaacttgggccaggtgatgcctggatggggagggtgagacatgtggggaaccctgcagtgccttgctggcacccataagaaaagggacagcaccggagcaactttccccacgcacttttgagagcctcatcgtgagcctggacgagcgcagggtcgacgttcttccgcagctccgcccagtcaatcttgggcccagcctggattgggttggcaagagcgcatgggttctgggtcgcgtcccacttagtggccatgggacggtcatacggagattctaatagatgcagcagaggtgctgggtgttaccnnnnnnnnnnatccccatggtaatgaacaaatgacccacaaccccgactctcggtgctcgccttgatgcgctcggtcttcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgcagtgccttgctggcacccataaggaaagggacagcaccggagcaactttcgccacgcacttttaagagcctcatcgtgagcctggacgagcgcannnnnnnnnntcatcccatatgtgtccccccccaaccccgcaccccccccacctccacacgcacatccttttccctttcccagtagtgtgcctgacctcggatgtgatctccgccaaccgtgcctgggactccaggaactgcgacttgatgttggccagggacctgcggccctcatcggaatccagtagcgcagccaccgcctcaaaatcagcggtggagactgtagtggcctgggtggccatggccctgacggggaaggcctgcgacggatggtagggaccaaaatcatggcgagatacctttgcgctaaaattctaaacaatggcatccctcttacatcttctgcgcaccttggtggccacccggtttactgcgaagcgcagcatggtgcgggttggcagcggactccacgctctacggcactgctgacgaccctttgcacccgtgtcccgatggatctcggcgggttgatagctcgttcgggggcagcacactactcggagatgtcggtttgaagagctgacaaagcagcacgggtgaacgggtttccgactttccagtgctcaacccccccctgccggtcctctgtcaatcgtggacctcgactgatgcatatgacttggaatttggatactgccttgttactgaggctgcagagcgcgacttcatggtaatccattggaggatctcatctgcgagtgctgcctgctccaatggtggaaccccttgtctcaatatccttgctggatcttctgggaacaccgtgaggtcggctgatgcggtaatctgacgcaaaggcttctgcatttccatcagtacctggaacgaactcttttctcttcgagggagccttgcacggaggtcgagcttcattaacctgcacattggctgatgcctctcagcccccgctaatgggagggatgatggccacctcgtccccagccttcagcggcacaactgatccacgttcgaggtactcgtgattgaggctgaacacaaagcgtccatctagctccttgagcgcaggaaactgctatgttttgtgggaatgggggtgtgatccgggattgctgatgtgatgcatcagagaaaatgtgccctccatgaaggttatgcaagcacctccatgggccccccaatcgggctatggatcctacatgagtacattcatgatcgcctcaactgacagagcaccgcctgacctgttctaggagatgactcaggaggctctctgtggtgtcagccgcctggacggccaccgaagtctccgatacgccggcaagctcacgactccttgcgaaaaagaggatcttgacggccatgaaccctccgccttgcagtgcgctgcgcaagactggaatgctggagaggtcggggattaccgcttgtgcgaggagggctccttgaatgcaacccttcggacccttttacattctagaggcatgtgcagcagtggaggttggatcacgtctcccaataaatcgaagcataagtttcttcagtgagggtcgtgggtatcttcaacgcagaggcatgataggggtgctcgaggttgcatggtgccgcacgtctcatgctgtgtcctcggcccaacccccagcatccagggaagctggcactggatccctttctcatgagcttggctcccacaattactattcaaaaaccccacaggatgctacagcaggctttgttcaagcattgcgcaatcagctgctggtcttgatctgcccaaacctcagcagggtgccatccgggtcagacagcgcaaactcgcgcatgccccactgcgtgtcctgcacccccttcaggctgctcaggccctttcccttgaactcgtcgtgcagggcatccagcccctccacgcggacataaaccccgttggcattggcctccgcgtccaacttctccgaggagttcacctggcgcaggtgcagctccaccggccccagggtcagcagggcgtagttatcggcgtcgccatcctcgtccgtgcgggggacaaagcccagcttctcataccaggtcagggagtccttgatggacgacacagggacgatggggaccgctcctaggatgcgtggggtgagcattgcaggtctgcgaggaggcgggggaggggaggttcggggaagtaggatctgcatcgatcgcactgaggtattcaggagactgtacagccacacctgggcgtggcactgcatggtgggagcacgacttaacctgtgcaccttccctgcacattccagccaagttcacctgctgaactttgcgatggaggaagccaggccacggctgcgaaagtgtgggatcgacaatgagggtttgcaaaaggtcagagggtgaagtcgcgctaggaccgacatggcaacaactgatgcgcccttgcgtcatgcagttggacatgaggcaggggtgagggaccatgctgtgaatgctgtgatcttaaggctcggtcctcttgcccgaagaactactcctcatgcatgctcgcaggctcctgatgagagggctgtgcatgctttataaagacactaactaaagcagtttcttgtttgtccgaattcgaacgaagccacaacagggatgccgggagcttaaagcaatgcagctgctcggcccagtgccccaaaagctgggccgcatccccttccagccctcgaagtttgcgccgtggaccagaacgtatacccggaatgcgaggtcacaattcttcaccaatcccgctcagcactcctccgagcatgcttccagggctcagcccgttttccggcttgaggacgagttcgaggtaggaggaagatgcttaagtagacgtttgttaaatagcttccagcagcttacactttagactatcctttttggaagccccagagtgtatcgcagtgagcatgcgtcagcctgacttcgtcgacannnnnnnnnnctggaccagaacgtatacccgaaatgcgaggtcacaagtctacaccaatcccgctcagcactcctccgagcannnnnnnnnncccgttctggaagccccagagtgtatcgcaatgagcatgcgtcagcctgacttcgtcgacaacctcacccgcccactcagatagctgcgctggacgacccccttccctgggaggagggggacggccatgcggcgccgactgataccagcgcagacgttttcgtggaggattctgtggatgactcctcatacgactcctcggacgacgacgacgacgaggacggcgcggtgatcgaggaggagtggagcgtgagcgacgtgcaggtctcggacctggtggccgcggccgccgtgtccaccgcnnnnnnnnnnnnnnnnnnnnnnnnnnnnnnnnnnnnnnnnnnnnnnncggccgccgcgcgcccgaccccgccatctccgccctggtcccgcccggcgcggcgcggcgcctgaccgccgagtcggccgacg

SEQ ID NO: 42186 - DNA, 72 bp, Chlorella protothecoides
ttgccgccatcagcgtccaccatccccccccccacacacacacacaaccacactccagggcaagcagctgag

SEQ ID NO: 42187 - DNA, 97 bp, Chlorella protothecoides
ccagcctcagggtctctcaactgcaccccccacatatgaaaatccccacactcaagcacacactcgcgtacacgcagggagcagcgccacacgtggg

SEQ ID NO: 42188 - DNA, 61 bp, Chlorella protothecoides
tgtcgcgttggccgccgcgtagttggcctgaccgggggagcccagcagggccgccacggag

SEQ ID NO: 42189 - DNA, 67 bp, Chlorella protothecoides
gtcgccgcctccctcccccaagaggtcgcctcctccctcccccaagaggtcgccgcctccttccccc

SEQ ID NO: 42190 - DNA, 815 bp, Chlorella protothecoides
  modified_base (165)..(174): a, c, t, g, unknown or other
  modified_base (277)..(286): a, c, t, g, unknown or other
  modified_base (386)..(395): a, c, t, g, unknown or other
gcggtccccgcccggcaagcccggcgcggggcgcgcacaggcggcgcaacctacgccgccggcccctgccgcggtttcttccccggaacgaccgcgcgacgtggccgaggacgccgcgcgcgctgtcgaggcaggcttggcggcgggggtgatctcccgcgaggnnnnnnnnnnttccccggaacacccgcgcgatgtggccgaggacgccgcgcgcgccgtcgaagcgggcttggcggcggggctgatctccggcgaggcgctggggaggggcggnnnnnnnnnntatggaggccgccgagtgcggcgatggctttggggcgcgtgccacctgcgacgctgctgatcacgatcctgcgcccgccggccgcgcctctccgcccgcnnnnnnnnnncatggaggccgccgagtgcggcgatggcctcggggcgcgtgcctcctgcgacgctgctggtcacgatcgtgcgcccgccggccgcgcctctccgcccgcccctgctggcttgctccccctcccggcctgcctggcagacgtggagacgctgccggcgctggcgtcgcgcctgctgcgtagccgggactgcggcacctgccgcgcggcgggggcggacctgttccgggacctgttcctggcccacgacgccctgcccgcccgcgtgggcctcctgcgccgcctgctgcgcgtcgccgtggaccgcgagggcgagcgcgaggaggggagcggggccacggagggcggggtgagtgggctggaggccggcgaggggcgtgaggcgtccggcgcggcccctcccgccccctcccaccccccccc

SEQ ID NO: 42191 - DNA, 61 bp, Chlorella protothecoides
ttgaaggtcgggggacaagtggactggctggttcaacatggtactagcatcccccaatcaa

SEQ ID NO: 42192 - DNA, 94 bp, Chlorella protothecoides
ggggcactgctccgtggagcgcgtgggctgtggcgacggactgcgtcgcatctacgacttcctcggcagcgacgagcccagccagtaccccggc

SEQ ID NO: 42193 - DNA, 85 bp, Chlorella protothecoides
gcccgaggcctgcccttgcatgcccggctcaacacacacattacacccccccccacaccccctcctgctcccccacagcagtccg

SEQ ID NO: 42194 - DNA, 707 bp, Chlorella protothecoides
  modified_base (189)..(200): a, c, t, g, unknown or other
ggtggaggagagggtggagatggtggaggggacgggggtggagaagaaggtggcggagggaagggtggagagggagggtggcggaggggtagggggaggaggaggagagaggggagaagcagaggggggaggaggagaagaggggggaggagaagaggggtgagaagaagaggggggaggaggaggagnnnnnnnnnnnngggggagaagagaaggggggaggaggagaagaggggaaaggggaagaggggggaggagatgggggggacgaagaaggagagcgggaaggggagaagggaggggaggtggggagaggcaagggtgagggaggggagggactagaggaggatggaggagaagaggaatggggagggcgaggtggtgatggcggaggtggtgctctcctcactgggaatggagaggtgtgtctctttggaggttggggggctaacttttgtggggatggtgggggactcttcttggcggctgaaggcggcggttggttgtagtctctgagcacagtcttgcgaagttccttcacattgcagaagttgagaatcgtcgtccgttttccaaccgcgtcgttgcaccgcagatttgtgcccttgttgttgagaccccagtttaggtttcccttgttgtagctccctgcacatgatgcaactgggatgttatattcgagcaaggtcatggtcatgtatggcaca

SEQ ID NO: 42195 - DNA, 74 bp, Chlorella protothecoides
ctcgatctccaccttgagctgctccaggcggtcgctggggagggggaggggagggggcacgggggtggtgtggg

SEQ ID NO: 42196 - DNA, 98 bp, Chlorella protothecoides
ggcgagaggtgtgcttgtgtgcgattggaataaggacctctctgacggggctaccgcccccacactctacctcccagagctcgaagcggtggatcaga

SEQ ID NO: 42197 - DNA, 176 bp, Chlorella protothecoides
gggcggcgcctgcgcgtcgacgcaggggggtgtggccggccccgtcagccagctctcccgcggcctctcaccgcgtcccggcagtccccccgcaagggcagctgccgcccacgcctccgtagcggcctgcaacagccgtgcggggtccgggccctggggacacaccaggaagagca

SEQ ID NO: 42198 - DNA, 15549 bp, Chlorella protothecoides
  modified_base (238)..(247): a, c, t, g, unknown or other
  modified_base (1166)..(1175): a, c, t, g, unknown or other
  modified_base (1854)..(1863): a, c, t, g, unknown or other
  modified_base (3146)..(3155): a, c, t, g, unknown or other
  modified_base (4188)..(4197): a, c, t, g, unknown or other
  modified_base (4394)..(4403): a, c, t, g, unknown or other
  modified_base (4901)..(4910): a, c, t, g, unknown or other
  modified_base (5008)..(5017): a, c, t, g, unknown or other
  modified_base (5121)..(5130): a, c, t, g, unknown or other
  modified_base (5753)..(5762): a, c, t, g, unknown or other
  modified_base (6647)..(6656): a, c, t, g, unknown or other
  modified_base (7692)..(7701): a, c, t, g, unknown or other
  modified_base (11701)..(11710): a, c, t, g, unknown or other
  modified_base (13017)..(13026): a, c, t, g, unknown or other
  modified_base (13104)..(13113): a, c, t, g, unknown or other
  modified_base (13636)..(13645): a, c, t, g, unknown or other
  modified_base (13720)..(13729): a, c, t, g, unknown or other
  modified_base (13803)..(13812): a, c, t, g, unknown or other
  modified_base (14593)..(14602): a, c, t, g, unknown or other
  modified_base (14989)..(14998): a, c, t, g, unknown or other
  modified_base (15179)..(15188): a, c, t, g, unknown or other
gtcgccgtgtccgccggcgccgacggcaccgcccgcctctggcgcgtgcccttcgcgcccttcgccggcgggcccgtggagcgcgacgcctcgccggtgctgcagtggaccgcgcgcggcggcctgcgcggcgtggaccaccactgggcacgctcccagttcgccaccgcgggcgtcggcgtctgtgtgtgggaccacgcgcgctccgacccggtgcacgcctttgagtggggcgccnnnnnnnnnntcaccactgggcgcgctcccagttcgccaccgcgggcgtcggtgtctgtgtgtgggaccacgcgcgctctgacccggtgcacgcctttgagtggggcgccgacacggtggcctcggtgcgcttcaaccccgcggagcccgacctgctggcctccgtcggcggcgaccgctccgtcgcgctgtacgacctgcgctccgccacccccctgcgcaagctggtcatgcagaccaagtccaacgcgctggcctggaaccccatggaggccttccacttcacgctggcctccgacgactgcaacctgtacacctacgacatgcggcgcctggatgtcgcgcgctgcgtgcaccaggactttgtgtccgcggtgatggacgtggactactcgcccacgggccgcgagttcgtggccggcggctacgaccgctccctccgcatcttcgccaagcacggcgggcactcgcgcgaggtgtacaccaccaagcgccagcagcgcgtgtttgcggtgcgcttctcgggggacggcacctacgtcttctcggggtcggacgacatgaacgtgcgcgtgtggaaggcgcaggcctcccagcagctgggcgtgacgctgccgcgcgagcgccagaaggcggcctacggcgccgcgctcatcgagcgacacaagcacctgccggaggtgcggagggtggtcggcaaccgacgcacccccacggccatctacaaggtacgggggaagtactgtattgttgggaggagagggggaaagggactggggagaggctagagattggctgggatagagggagtgcatgggtcacctgtgatggacggacgtgctcagggggagaaggggtaagagtgtgcgaatggccgctggggcgccagaggtgcaatcccatcgcagcacgcctcggcgctgccgctnnnnnnnnnntggggggagtactgtattgtggggaggaggggggtaaaaggactggggagaggctggagattggctgggatagagggagtgcatgtgtcacctgtgatggacggacgtgctcaaggggagaaggggcaacagtgtgcggatggccgctggggcgccacgggcgcgaccccatcgcagcacgcctcggcgctgccgcttgcgctgccgacgcggccatcgggcgctgtcacaacctgcgcggctacatacaggccatcgggccgtccctctcacactcattcacaccgccgccacaggccaccaagacgcggcgggcggtcatggatgcagagcgaaggaagctcaagaaccgcatcgcgcacagcaagccggggagcgtggtggtcaagcccgcgcggcggcggaagatcgtggaggagctggagtgaccgtggtgcacacggtgcaagtcttgctggagaaaggacggcttgacctgtggcgtgggctggacctgggtcattactggtcctggctctctgtcaacaccatcgtgccggcggaccaggtcctcatcatgcacctggggaaatttgttcaactgaccatggcgtccccgctggcgcgacccctaccatgtcgtatggcgcaattgcaggaactgtcaagactccgaggcatggccttgcacagcgcaggnnnnnnnnnngcctgtggcgtgggctggacctgggtcatcactggtcctggctctctgtcaacaccattgtgccagcggaccaggtccccatcatcaacctggggaaatttgttcaactgaccatggcgcccgcgctggcgcgacccctaccatgtcgcatggcgcagttgcaggaactgtcaaaactccgaggcatggccttgcacagcgcaggctgcctcaaaagtcagcaaaggtgcccaccgacgcgtggcgtccactgcccagcagcttgtgtgccacctcctgccctgcctcaaagtgcgccatgtcctctgggccttgaacctgcgcagttggtcggtggggactggggctgtgaagagtcctataatctgacataagctcaccatctgtgcaggtcagcagtggcctgccaatcagagctttgttacctttgggacgaaaggggcaggcatcctctggctgacaagggccgaccagtcgaaccctgcaaaccagggatgcttccggatatcgctcactcctccctgggcaagcatgggggaagcggaataggatgagagggagaccggatgaggtggggttgaggatatgtgaaggaagagggaaggcacagggctgagaattgtgagcggtcaagggaactgaactcagtgatctgacgttcacggccttccagacatgggcaaggccagccacagacctgcaccgtgcccagtcggcggctgggctgcttgttcagcaagcgcctgatgaggtccttgaggtcctgtcgaagggtggttgcaaaagaatctggctcagattggccgatggatgtttttaaggagaggcacctccattgttggtcagcatgatctgtcgcaagttgacaagctagtgttcacttgcgtgcttctatggggacaagattgggcttgtatatggtggacacactgcaggctcatgcagaggaagaatgggaccatgcatcgttaagatggaggaccaccaagtcttgcacaaacgggccccacagaccttgctgaagtaggcaggcatggtgtagttggcgctgcagatggctcggaacatgactgccctctcctcctggtggaagggaggggtccaggccaccatctcatagaggaggactcccagcgcccacctggcagtgggaggaggtacatcatttgaccttcacacacgagtcaggataatcggtgcaaagggcagccaagcgcatgtcagcacgggcctaatgcacacatgctaccttccacccagctcaccagtccacaggcagaccnnnnnnnnnntatttgaccttcacacacgagtcgggataatcggtgcaaagggcagccaaatgcatgtcagcacgggcccaatgcacacatgctacctaccacccagctcaccagtccacaggcagaccgtggccagactgcatgaggatctccggggcaaggtattcgggggtgccacacagggtataactccttgaccccggcgcgattcgcttggcaaacccaaagtcggccaggcgcaggtaccctcggccgtccagcaggaggttctcgggcttgagatccctgttccaatgaatcgtgtacgggtttgaggagatgctgctaggttcagataaactcaaatgtggagctgttcccaattggtctttggatggaaacacgagtaaggttgagtccagcctcagaaaccaatcaagcctggccccctcacctccaggccacgcccttggaatgcatgtactccagtcctgcaaccacgcatgctgcatagaacctggcactggactctgagagtggatctgtgcggttctgcaaccgggatgttgatggaagatgcttggtcagccgatgagcagggtcagagtgcctggccagcagtgtgggagcatagcgagcagcacccaggagcctttgcttccccagatgcattgctgctggcaccctgtatggtccccctgatctgcacctggagataggtgaaaaactctccgccctgctgaaagtccaggagcatgtacaggctgcacatggggatgaggtgccaaaagtctgtgcatgcagacccctccatgggcatggcatggctctggcaagtctgaactcatgctccctccccttcctgctccctccatcttaccactggctgtcttgcagggccgccgccatgttgaccaggaaagccgaggaaagggagctcatgattcccttctcgcgcagcacatgcgtctgtgaggagggcttactgggcacttgtacgagaagccggggactgacagcatccgcatggagacccacagaactcattccgtgcccccccccnnnnnnnnnnatctgtgtggagggcatactgggcacttgtgcgagaagccggggactgacagcatccgcgtggagacccacagaactcattccgtggcccctccacccccaccaaacccacctgcagtccctttgccatcacatggctcttcgacagcaccttcagggcatgcacccggcccctgcacctgaccagcacgacgtagnnnnnnnnnngtggctcttcgacagcaccttgagggcgtgcacacggcccctgcacctgaccagcacgacgtaggcaaaggctccggtgcccaggattgcgatcctttccagctcatgcagcgcgatgggctggagaggaggagagtgggcgacagctggcgagcagagttgagcagagagggcgcatggcctcctcgcacctcagggggccagcaggaccatcaggcacccacctcatcctgcagagtctgcaccagagcatgcttggcacggatgaggtctggctccgacggcagcggcacgggcacagacttcaccatgggccctgcagcgtgtgcggcctttctggccgcatgctgctcgactgactccccttgaagaggaggcgagtctctgccctcgcgaacgccgggcaggggccctgcttcgccggcctggccctcccgcgtctgtgcgggggctggctgctggcctggcagactccgccccactccccggcagacggcnnnnnnnnnnagtgggggggttggggatacctctagtgcagcagggacaatgcaagaggcagcaggagtgtttgttgagctagctacattgctggtccttgggaagtnnnnnnnnnnaaccaccatggcatgctcgatagtccacagcttcacgggcgttgctgccacgacagtggccagcaccgtctcactgagcatgccagacaggcgaatgtccccannnnnnnnnngaccaccatggcatgctcgatggtccacagcttcacgggcgttgcggccacgacagtggccagcaccgtctcgctgagcatgccagacaggcgaatgtccccaaacatgctgtgtggcgttgcgtgggggggttggggatatttctagtgcagcagggacaatgtaagaggcagcaggagtgcttgttaagctagctacattgctggtccttgggaagtagttctcatgccagtaaaacatgcttcaaacattaagctcacctgccagcgctgcatgtgcggtgggagccctctgcagagggccccatcatggtgcaaacgccagactccagcacgaagagtgaggcgtcgttgctctcgccgggggtgaccaccgcccttccctcagacatggacatgggacccattgcgtcgatgacagccgaaagactctcgggcgtcaggtctggcgcaagacgactggccctgagcgctcgtgctgggtggaggatgcagaaaaagtgggcttatggttttcaagtatctatgtcgaccggaagcagcaagattttgtgcgctgctccgtgctcatcagccttcaacaacccaatcttcacaaaatccagccaggcctcagaaccatnnnnnnnnnngtctatgttgacctgaagcagcaagaacttgtgcgctgctccatgcttatcagccttcagcaacccaatcttcacaaacccagccaggcgtcagaaccataccctccagtcccttgacgctggacacacatgtccactttacacctacagcccacctaacatctcccttgtccctgctggcttcggatggctcggaatgacactgaagagcaggttctggagatccccaagcccaagcatcgcgagacgcctgagcggtgttcccccttcgctgcgccgggccagtattcgctctgctccatgtgtttcagtgttgggagccaggcgcttggggagggtgattgctcggccaacagcccggcctctggccgcgcaatcatccagggtttgggaaggaggatccggtctagggcatacgggcctcgcagcgggtgctctatggggcggtgggctatccatggcagtgtgtttcgatccacacactcccatggactgctcctgacgaggatccatggctaccaagtcactcagcgcgctgctggtcggcggtcgtctctgtacatgtcaggctgtatatgtcgtgcgacggcctggcggagttggatcaaggccgtgatgttagtgctaggaattttttaacgtacataatatccattctagccccagagcgagccattgcatactatcaaagtctcgcaatcctccatcggcaagttcttggtcatggccccagtgcacatgcaggttcagcgcaaggagcgcccatcattggcgcaggtgtcgatgatagcttaaactcgagtgcataatatgcccttgcttttacatggagtatctacgagcccagcatcgtacattctccagcagagtcagcgagatcatgcnnnnnnnnnncgcataatacgcccttgctatcacatggagtatctacgagcccagcatcgtgcattctccagcagagtcagcgagatcatgcgatgcatgacgtgccctgtatgctggacaggaactcacctggctcgagccgtttatatttgcttggatccacttcgatacaaacggaagattctggaaagagcacggcatattacgccatcttcccctcgccagtacccttgttggtgctccgtcgcgacgcccatgcaacgcctgagggcgatagggcgcctggcgcgccaggcacgttccgcacttgatgtgactccaggaatagatttagtagccatcggaggttccaggtgcgtggtgctgtaagccgccaggcgtccgtggatgttgtgaggctggaatggtcacaatgtagcccctgccctctgccacaggcccctggccacggcatgcgctggcacagcagcgacagctgcgcggtcatcgaagggagctgccgccgcagctcttctggtcggcagtgcggcgtccatgtactttgccatgcctgcacatgcccgcgatgagagcacagcggcaatcaaggctcccagccctgcagatcctgtaggtttggagagagttgtgctggtcattcttctcttaatatgtgtccctttcatggagacacaactctggtttgcaaaggggcgtgttctgtgcgagcattacctcaaagctccagactctaaccacctgcactccacatgcagccactcgacgtctactcgctgccgaagacccccctgcccctccccgagagcatcgtcctgtatcagtacgaagtgtgtcccttctgctgcaaggtcaaggccttccttgattaccacaaggtgcgcgacatgggttcaaagggcgagcagtgcagtgttgctgggaaagggctggtactgattggcattcgcagcatgcttgggtcgctaggattttcacagactagacgacaccccccagagtcacacatccttgtctgcaagctggcaatccccactgttacctcttnnnnnnnnnngctagacgacacccccccagagtcacgcatccttatgagcaagctggcaatccccactgttacctcttgctgatgacaagctctgtatgcaccccggaatgcctggccgcccagacgaccccacgacccggcacctccctctccccagatcccctacacctgcgtggaagtcaaccccctgaccaaggcggagctgaagtggtcagagtacaagaaggtccccgtcgtcgtcatggacggcgagcagttcaacgactcctccgccatcatctcgcgcctgagcgccagcgtgggccggggcgccgccaccccggaccccgccgcccccggcggctggaggtcgtggctggggcagggcagtgccccgacgtcctccccgcccgcccgcagcggcacgcagggctcgtcggacgaggagacatggcggcgctgggtggactctcgcttcgtccgggtgatcaccgtgaacatctaccgcaacgcccgcgagtcctggcagacgtttgactacatcgcggagcacgggaactttgggtgggtgcagcgagaggctgcgcgcgtggcgggggcgggcatgatgtgggccctcagcgggcggctgaagaagaagtacggcatcgacggtgactcgcgcaaggagctgtatgcggtgagcgagcctgggctgacgtcggtgtgcaggcagggctgggaagttttttaatgtctctacggcgctgtaggggtcgctgacacagcacatttagaaccagggatcgtctgcgtcttggtgtttggttcttgtgtttgatgctcccatgttttgcatgccattgggcccctgtctcgcacccagcctttggcacatacaagctgttgccatgccaatccctccgcaagcgacaagggtcgcaagtaccaatctacctcaacatgcaacctctctcccaaccgccctgccccttcaggacgcagagtactgggtccgtgggttgcaggggcgcacattccatggtggcgacgctccagacctggcggacctggcagtttttggagtcattcgcgcggtggctgggaccgacacgttcaatgatctcatgcacgggaccaagattggcacctggtatgaagcaatgttcaaggcagtgggtgggagtgcccgccgccctgcctgagatgcggcacctgcgccggctcggccaggcagcgcacctctgcagccttcactagtcagcctgttgtgaagagttaaaatgaatacccccgtttccttgtaatgaagaatgactttgcaactatcgtgggaccaccctgatcaatactgcattggcaaaaatggtgcagagcccctgcttagcacgtcttcccccctcggggaatccgcatcgcatcaaggcgagcctggggaagaggagtggtcagctgccgtgcatggctgcaaatttcccacaaaaaactggagatcctcgctgagtcatgctcatcacgcacacgtcctcaccagaaatccgtacggcgacacatccggtaggtcccacatcgcgcgctcatacgtggcaattccgccatgattctaggcctggtggccaaattcctccactcactaatcctgaaccctgataaagagaaggaagctggaacgaggatgcgggacaagatggaacccttgctcccagcggagttaccacggccccgagccgtcgattgcccccacatgggcaactgcacgaaatcacgtgcgtccaactgcttcgacgcggcacctgctgcttcctcccaggtcatgccatacacaaggggactcatcccattttccaccctatactcttatcatgtaggcacgatgtgtatggcggacaccagccttcgccgccgtgcaagcgctgcacatgccgacacctacccgcgacttaagaccctgcaccggggtggaaactcggtggtgtaccgggcccaatccccagccggcggcactctggtggccaagcggtatcacatccatgccatgtgctctcgagagcttggagccatgcgtcgggaggtgaggctggcgagtatctcgtcggactggcatgcaggggcaggcggccaccacaagggacccaatacttggatcgacccctttcgccctgggcccccgcagatgcgattgctgaggctatctcaggatgttccgggagtcgtaagactgctggaccagcacgagactgccctgacggcctgcatgatcatggtgagcaggggtcggggcccccgaccatccacccgggcgatgcccggtgacgggaacggtgtgcaagtaccatctgcgcttggtggggcacgcaggggcccggtccacgcctacctatattcattcgtcattgaccggctccatgcccgcgaatcgcaggaggattgcgacggaggtgacctgtacaacatgatgaggtttggggacgccctgtcggccgactgggtggcttccacggtggtcaagcccctgctccggattctggcttccctccacgccacctccatcatccaccgcgacattaagcccgagaacctgctgctggatgcaagggggagtctcaaactggcagactttgggctgtccatcgaccagcgcaaggagattcccttcctccgcgccggcaccctggactacatggcacccgaggtgggatgaggtggttggagcctggtgccagaacctcctgcccgagcaactctccttggccttggactgattcaaattcatgatcacatgcaattaaacacgcaagaagtcacatctcgatgcacaggtggtccggggtcgcagcacggccagcagccagctgtgggagggcccggagacatcgctggcggaactggaagcagcaggcatcgcgccctacgacgagaaggtggacgtctgggccgtgggcgtcctcgcctatgagctggtggtgggccaggcccccttcttctcccccagcgagcagcgcacgatggagaacatccgggcggccagggcaccccacatcccgctgcgcctggcggggacaccctgggccgactttgtggccaccgcccttgcccccaactccaccgagcggccctccgcggcgcgcctgctggaccatgcctggctggcaggggaggggcccgaggaggcgagggacgagggcatcgatcgcccgccagagacgctacagcctccaaagtcacgggaggcggaggcggaggggaagctgcacgccgagcaaccctcctcgccccggacacctgtgcggagggacgcctctgcgcgatctcgaccggtgctgcacctgacggcaagctgccagcagcacagcagtgcagccgccgtcagcgtgccgccgccttgtcaccggccaaccagaatggagcgaccagactgcggtgggctgagcaatagcatagcacccctcaaaggtaaactcacacatccctcttctgcacgaaccccagcccaccctcaacaccaggcgacagccatgccgaggcgtgcctgagcaacccacgcaacctcattcccgatatgtctcatcagtaggtcgatgttctgtctggttgaatctctgcacaagaatcccctctcatttaatccgtaacctgtggtcgtccacatcccagccgtcctgccttggagcctgctcacccagccccttcttccactgtgcatccagtccaacccagtcctgcattgctccagtctcgcgagtgtccgtggtgccaatgccggtgctccttcactatattcctgatcggtcccaagttgtaacattgttgcaaggcttcagtcatctgctgcagaggctcttgagtgaaaaagaagtgctgtgggaatagctgagagtgtgtgttctgcaacactgctgtgacacagggtgccaggcaagatcctttgcctgtcgcctccatggaagcttcacaacatatcctcaccgcatgagggcattatgtcggacacctcccatggtttcattccccaaaatcttgtgtgtaagttaacaacctcgtgaagtttggnnnnnnnnnncattcctgatcggtccccagttgtaacattgttgcaaggcttcagtcacctgctgcagaggctcctgagtgaaaagaaagtgctgtgggaatagctgagactgtgtgttctgcaacactgctgtgacacatggtgccaggcaagatcctttgcctgtcgcctccatggaagcttcacaacatatcctcaccgcatgagggcattatgtcgtacacctcccatggtttcacacctcaaaatcttgtgtaagttaacaacctcgtgaagtttggcagcccctcaccaaaattgcattaaccgcagcaatctgccagttgatagctctagtgtacgttgagatcctgcttcaacaatcatcttgacgaaccatcgattccccaggtgcgagagcgcgccactttgaaattttcaaatgagacccggcggatcaagacccgcgacatcggaagcatgcctctcatgacccggacgcatgcgtgccgccttggcatcaacatgcttgtaattactcagacgcgcaggtaccacacagtgtgacgttctcctgccttgcctccgcaatggctcggacacggactcggagcgcagcagtacattacgaagagagcagcgatgagtgagttggcatgcgggtgatgtggtgagaatctcaaatgagacatgagcattgacacctctcacgatgtcgtgcaggtcgggcagctctggcagcgaggccgagcagcaggtgtactcaccagccccgggcagtcggtccaaggtgaggcacctgcacgtgtgcgcgaggtgcgcagaggtgctcaggatagacttcatgatttcaaacgatgcaatcttgcactatgcagaccaggggagccctcgcgccgtcagctcgccggcctgctgcgcgagcagcggcgcgacagacggcagccaaggcgactgtggctcctgcagctggctcactcctgggtgcgcgagagtgtcatgcaaatgagcgctatggcggcccttcgagccagcttgcatgctcttgaagcaagaatgtgtccaatccaatgctggtccccatgcccactccatgcaccctttgcagaagctgtccgacagcccagtgctgccgcagatgctgctcgggattggaccactcggtatacagcagaccgcagaacggccacggcagagctgctcaacttcctgctccaggtagcgacctgctgcacatggcctcgtgctcaaatagtccttcccaggaagacaaacgcactggtcaactgcctgctgccagggcacaggtttccctcaccgcatacagccaccccccnnnnnnnnnngtgtgtccagtccaatgctggtccccatgccctctccatgcaccctgtgcagaagctgtccgacagcccagtgctgcnnnnnnnnnncggtccctcccaggaagacaaccgcactggccaaactgcctgctgccggggcaccggtttccctcaccgcatacagccaccccccacgacaggcatgtggcgtgttcggcgtcaacctgacggtgcaggacgttgagcaggggtctgccgatgacactcgcaagcgagcggacgacaccgccatgcaggtgcggcatggggaggatgtgggtcctcaggccacacatgtttgtgtgcagctccgatgacgtccagcatggaaactgcatgacgatgaatgcgtggctggtatggagacagcaagggacccaccacgcacccatccccctcgcagctcggtctcagcccccagttccaggccaaggggcagcgtgcattccgtgcgtcatacctggagttctggtcggccctggtccgagaggtgtgtggcacgactgattccccaggcatggagccgggacccgcatgagtcagaggaatcgcagcgaccaccttccgcatgattcatcgcagcgccagagtnnnnnnnnnnctgaagccgggacccgcatgagccaggggaatcgcagcgaccagcttccgcatgattcatcgcagcgccagagtnnnnnnnnnncgattctgtgaggcagtgtgggccgggacccctcccccccccaaagaaaagaatccctcgccctcctttcctcnnnnnnnnnntgattctgtgaggcagtgtgggccggacccccccccaccccccaagaaaagaatccctcgccctcctttcctcctatagtcgggggccaaggcccagctctttgaccagtacctcatggaccacctcactgccctcgtcatctccctcaacacgtgcgctgttcgtcgccctgggtgcttggcaggctgctcgggtgtgcacgcctggtgcagttgactgcgaggccaggcacgacgctggcctgtgctgcggccggtgcggccgctgtgtgccgcagtcccatgccccgaacccctggcctgccctgtctgatgacccatgctccctcccgcgggccccaccactccgcagctctgcggtgcgtgagttccgccaggtggccacgctgacggccgtgcagctggtgagcagctgcctccaggttaacgccgtgctggcgggggagcgggacacggcgcagggccaggcggacgccgaggcgaggaggaggggcccggcggcggcgggggcggcgcagcgcgccgccgccttccgccgcgccgccggcgccgcgcactcccgcgtcggcgagctggcggcgtactgcgatgccctcttccagggcgtctttgcgcaccgcttcaggtgacgcgtggggtgtggcgcgtcctggtggggaagtctgcgcggtgccgcacagaggggctgccgcgacggccgcccaccctcgcgcccgtccacctctcatccatccacccacgcctctttgcgcagctttggcacccctccccgtcagatccnnnnnnnnnncccgcacctctcttccatccacccacgcctctttatgcagctttggcacccctccccgtcagatcccaatacctcccttctcccccccccccgcagggatgtgtgcccggcggtgcggtccacgacggtggccggggtgggggcctgggctctgctggcccccgccacctacatgaccgacacctacctcaagtacgtggcctgggcgctgtcggaccgcgacgccgcggtccgggccacggccctcgacgcgctgctggcgctgtacgcggcgccggagaacgtggccccgctgcacgcctttgccgcgaggttcaagccgcgcttccgggagctggtggacgatgtggacgacgaggtcgcggcgcgcggggtgaggtggggggnnnnnnnnnnggggtccacgagggcaagggtgggtggggctgcagggacgcatcctgtgggcggcaagcggcacagggtgccccgtgcacagcagcaggccagggcaggccgtgcctcgacactccccataccatccccgtgtcggccaagcccgcccgcgcgcctccagccctcacccccggggagccannnnnnnnnntcccgtgcacagcagcaggccaggggcaggccgtgcctcgccactccacataccatccctgggccggccaagcctgcccgtgcgcctccagccctcacccccggggagccaaccacccgaccgccaccacccccacagatccggctgctgacgcggctggcggtgctgggcgtggtgcccaccgccgacctccagggcctgcaccgcctgctgggcgatgccagcccgggcatccgccacgcggccgcggcgctggtggcctcaggcctggagagcgccgcggcggcgggcgcggcgggcggagggcacgacgcgcgtgccgcgctcctgcgcggcctgctggcggtgtgcgtggacctgt

SEQ ID NO: 42199 - DNA, 7602 bp, Chlorella protothecoides
  modified_base (517)..(526): a, c, t, g, unknown or other
  modified_base (880)..(889): a, c, t, g, unknown or other
  modified_base (1092)..(1101): a, c, t, g, unknown or other
  modified_base (1386)..(1395): a, c, t, g, unknown or other
  modified_base (1714)..(1723): a, c, t, g, unknown or other
  modified_base (1797)..(1806): a, c, t, g, unknown or other
  modified_base (1865)..(1874): a, c, t, g, unknown or other
  modified_base (2371)..(2380): a, c, t, g, unknown or other
  modified_base (2651)..(2723): a, c, t, g, unknown or other
  modified_base (3189)..(3198): a, c, t, g, unknown or other
  modified_base (4096)..(4105): a, c, t, g, unknown or other
  modified_base (4227)..(4236): a, c, t, g, unknown or other
  modified_base (4538)..(4547): a, c, t, g, unknown or other
  modified_base (4784)..(4802): a, c, t, g, unknown or other
  modified_base (5001)..(5010): a, c, t, g, unknown or other
  modified_base (5323)..(5332): a, c, t, g, unknown or other
  modified_base (5541)..(5550): a, c, t, g, unknown or other
  modified_base (6105)..(6114): a, c, t, g, unknown or other
  modified_base (6338)..(6347): a, c, t, g, unknown or other
  modified_base (7352)..(7361): a, c, t, g, unknown or other
  modified_base (7437)..(7446): a, c, t, g, unknown or other
cctccccccaacaccccctaccccccaacaccccctggcccaaccaacccaacccacacgcagctcaccgagggcggcaaaggagttcatgatcaggttcacccacagcagctgcagcacgttcagggccagtgttcccgtggagaccgcggcgatgaaggtgacaatgagggccaccaggctgatggtgagctggaactggaggaacttgcggatgttagcaaacacgttcctgccccacagcaccgccttgacaatggaggagaagttgtcgtccaaaatgacgatgtcggcggcgtccttggccacctccgtgcctggagggagtggggtgaatcagggtggtggaatattggacttggtggaagcaggtggataaagtgggaaaactgcaggcatgcagaactacaaggggagcaaatcaagccccatgcactgtcacgccccaatagacacataactcaaacatgcaaaaccccttctccaccccacagtctgcccacctgcaatgcccatnnnnnnnnnnaggtggaaaggaaaatgggtggcgggggggcagccttgatgggagcgagtgcccatgctcagtacggcttgcaggcatgcacggcggtgacacaagccaagcaggtcccatacgctgccacgcccgaacaggcaaatccttcgacgtccaagaggatccttccttggcgcagtgccagcccacctgctatgcccatggccagtccgacatccgactccttgagggcgggggcgtcgttggtgccgtcgcctgtgaccgccaccacctcccccaacagcttcaggttgtgcactagggtgtgtttgtcggtgggcgaggaacgtgccagcacctgcacagggtgtgcaatcctcnnnnnnnnnntcccaggcgcttcaggttgtgcactagggtgtgcttgtcggtgggggaggagcgggccagcacctgcacagggtgtgcaatcctcatcgccttgagctcctggaacaggctgatggacagccagacaagacattcaggcatctaacccaacaccgcatattaaggcccccataaaaaccagtcctcctttccaccacccaccnnnnnnnnnncgagtggggtagcacgtcaggccacatgcactatctggatcaatccccccagaagctgtggggcgatttcacagctttcatgccggcatgtgcctcacccatgcacaccggcacaccaataacctcatactcccctttcttcccagacagccataccaacagacacacacaaatacactcacctggaggcgtggcaggagctgcagcagctcctgctcgtccatgttcctgaactctggcccctccatggcaacgccgtccggggtcaggatgccgcactcccgnnnnnnnnnntgaagcttgggcaacagggcccgcagcttggcctcgtccagggtcctgaactcgggcccctccatggcgatgccgtccggggtcaggatgccgcactcccgcgcgatgtgacaggcggtgtggatgttgtcgcccgtcaccatccgcaccacgatgccggcgcgctggcaggtggccaccgcctcggggacctcctggcgcacagggtccttgatgcccactatgcacagcaaggtcatgtcacgctctggcggctcggaccaggcatcctccagcgcccccttgggcaccggcacatctgcacgcgaaagggttgcannnnnnnnnntagaagttcaggaatcccacacatcctagagcaaggccccctcaaaaaccagtcctcctttccaccacccaccnnnnnnnnnncggacggagtgaggggtgtaattctccaacgctcttctacacggccaggcgtcgaccannnnnnnnnntgagggggagggtgatcagtcggcgcacacgagcgagcagcgagggccttgcacatcactccccctcctggctccagataacgccctcccggctccagataacgccctcccgactccaaatcccccctcccaaaaggaccaaagagaaagcaccacaagcctcgcctcacccctcatagccaggcagagcgtgcgcaggccgcgggaggccatgctggtgaccagctgcagcagctcttggcgcaggccctcgcccaggtcctccaccgcaccgcccgcacccgcgtagcgcgtgcagcgccccaccacgatctccgccgcgcccttgcacagcagtgtgagacccgcgcccttgcgccgaaccagcgcgctggacatcttgcgcgcggaggtgaagacgtaaacggtgacgagctgcgtggccagggcctcacgcttgcgccggtaatcctggccccagccgcgcaggagcatgagcagcgcgcactcggtgcggnnnnnnnnnntcgtagacggtgaccagctgcgcggccagggcctcgcgcttgcgtcggtagtcctggccccagccgcgtaggagcatgagcagcgcgcactcggtgcggttgcccacgaagtccacgccgccgtgctcactctccaccaggtaggcgctggagttgaccgccacgttctcggtcaccgcctcggccagcggctgcggcaggtcggcccagtccggcaggcccttggtcgcggcccccgcgaaccagccgtcgaccacggtcatgcggttcnnnnnnnnnnnnnnnnnnnnnnnnnnnnnnnnnnnnnnnnnnnnnnnnnnnnnnnnnnnnnnnnnnnnnnnnnacagcacgcgcacgaagttgtggtccttgagcatggccttcatggtggaggccagcgcgatggtgaccgccaggggcaggccctccggcaccgtgaccacgatgatggtgacggcgataatgaagtactccagcgggccctcggcgaagaggtccatgggaaagccgccgttgtccacgatccagcgaatcatgagcaccaggaagcagaccagggagatgatgacgcccagcttgccaatggcaatcaccagcaggtccaacttctcctgcaagtttatgagtgtttgaggaggagggtcgttttcatcgaatgacagatgtgattttgatggctgactagaactttcctctgccccgtcaatctggatgcagggggatgggggggacagccgaacaagaagctctccagataccactcgtcagcctgaaccagatccgactcatcacccccccccccgccgccnnnnnnnnnntaggaagcagatcacggagatggtgacgcctagcttggcgatggcgaccaccagcaggtccagcttctcctgcgagtttgtgatgtgtttgacgacgaggttcattttgatgggatgggaaatgtgattttggtgcgtgactaggaatttcctctgcccggacaatctggatgcagggggatttgggaggacagcagaacaggaggctcttcagataccactcgccagcccaaccagatccgacacatcccaccccccaaaatccctgcctgtgcactcagatttctccccctcactcatgtcgatgcacccggcctccccagacacacacgcaatacacacaatccctcgtgtcatctcacctggagtggcgtcttccccgacttggtctgcaccagggccatggtcttgccccactcgctggcctcgcccaccgccagcaccagcatggagccagagccttcgttgacctgcgtccccgaccggatccaggggtcggcggggcccttgcgcactgggtccgcctcgcccgtcaggctggcctcgtcgatgaccagcgcattggactccaggcagtagccgtccgccaccagcttgtccccggtgtgcaggaggacgatgtcgcccaccaccacctcggtgttcaggcacaggcactgatgcccgccgcgcaggaccttgatctcgatcaccgacttgcgcgcgttcagcacctgcatctgccggtccttctgccagtcggtgagggcgccgacgatggagacgaggaagactgaggccgcaatggcgatgccttccacgtatgcgtgtttgttgcgcgcagactccactgcgctgccaatgacggtgcagatgacggccgcaaccgtcaggatgatcagcaccgggttctggggannnnnnnnnncgggcccttgcgcaccgggtctgcctcgcccgtcaggctcgcctcgtcgatgaccagggcattggaatccaggcagtagccgtccgccacaagcttgtccccggtgtgcaggaggacgatgnnnnnnnnnnatcggtgaaggcgccgacgatggagacgaggaagaccgaggccgcgatggcgatgccctccacgtaggcgtggttgttgcgtgcagactccaccgcgctgccaatgatgatgcagatgacggccgccactgtcaggatgatcagcaccgggttctggggagagtgggggagtggagggaagggaggcgctttattgtgagacagagccggggagaactttggtatgaatattcacacaagcaagggccatgatgcaactgcaatgcgtctgcgcacctttaaagccttgtaccagagcttgnnnnnnnnnnagtagggaagggaggcgccttattgtgcgacagagacagggggacctttggtacgaatattcaaacaagcaagggccatcatgcaactgcaatgcgtcaacgcacctttaaagccttgtaccagagcttgaagaagcccttgggcgggagctgcttgtgcacgttggcaccgaaggccgacctcctcgcatcgatcccggaggggccgtcgacctccaccccatcggtgaggctggnnnnnnnnnnnnnnnnnnnaccatagcgcgccacaagtgcgctcgacttatcctgcgaggggaattaccagcatgaagaggtacgggaggttaatggcggggaggtcaacagtctgggtaccatgcaggccacgcacctaattgcatgttatgaatgagagaaacatgcaccaatggagctctgaagtccccggacgcacctcgttcagggcgctgannnnnnnnnnaaatggcggggaggtcaacagcctgggtaccatgcaggccacgcacctaattacatattatgaatgagagaaacatgcaccaacggagctctgaaatccccggacgcacctcgttcagggcgctgagggtctcttggtcaatgccgaagggacccgacccttcggtcccttccggacgcagcgcctctacatcgatgtggttgtcactacgactcatctgaagattgttgtttctggtgggaatcgcgtgatctcgtttacttgaggccacatcgtgcgccgcgagctgcggcttcctgctagggtgcgaccnnnnnnnnnnggcgcccccacaaacccttgccggaactcccggaagccgggaagctggggtcctataagctggaaagatctgatataagtccacgatactcaatgagaatcattcacatgtacgcctaatgatgaattacattataaatattccgaaagggggccagcgcttggagctggagaaaacacgcaagctcgagagccttcacctccagcaannnnnnnnnncgaaagatccgatataagtccacgatactcaataggaattattcacatgtacttttaatgagaaataacattataaattttacgagagggggccagagcttggagctggagaaaacgcgcaagctcgagagccttcacctccagcaagcacgtgacctcacagagccgatgtctttggaagcaccccatgcaggtcccttgccgcctcctggcatgtcctgaccagccgtattcggcgggtagaatcctcgcacgcccccgccgcttcgcgcagaatggcaaggccctcctcgcgcgtcgtgacggacaggctccggagtacctcgcgcgatttgcgcagcccgaactcgaagctggggtgggcacacgccagcagggacagcgtcagggtcctgtacagctcgagccccgccctcctcgtcctggcgtggtttgggacggtgaatcttgcttcaaaaattctggggatggtggatgaggcctcgccgacccagatgtttggctggcatggtgctaggccagatgctgtgaagaaggcaggcccagagagtggtnnnnnnnnnnatttctcgtcctggggtagtttgggacggtgaatcttgctttaaaaattctggtgatggtgggtgaggccccgccgacccagacgtttggctggcacggtgctaggccagacgctgtgaagaaggcaggcccagagagtggtgctgacggcggcctccacatggaccagaccagggcccccccacctttcgttcgccagcagcgcagcactctcggtggccacnnnnnnnnnncgaaccagaccagggcccacccacctttcgtccgccagcagcgcagcactctcggtggccacggcctccagcaccaggggcccggctggactgccggcgccgaggtgctccaccagggtcaccaccatctgcgtgcgtgcaggggttggcgtcactgctcgtctgaaacccaggataaattaccaaacgcggtgggagccgggtgcgccagtccaagaaagcggcgctgtgccccgtattgcgggcccgtccatggagtgatgggagcacggagcctgcagggaggggccccgctccaggcctggcgccctgcgcccagtgcctcaagctatctccagttttcaccaccccggccccctcacctgccggaaaccttggtcattcccaggctctaccgcgctcgacacggcagccaggcccagctgcagcgcctgccagccccaggcctcccggggcctcggcggcagcgccggccacagcgccggcgcggcggccagcgcggcgcggaccaggccgaggtcgtggctcgccagacagcgcgccgtcagcgccgcagcgcgcgccggcccctcgccgcccggcgtggctcctgggagcagcgccggcaggagggtgaggaggaaggccagcctggcggcctcgacgggggcggagagggatgcagggccgccgggcgccagggctccggtgcccacctccgccagccccacgctccccaccacacccaggtctgtcgggagccggcgcaggaactcgtccgcgccgcacacgtcgccggccgcgctttccacgcaggcgcgaaccagggccgcatagggggccagggccatggcggtgtgctggagcagcgccaggcagtgcagcgcacgcgaggccaggcgcgggtctggaactgttgcgccggcgctcggggcgctgggtcctgcggcaccctggctccccccagcaaccaccggggtcgagccgggcccctcccacacgctcgcgaggaggagcaccgccgcnnnnnnnnnnttccggctccgagacgtcgaggctggggcggcggtctgggggccgcgcccggccgaccccgggtgccagggcccgnnnnnnnnnncggctccgagacgtcgaggccggggcggcggtctggggggtgcgcccggccgatcccgggtgccaggccccgtctgcggcccgcaccgccagcgcatacgcatctgccgtggcgcgctcgacctcggccaccacaccgagccgcgcctcgccccag

SEQ ID NO: 42200 - DNA, 61 bp, Chlorella protothecoides
agccccgaggcgtcgcccagccccagccccaacgtatcgcccagccccttcccatggtcca

SEQ ID NO: 42201 - DNA, 61 bp, Chlorella protothecoides
atcttttttaattttttttttgggggggggttcatgtgggaggggccgagcaggcaatgga

SEQ ID NO: 42202 - DNA, 79 bp, Chlorella protothecoides
agcaggggtggtgaaggagggtggtgagtgttgtgagagtagtttaagacattcgaagaccccattgtaacaccggctg

SEQ ID NO: 42203 - DNA, 115 bp, Chlorella protothecoides
ccacaggatcgtttgggtggcataggcccccgagcacctctaggcaatcaccccccccctcacactccaatcacgggccctctcatctttcccatgcagacccagggagactgag

SEQ ID NO: 42204 - DNA, 65 bp, Chlorella protothecoides
ttgtcgtgacagggtggtagatgtgaggccggggtgggggggcaggtacacaggggagggatgct

SEQ ID NO: 42205 - DNA, 72 bp, Chlorella protothecoides
gcgccgggttgaggcctccctctcgagggccggagagggggactggccaccagcagggcgcgccgctcaccc

SEQ ID NO: 42206 - DNA, 62 bp, Chlorella protothecoides
actgcccatgatcgtcctccagaatgtccaaagccatgaagatgagaggctgcaagtgtgct

SEQ ID NO: 42207 - DNA, 11447 bp, Chlorella protothecoides
  modified_base (570)..(579): a, c, t, g, unknown or other
  modified_base (1963)..(1972): a, c, t, g, unknown or other
  modified_base (3299)..(3308): a, c, t, g, unknown or other
  modified_base (3870)..(3879): a, c, t, g, unknown or other
  modified_base (4119)..(4143): a, c, t, g, unknown or other
  modified_base (4391)..(4400): a, c, t, g, unknown or other
  modified_base (4507)..(4516): a, c, t, g, unknown or other
  modified_base (4951)..(4960): a, c, t, g, unknown or other
  modified_base (5433)..(5442): a, c, t, g, unknown or other
  modified_base (5768)..(5777): a, c, t, g, unknown or other
  modified_base (5863)..(5872): a, c, t, g, unknown or other
  modified_base (6434)..(6443): a, c, t, g, unknown or other
  modified_base (7007)..(7016): a, c, t, g, unknown or other
  modified_base (7419)..(7428): a, c, t, g, unknown or other
  modified_base (7495)..(7504): a, c, t, g, unknown or other
  modified_base (7560)..(7569): a, c, t, g, unknown or other
  modified_base (8932)..(8941): a, c, t, g, unknown or other
  modified_base (10397)..(10406): a, c, t, g, unknown or other
  modified_base (11122)..(11161): a, c, t, g, unknown or other
  modified_base (11358)..(11367): a, c, t, g, unknown or other
ggacgggcccgcgctggccgccgcgcgcgccgacatggccgccgccggcgtggcgcccaacgccgtgacgcacgacaccgtgctgtcggcccacgccgcacgcggcgacctggacgccgcgctggcctacgcggcggcggtgcacggagacgcggagtgcgagtacagcctcttcttccagaccaccctgctgcgcgtgatggcgggcggggggcgggtgcgggaggcccagcgcatcttccgcgacctgcgcgccggcggcgcggccgacgacgtcgcctacatgaccttcatcgacggcatgctggacgcgtgggaagggggagggcgcgcagacgaggggctgttggaccaggccctggtgagtgcgcggaatcccctggaatggggcagggggcatggttgcagggagttgagaggagccatctgagcagatggaggggttggggcggcggaaactccgggctcaggggggcccccgtgcggggcgtgtgcggcagcacatctcgcgggagccgcaggcgacagcgatgctctagtgcgtgcaccccagggcgcgggggctgcgannnnnnnnnntcccctggaatggggcaggggcatgactgtagggagttgagaggagcaatctgagcagatggaggggtttgggcggcgggaactccaggctcagggggcctccgtgcggggcgtgtgcgccagcacatctggcgggagccgcaggcgacagcgatgctccactgcgtgcaccccagggcgcgggggctgcgatgccgggcccacacctccccctcccccttgccccggtgcatgcaacacccacgcacaccgccctcgtccacaggaggcgttcgagggtttggcggaggccagccctcgcctgctggagccccggccggaggtgggcggggcgtgggtcctggacctgcactcccacagcgcctggacggcgcagctgactgcgctgcgcatgctgcgctccttctcggcccgagcctcgcccccgaccctcaaggtcatcaccggccgcggccggcgctccaacttccggggcggcggcggggagggcagggggccggtcaaggctgggtccagcctgcgggatgcggtgctgaggtgcctggagggtctggtggacgtccaccagtccgtccagaacggcggcgtcctcttcgtgctgggccgggagatcgagcggctggcgcggaggggggcgctggcgtcgccggacaccgtggcgcgctggctggtgaccccgcgccgcgtcgaggcggcggaggaagccaaggacccgggagataggctgggaaggaaggaggcggcggcgcaggtgctgcagggcatcccggccgcctgaggctgccgcggctcgctgaggccgtgacagaggcacccgggcgctggggctcctccatcgatgctcgtaaggctgttgatccgcctacagtcctttttctacctgctagccgtggcaacgaatctcatgggcgtcacatccctcccaaggtgtttgtgtacatatcctgtacagcggggggattaacccctccagaatctggtttaaaagtaacacgtgtccggaacgaccccccccatcgcgccgtacatgcctagctcagctccgaggcgagagcatcgtgtagagcatcggcgtgttgcgacaatgttgtcagccggcatgtagtcgccttcctgtcgggagacggacagatgcggcagggacaggaggcgtaggcacccgccgagaggctggggatggcttggagtgagctcctatgggagtacctggcagcagtgcgcaggactccacaaatcttcgcccgcattggtttcagaaagcgaaccctggaagactgcctgaatgacgtgcgcctcgaggaaggatcgccgggaagctccattgttgcatgggagggattgtgttcaccgtggcctgaggccccacaccctcacccctgctccnnnnnnnnnnttttcatggaagggattgtgttcaccgtgacctgaggccccacaccctcacccctgctccccctcctgtcgccccttgcacaggccctgctgcaaggcaccctgcgcaaggtcttcagtgggctggacctcctcatgctgggcctgggcatcaccatcggcgcaggagtctggcagctcaccggcttggccgcggccaccctggcagggtgaggacgggctgggctcgcgaaaagggggccgggcagcgcagggtttgttggcattggtacgaatgcaactctgagcagttctgggttgttggcccccagcgcgaaggcctctgctggacgcatgcattccgcacggggcactgccgcatgggactcaccactgccattcgccgacatccaatccaccgacaaccccggcactccccaggccgtccatcatcatcgcctacctgctggccggcacttcgtgcaccgctgcggcggcctgctatggagagctggcagtggtgaggcggggcggtttggtcttgcctggcgcggcgctacgtcgtcgtcgtccctcacgctcgggccatgctccgggacctgtctcacccatgatgctctctggtttgaggacgcacgagtccttgcgtcatgcccctgccaggacccacggacgcgcagccgccatgtgaccgccctcaggctcagatggccagtgcccccggccctcgcgacatcgcctccttcccatcacccaccccactcccctcaccctcccccaacgcaggagtaccccgtcgccggcggctccttcacgtacatcatgctgacctttggcgagttccccgcctggatcgcggtctccaaccagatgggcatcgaggtgtttggctccgccgcgctggcccgctccttctccgccttcctggcctccatgtgcggccagccccccaccttcttcacgctgtcgggcagccatggcgacgaggaagactggagcatcgacctgatggcagggggggggaccctgctcatcacactggtgctgacgctgtcggggcggctgtctggcatcttcatcaccggcgtcaccctggtcaaactgggcctgatcctgttcatcctggtggtcgccttcaccaaggcggacccctccaacctgcaccccttcttccgcgacggcgacgtggggggcatgctcagcgcggcctccatctttgtctacaccatgaccggcttcgactccatctccaacgctgcggaggaggtgtgttgatgagggggaggaataacgaggtgtgtgtgtggggggggaaaggggggatgattcacacagcaggcagcgcccannnnnnnnnngtgggggggataacgaggtgtgtgtgtgtgtgtttgggtggggatgattcacacagcaggcagcgcccatggggctctggaggctggcctggccacgggagcacgaacttggctctgtcgggcgtgcctgggcacgggtgacagcgccccgcggcagcggcatgcatgcctgtgtgtcccagggcacgcccactcagggcgtgggccgaggggcgctggcacgccctggcacctgcaggcgaccctctgcgcccacctccacacccccccacgcgcaggccaagaacatcgattcgctgccatgggcgatgacgggggtcaccatcatcgccaccgtcctgtacacgctgctggccctggcgctgagcatgctcctgcccgccactgccatcagcgcctcggacggcatgggccacgatttcttgaccatcggtgcaggagaatgggggggagggtctgaggaggtgcagggatatgcatggacggaccttgtcaccagatgtatgtcccccgtgcagtcgccccgcacgctggccatgccaatgtgcacttgcggcacggnnnnnnnnnntgcctcggacggcatgggccacgacttcttgaccatcggtgcgggagagtgggggggagggtctggggaggtgcaggaatacgcatggacggacctggtcaccagatgtatgtcacccgtgcagtcgccccgcacgatggccatgccaatgtgcacttgcggcacggtgcacaggcccctgggcgtgagccattctcgtcggatctgccccggctcccttgcttcccgcttgtttctcgnnnnnnnnnnnnnnnnnnnnnnnnncatggtcaacaccccctcctcaatcaggcctgcactacatgaagtacgtcgtggccgtggccgcggttctaggctccttcacgggcctcctggtgggtctgtacaccgcctcgcgcatcgccatggtggtggcgcgcgactggatgctgccgccctggctggccaagatctccacgcgcaccaacacgccggcgcgcgcccagatcgtcgtgggcgtggtcgtgggtgggtgctgcggggtttggggnnnnnnnnnngggatggggctggggcatggcgagcaggggggtgcggctgcctgctgctgggatcgccgctctggcgtggcgaattttgcctgacgctggcaagtccaccatcccannnnnnnnnngcctgttgcggggatggggctggggcctggcgagcagggggtgcggctgcctgccgctggaattgccgctctggcgtggcgaatcttgcctgacgctggcaagtccaccatcccaaggctccaccaccccgtcccaccttggaaactgtagccctcatcgccgccttctcctccggccatttcctggcggacctggtcagcttcggccagctgctgagcatctggtttgtggtgaacgcgcagctgtacaggcggtactacccgggcgtcaagctgcggttcacacggtgggcacagggtggagcgacctgagaaggcaggggaggtgtttcagagcttgcacagggatcatgcagtgcgtgtgtgactggggtctcaatgtttctgtcagatggggatgaggagtgaccaagagcaatgcagcctgccatccannnnnnnnnntctgaaaaggcaggggaggtgtttcagagcttgcgcagggatcatgcagtgcgtgggtgactgggagtcaggtctcaatgtttctgtcagatgggaatgaggcgtgaccaagagcaatgcagcctgccatccacgcctgtggccctctccaacggctccgcccaccctgctcccctttccatcacatcaggcacggcacggtggagaccaatacagccccctcccacgcctgggttcccggcagccgcctcgatctgtccctggtcacccgccagatcctgacgggggtgcacatggtgctcatcaccctcggtgccacgggtgcgcagggttggaggagggagtgagaccccagccccgatggggcctggcaggggtgcctcgacgcgcgctggcggcggggcctccacaccctgaacacccacgacctgctcacccctccgcgcacatgcaggtctggcaacctggttcannnnnnnnnnaggagtgaaaccccagccccggtggggcctgccaggggtgcctcgacgcgcactggcggcggggggtccgcactccgaacacccaagacctgctcacccctctgcgcacatgcaggtctggcaacctggttcaggaccaccaccgggtcagaccggacgctgcgcgtcgccggctgctcggctttcttcctgctctactttttggcggcgctctccatgcgcctgctctgcccactgcagtatgagcctcagcgctggcacgtccccgctttcctcatgctctggctccccgccaccgccattggaatggtcctttttgggtgagnnnnnnnnnngcgccatgaagcagattctcacggcagccctaccgcacgattgcgtatgagcgggctgggaagtgggatctgtgcggcactccggnnnnnnnnnncacattctcacggcagcccaaccgcacgattgcgtatgagcagcctgggaagtgggatctgtgcggcactccggggctgcgctggagcgcgtcccaccacctctcctccgagctcctcccactgacaaacaggatgacgagcctgcagagcagcatttggatcaaggtgggcgcctacaacgccatcggtctgatcttttacctgctcttctccctgcccatgagctacatcaagcactacaagctggactttaccaacaccgagctgctcaagtgagtgtgtgcgtgtgtgcatgtgggggaaatcagcaggatactgggacgaaggtgcgaaaggtcctcactgggatcgggtttttccagaggccgagggcattgcagagcgaccacaaacccttgcacctgtgaggcctgggctcggaccagtatttgccaagcggcatttgatgtccccaagtcctgcagtcccgacgcacagtcctccccccccccacacacacacatacctcacaccaatcccatctccccccacactgcagtgtggtggacatgcagtttgtgnnnnnnnnnnttcccccacacacacatacctcacaccaaccccatctcccccctcactgcagtgtggtggacatgcagtttgtggagggcaagtgggaggcgacggcctccaacatcgaccgcgtgggcacagcggtcacgaacctgtcgctggccgactcctccgacccccagcggagcctgaaggcctacgggtacccgggggcgagcgggtcactggcctccaacacccctgtgcgatcgacgcggctgagcgggggggctgcttatgccaggtcctccctctctggcaggggaaccacgccggcgagcacccctccagcctcggtcatgaacggtcaagcccacgcggcagcagattcatgaagcgatgagcacataggaatccctgggccgggcaaggctcagagtcatcacaggcttagttcacatgttggagaggtgacagcacttgctatgccacatttatatacaggccatccctggtctccatacccctttcaaacttcaatgacccccctaaacccgcctgactgtctgtttactgaagcaaggaatgcaggagcctgtgtgnnnnnnnnnncagttgacatgttggagaggtgacagcacttgctgtgccacattcatatataggccatccctggtctccataccccctttcatacttcaatgacccccctaaccccgcttgactgtctgttgactgaagcaaggaatgcaggagcctgtgtgactgggctgaggggggatgggggccagaggtatcctggccagatttgctggcgtggcaccgccacgccatgccgtccggccatgccgacaccctggcttggccccgtcgcctcatcatgggggcccagttcatgccgcacttaccatcccaacttctgtagcttgggcacctggccagatgaggagtgtgacgtaggcctcggcctgactggactcccgcgggcctgcgtgccggaatgaattggaaggannnnnnnnnncgtcaggtttgctggcgtggcaccgccaggccatgacgtccggccatgccgacaccctggcttggcnnnnnnnnnngttcctccaggactactgggcgggggtcaagaaaataccccagatattccagaggnnnnnnnnnnattcctccaggactactgggcgggcgtcaagaaaataccccagatattccagaggataggattccgaaaacgaacgcttgaggatgaactcaatgaggtgagcatgcgggacgcagggtgcacccccctaaccctgggggagggttttgccagttgggatctccagccctgctcagcgctggcgccagcgttcagaccccgcgcacccatgcgcacacacaggccctcctgcgcgggaacctgcgcaaggtgttcagcggcttcgacctgctcatgctgggcctgggcatcaccatcggtgggggggtctggcgcctcacaggccacgccgccagctccttggcagggtgagggatccgaagctgttgctgccggggctcattcaggttgaggctgcctttgtagaggggccgggtgatctgtccctgcgctggggccacccattggtgcgcatggcctcacatgaccttgatccttcactggcttcacatctcaggccgtccatcatcgtctcctacctactggcgggcatggcctgcacctttgctgccgcttgctacggggagcttgttgtggtgagtcagcgctgtctggtttcatgctgctgcgtggtttgaggtccgcggctgcttgccgctcacgaggccgagctggcagtgtggaacctttgtggagaggcgccgcggcctgctagcagggttgcactggggccctcagcagcgcgcggcctgcaacatgcacgccccagctccaggtgtcatccagctagccctgggcgaccattcccaccctgacacaggagtaccccgtcgccggcggcgccttcacctacatcatggtgtcctttggcgagttccccgcctggatgacggtgagcaaccagatcacggagtacctctttggcatggccgtggtggcccgctccttctccggctacctggccaacctgtgcggcgccgactccacgctcttcacgctgggcggcagccgcgtccccggcgcctggtccgtggacttgatggccctggcagtcatcctggctgtcaccgccctcctctgcgtctccggccactctggatccaagttcatatcctgtgccaccgtgctgaaactgggcttcatcgtcctcatcctcatcgtgggcttcaccaaggccgaccccgccaacctctcccccttcctcctggacgacagcgtcaacggcatcttcaccgcagccgccgtcttcatgtacgccatgaccggatttgactccgtctccaacgctgcggaggaggtgcgggataggattacttggaagaagagggggggtaagagtgcttgagggtgcaaggaggccgagatgggctacgggagggcgggnnnnnnnnnnaaggattacttggaagaagaggggggattggagtgcttgagggtgcagggaggccgagatgggctacgggagggcggggggccaccatcctcgaccccactgtcacagcaaacccgccacaccttttcctcccgcccacaatcccaggccaaggacatcgggtcgctgccatgggccatggtgggcaccaccctcatcgccaccgtggtctacatgctgctggccctcatgctgtgcctgctgcagccctacacgcagataaaccgcctggacggcttcacccacgcctttgtctacgtcggtgaggccctgcacattggaattgagggatcaaacaggggagtatctctccgcaaagtctacccttttgcctcccctggggccccaccatgatctttcctcaggctggcgcacgagcggggccaagcaaaacagcattatcatcaccgcctcgcccacctgcccgctcccagggctggactacatgcaatacatcgtcgccacggcggcggtgctgggctgcatcacagggctgatggtgggcctgtatgccatctcccgtctggtcatggtggtggcgagagactggatgctgccccccttcctggcccgcgtgtcaacccgcacccagacccccctggtcgcccagatcgtgctggggctgatcatcggtgaggacgatgggatttggggaggcgggattggtagcgcccaggagaggagggaatgggtaggcggcccatgcctgggcgggggggtggccacctgttggaccggcatcctcggttgggcgactgggcgtgttggggccgctgggcatgtgatgggggctggcaggagggttgtgtgcaggcttcttcccttcccttgtccctgtctgactccctctggcctacataccaccttaaccaacaccaagtaaacccacccctcccgtccatctccaaccactgcaggcaccatcgcgttgctggtgcccgccgacttcctgggcgacctcgtctccttcggccagctcttctccatgtggtccgtggtgaatgcccaggttttccgccgctactaccccgagatcaagctacgcttcacgcgcttcggggccgtggagaccgcgaacgccaaggtggagtccatggcgctggggggtaggctgaacctctccgtcgccgcgcggcggcggctggtggccctccacatggcgctcatgacactcttcgcaacgggtgagagggacggagggagggagggaggggtgtcataatggtgcccctggaacaagctgctgggatcgctcagttgtgcatcattggcatcagggcggggcgggcgggctgccagcttgccacgctctagcgctgtgcccgttgcccaaccccctacccctggacccctccccctccaagaaagcttcccaaccatgcatcaaagcacaccctttcctcctcaaccacggtcnnnnnnnnnngtaatggtgcccctggaataagctgctgggatcgttcagttgtgcatcattggcatcagggcagggcggacgggctgccagcttgccacactctagcgctgtgccccttgccaaaccccctccccctggacccctccccctccaaagaagcttcccaaccatgtatcgaagcacaccctttcctcctcaaccacggtcataggcttggcgacctggtacacggtgatggagcgcaacaagcagcacaccatggaggtcatcgggtgctccgtgtttgcggcgctcttcttccttgtcaccctctccatgaagctgctctgccccatccaatacgagccccagcgcttccacatcccctccttcctcatgccctggcttcctgctggggccataggcctcatcctgtttgggtaaggcggcgtggcgggtgggtggggtggtctgccttgttcgaggaccagcccactggctgggggcattcagtgatcttctataagccacagtgtggtccccctcgggcgagacatgcggtcgcatatcacaaaaagttgcaggaaacggcactctgagatgctcaccgccctcttctttgaccctgcgtagtatggcaagcatcagcccttctgggtactacaagataggcgcgtacaacctcttggtcttcctcttctacttcctgttctcgctgcccatgagctacatcaagcactacaagnnnnnnnnnnnnnnnnnnnnnnnnnnnnnnnnnnnnnnnncgactttgtcaacaccgaacaaatgaagtgaggtggcgaggagtttgggggttgggagggggaaaggtggggatgtgcgagccttcgctgagctgcttgagcgctccctctcacaaaggtgcctcgcctagggccatggcctggcggccgactcgccctctcaaaacctctcaagaagtgatccgccaccgcctctnnnnnnnnnnaggagggggaatggtggggatgtgcgagccttcgcttagctgcttgagcactccctctcacaaaggtgcctcgcctaggg

SEQ ID NO: 42208 - DNA, 291 bp, Chlorella protothecoides
cttcaggcggcgggtgcccgtgagctcgggaatcacctgttgcgaggagtggtgggcacgcgaggggggttagcctcgtgagcaggtggctctgtcggtttgacagtcacaactggctgcatttcatgttgctgctgcacaaccccggggtcacagggatgggaacgaaggcttgtcttggatgaaggtggtggaccccttccgtgcttgggtgaagcatacatgggaccagcagcagcccctgtaacgacacctcgcaccgggccccagccctctggccctttgagcatt

SEQ ID NO: 42209 - DNA, 61 bp, Chlorella protothecoides
cagcatcaggcgcccagggatcagccagtttccaaagctggtgaaggtgcatcgctcctcg

SEQ ID NO: 42210 - DNA, 72 bp, Chlorella protothecoides
gcccggggccaggccgagcgtcaggcccgccggggggatctgggagcggcggggtcggggagcgacgtggag

SEQ ID NO: 42211 - DNA, 75 bp, Chlorella protothecoides
tcgtgttcggctttggtacgcagcagagtggcggggtggggggaggcctgcctggactcggtgacttgcctcgtc

SEQ ID NO: 42212 - DNA, 316 bp, Chlorella protothecoides
gccagcggcccctccgcctcgcccggcgcccggcgcccgggccccccacagcccacgctggcgcggcgggccacgggccgcagcgcggtggccggggccggtggcggatgcgtgtgcgtgccctcgtaggtggtggacagcaggcgcgcgtcgcggctgctgcgccccacctgcttgcgaacgcagcacccggggtgcgtgcacttgtagtaggagcgcgggtgcgggttgcccttgaccatcttctgcccatacttgcgccagcggtacccgtcgtccaggttgtcggcgtccgtctccagctccaccacctgcc

SEQ ID NO: 42213 - DNA, 61 bp, Chlorella protothecoides
ctctcgttacctccccagtttgctggcagggttggcctaccccaccttcgccaccctgcga

SEQ ID NO: 42214 - DNA, 94 bp, Chlorella protothecoides
cacgggcgtcaggctggccgccgtgcggcgcttgactgggcctccctcgccgtagtgatcattctctgcagaggaaagcgcggcgtccaccagc

SEQ ID NO: 42215 - DNA, 76 bp, Chlorella protothecoides
gccgggggggccgccggcgtcctgcgcgtgcatgggggtttgggggccgtccgtgccgggggctgcggcgcgcttc

SEQ ID NO: 42216 - DNA, 75 bp, Chlorella protothecoides
cgcgcgggtcggtactgatctccagcctgacaggggggtgagggagggggagggtgtgcggagggagtgaatatt

SEQ ID NO: 42217 - DNA, 162 bp, Chlorella protothecoides
gcgcccgccgccgccgccgcgcgctccgatcgcgcgcgctcgcgctcctccgcctcccagcgccgccgctcctcggccagcgtgatgtagcgctgcagcatgggccccgcacggtcgctgagcaggagggcggagtaggacacctgggcggccgtccagcag

SEQ ID NO: 42218 - DNA, 77 bp, Chlorella protothecoides
tctttctcggagtcggtgagatggggggctaagggaggggggctgctcatgtgtcttccacgaggccgccggttaca

SEQ ID NO: 42219 - DNA, 97 bp, Chlorella protothecoides
caagcaccccttctttttcctgggcctgaagtaccggaccgaggccggcccccgtggcgctgctaacggcggcggcacagaggccaacaagtcgccg

SEQ ID NO: 42220 - DNA, 90 bp, Chlorella protothecoides
ggaccaggcgctgggctggacccacgtgggtctggatgcgcggggggaagccatgcgtgggcgcgagacggggctgggcaacctgctggc

SEQ ID NO: 42221 - DNA, 61 bp, Chlorella protothecoides
aaaacccagcctgggagggccatcctcctgtggctctagcgtccacacccattccttgacc

SEQ ID NO: 42222 - DNA, 112 bp, Chlorella protothecoides
cttgccgcccaggctgacggtggtgccgtcgcggcgttgccacaggttgacgccccgggccccaggcctgccacccaggatgccaaaaggggccagcgcgcgtcgctcggag

SEQ ID NO: 42223 - DNA, 98 bp, Chlorella protothecoides
gcacagcaggtacagcaccctcatcacctcccacccagccagcacaaacctggtctgcaacaggcaagggcacggctggcaggcgcatggggtggaac

SEQ ID NO: 42224 - DNA, 183 bp, Chlorella protothecoides
ttcggcaccgaccggggggtctgcctcgccgccggcggtctcgccggccgcgccgagcgccgctggggcgcctcgacacgcgtccgcccccttgcgctcggtgcagccaccgccgctgccaccatccccgtcggcgtccggcagctccagggtgtaccactcgtgcagcgcgagcgtgtgctt

SEQ ID NO: 42225 - DNA, 61 bp, Chlorella protothecoides
cggctcgacagctcacctccagctcagcggggagagtcttcccaaactcaaaggcacgggc

SEQ ID NO: 42226 - DNA, 61 bp, Chlorella protothecoides
gaagggacgtgcatgaagcacccacgcatgcatgggcacccacgcatgaatgggcatccac

SEQ ID NO: 42227 - DNA, 73 bp, Chlorella protothecoides
tctggtggtcgagtggggacctcatggcgacaggggaagagaaaatgtgtggagaagttggtggaggcgccga

SEQ ID NO: 42228 - DNA, 63 bp, Chlorella protothecoides
ttgaagaccatccacaccccttttcactccgtacgacaggggtggccggcccatttgattcct

SEQ ID NO: 42229 - DNA, 77 bp, Chlorella protothecoides
gacctccctgcatagtttctgtttcattcttgccccatcaccttctccatgtgaatgctgccaccccctttccgggt

SEQ ID NO: 42230 - DNA, 92 bp, Chlorella protothecoides
cgacgtcaaggtcagcctggtgaagggggaggggtggagagtgggaaagggtccatgcggggacaccgcaatgtgagcaagggcgtgctggg

SEQ ID NO: 42231 - DNA, 64 bp, Chlorella protothecoides
cataccaccctcaccagcatcagcccccccaccaccccccccccctcctttgcctgcacctggt

SEQ ID NO: 42232 - DNA, 125 bp, Chlorella protothecoides
ggcccccatctccctcttgaatgttggggacagggtgggaggcttcagcctgacccaacctcgggggtgccatggtcgccctctccgcccgcgatgccttgctgggcgatgaagtcgcactgggg

SEQ ID NO: 42233 - DNA, 87 bp, Chlorella protothecoides
tgcgctgcgggcggcggggcggggaggctgcccccgccgagcggtaattgcccctgtaaacataaccagccggatgctgaaggcccg

SEQ ID NO: 42234 - DNA, 62 bp, Chlorella protothecoides
ggccgtcgtcgcagcgggggatgtgcggggggccgtggcggcggccgcggtggactcgctga

SEQ ID NO: 42235 - DNA, 61 bp, Chlorella protothecoides
agcaggccgggtcgcaaatccagggtggtgtctgagcgccaggtggcgcctttctgattgt

SEQ ID NO: 42236 - DNA, 61 bp, Chlorella protothecoides
gctgtcctcgcacttccaggaggtggggcgggtgtgggctggcagcgaggggccctcacac

SEQ ID NO: 42237 - DNA, 70 bp, Chlorella protothecoides
ccccaggcccgcgtgccgagccccaggagcccagtggcactgccactgcccatcgctgggcagagtatgc

SEQ ID NO: 42238 - DNA, 95 bp, Chlorella protothecoides
ctgtcaagagtgctgaagggcctgcttttcgggtgtgtgcggggggggtgaaaggggagggtgcaacggtgagggtgctagttcgagtacacgac

SEQ ID NO: 42239 - DNA, 444 bp, Chlorella protothecoides
  modified_base (135)..(268): a, c, t, g, unknown or other
gttccatccagggcacctgctggtcagctgacacgcaggtttgcagggggcgtgcgcacgtcataccggcaccggcagccgcctcgacaggctcggctccccatcaaactcaccgccatcgtcgtcgctggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccctcatcagtcgcaggaggggatgcgatcgccggcgaggtggcggtctgcgtgggatttcaaaggggtttgttggccgtcatgcaagggcttgcgtgggtgggccgagggattgtgtagaggagcgcaggggcgtcatccgggtcgatgccctccatggcacacggcctcgca

SEQ ID NO: 42240 - DNA, 28262 bp, Chlorella protothecoides
  modified_base (110)..(197): a, c, t, g, unknown or other
  modified_base (451)..(460): a, c, t, g, unknown or other
  modified_base (762)..(771): a, c, t, g, unknown or other
  modified_base (1952)..(1961): a, c, t, g, unknown or other
  modified_base (2203)..(2378): a, c, t, g, unknown or other
  modified_base (2534)..(2543): a, c, t, g, unknown or other
  modified_base (3770)..(3779): a, c, t, g, unknown or other
  modified_base (4250)..(4259): a, c, t, g, unknown or other
  modified_base (4449)..(4458): a, c, t, g, unknown or other
  modified_base (4605)..(4614): a, c, t, g, unknown or other
  modified_base (6424)..(6433): a, c, t, g, unknown or other
  modified_base (6791)..(6800): a, c, t, g, unknown or other
  modified_base (7064)..(7073): a, c, t, g, unknown or other
  modified_base (7858)..(7867): a, c, t, g, unknown or other
  modified_base (9160)..(9320): a, c, t, g, unknown or other
  modified_base (9377)..(9386): a, c, t, g, unknown or other
  modified_base (9577)..(9586): a, c, t, g, unknown or other
  modified_base (9643)..(9652): a, c, t, g, unknown or other
  modified_base (10178)..(10187): a, c, t, g, unknown or other
  modified_base (11019)..(11028): a, c, t, g, unknown or other
  modified_base (11096)..(11105): a, c, t, g, unknown or other
  modified_base (12398)..(12407): a, c, t, g, unknown or other
  modified_base (12779)..(12788): a, c, t, g, unknown or other
  modified_base (13184)..(13193): a, c, t, g, unknown or other
  modified_base (13418)..(13427): a, c, t, g, unknown or other
  modified_base (13870)..(13879): a, c, t, g, unknown or other
  modified_base (14413)..(14422): a, c, t, g, unknown or other
  modified_base (15187)..(15196): a, c, t, g, unknown or other
  modified_base (15964)..(15973): a, c, t, g, unknown or other
  modified_base (16534)..(16543): a, c, t, g, unknown or other
  modified_base (17388)..(17397): a, c, t, g, unknown or other
  modified_base (18524)..(18533): a, c, t, g, unknown or other
  modified_base (18950)..(18959): a, c, t, g, unknown or other
  modified_base (19275)..(19284): a, c, t, g, unknown or other
  modified_base (20264)..(20273): a, c, t, g, unknown or other
  modified_base (20733)..(20742): a, c, t, g, unknown or other
  modified_base (21676)..(21685): a, c, t, g, unknown or other
  modified_base (22055)..(22064): a, c, t, g, unknown or other
  modified_base (22514)..(22523): a, c, t, g, unknown or other
  modified_base (23691)..(23700): a, c, t, g, unknown or other
  modified_base (24188)..(24197): a, c, t, g, unknown or other
  modified_base (24278)..(24287): a, c, t, g, unknown or other
  modified_base (24811)..(24820): a, c, t, g, unknown or other
cggcgtcgggcaccacggtgacgtggcgggccagcgcgcccagcgcgcccagcagctcctcggagggcggctcatagccgccggcccagagcggcggcggggccccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccggcagcggctcctccccgtcagtcagccagaactccaccagtgtggacaggaggagcagcgcctgggtgcgctgcgcgtgcagcgagggggaccgggacagctccgggcggcgcactgagtgttgtgtgtgtgtggaggggaggggaaaggggggtgagttgggacttaatggttgttcattgtttgggaggaggactagtaacgatctcagctactccagaagcgttgggacgccagcacaggggtccnnnnnnnnnnttccgggcggcgcgctgggtgttgtgtgtgtgtgtggagggggggggtgaaggtggggagttgggacttaatgtttgttcattgtttgggaggaggactagtagcgatctcagcttctcaagaagcgttgggacgccagcacaggggtccgccactcccctccttcacctttcgataaccgtccctgccttcctaaccccacaccctagaagccacacctggagtccgtccagaggagccagccacccccccgcccacgggcaccagctcctccagcaaggaggaaagcagggccaggtagnnnnnnnnnnggaggggccagtcacccccccgcccacgggcaccagctcttccagcaaggaggaaagcagggccaggtagggctgttggccctggccccccgccgactggccgccgtggccgtgcaggagcgggagatgcagcgcgtctgacaccgcctgctcgtgatggagatttgaaggatgacaagtgagctgctgtgtgagctgggcacctttgatgacaacatagggcaggtggcggtgcggcctgggcttacaggggcctcccttccttgcaacgccctatccctccggcccttcagatgaggagggggccaactggctctcactcaccctccgcatggagcctggcaggaggcggtcatggggcgcgcccgaggcctggccgccaccaggctggccaggcgcggagtccggccaggcggccgcctcctcgccgccgcggaacgcgtagaatgcaaaccaggcaaaaaagtactgcgccacgcccatgtggatggagggccggcccgccgcgtcggcgaccagcgtgccgcctccgtactgcggccagcgcgccagctcagcgcgacccgccccgctgcacagcagcagctgggtgtgggtgggcaggcgctcgcgtggaaaaagaaagcgtgtggcgccatccgcatccgcatcccgcatggcgccgaacagcgggccgccggggtggagaagcgccagcagggcatccacgtcctgggccttgccctcctgtgtggtacagcgggaaggacaccaaagggtgcataggaagtgatgagcatgcgctgggtggtgaagattggtctgagtgcacgcagaaggatcggtgtccccgcaagcacattccccccattgctcccaccttggtgagggagctgagccagctgacaccgtcgtagccgaagagacgtttcagcaggaagggaaaacatagctcgaagaactctctcgggttatccctgaacatgcatagggtcgaggggcgatggtggaccccgaagccagcgaagtgttgttcagccaggagccccgcagcagtctatcatcggcgtggcagcggctatgatcaggatgactcgtgtgagcaaatggattctaacacacattcatacgcttcttcaatttatccagatcgcccatgcatgcccaccggttggccgcgatgcactgttccacagccttgnnnnnnnnnntttggcgtggcagcggctatgatcaggatggctcgtgtgagcaaatggattctaacacgcattcatacgcttcttcaacccatccagatcgcccatgcatgcccacctattggccgcgatgcactgttccacagccttgcaggcctgggctacgttcacacggggccgctcgaggatggcacgcaacccctgggggttggtgggatcccaatcccgatccatgatcgctgaagggctagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcgtcaaaaatcccattgccggttggttttgggacagcatgtcgctgcgcctggtgtcgtcagcccggctggatgccagcatctcggcgcatgcggtgtcgggcgacggcaagctcctggccgtggcgcgggaaaatgagatctccatcctcnnnnnnnnnncacggggttctagcacggccgcatcgactgcattctgaattggggtcgatggtctccacgggcaattccgccgcagggctttcgcgcccaggttcaaatggcagactgcatgcgaaaatgtcgcagctcggcaaacaggtacatgccaggatgtgagtgtttccacatcaaaagacccaaaaaggagaatcgaagcgtcaaaaatcccattgccggttggtttggggacaacatgtcgctgcgcctggtgtcgtcagcccgactggatgccagcatctcggcgcatgcggtttcgggcgacggcaagctcctggctgtggcgcgggaaaatgagatctccatcctcgaccgtgccagcccctcccagaactggacgcctgtcgcccgggtggggccatgccagcactcccagcgcgtctccggcctggcctggtccgggtcgcagctggcctcctgctcccacgactccggggcggtggtctggacccgcaccccgcagggtgcctggtccccgaacctggtggtcacccgcctggcgcgagccgcgctctgcgtgcgctgggcgcccggcggcgcggccttggcactgggagcggtggacggggccgtggtcgtctgccacagggacgaggagaggtcgctctgggccccccgcatgctccagcgaggggatccgcagagcgcggcagcggtccaggacctggcctggcacccggcggggagctgcctggccagcgtcgcggccgacggcagcctgcgcatccatgccacgccatgcagaggtgaggccccggcctggagtgccatggtgggcagctcctgtgctcggaaggcggtgcgactgtccattcttggcacgtttttgcaaaccgttgacagcacgtgggagtttgagtttgctcaatgcaactgcagttgccttgcccgagatggaaactggcaccagcgctgccactcgcgctcaacaccacctggcaggcgcgggcgcacccacccctccgagcaccaccttgggcgcgtttggcacgctgctctacacagctaccccctcccccggcgcctgggccatgagcgtggcctgggacccgagcggaagctgcatggcggtggcttcctcctgcggtggcggcgccccgccgcgcctgaccctcatcgcagggctgctgacgggaggtggggcgtgcactgccgaggcgctgagggaggcgggcacacgcgcccagaccnnnnnnnnnncgacgggaggcggggcgtgcgctgccgaggcactgagggaggcgggcacacgcgcccagaccctggacctccggggcccctgcctgggtctgaccagcctgctcttcctgaccaaggatgtgctggtgggagcagggttccacggcaggcccctggtcttcaggcgtggcgcggatggcccttgggcccaggactgtgacccgggcccgcaggaggacgccgggggcgcacagcagccggcaggctcccctacgccggccaggcctgccaccctggcgcagcgcatccgcatgttcgaggtggatgagaatcgcagcctgaacgtgcaggggcgcagggtcggcgcgggcggtggcaaggcggcgggcgtggggcccgggcggccctccggccccgcccgagggcccgaacatgctagccacatcggtagccttgcgggcctggcgcaaggggcgttcacctccgccggcnnnnnnnnnntccgggggcccggacatgctagccacatcggcagcctggcggggctggcgcaaggggcgttcacctccgccggcgccgacggccagctgctgctgtggcaggtgacgggcgtgcggtgaagctgacgagtcttggatgcattgctggggcatgctttgcgggctgtagatcttgagcccaagcctgcctnnnnnnnnnncggtcttggatgcattgctggggcatgctttgtgggctgtagatcttgagcccaagcctgccttgaataattgcgtgggtgactggtcggccagctgttacaaggcagagcaatgtaagagcaggaaaattcagcaccgcggcaccnnnnnnnnnncgaatagttgcgtgggtgactggtcggccagcagttacaaggcagagcgatgcaagagcaggaaaattcagcaccgcggcaccgcatcagccctccagcttgatcctcttgatgtcgggcgggggcgagtcggtgctcgtcgggttctcgcgtttggtgccgctcccctgcccctcctccttcgctcgcagctgcccctcgtcgccgtcctccttctttgccgcggcgcctggcgccgccgccgccgggagggcctctgcgggaccgtccaggccgtcctcgcccagggcactgaagagcacgatggctcccggagacaggccatacctggcatggtttggggtggcaggcatggctcagaggaagtttgtgggccgcaacaagctgcgtgcgaccaggagcgcagccaggccacgaagaggcaggccgtcccctggccccaccatcaggcctcctctcatcctggctccccctgggcttgtcccaccgacccagaatcatcgtacatcacgcacctgagcgcctggtcgcccgtgagccgtactgccccctcgtaccgccactcctggtgctcctcgtcccacacctgctcgaaggcctcgcccgacagcgcacacgccggctggtcctcgtccacgggcacgctgtgccgctgctgtgccgcggccgacgccaccctggcgtcgggctgccggtcgcctcgctgcggcggctggccctccccggccgccgccccctgccccgccccggcggcgctggccaaccagacgtccaggtccacataccagaggcgggaggcacggagggcgccgccgccgcgccgcgcgcggcgcaggaactgcacgtccaggaaggcagacttggtctcggccgtgcgggcgagcaggcgatgcacggcgtgcgaagcgtcgccctgcggtgtgggccgggggtgggaggaagggagacgcgtgttcggcggggcgagggttgtgtcacaggtttgattgtttgcaagcagatgtggccccgggcagaggcaagcaggctggctggtggatctcgagctgcctgttggctggcgtgtgatgaagtgtggcacctcacaaacctcctgccaagacttcgaccagccagtcccttgccactgtgcccccaccctctggaccgaccccctgccctggtgtttctgctgcacccacccaacacatccccccagctcccggcccaagtgcgcgccctgtcagtcacacccctggcagccacgccctgtccgtctcctggtgatctccttggaattcttcccgtgccaggggcactgcgcgtctgcagggttccacgggtcgcacacaagcagcacacagatccccccgcctccactccgtcaggcagccactagaagcacacgctaccttgattatctccgaactaaactccagggatggctcgcgggcctcggccacgcctgcagcctttgctccgcccagcacccccgctgccagcagggaggagaggaggtccgggatggggacagtgggaccgctgccgggccgcggcgtcgggtggcacatccccggcggcggcgtcttgtacctcgggaccaggggggcgggcgcggcataatgctggtgctgcgccgcaggcgcaggctggtggctgtaccggggctgggtgacgggggggtactgcggtgccgcagccgccggcagcggcgcggcgtactgggccgcgccgtgtgcgccctcgtagtgctgcggagccgcccaggccgggtactgcggcgcggtctgcgcgccctgtggtctgtggtactgcacatggtcctggtacnnnnnnnnnnggtactgctgcggagccgcccaggccgggtagtgcggcgcggtctgcgcgccctgcggtctgtggtactgcacatggtcctggtactgcatttctgcctgcgccatcgccagcacgtggtcggcgaacaccccccgccaggttcccagcagcttctgcagcgcagggcgtgccgtctcgcccccccgccaggccacggcgaacacctgggggcgcggtgggtatgaggtcatggtggggtgaggtaatgtggttggggataattgcggagctatgggatccttgagctagaggacatgtcttgacagacagcatggtacgagccattcatctgttcttccaggcttccaccccttgannnnnnnnnnaagaacaggtcttgacagacagcatggtgcgagccaaacatctgttcttccaggcttccaccccttgactgcttctgctctcctcttgcagcaccaaacaactccacccagatatcacacacctctgggagggctgcgctgaagtacgtcttgtagggttcacccacaagcttggagatggagtccaagaggtacagggcaggcagcttcaggggttggtcggcctgtgatgtagggggttgggtcatgatgatcggtgcacannnnnnnnnnctcacccacaagcttggagatggaatccaagaggtacagggcaggcagcttgaggggttggtcggcctgtgatgcagggggttgggtcatgatgatcggtgcacagctgatgattgaatggtgcacatgacacatcaccatcgcaagcactgcaccgtcgcttgtgtctccccctggacgccgctcacatggagcaccctgttgatgatgacttgcgccaagcctggcacagcctggggctggttgtgcatcgcctctcgcgcgatctccgtgagagccacgatgttacgtttctccggggtggtgaggtcgtccacgaaccccgcaaactccgtgacgaagccttgcgtcgggtccatcccgaggtcaagaggacaacccaccccgcgacctgcacgcgctgcggaccacaactgcactgcacgacgaaaaccaatcagcaaggatgtgcacagccgttcaagggtcagcgcagggtctggccacccctgggaagctctcggtcgggtctgatgctttggctcttgtcaaccgtcttacaggggtggtgcagcgcacggcaagttatgacgtcgtatcgatttatatttgcgtttactatgagacgctgggccgcgttcatggtaggatgctacccgtatcctgctggaacgggtagcagcaggcacagcatccagctgtgggttgagggcgcgatacaggacgactttcgtttgtgcgagcgacaaccaccgctctctcatagtttgccccatatactgtgtcttgcaaatccttacactcgnnnnnnnnnntgagcgataaccaccgctctctcataggttgccccttatactgtgtcttgcaaatccttacactcgccgttcaatatgtaggccaagttattccgcttgtggctccaggatgacggagcacgacatggcagagcgggaatggacaagtccggagcagactggtccccctcccctcccccccgacctcgaacgccgcgtgttctggcgcgtcatccccctgctctttgccatcgcatacacttctcagctcgacaggaccaacctcgccttcgcggccctgcagctggatgcagacctgggcttctcgcggactgtgcacggccttggatcaggcacgtgcctggagatcaagatctgaatcccacggcttcagcagccctcgcctgctaagtgcacagtcgtgcattgatctggcatgtgcctggctcccgatggccctctgctgggcccaaattgccttggccttgatcctcatcttgcctggctctcctcccacaatctgacggccctctgcctagcccgccctgcctcgaagcattctccacagcccgcaccttacaccccccccctctcaggcctcttcttcatcggctacctggcgcagctgccggccaacgtggcctgcctgacctttggcgtgcgtcgctggctgtcctgcatcctgctggtctggggcgtcgtggcggggctgggcgccgccatccgcacccgcgcccacttcctcgtgctgcgcttcctcctgggcctggccgaggcgggcaccttccccgccatctacttccagctggcccggttctacgacgcagacgggctgggcctggcctacacctggtgggtggacatgagggggggggtgagggggccgccggcctttagaatggcgttgcaatgctgctcgggcggccgagcctgagaataggattttggaccttggccacagtctgccgtgcctgcaccacatcaggcccggccgacctcacatttgtctgcggccggcctcaaaccataccgtgcctctgcccccacctcccggcagggtggcgacggctaccgcggtggcgggcctgaccggcgccccgctggcggccggcctgctggccctggacggccgcggcgggctgcgcggctggcagtggctcttcctgttagaagcggtccccgcctgcctcctctcagtcgcggtggccctggccctgccctcccccgccgacgctggctggctgtcggcaggggagcggtccgcgctccgaacgcgggtgcgctgggcacaggcagggcagggcgcactggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagggcgctgaggtgggcggcgtcggcgacgaaaacggcagtcgggcgggcacgnnnnnnnnnngccgcgctccggacgcgggtgcaatgggcacaggcagggcagggcgcactggagctggtgccacgcgaggctgccgtcgccggggcggggccacacgacggcgaggccccggcgtccgaggaccgcgccgacgatctgcccctgctggcgtcggacgggggaccccggcgtggttctgcgccggtcaagannnnnnnnnncggcgggcgccggggcgacctcccgccagcagcggctcgacgtcaaggcatcgctcnnnnnnnnnnctcagggcaatgaggtgggcggcgttggcgacgaaaacggcagtcgggcgggcacggcggccgcgctgcgcgccgcactgcgcgacgcgaggctgtggtggctggggggcatcctgctcctggtggacgccgccatgaacgcggtcaacttctggctgccccagatcatccgcgcctcgctcagggccggcatagtgaatggggacgagggaggcgaggcgggcgccgaagcgacctcccggcagcagcggctcgacgtcaaggcatcgctcctggcggggctgcccttcgcggtggctggcgtgggcatggtgctgaatgcgcagcatgcaaagcggcgccacgagcggcggctgcacaccgccgtccccctcgtcgcggcggcgggcgccctggggtgagtgcgagatgcgggggctgcggggggggtgggggggggttgagcggaaattaggtatgttcatgcgtgcgtgggggggtgtgggtggaggtggtgaacaactggcaatgggcaatcgcggaaccnnnnnnnnnntgggatgcggggttttgggggggagggggtgaacggaaagtaggtgtgttcatgcttgcgtggggggttgtgggtggaggtggggaacaactggcaatgggcaatcgcggaaccgcctgctgaagagtgagctgccttgccacggcagggggcatggtgcaggaacagctgcgtggctagattgtgtggcgaccttggtctggtgccagggatccattgccaccgcacgcccaagttctggcaagagtctcattgatcgcaaaacccagcaatgttcccccccctctgcctgtttcctgcccttctcccccccgaaaaaccctcctttcccacctcgacaggctactcccgctgacagccctcctgctgggcacggctggcaccgtggccgccctcacggccggggccgccggcatctgggcggtccatggccccttctactcctggccgtctgccttcctggacgcgcagaccgcgtccctgggctttgcgctggtcaagtcgctgggcgctctgggcggcttctgcgggccgctggtcgtgggcgtactggcggatgccgagggcggcgatttcgcaggcggtgccttcttcctggccgccgtcgcgctgcttggagcgggcatgactctgggtgagagaggctgccgggactgtccctgacttggagtgcatgcgctaaatgaaagagttgatgtggtttggtctgtttccaagcatgataaacagcatgcccgggaagcacgatgcatggtagggtctcatgcaaccctttgctccttcctaggaagccccctcacacccatgcttgcccctccacagcattccgagnnnnnnnnnntacacccgtgaatggattctcctgtattttcgttactgaccatgctctgcttgtttcccaaacccttnnnnnnnnnntcatgcccgggaagcacaatgcatggtagggtctcatgccacccttcgctccctcctaggaagccccctcactcccatgcttgcccctccacagcattccaagggtctcagagcgaggcagagccattgttgcgattgccatcctggctgcgttggcgtcaaagtaatactgtggagcacatatcctcagtacccttctgataatcacacccgtgaatggattctcttgaattttcgttaccgaccatgctctgcttgtttcccaaacccttctgtcacccacccgaattttcctgccagggccgtgctgcttgacctaccctcttgcacatcgcaccagcccatgtaactggactggtgtgcatctgtcagaggcatggtggggattgcaagtaatggtacacagacttgcagcccggctgactcagcacagctgcccgtacggcctgaccggggtcaagctgaggccgcgggcgctcgctccaggcgacatgccctcaggacctcctcagcctgctgctgatcgggcaccgaccggaaatcgggctcgatgccctcccggtcgatgtctaccccggcaggtgtaaagtacttgcccaccgtgagcaccaggcctgtgtgtggtagttggcaggtggtgcacattgaggtaccagcgggaacaggcgagccgactttctgaaaagagagtgccaacaatagcgcggtgcaccactgatctgcacccctgagcgaccatcacctcccggccatcctccctcatcacagcagtgaacacactcggttgatcttcaagcacaccgcctatcggcgcccctcagggatcgcacctgagccgtcagagagttcatacaccgactggatgaggcccttgccgaaggtctgccgacctgcgacgaccgcccggcagttacccctcagcgcgccggccgccgcctcggccgccgaggccgtctgcccgtcaaccagcagcaccagaggaagggacgtggccgggggcgagcgggcaatgtacggcggtcgcgcccctgcgccgcgcccctgtgacctcagcacgacatcgccctctgcacgggcgtgaattggacggcgaacaggtcttgttgcggggaacaggtgaccggtgagcggcccgatcacgattagcactagctcatgcaggcacgagacgctgcagcctccccattgtgagggcagtagccgcttctcggccatcaaacgcaccaccgaggaagaggctggcaacctccacgccctccgtgacgaggccgcccctgttggagcgcaggtccnnnnnnnnnnggcgaggaagaggctggcgacctccacgccctccgtaacgaggccgcccctgttggagcgcaggtccaggatcacgcgccccgcgccccccgcctcggcccgagccagggcaccggcgacgtccgcggctgcgcgggcgtcgaagcggcgcagcttgacgactgcatcgccgctgggcgcccggggcagctccaggctgaccggggatgaggaggggccggccctcttgccggggagggagacatcgtatacagacccgtccagcctccgtgcctgtgctgggcagcgcagcagggcaaagggaggcttgccaagggtgcagaacaagttgatggcacattgatgtagggtggacacgcaatgggccccttnnnnnnnnnnacagcagggcagagggaggcttgccgagggtgcggaacaagttgatagcacatcgatgtagggtggacacgcaatgggccccttgcaaggccgggccagctgcaagcaggcctgctccctggggtcccccttgtcttcctcatgcatcaaccgacagggattcacgtgccttgagagcgaggtcggcgccgtcggcgctgcccccctgcagcagcgatgccactttgaagggcggagaggcgcagacgctgtggccagccacctccaggagctcgtcaccctggggggtgaggggggatgcgtggcatgggtgcattgccaagcacccttggggtgtagcctctccgcgtcatggggcagagccagagcgagcagtccgtgagacagttctccggnnnnnnnnnngtgaggggggatgcatggcatgggtgcattgccaagcacctttggggtgcagcctctccgcgtcatggggcagagccggagcgagcagtccgtgagacagttctccggaatcaccgcccccacaaggtccgcctcccgcaaacccactgccaaacagatccagcagggccatgcactgtgcaggcgcctccttcgctcaccaggcgcaccccggcctgctcggcnnnnnnnnnnagtccgcctcccaccaacccacttccaaacagatccagtagggccatgcactgtgcaggcgcctcctttgctcaccaggcgcaccccggcctgctcggcgagggagccctggatgacgcccagcacccacacccccgcgctcggccgccggccgtcctccagcctggcagcgttggtccgctccaggtactcctcgccggtcaccaggttcagccccacgccgctcacatcgtacttgagcatgccggcaaaggctgagcgcgaaatgaggcggctgtaggggtcgtgcagctgcgccagggctgccctcaccacgctggggtcgggaggaaagagcggaagggggccatggggtggaggagtaggggcagcgtctggcgagcttcccccaccaggccacgatgggttgtggtatgctcgggtgccattacaccctggagacnnnnnnnnnnatctggccagcttccctcaccaggccacgatgggttgtgttatgctcgggtgccattacaccctggagacaacggccagcagacactctaatgagcgccaagcacgagcctcacagcgacgcagcgcactgcaccaggcactgcccagtcaacctgtgtgcctcctcgaggtcagcgatgccggcgtgcgccgccctctgcgcctgccagtcctccctgcggaaaccgcggctgcgaacgtcctcgaagttggtccccaccacctcccagacctcgtccaggaaggtctgtgctgcctgctaggatgagagagggggagaagttgtctgagatgtgggttgatgaaggcatctgtctatacgcaagcttgcaaggacctggggtggatgtgctggacctcctccgtttcaggccactcacaggaaagtgttgccattgtcaaaccactaaagacatgcttgaaccctgaacagaggacactcacagcatcaaatctccctgacttatcaaatgcaagccagcaagccgcacctnnnnnnnnnngaccactaaagacatgcttgaacccagaacagaggacacccacagcatcaaatctccctgaattatcaaatgcaagccagcaagccgcacctgagcctcccgggcattcttggtgaccagggaggccctgaagcgggaggtcaccccccccaccgccgcctccaggccctgagcagattccaccagccggtcctcgagcagcgagctccagttcgcggcatggcacacgcgcactccccccaggctcagcgtcgaggtgatgaagagggccgcaacacctcgaagtgggcctgcccaccaaggggccacacccctcccagcatcctgagagggcgaatcaggccctgcatatgttcgctccgggctcctacgcaagccctgaagtgctttcttccctatatccaccgaccatgccgacagtcgcggctgggaggtggggaggccatgtcgtggtggccctgtcacaggtcgaccgtgcggggccatgcgcaccgtccacgggccctgagcatgctaggtgtgagaagatgggaggttctccaccatatatacaggtgcagggattggctcgaccccttactgcgtcgatcgtttctgaggtcgagccttatcccgggccgttcgatctcgccgccaccatggtgagtgggaacaggagcaccctccccctcattcttgcgccagcatcctgattatggcaacgtcccgtgctccagcctggtccccctgtgcaatttcggtcaaaagtcttattactctggtcannnnnnnnnnatcttgcgccagcatcctgagcatggcaacgtcccgtgctccagcctggccccctgtgcagtttcggtcaaaagtcttattactctggtcacatccaatcagaaggaacagcagcagtgccagtctgtgctggctgtcgagtccgaccagcaatcgagtcgcagggagaggtatagtacagtgaacttgggccatggatgccaaaatatcagtatcggtcgagaaatgcggcaggcaggcatcgacgtatggagtgatggggggagtgggtggggcggaacttgcacagatgctggagaggcagggtcggtcgcagccgcggctggctgggtgggcagatggggggctctgtcagagggccaggtaccgtctgaaggccccccgcccgacaccgtgcgccgggcgctattccacagtacatggaggaaagcaatgctgaaagaatagtctgggtgcggtccaccccctcacccgctgacgccgcaccgaccccaggcgggcaggggccggggcagcggcgtgtgcagctgggtcgggggcggcagcgcctggcccccccggctctggccactggacgtgatctcctgggagtgcatgctgtgcgacagctgctggcaggccgccgcaatggcggacaggccggaggagtgccgcgcgtcgtcccaggacctcgcgcccagaccggtgggcgcggcggacgcaggcggcgcggtctctgcctgctcgggccgggcctcgccgcgggcggcgtccgcgcccagctcacgnnnnnnnnnngtcgagcggcgcggtctccgcctgctcgggccggaccttgccgcgggcggcgtccgcgcccagctcacgcagcatcctgcgcccctggctccaggggccctgggtcgagggcttggcggggaggggcgagacccggtcggcgctgtcgccacggccggagcggtagcgccggggcacctcgccccggccatccagcaccacgacgtcgtcgctgctcgaccccggggtggagtctgcgtcctcgctccccgccgccacctcctgcccgagggccgtgccgggcagggggcgctgggccttggagaaggccgacacggggacggcgccgctgttgtggccacgcaggcccggtgcggaagcctggggggagaggagcgcgagagtcggttgggggatggcatctcttgggatcttcaggattcccacatgaaacattgcacggtcgctggcaactgctctcatgcccatgcacagcatcgacgactgaagagaaccaaagcggctgcatgcgagaggccagacactacagggttcgaaggactctcgagccagcatctggcnnnnnnnnnntacatgagacattgcacggtcactggcaactgctttcatgcccatgcacagcatcgatgactgaagagaaccaaagtggctgcatgcgagaggccagacaccacagagttcgaaggactctcgagccagcatctggcccagccaacactcaggactcacctccaccagtcctccaatcgaggcagccagcagtctgtagagatcctgctcccaagcagccccactgcagggaattgcaagggtacggggaggatggggcactgaaacctcatgcctcgcctgcctgcctgcacgatgtgcatgtctgccacccagcacccacctcctgtgcggcagctggtgtccagggattccaggcaccacaggcagcgcatcccgcacccggccctgctcatcatccaggctggcttgcagggcggctgtgcggcccagcaggcggatggtggagggtgccaggccacagaaggggtagttctggcaagggtttgcctgttggatgaagaagagggagcatgcctgggtaagagaagctacacaccggagggcaatgcaatactgggaccgaacacggctgttgcactggcggcggccttgttcccacaggacagtgacatgcagaggataccctctgctcacctccagctgggcctccaccccgggggccgctctggccagcaccgagaggatggcctccgtggcggcggcggaggcggccgccaccactgtcgacagcgtcatctggggtggcgcagcgctctgggcggacttcctggcctcgctgttcgtgggcgccggcaccacggagcgcgccccgtcgccagcgtggtcctcgacatcctgcatcnnnnnnnnnnagctgcagaggcggccgccaccactgttgacagcgtcatctggggtggcgcagcgctctgggcggactttctgacctcgctgttcgtgggcaccggcaacacggagcgcgccccatcgccagcgtggtcctcgacatcctgcatcgaggagtcactgccccgacgcctggtcttggcgggagggaccttgaagtcctcgggcagccaatctgcacagattgacaaggtggggattcagcttccagttcgatccatgaccgaacactgcccatcaccagaacgctttctgcaggcatgtgcacaacgatgccccaggcacatggaggccccgccccaagccggacccttcccacaccttggctgcaggaggacgacagggagtcccctcccctttttgccaccttggcgaagaacttttgtgcatgggatcggatctggattgcagacttggtgcccacatgccctgcatgaagggtgaataaggaacgggccatcatcaggctggcgctcccaataggacaccagtgtacagaagtggagccttagatagccctcaaggagtcatttttgctgatacatggattgtatgacctccatgcataccctcccccccagccctgagcctcaccctgtatcttctgccactgccggccgtagaggcgcacaccgtccacgaagcgatcatgctcctcatccgtccacctctcgcgtggcctggtgatggtgtacgccttccgtgcctgtaggtagagggcggggctggggatcgactccagggtccgggaccctccgagattcgtcggtcctcacccccggccgggcagcgcgaggcagcccgccgtaccttgatggggtagcttcccggaaggctaggctcgcttgtcatcgtgagcaagggacggttggtggaatgtggcgaggtacagttttgttccgaggccatggacatgccgggtgaccccgcgaatactcgggttcctcggcgggatgcgaccgactcgagcgacctctgggaagtgggacccgctaaggaccctaaacagctctgtgctaccggtttccgggtactgaagtgcccaactcgtctcgcagagtgttgatactgaccctttgtcggagtccgggtnnnnnnnnnngagtgggacccgctaaggacccttaatagctctgtgctactggtttccgggtactaaagtgcccaactcgtctcgcagagtcttgatactgaccctttgtcggagtccgggtggccacagctttagattgactgagcgacatgggccgtgcagatatcccggggtcgaatccctcgcgtgctcccagccaagtgttgccccctccctcgtggggcagcccctccgccaggcatgtcgcgccgtggcgcagtgcgcccttttatggccaccattcacctccgatccccgacccaacgacaggaaggcgctttgagagagtttgtcacggtacttggtggcggacaggctttgcagcagcgcaggctgggaagcctggagcttcacagtccaagaatgggcaggaagctgctggctcannnnnnnnnngcagctttgcagcagcgtaggctgggtagcctggaggttcacaatccaagaatgggcaggaagctgctggctcaaacaggcaccgccccctcacctgcggcaggtgcccccacggccagcgcgtggggggtgccgccatggcgtttgacgccctctggctgttccacgtttgggggggccctggcctccaggtcctgcagcgcctgccctatcctcgcagtgagctcccgccacacctgcgtcatcaccggtgagatacctgaattactatctcttgccatgccactgtgagtcaggtgtattgcgcgttcgtagnnnnnnnnnnatcatcaccggtgagatacctaaattcctatctcttgccatgcccctgtgagtcaggtgtattgcgcgttcgtagcgcggcaatggccagcatactctgggcggcagtccccgcagctgctgctcgtgcccgctgactcggtgatgccttcggtcccacgaccacacctccaaaggaattcctctgccaaactcaacagcacagggccagggccgccccaccccaggcccccacctgcttctggtcatggccagggcggttgcagcggcatgagatgtcctccagctcgacaggctgccccacgaggatgtgcacccgccgccctacagatgggacgacggcccgatatggcatcacctcccccatcccggtgtggtagaagggcaggacagtgggctgcctgcgtcgcggggcgttgcggaggtggggttgtgacgtgagcagtggggcgccgtgcttcgttcgtgctttctcatcagctagttatgagggtcgccatgttctcgtaaccctcgctaggcccctccgcacgctcacggcaccccgtaccccccaccagcgctctctgcaataggtcactcccagtccaatccatcaccgcccgacagaccacaccccgcgcccaccgacctgccgccgctatgccgcatggcgtcgcagatgaccttgcccaccccccagcgcagcgtgcccagcgtgccggtgtagttcacccggctctcggggaagaggtgcagccagtcgccccggcccaccgcccggcccatgctccgcaggctgagctggtccaggcccacgccgcgctcgatgggcagcgtcttcccggattggaagaactggctgcgggttggggtggggggaatgggcgtggtgtggtgcgtttatgtgtgtgctggtgaggtgtggggcccattcccgcgtcgtccagtggcgccagctgggtctgcacccccgaccgaggcgactcaccccagcagtgnnnnnnnnnngtgggattgggggaatgggtgtggtgtggtgcgtttatgtgtgtgcaggtgaggtgtgggggccattcccgcgttgtccagtggcgccagctgggtctgcaccccgaccgaggcgactcaccccagcagtgcattcttgtagcagagttccttggcgcagagggtccagcgcatgccgccgtgttgatgctcggtgaagaagtagctcaggggcaggatggcggagaacagggcggggtcgtcgagtgtgctgaatggcattggcagggattcagtagggggcagcatgaggggggaggcagcaagggtcggggggtacctgctgctcagcgtgtactgcacacgcagttggaaacagagggatgccatgggaggtcagtcagccgatgtgaaccccagagccccatctgtcgggcagcattctctgaggccgtcagcctgccactcatggtgttcgacnnnnnnnnnntggggggtacctgctgctcagcgtgcactgcacacgcaattggaaacagagggttgccatgggaggtcagtcagccgatgtgaaccccacagcccaatttgtcgggcagcattctctgatgccgtcagcctgccactcatggtgttcgactgcaaaggcgcatcggcacgcatggtttcccagcttgacaggcttcagagccaaacagaaccatgaagccaatgcgtgtgccccactacctggtgtgattgctcacggtgatcagccctagccctggtgggcgctccatggtgtgctgcaggaagtcggcccgtccctcaaaggtgatggtatttcccacgctgaggagcatcttgcagccccatgccacgactcctagcgtcaggctgcggcccaggctgccccagggtgcacgcaggagctgctcttcgctcagccgctcttccggctcgaggagggagtccatcgggggaggggccccacggtgatgcgactgttgctatgtgcctcggctttcttggaataaatcaattctgtatcgagcgcccaggtctctattattggccgggtcagggtgcacgagcacttcctggcacacgcaggtcgagatcaaagagcccctcaacaccgcaatgccgtataatcggtgagttccttctaagccaagtaggatttgaagctaccgttcactgtacccagtgtttgtgtcgagactgtaaacggttcatggccacgtgctgtgtttgcgccgtctgccccgagggcagacgatccgatcaggagctggggcaggtaggaaacagctgctgacgacggtaattcgacaaggtagaagtacagtgatacagaatgtgaccctggtcgcatcacaggtcagcagctcagactccagcccccacacatatgggataaaggtgcgccctgcactcctgcnnnnnnnnnntgggcaggtaggaaacagctgctgacgaaagtaattcgacaaggtaggagtacagtgatacagcatgtgtccctggtcgcatcacaggtcagcaactcagactccagccccccacacacatgggataaaggtgcgccctgcactcctgcaaatgttgattgaatatttcaaggtgatgtcagagcatatcattgtccctcctcattcaatgctgctatgggaaatcaggtgcatgtcaggtggttggaaaatgactcttagcaaccccgactcgaagggcgcctgctgggtgcgtgctgcgatagatagcgacacccccccagtgtgatcgctcgcatcccaacagacgggtgaaatttgggacaaacannnnnnnnnncaccccccagtgtgatcgctcgcatccaacagacgggtgaaatttgggacaaacaacacaagagcaaatcgaagtggcagcttcaatgctgcgtctggggttgggtctgcgtgccacccgctgcgtcccagccagagtagccagtgttagaaccatggtgaggcgtggaataggaagcgcaacgccgatgtcgggctgagtaccatgccagtcattccatcctcatagcgcacatcctgatgcaggcaagcgcggcgtcagggaacacctaccatgtccttcagtacaagtttgttccggacatggagaccaagcgggcccccgtacgccaggcgcatctcgactacctaaagaacctcgtgagcggaatgcaaactgggcagttgctggcttgtttgggataatataccgtgcggcgcatcgaagtggcgcagcagatggatgcttgannnnnnnnnngaagaacctcgtgagcggattgcaaattgggcagttgctggcttgttagggatagtataccgtgcggcgtatcgaagtggcgcagcagatggatgcttgaccatcccggtcatcaccctgctgcaggctgatgagaagaagctggcaatggggggagcactcgtggagcctctggactcctccctcctcatcttccgcaacatcagcaaggaggtaggcggtgtgcatgtgcatgggaggtgatgctgggcctgtgtgacacaaccaccagtatgaatgcatgtggctgcccagccgcatgagcatcatccaccactggacaaacatgcaccgcttccttgtcgcaggaggtggagaagatcgcggtggaggacccttataccaagggtgacctcgttgccgaatggtgaggggttttgtgagaagggtgtggagtgttcttgctcttgccaatgggtgggacgggcggggatgcgcttcatgaccgcctcgctcgcaggcgacaacatgggcgccctggtcaccacaccattgacctcctcgcacacacactttgcaggactgtgcggcggtatatgcgcgtcgtgggggacgcagagtgatgcgcccgctgcgtgaatactggtgacgcctgccgcccgatggaagcagggtgtctgcttgccgcacccccagtcctcccgccgcagctgctgagccgtttgcctcatgcctgtccgcatatcactccgactctgtctccatgtccgtgctgtcgacaggctgcctgacttccgcgcggtcagcagcggtgttcacgcagcaccacgcaggtcgtgacacagcaacccctttttgccacctttccagagtcagatccttcactcccaggcggcgtccagggcagcccgccgcgcctgctccgccacgcgtgcctcgcgcttcgcgcgccccgcgtcccgcagcgcctcctccttccccttgtcccgcaggttcatggacagcgcggcgcctatcagtcgccgagccacggctgcactggccgcgggccggggtcggggcggcgcgagctccgccggcggcagggccctggcgccggcggaggcctcctcccagccacgcagcgtgcccagcgcgggccccgacgccgccgccgccgcccgctgcgccgccctggcggcgggcgggnnnnnnnnnntgggccctgacgacgccgccgctgcccgctgcgccgccctggcggcgggcgggtcgaagaacacgagcacggctgccgtctcgtccacccatcgaacgtagggcgggacggcgggcttcagccgctccgcccactcctccacgtcgcgctgccggatggcaggcgacaggccggtgagctcaaggcagtgcgcgcttgagaaagggggagtgccggccgctgcagaggggccggccgccgtggagcgaggatcaagtggcggaggtcctgcaccacggccccgctcgtcttgcgccagcagggcggggtctggtgcgcccgaggtggtgggcggagagggctgcgcagcggggggggggacggcggcctcccagtcgtcctcccagtcacaggcaccctgggaagagcctggctgatcaatttcaggttttgagacgggatcctgcacattggtgttggagaggggatcacgctgtggtccttgcagnnnnnnnnnncgttcaactcgtttatcacactattttcttcgtccagtccaggggccggtgaccccgccgggttcgacatgggcgtgtgcnnnnnnnnnngagagcctggctgatcaattttaggttttgagacgggatcctgcacatcggtgtgggagaggggatcacgctgtggtccttgcagggaggaattcagagctaatggcccccaatctcaccccactgtgcaattaagagtataggtgctttcacagcaccccacgaccgaacactcacatctttcaatgctaggttgttcaactcgtttatcacactgttttcttcgtcaagtccaggggccggtggggaccccgccgggttcgacatgggcgtgtgcgagagctcggccagaagcgcaggtcgctggaggtgaactttaaaaagggcaaaagaagtattgactgacaccacattgtagatttcgtacaagcttattccccacccgtcagcatcaccatcgcgcgcgcgccctgccccgggagttactgacgactggtaaagattcaaaaatatttactcagggcatgcgagcttgccttcagaccagaaaggcacagtgcttctcccgtagaccctacacagcnnnnnnnnnntatttattccccacccatcaccaccaccatcgcgcgcgcgcgctgccccgggagttgtgatttgcatactgacgactggtaaagattcaaaattatttactcagggaatgcgagcttgccttcagaccagaaaggtacagtgcttctcccgtagaccctacacagctacatcttccatcatatggcatggacttggctcgtcagatgctgtaaagagcagaaatcctggactttgcaggcttcaaccacctcggccgtccacacattgatgtttttgttgttggactcactgtgcacctcgaccatgcacttccaggcaggatctgccgccgctggaacctctgactcctgtatgccgtcgccacatgtctgctcccacaccgagagcaatctgcaggagtgacggcagtattgctctggcctaagggggagagttcacatcgcccagacggcacactcatgctggatcccaagcacgcatggtgtcagctgccatagtgctgcagaggtgaagagctggttctgtagaagcattatgctggcaatgagcacccctaccctgagaactgcttggcctttgccaacttactctgctacatcaggagccccatacgtcggcttcaaggtgatcgtcttggctttctgggaaaggatacagtaatggatctgcttgccgactgggaccgaatttcccaggagggacggctcagcgagccctcatttgacagggagccgctggacagagcacaatctcgggagcggtggcatatacaggcctccgggaccaagcagaaaacagcactttctccaatgggtcagtggctgtcaggctagcccaagtcatcagtcggaccagcagccccttctcacctgcagcccggtgagaacattcctgaagacggcatgtgcggcgagatggtacaatccctgctcctcctccagtgtatcctccagagccactatcaaagcacgcagctggaggaagggggaggccagagacaaggttggaggattgattgggcagcatggcatgcacgacgcagtgggagagaggccgagccgggcgagggcaggctggccgtggctggaccaggcgaggctgtccgcctcgagatgcgccccattcttccatgcttgtgcactccccctcgccaataatttcaatgcgatgggcatgcatgggcgcttgcacggccccccatgcactgcatgcacaacaagcatcaggatgtccctgccattgaccctctacacacctggagactgtccagtgaccgagcctggaggggcatccccaccgcggcctggctcgatgccgtgagcttctgcagcacatccttccttcgagccatgatctgcaggaaagagtggcacatgtgcgagtcgttcactcgtgtccgtggacattagcgcccgatggagcgtcccttctcttcaggctggccccagcgccacacgctgtcagtcgctctccacgggacaaccccactgtctctggagctccacaccgcccgagcttgtcccacatgtgacatgggcagtcaaggacaggctctgcaccagctcacctccctaagctttccccgagtggccctggccaccatcagcatctgctgcccctgctccggatccaggcccagcgagttctgtgggtggcccatggggtgtgggggaggtctagttgggtgctgtgaaggtcaaacctgaatggtcgcccctgtggaccatgggacaaccaactgccacacctcctcgcatgcctgcacggatgacaatgcacagacccgggaacctcaccacgatgtgttcccactgacggtccccaagtccttcgagcagtctcgtgatctgttccagccggtcacccatgtacttgaagatcctccatttcaggactcgctgcgtgcaatggggtgggttgagcaagagaggggttcaaacgacgaccctcggcggcctccagtggaagtggccaggtcgcatgcatggcgcagattatttcctgtttccagtctccctgcagggctccaccaaacaagcaccctgggccacctgagccaggcatgcagacctccatggcaaccccctcccaacaatctctccctcccagacccaacaccctccagcccgcaggcccacccccacagacaagctcaccccctccagcattttcctgcgcagctggtcctccaggggcttgcacttcccgccccgctcctccaggtccacgatgagctgcttcatggaggaaagtgcatcgccccaccgccgggccaccacctcggtgggcacctgcgagaaggcgcgtgcctgctcgggcggcagggccatgagtctgtccatgctggcgagcgtgcagcccccgtgccaccccgccagctgccccggggtgaagtgactcgccgctggtcgcgggcagccggcgccgggcgggggccgcgccctgggcgccccgggcgccggcgcacccccgccaccctggctcatgtaagccctctccagcgcgtcgatgagctcgtccctcacgctcatcaggccagacaggagggagtgctgggacgccaggacggcagcctcggcgcgcgcggcctgcagggaggccgccacagcgctgacgtggcccacgaccgcgccggcggccgccttcttgcgggcacggtagcgtatctgagccagtcggttgcgcgcacgctgacgctccagcctctcctcggcagtgtacttggggcgggaggtctggtgatcggagtttgaggaggcccctgaggtgcccgtggctggtacagggggaggggccttgtccacgggacccaggccggcagtcattgctatgacgggagcgccgtcggaaaagtcaagttctagggtgggcgtgcaaagggatgtggaggcacttcctccagcatcggtactcaggtcgaggaggggaaagcggctgtccccctccagttcagaagtccaccaggcctggttcccggacggagccgctcccagtatgtcccagtcgccatcttcgaggcatgatacatccatgatggacgcagagagccgtgtcccgcacaggacaccaacacaaatggctttcgggcgaacagccggatcagggttttgcgtcggggcacggagtgtctcacaacttcttacgtcagccagttccaggagttcatcatcacgatcgaaatctctgcagggatgaattgttttcgagccctggagggtattccattctccccgaagattacgtcactgtgagggcccgggagtgacgctctaggaggtcctaatcggccatcccgggacagtacttaacgcccagtctggtgccacttgagccgacccatgtttaaataagatctgaaaatgcgtaaaattgcttgatggggattcgagaggcccctgttcggcggggggcccactctcgccccttcgggagaccccgtcg

SEQ ID NO: 42241 - DNA, 61 bp, Chlorella protothecoides
ggggggtcgcgcgccagcgcttcgcgcagcacgcgccgcgcctcggcgcaggcctcccgtc

SEQ ID NO: 42242 - DNA, 61 bp, Chlorella protothecoides
ccagcttgaggcgcacaggcgggcgcaggatgctcaagcggtgatttgccggtgttcaagg

SEQ ID NO: 42243 - DNA, 61 bp, Chlorella protothecoides
ggacgcatgccggtccaggacctcggccatgcggaagaggagaggggaggggcgcttgctg

SEQ ID NO: 42244 - DNA, 111 bp, Chlorella protothecoides
cgagagggtctgataaccttttggtatattcaggccatccttttcagagtattctctgcgcggagtgatgcatgtggggcatttgcatgacggaggtccgtgcccgtcatg

SEQ ID NO: 42245 - DNA, 642 bp, Chlorella protothecoides
  modified_base (352)..(578): a, c, t, g, unknown or other
cccgccgcaggcgccacaagaagcgtatccagggccccgacgtggcccccccacatgatgcccccccggtcttgggccgaccagatgcccacgcccacgactgtggtcatgcccgggtggggcccggaactgctccgccagctgggtgatggcccgctccctgccgacgtatgcctgatggcgcagcttgcggaacggcttctcgtccctgtgccaagccaggccccatcgcaaaggtggggacgaaccacacgacccgcgacaggagcacctctgtgctggctgtcttataggtcgggcacctgtgggaaaggggtgttaagaaggggggggtggaacatgcggccctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaactgatttgagaatttaaatgtgaataaacagtcggggggggggggggggggggggggg

SEQ ID NO: 42246 - DNA, 61 bp, Chlorella protothecoides
ggccacctgacgggggacgtaacaggcgggggataaactattaagggttgcatataatcct

SEQ ID NO: 42247 - DNA, 79 bp, Chlorella protothecoides
ggcagggcacctgtcagcgtatgggctcttgcatgcagactttgggtgttgacctgggcatggctttcagccaataaat

SEQ ID NO: 42248 - DNA, 61 bp, Chlorella protothecoides
agggccagccccgcacacaccgcccctggaggaaggtcatcatcgtggtggagggcatcta

SEQ ID NO: 42249 - DNA, 125 bp, Chlorella protothecoides
tcctccgcctgagggtttgtgtgtgtgaggggagggccatgggaaacacgggctcggggcgggccggcgggtagccaggggtccagcgccactgtcaggaccaaggcgaagcgtcgatgcaaccc

SEQ ID NO: 42250 - DNA, 61 bp, Chlorella protothecoides
gccgcgcgtcagcacgggactgatggtcggtccctccagcccgcccagcagcttggagccg

SEQ ID NO: 42251 - DNA, 68 bp, Chlorella protothecoides
ttgtggctttctggggtcgtgcggcgagcccgggcagccccggcctgtcctgccgcggccttgcctcg

SEQ ID NO: 42252 - DNA, 61 bp, Chlorella protothecoides
tggtgtgtctcgtcatgtatcgcaaggagggggggaaagaggaggtgcgagggtgcagatt

SEQ ID NO: 42253 - DNA, 106 bp, Chlorella protothecoides
aggcaggatcccatccaagtcccacacaccatggcttcctgtctttccgtcgagtcacgcgtgcgcaccatccataagcaggacgctgcgcaggcccagcctggcg

SEQ ID NO: 42254 - DNA, 3821 bp, Chlorella protothecoides
  modified_base (96)..(275): a, c, t, g, unknown or other
  modified_base (740)..(749): a, c, t, g, unknown or other
  modified_base (1106)..(1115): a, c, t, g, unknown or other
  modified_base (1469)..(1478): a, c, t, g, unknown or other
  modified_base (1557)..(1566): a, c, t, g, unknown or other
  modified_base (1685)..(1694): a, c, t, g, unknown or other
  modified_base (2324)..(2333): a, c, t, g, unknown or other
  modified_base (2637)..(2646): a, c, t, g, unknown or other
  modified_base (3047)..(3056): a, c, t, g, unknown or other
ccgcgccccagcgcgtccagccccagcgcgtcggtgctgaggcggcgcagcgccgccaggagctgggtggggtcggtggggaagcaagcgccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcccggcgccaggcggctcccggcgaggtggggtggtgcggcccggccgccggggtcccggggggacggccccaccaggcccgccagccgcgcggcgtcctccagcgtgaaccccgggcggggggcggcgtcggcggtggtagcgtacaggcccacgccgatgcgcggcgagcccgaggcctcgggaggcgaccccggcgggaggggcggcttgcccgcaacgcctgctgccagcaggcagcccagcggggctgtggcgggcgggggcgccgcggcgccgccgccaacgtccagctccgaggtcagacgggcgctctggagcgccagtgcctctgcgcacaggcgcaggagaggaaggacaaggtgggcggggcagggtgtggagacaggggcaccacgggattcggattacggggcgcacaccggggagcgtcggcctgacaggcacactcacgagcagcgnnnnnnnnnntgggatttggattacggggcgcacaccagggagcatcggcctgacaggcacactcacgagcagcgcaaacacccccagggaacctgatgagatgtgcaaaggcaccccctccaaacaatgcgcacccgcggccagcgaggactggagctccgcgctcagcagcggcgcgttgccttccggcagcctgacctcgccctccaggtgagcgaagaagcagacgcggcgctggcagcgggggccgtcagtgcacatctgtgggggttggcgcatcagggagtgtcaaaacttggggtacgagcatgctccaaaatcccagctgtgcgcctgcagcgcggcgcgcggccagcaggggcaggnnnnnnnnnnggtgcacatctgtggggtttggcgcatcagggggggtcaagactcggggtacgagcatgctccaagaacccagctgtgcgcccgcagcgcggcgcgcggccagcaggggcaggcgcgtgcagagcagggccggggttcatgtttgccgctgcatccaccccccaggcccggccccagggtacctgggtacggtagcgcgtggggtgcagccagcactcgaagatgccgtgggcgtacgggcaggcgtcccctcgcacgcaggacccctcctgtcggggtggagcggggagggacccgggtgagggatttaaggcgggccagtgcaggccccaaccccaaggaggcgcaaggctnnnnnnnnnnaggtggagcggggagggacccgggtgaggattttcaagggggccagtacaggccccaaccccaaggaggcgcaaggctnnnnnnnnnngcagaagacatgagtcactgtctgcagccaaggcatccaccccctagcactccagtcggcacatgtgcatggcagccaaacctcagcacacgctccaccccacccagctgcaacgtatnnnnnnnnnngggcaagccgtgccagaatagcggtatctttttgggcagcgccgcttggctttctcccgtgcactgagggtggttggcaatcagaagacatgagtcactgtcttcagccaaggcatccacccagttgcactccagccggcacatggtgcatggcagccaaacctcggcccacgctccaccccacccagctgcaacgtatctgggtgcgcaaagggacagcccgtccagtcgtgtggacgtgcacgagggcagcgcttgatctgagttgaacatgccgtgatgggaggagtgactgcttgccattcttcaacatggagacctatgaggcgtggtcctggtgcaaagcctccatgcaggtctatcagcgtcccagttccccaccgcttcagcatcccatgaggaccataccttgaactcgtacatcctgaactggtcggtggagaagcacgggtcgttgatgtcgaaggccctgtcgaacccaaggtcctggccgtggagctgggtcgagggggcaccccccatcgaggccatgccgggatgctgggcccctgaaaatgccggtccaggctccattacctctcgaggtgagtgcgtcacatgggtccgcggcgcggtgctccagcaaggggnnnnnnnnnntgggggcacccccaatcgaggccatgccgggatgctggggccctaaaaatgccggtgcaggctccattaccgctcgaggtgagtgcgtcacaggggtccgcggcgcggtgctccagcaagggggccctcccaggccatgactccccccgatgtgttcaaatgaaccagacgcccgccgaggcgaagggcacaggtctgattaattgtggctgcaagcaccaggctggaccttgcttcgatgatgtggggtatcgtggatcctcgagctgtttcccagcccgtatgctccacagagggaggaggnnnnnnnnnnctatcgtggatcctcgagctgtttcccaccagcccgtatgctccacagagggaggaggacagggtaggcacgtccccgatgtaagaattggcggtcctgacgagttcccaggtaatcatcgaccccatcccgctgacatgaccgcgtcttgacggcgtccatggccctggcgaggcccgtccgacccccctgggtgggcgcgtgtctgactgggcgcggggggcaggggggatcgccacttccccctttcctcgggccggagaacacctgtccctccatacccttgtctcctcttcccggcaacgctcacagcagggcagtcatgcctgggtcgagccccacagccccccacgaccttcacccaaacagagcccgatacgcctcgccctgcaggtgcgtgnnnnnnnnnntacggcctcccacgaccttcatccaaacagggcccgatacgcctcgccctgcaggtgcgtgtcggcgcgcgcggcatcgcgggtggcggcgcgcgcagccgcgcgtgcgccgccgccggccctcccccccgcgccagcgggggcgggcctccagtccgccagcgcggccagcgagccctggcccaagctggccaccagcagcttcttgatggcgtcgcgctgcgccttctccgaccccagagcggcgaagtcggcgcgccaggccgccagccccccgccgccgccgggcaggctggccatgacactccaggcggcctcgcccccgccccccggcagctccgccagcagcacgtcccggatcagacccaggatctccacctgatgcagggccagggcctcgctggacaggctggacagcgcggcgggcaggacctcgccacccacatagcgcgccagcgccggcgaggcgcgcgccagcggcaccagcgaccggcacagcaggctgaagcggaaggcgctgtcgtcgggccagcccatgccgcgtaccgcggtggagatcagcgcaaaggccgtggcctcgtcgcgctccagcacccactccaacagcgagcgcgagtgggtggtggggttgggcgtggcgccggccgtggcgccggccgccgcgctgccctccgacacgtcgcgctgcgccacggcggccagcagcgcggcgtgctcctgcgtcagctcgcgcagcaggcggtcgcgcaccacttcctcgcccag

SEQ ID NO: 42255 - DNA, 65 bp, Chlorella protothecoides
ccagcatgaggaggtagatggcccaccatgagtaacccgtcttcagcatggaatggcagatgaac

SEQ ID NO: 42256 - DNA, 6528 bp, Chlorella protothecoides
  modified_base (528)..(537): a, c, t, g, unknown or other
  modified_base (593)..(617): a, c, t, g, unknown or other
  modified_base (844)..(853): a, c, t, g, unknown or other
  modified_base (1514)..(1523): a, c, t, g, unknown or other
  modified_base (1835)..(1844): a, c, t, g, unknown or other
  modified_base (1999)..(2008): a, c, t, g, unknown or other
  modified_base (2421)..(2430): a, c, t, g, unknown or other
  modified_base (3522)..(3531): a, c, t, g, unknown or other
  modified_base (3797)..(3806): a, c, t, g, unknown or other
  modified_base (4050)..(4059): a, c, t, g, unknown or other
  modified_base (4208)..(4217): a, c, t, g, unknown or other
  modified_base (5727)..(5736): a, c, t, g, unknown or other
  modified_base (5988)..(5997): a, c, t, g, unknown or other
  modified_base (6271)..(6280): a, c, t, g, unknown or other
gggagaatgggggaggggggtggaggctgggaggggctgggctgctgggctgctggacatgcgcgcagggcggggctgcatgaaccccccgcgaaggctgttcggagccggggcctcgcgccccctgccgtcccgggacgcaccggcagacgggatcctgccgggccgtacatgtcggcggtgaacatgggcatgcggcccacccagccctgggatctgcccggggcgatgaatgcatcgcggccgggtcgggggccctccatccccgcctggcttcggggtcgtcgctgctccagctacaccccgatcatgcccagaatgcagcccacacccgctccgagatcagcgaagccatgagcaatggcaagtacggcggaagaagggtgtcgggggccccggggatccccgaaagctgcaggtcgtgggtctgggtaaaacatgtccgactcagcagctctgagagtttcgtcgagggtatcacgtggccgtccccatccgcctgcactcgtggcagccggacagatgagnnnnnnnnnnaggtatcacgtggccgtccccatcggcctgcactcgtggcagccggacagatgagnnnnnnnnnnnnnnnnnnnnnnnnngagcgaatactcctgacatcgccctcttcagatgaatctgatgtcggtccaaataggcccaggaattgatcgatgatttacacacctttcaagacgtgatatacatccgtattatcgttatcaagtacacggcctggcagcctctggctgtggtactgactcctcacgcaagtactccaatggaagccattctcaccccccccgtactgtcgtcttgtatcctcacnnnnnnnnnncttgatcgatgatttacacccctttcaagacatgatataaatccgcatcatcattatcaagtacacggcctggcagcctctggctgcgatactggctcctcacgcaagtactccagtggaagccattctcacccccccgtactgtcgtcttgtatcctcacgattcaaagctgtactgcaagctctctagaagtttctgaagcgagcgatgtcccagcacgcgagtaggataagcctgaaggcgcccggaaggtcggccaaataacacaccatttgcccgcccgcatacactggggaggactagcgcagatcagtaccagatcaggcgatgcctagcgattttaaaggtttctccaagctgttgccatagctgttcggttgccatcccgtttcaaggccattgctctgttttgggctaagagttgaaccggaagcgggcgcgagatctgggccccggacatccgcggggcacctggtgctggaggggacctgaagcccaggagggactagacatgggaacgcatccagataatcatttgattcctcaattcatattctaagaagatgaaatgactgtcaaggccattcgagggaggtggaggcccccccgcttgccggacgcattccaggaactccacgttcggaagggatgtcaggtgtnnnnnnnnnnagcagctggtgctggaggggatctaaagcccaagagggactagacatgggaacgcatccagatgataatttgattcctcaattcatattctgagaagatgaaatgactgtcaaggccagtcgagggaggtggaggccccctcgcttgccggacgcattcctgaaactccacgttcggaagggatgtcaggtgtgtgcggtcgacggggcatacccatgaggtcgcacatcatcttatgactttatctgtgcatgaattggtcatgcgtttcgccgggccgcgtgttgctgctcccacttgaatttgggtgcnnnnnnnnnnagactttatctgtgcataaattggtcatgcgtttcgacgggccgtgtgttgctgctcccacttgaatttgggtgcccacctgtattgcaaggccgccccattcacacctccccctccccggcctgacgggctgctcttcccctcattaccgcgcnnnnnnnnnntcgccccatacaaacctccccctccccggccagacgggctgctcttcccctcattaccgcgctctcgcatgtggtgcaggtgcttgtaggcaccctgttgatcatgtcggtgtgcagccccaatccggtgtggagcgcgctgtccctggacccggttgttgccacccccgccatcgccctcctgctcttttactggagcagtgcggtgtccctgggaatgggcaagtcgcccctccagatcacggccgaggtcatgctttcgtcctcctcgggggcccttgtcgccgcgggcctgtcctacctggccgtcagcatcaacggcggcagccagctggaatctgtgacaagggtgacgcctgcgctgcgtgtttggtggggaagaggggggggagggggatgccttgcatccgtcnnnnnnnnnnccgctcagtttgaacccttgtgcattgaagctctccccgctgccccgcctggcaatgtgtgtaaagtcatagtgcatggttaacctgtgcctctcatgtcaagaaccttgcaaatggatatggagggggtttaagaggctgtgacaatcccgtgacacaaacatcatgactcttgatgccctgggccagagcccactttgccttcacctgctggagccccactttctccatccttccttgcggcccctctttcctccgcaggcagcggctaccgcggcattttcgggcgcatatatattcgtgggcatggtgtgccgcttccgctggccctcgctgaacgtgttcttcacttcacacctggtagccgtcgccatgctggtcggcgcctcctaccacaatcacagcagcttcctcctcttcagccgcctgtggatcaccttctgcgccatcgccagcgcaacatcccttctggtctgttccctggtcctgcccatgacgggcggcttcctcatccgccgcggtctggccgagggactggaggcgctggggtcctgcgtcctcggcacactgcgcctgctctgcggcgaggtggacgagcggggcctgctgcgcgcgcggtcgggggacaacatcagtcactttggcatggactcgggccttggcaatgcgggggtggccgaggtgcaccgccaggcagatgccgccgccgccgctgtgacagtgagcgcggcgagatctgctttacagccgtgtggcaagaacacagagggtttgggatgtattggtggtgaggagaagagaggttgtggtcccaggaatgggcgccttggacgcaagactggaagccgcatgagtctgcagtccccttacccatcaccgcccccatagatcctcccccccccccagaaaatcccccttgctgccgactccacgcacagacgttctacaagttccaggactccacgcgctgggaggcggagttctaccggcggcagtggcgcttcctggttcacagctacgagccggtggcggtgctcctgcacagcgccgtgtccagcgcgatgatggtggtctacccgctgcagacggggnnnnnnnnnngcaggcccgcgcgcacgcgcacgagctgctcacgctgggctacgccctggccgccgtgctggagtgcgcggccaacgtcctgcgctcccgcgcccgggcgcgggagctgctgcccctgctggacgacatggagtgcgcctacgtggcactgctggcaaaggtgagaggtaagcacgctgcggggggaagcccggcccccagcgaagccacgacgtccgaccgctccggcgcggccgtggggggccgccagtcctccgacgccaccnnnnnnnnnntgccccctcctggacgacatggagggccgctatgtggccctgctggcacgggcacgcgccagcgcggctgtcgaggagggcgtcgctgcaatgggccccccagcccctggtgccgctgcttcaaagcctttaccgggtccgaccgccccgacagacatcaaggacgacgcccccagtgccacgagcggcgcaaatcaggtcgccttccacctcgtcctgtccacgctcttcacgctgtgcaccnnnnnnnnnncaccgctgcttcaaagccttcaccgggtccgactgcctcggcagacatcaaggacgacgcccccggtgccacgagcggtgcaaatcagatcgccttccacctcgtcctgtccacgctgttcacgctgtgcacccgcgtgcggcgcctgnnnnnnnnnnagtcctccgacgccaccggctgggcgtgcgcgtctgaggccgccgcctcggcggacgccgggagggccccctccagcgccgcggcggacgtgggctccatcgccctcaacctggtcctgtccacgctcttcacgctgtgcacccgcgtgcggcgcctggcggcgggcctggccgacgccgtggcggccgaggaccccacggcgcgacgccacctggcacgccacttcgcgccacgcccgggcaatgactggcgcctgcacggcatggcgcaggagctgagaggtgcggccagccttgggcctgccccgctttccattgcgggtatctctctggtctcctcgccccacggccctggctcgagctccctggcatactttgcgtccacctgcctgtcgtcggcgctgctgtccagcgccagcctggcgtgcgtctctcccaagggcctggccgctgcggtgcccgacatcagtgcgccggggttgcaggcacccatccccgccgcactgccgctggtgcaggccagcctggcgtggcacgcgcgctggtcggcgcggctggccgcccgcaccggcgtcaccccggccatgctggcgctggggctgcagggcgcgacggcctacctcatcatcctgacgctgctgataatcccgaccaccaatgacgccttcaaccagcgcaccctctgggccatcttcatcgtgatcaccatcctggagccttttgccggtgcgtaagcttggggatcgtgagagggttgaggggtgacaatcgtgggttccctcgcacactgcgtgacccaagtaccccagcgcttgcctgcccaccccttccaacctgacaccgtctggttcgcgctacggccctcacctgccgccacctgtggcgatgcctgccaccctcctccttacccacatcggcgtgcccacctcctcccaactgcccgccaggcggcgtctttgtgaaggccttgcagcgcatcacggggacgttggtgggcctgggctgcggcctggcagtcacttacttcacctacctctgcaatggcctgagctacgacaacgagccggccaaggtctgggcatctggaggcagggagggggtctgagagctgtggtcttctgagtgctgaccctccctccctctccctctccccgcacctgcagttcatcgtcatgacgctgggcctcagcctcttctccggcgtgttctctgcctgcaccctgctctacccctcccagttctacagcatcctggtggcaagcatcctgctggcactaggggcgctgcccggctaccacacctccgcccccatgccgagtgtggcgctctggcgcctggccgccaccgccctgggggtgggggtggaagtcctggtggcggccacggtttttccagtgacggcgcgagccacctaccgcgggctgatggcagagagcctgcagggcctgggcgacctcctgcaggtggccaccggccggttggtctctggcagggcccccagccgcggccnnnnnnnnnnggtcctggtggcggccacggtctttccagtgacggcgcgagccacctacagcgcgctgatggcagagagcctgcagggcctgggagatctcctgcaggtggccaccggccggctggtctctggcagggcccccagccgcggccgggggtccggggcttgcggcggcaagggcagcagcagtacggggggcgtgcacggcggagaaagcggcgccaagggcagcctccctggcgaggacgtggaggctggcgnnnnnnnnnnagggtgtgcgcggcggagaaagcggtgccaagggcggcctccctggcgaggacgtggaggctggcgcgccccgtggcaggcctggcggacttggcggcggggccagacgccagaccgaggacgtcgtcaggccggcgccggtgtggacggcgccaacaggtggctgcggtctgcgggtcacctcggacgccgagccagggaaggaggtgcgcctgcagtcagccctggtacctagcacagtctttggcccgatgcaaagctgcgcgcaagggtnnnnnnnnnntgccagaccgaggacgtcgtcaggccggcgcgggtgtggatggcgccaacaggtggctgcggtctgcgggtcacctcgcatgcccagccagcgaaggaggtgcgcctgcagtcggcctcagtacctagcacagtcgttggcccgatgcaaagctgcgcgcaagggtgggaccctgcacgccacctgtctgtgaggacggtgcgtgtatccatccccgacaacgccccggaccccagcagcccccagca

SEQ ID NO: 42257 - DNA, 85 bp, Chlorella protothecoides
cccggcggtcggccccgcatcctccccctccccggcggtcagccccgcatcgtcaccatccccgacggtcagccccgcgtcctcc

SEQ ID NO: 42258 - DNA, 70 bp, Chlorella protothecoides
ttgtcagccatgggctctgccccccccccccccccccccccgcccgccgatctcatcctgcgccggctgg

SEQ ID NO: 42259 - DNA, 61 bp, Chlorella protothecoides
ccgccccgccaaggacctggagcagagcaacaatgtacgtgctggggctcgtgtgtgactg

SEQ ID NO: 42260 - DNA, 74 bp, Chlorella protothecoides
cgccaccacctgcacgccgctcgcgcccactgttcccgccctgggcactcccacgcagggtacaccagctacga

SEQ ID NO: 42261 - DNA, 73 bp, Chlorella protothecoides
gcggcgcagcaagcgcggtggtgaccacggcgagacgtatcgcttccccgcccggcgctggctgggggatcgc

SEQ ID NO: 42262 - DNA, 61 bp, Chlorella protothecoides
ttccactgttccctcagtggctgggcttgggttttgaatgttcctggttcatgaacatgga

SEQ ID NO: 42263 - DNA, 75 bp, Chlorella protothecoides
cttcctccccaccggctgccactggctgcgccgcacgctcattttccggggtgccctgccactgaggactgtgca

SEQ ID NO: 42264 - DNA, 61 bp, Chlorella protothecoides
cccacctgagcgccaggatgccctccttggcgagcaggtccagggagagggggtcgatgcc

SEQ ID NO: 42265 - DNA, 172 bp, Chlorella protothecoides
gcctttgtcgccgcgggcgtctacgccctcaaggtcgtggtgtggccctacgtggcggatgcagtgaccaagtggaaggcgagccagggcgagacggcagaggccaaggccctgcaggagaaagagtccaacgccctggccgaggccatccaggtgagctggcagcagggtg

SEQ ID NO: 42266 - DNA, 71 bp, Chlorella protothecoides
ttcgtccaccaccaccaccctgcacacccggcgcaggcgctgcaagaagcgtatccaaggcccaggcggag

SEQ ID NO: 42267 - DNA, 61 bp, Chlorella protothecoides
ctgtcattggcagccattgtgtctgagggggagcatgggggagacatggggattgtcatga

SEQ ID NO: 42268 - DNA, 61 bp, Chlorella protothecoides
caccagattggtgtatctcaggatactttcatcacgctgccgcaatgtctcatatggagtg

SEQ ID NO: 42269 - DNA, 64 bp, Chlorella protothecoides
tcgtactgcaagttccggtcccccccccccaaaaatgtctcacctcgttcaatgggtacgcttt

SEQ ID NO: 42270 - DNA, 73 bp, Chlorella protothecoides
tctggtggtcgagtggggacctcatggcgagaggggaggggagaatgtgtggagaagttggtggaggcgccga

SEQ ID NO: 42271 - DNA, 61 bp, Chlorella protothecoides
ttagggggaggggggttagggggaggggggggtattgctgcacaaacacccacgttgcatc

SEQ ID NO: 42272 - DNA, 75 bp, Chlorella protothecoides
agcagagaatgcaggccgccagggtcgtgccggcggcctgcgtgcgtgaggagctgcagcacttccacctccctc

SEQ ID NO: 42273 - DNA, 76 bp, Chlorella protothecoides
tgggtcgcggtccggggtcgcgtccccttcaacccctgctgccggggccgggtaccgcgccaggcgagcggccagg

SEQ ID NO: 42274 - DNA, 103 bp, Chlorella protothecoides
gtgaccgacactgggctttgggtgaagacacggctctactcttaatcgacacctccctcaaaacaagctgattcatttgttacacacaggcagagatcgcaca

SEQ ID NO: 42275 - DNA, 62 bp, Chlorella protothecoides
cgagccgattgaagtgcacaccacaatgatttattctgctagatacagaggcgtgcacggac

SEQ ID NO: 42276 - DNA, 61 bp, Chlorella protothecoides
atgcaaagctgcaggcgcagaggcagggggggcatagggcatgcggggtaggcagggaagc

SEQ ID NO: 42277 - DNA, 92 bp, Chlorella protothecoides
ccgccgcgccactcgcgcgtgcccagccacgaggcgctgctccgcgtcgcgcgcaagcatcgcctgcccccgcccgtggatgcggccgccga

SEQ ID NO: 42278 - DNA, 4240 bp, Chlorella protothecoides
  modified_base (105)..(114): a, c, t, g, unknown or other
  modified_base (3643)..(3652): a, c, t, g, unknown or other
  modified_base (3854)..(3863): a, c, t, g, unknown or other
gctgggacccctggacccccagtctgccctgccaagtctggcaggtgggtggcgttctcaggggggggagagggtttacactctgatcccttcagcctcgactcnnnnnnnnnngctgccgccgccgaagcggggccaggccccgagctcatgggcgcactcgctgacctggcgcccctggccctgtccctagagggcggcgggctgggacccctggacccccagtctgccctcccaagtctggcaggtgggtggcgttctgggggggggaggctttacactctgatcccttcagcctcgactcgggcagaggagccggcccggcgcaagtgtctgaactccacacaggaagcggtgccctgtgctgaaaatcgggcctggcgtcccagtacggatcctgtatctcacaatcctcccctctttctacctgcagagcctgtgttcaaggcgtggggcatgccccccccgggcgtctgtcgcaagctgcacagcattgaggccgggagtctgcccctccccctggatgtgtcacgcggggacctggtggagtttttggaggggcggctgggcgcgcagggccgggccctgagtgccgtggcgccgcccctcccccgacccctggcgctgctaccgggtgagggggcggaggcgccccgcgacgaccccggggcggcggagagcgtcggcgcagacccctcccagtgcccccccagccccacgcgcgacgtggaggaggagggcgagaatgtcgtgcgccacgactggatgagcgtggcagagccggtgctcctcaccgccctctccgcgcccgccgccaacgccagcaacggggccggggcagccgcagcgccgggggtcgtggtggtcatgctggagccagggcggcggctggtgacctacgcctgcgacgacgccgtgcctcgcgtcgccgcccgcgccgcctgattgtcgggccatgccgattgcggccctcctgatcctgttccctccgcaccatctcttctcactattgctgcacacacgctgcaccctgtctccgacaagcaccccccatgtcccacttgtgcatttttgtctcgcgcgtgcattgtacattatcgaccgtaagagatctattggacaggggcaccttgcgtgcctgcagtggtgctacagtactggggcgaagaggagcggaggccgcatcaatggaggcggcgctccagattgggatcggaggtggttgggtagggtggcgggtgggtacagcagctggccctagccaaactcagtacctcgtcccctagttgccgccggctggcatcgtgtagtcatactctatggtgggcaccacgctcgcgatgaacttgaggaacaggatgaggtagctgcgatgcatgcggggaggggggggattgtgggtgggaaatctggtgttcaatgcccagggcaggcagagtgcgtgcaggtggatcccaatgagcagcagttgttgctgcacaccagtgccgacaccgacgaagcatgccagcacatctcacgccccccttggatgctttccaagatccctggacccagcttccacacaccacctcctccagtccgacgcactgttctactcggaagtctgcccggccctccgtcacgacgcccgccagcttccgcatgacattggcgtggcggcaggggtggatggaggccgcctgcaccccggccacgccatgagggtgcggctccaccgtgaccgtcttgcgcgcgtgctccgccgagatgtcctccagcacctgggcgggggagcaaggggtcaggagggttgggatatagtggggtgcactacagcaggatcgtttgatgacgacagtacagcaggtcgctgccacacgcagcaggcagccaaaccgcagcgtggcagcaggcttgctccaggccccccctgcctctgagctgccggtcgggcttgccagccatcgtctgtccccgcctccgtttcacactctcacacaccggtcacctgatcgggggccaggggctgccggcgctcatcgtagccaatgagccagaagcgcggcacctggtaatacttgtcgtaagtgatgacgaggtcgtaggtgcgggtgcgccgcacgccatcccccgcctcgttcgagcccggctgcacggcggcgtccggacccttgccctgcaacggtgcgggccggcggggcaggtgagcgggaaaggaagctcatgtatcggggtgacagaggccacacattcaggccgccagccctgtcccatgctccaaatcacgcccgagggccagccagcccatgacagcaggcagcacagcgtgcacagcgtgacgtaccgcctccaccgtgccgacatcctcgctgtcatctaggtcggcgaggtcggggatggcatcgtcgtcctcctcctcaaggcgtgcggcggcgcggctggcccccgccccgtccccaagggtgaggtccttgagtgggtctgcaggggcaagggagagggcacggaggaggtgcttggccaggcagcacgggcttctagtgtgggcttgacagcccagctccagggcgagaagatccacaggcctgcctcgagggctcccagccttgcacgaatgcttgaaatcactggcccagctcacaaacgtggcatcaggtgggcatctgacatcccgcccctccgcccgccaccccactacatgcggcattgccgcctcaccgctgatgctggggatctcctcaaacccctcctcgttcgtggaagagaggggggcgctgggcctcgagctggcagtcacccagccatccccgccgctcgcgctttcctccacctcaaactcatcccgctcgccatactcctccacgtctgcggccctcctcaggcagggtactgcagaacagggggagatggagggcagagaggcatcttctccttgcatcgagcagcatgctaaacaaggtgtgaggcagaggcgcccaatcactaaacggccacccaccattccgggttatgaggtactgtttgtcgtctggaaggaagggtcttgccttccgtgcatcacccgcttccctgcgagaaaacaagcgacggagctgtgtcctgagagggcatgacctgatggtcagacaagggtggcaggaacattggtgacaggggctacctcagagcatccatctgtgtaccccacctcaccaggaccatgtcgggcacgagtgcaccaggtagtctcccgcggtcacaaattcttgcggggtcagcacctaggtcacaatagggatgtgcgggtgggcacatcgcgcggttggggtacacgggacgatattagggacacacacgcagggcttgaaacccctggagctgaccatggatgatcaaaatccactgcaaggcatgctgggctgggcagcgaaatgtcattgactcacccctttctccttgaaagccgactgtgacagtgttgggaggaccttctccgccgcggtcttgtacgtggagtggatcagttgccgaagacccgacattctggcggagacctcgggcccctgcccacggtgtgagtgcgaactatgagtgcacgaaggtttcggtgataggttgtgggacgacgtgttcacgatgcggactttcaaagctttccgctgagctgactcggggcgctgtnnnnnnnnnnaacgtgttcctgctgcggactttcaaggctttccgctgagctgactcggggcgctgtatattctggcggacctcagattccgtttgttctaggccacaacaaactgatacaggcatgcctggcaaccagctccacagtgtacaatgatcacaagaccacaggaaacctttcataaaagggccaccgtctccttctcgtcccnnnnnnnnnnatattctggcggacctcagattccctctgttctagggccaatacaggcatgcctggcaaccagctccacagtttacaatgttcacaagacaacaggagcccttttataaaagggccaccgtctccttctcgtccctgaggccctgtcctgccccggctggtccctcccgccgctgcacgctgcacctcagcccatgcgcggtgtgaatggtggcgcccgatgcaaggcctgggtcagcggccagggagaagctgtaccgccgcagcgtcatggccagggccacggttgcctccagcatcgcaaactggtcccccacgcacttgcgggcaccgccacctgagttgttggcggagaaggggtggagggggtgggtggcg

SEQ ID NO: 42279 - DNA, 61 bp, Chlorella protothecoides
acttcaggcagcacggggaaggcagcagccgcgctcgtcgtgaacaagtttggaccgcagc

SEQ ID NO: 42280 - DNA, 70 bp, Chlorella protothecoides
aagaggaggagggggaagtcatgggcaatgagcgtggggaggtggagcgcccgcgagtgtcgtgccggcg

SEQ ID NO: 42281 - DNA, 72 bp, Chlorella protothecoides
tggaggggcagagtgaatttgccgtggggggggtggttccctggcaaggcgcacaaatggtgatcagcatgg

SEQ ID NO: 42282 - DNA, 61 bp, Chlorella protothecoides
tgcagtctgccacgccacttgctggcgggggctcactaccctcgcccctggccatggtccc

SEQ ID NO: 42283 - DNA, 98 bp, Chlorella protothecoides
cgacatctcgggcatgcagctgggctgatgcagcgccagcggtggccggaaaaaggggggcggggggggggttgtcctcgtgctggagcaatgggtgc

SEQ ID NO: 42284 - DNA, 61 bp, Chlorella protothecoides
ttccgctagtggttgtggaggccatgagggggtgagaatgcactgcgacttccggtactcg

SEQ ID NO: 42285 - DNA, 61 bp, Chlorella protothecoides
caggatgttttcgccgtggcgatcgcccaggcccaccaggtgccccaccatggaccagaca

SEQ ID NO: 42286 - DNA, 101 bp, Chlorella protothecoides
cgacttcttctcgggtgggtggggtgattttggggggggtgtccctggaagctggggggtgtcaacattccgcggctgatcatgctgctcacagggaggct

SEQ ID NO: 42287 - DNA, 8484 bp, Chlorella protothecoides
  modified_base (173)..(182): a, c, t, g, unknown or other
  modified_base (2960)..(2969): a, c, t, g, unknown or other
  modified_base (4230)..(4239): a, c, t, g, unknown or other
  modified_base (5016)..(5025): a, c, t, g, unknown or other
  modified_base (5725)..(5734): a, c, t, g, unknown or other
  modified_base (5980)..(5989): a, c, t, g, unknown or other
  modified_base (7310)..(7319): a, c, t, g, unknown or other
tgcccctgctccccccggcaaggaggccagtgtcaccttagaatcactcagactgagggttgggagcatccagtatgagagacgtacactgcggaccgtaggcagttgcaacgcatgtgatggggccctgggtggcaggaaggaccccgctggccgccggcacgggaggacannnnnnnnnngggtggcgtgctggcgcacgaggcggcgctgggcggggccgaggcgcgcgcgggggtggcggcggcgatctcggcgtatcgacagcgcggcggcagggcggggccgcctcggctacctgacagcaacccgctggccgaagcgtggcgagaagattttggggcggggaagctggcggagatcgtgctggacctgtttgggcaagatatcgaacccttcctgcccccgatcgaggggcgggtgggtgacgaaggcgaggggcaatgagtgtgtttgggtgggtgaccaccgcaagctggacgtcaccgtgtgtgcctcatgcgccggcctgccatcatgctgctgagtatgcccctgctccccccggcaaggaggccaggtgtcaccttagaatcattcagaccgagggttgggagcatccagcatgagagacgtacactgtggaccgtagacaattgcaacgcatgtgatggggccctgggtagcaggaaagaccccgctggccgccggcacgggaggacagtccaggtcgcgccgactcgggcgggtcgcccgtgcgatccgtagggtgtcaagagggtgcccctcacacgagggatcggcagcccgaccgcgcgaggcgtcgcatgagcgtgagagccccgcctgcagcagcccaccgggtcaatccacgcgggccgcaccccccccggccccaatatcatgtgcaattccccgctcctttcagctggccacctcgcccagcgccacaagtccggcgcctgtcgatcgcgaagggattcatacaagccgtgctgggagcttcgagacgtacactccgaggatgtgggcctgagcagtagacaacggacatccctgcacgatggtgagacccggcccgacacactccctgccccgaccttagctcctgggaggtggtatgacatcagcgctttcctcgttgcaggacgacgcccagctggatgatatcatagaccggctgctggatgtcagaacagggaggcctggcaagcaggtcaccctcacggagcaggcaagtccgcagccccaggggtggacccgagacgatctgttttgggaattcacatggtttcgtgagtaacgagaccgttctggcatgcatgtagcgctacacgtcgcccgcacttcgccttcccgcaggaaatccggcagctctgcctcacggccaaggagattttcatgacccagcccaacctactggaactggaggcacccattaagatttgcggtgaggtcctccgcgccccccggccggtgctgccgggattgtcccgctgttccgtgacccggtgtgggggtggcctgccagtggctccatgcctacatcttcgacacaccccctcctctcaggcgacattcacgggcagtactctgatctcctgcggctctttgagtacggaggcttcccgccagaggccaactacctcttcctgggcgactacgtggatcgagggaagcagagcctggagaccatctgcctcctcctctcctacaaggtgggcatgggttggggcagtgaaggaagggaggggggggaggcgggtgtgcacagtggcatgcctgcatgcaatggcctgaagtgcttgggtggcgaggtttgcctatgtgcagcttgtgggggggtggatcatggtgttgcacttccgggcccctggattccaggtagtttcatcacttcctggtcatgggccggccagcatccctttcccatccctcgcccaccccattaaatcacagatcaagtaccccgagaacttcttcttgttgcggggcaaccatgagtgcgcgtccatcaaccgcatctatggcttctacgacgagtgcaagcggcggtacaacatccggctgtggaagacattcaccgactgcttcaactgcctgcccgtggcggcgctgatcgacgagaagatcctgtgcatgcacggcggcctctcccccgagctcaagtcgctggagctgatcaagcgcatcccccgccccaccgacgtccccgacacgggcctcctctgcgacctgctctgggccgacccagacaaggacgtgcaggggtggggcgagaacgaccgcggcgtcagctacacctttggcctggggaccatcaccgagttcctgaacaagcatgacctggacctcatctgccgcgcgcaccaggtggtggaggacggctacgagttcttcgccaagcgccagctggtgaccatcttctctgcgcccaactactgcggcgagttcgacaacgcgggggccatgatgtcggtggacgagacgctcatgtgctccttccagatcctgaagccggcagagaagaaggcgcgctacatttacaacgccatggggcagcgccccgccacgccgccgaggcccggcgcgcctcagccacagccgccccccggcgcctgagtggcggttgggggaatgggtgaaagggggtggcccaggacccacccttcggctccggggccaatccaaccccccaaacaacaccccacccctggacgccgtcgcattccatgcaaaggtacccaatgcacctgcagcgcccattcctccctttccatcccttgggctgcccctcgttcaggcggggcacgtctgatcgctggcactgggcaggctgcggggataaccgtgcagcggcctcagccccatcgcaggcgcctcgtcccagtcaccgacgctggaccggggacggctggtgtgctcgagtgccctctccagaccatcctgccccagcccatctgcttttccctgctccaacnnnnnnnnnngctggggagggctggtgtgctcgaatgccctggccacgaccccactgtcccagcccatctgcttttccctgctccaacccgacccccctccctgtccaaagtgctgtgaaacgactgtgtggcaaggacaggcatcgggtgcagggcaatctatgcagggcaggcccggctgccaaaggctcgtgatggggatgccgctgcttcgttgggctctcccactctgtgacgccccaggcttcagcatgcagtgcgtgccgtgccagtcctgccctgcgccaccacccgcctacatgccggggatgagcttggcgcgctccgcctcgtaggcctcgtcctccttcttccgccagtccatgtactcggcgtggggcttggggtggtgcgcccagcactccttctggaaaaagtctttgaccttgggcacatggtcctgcaccagcacctggccctgctccgtggaggcgccgttctgctccaggaagtcctggacctcctggtggcccatgttgcgggcccagtgccagggccggtcccccgcgttgttgctggcatcgatcttggcgcccaggctgagcaggagctcgcagccctccgtccagccctcataggccgcggagtggaggggtgggtttccggccgcctccacctcgttcacatccgcgccggcgtccaccgcgcggatgatggctggagtagggggagggaggggtcctggttggtcagtggtcccggcgccccattcgaatgacgagggatccacggagccagaccccaatgcctgccttcaagcacgtccctcaccatctttatcgcggctgtgtgcagccctgtgcaccgtcatgctgcccaccaagccccgcccgcgggtgcaccccccgccatctgccttgatgccggtgggaccttgccactgcaggaagggcccctgcacgttcttgtaccacggattcttctccatcgtgcaatgccctgaccaatttcggatcggagttctcgcgccgtctgcgatcgcggggatgggcccctgtccctcctatgagttgcggggggcggggcctctcacgggacagctttgacccatgcgctttgaccgaatggcgggaacaccagcacgcaacctcaacccccagggatgatctgattcctctaaaggggggctcttcagatgcttcaaaaccatgaatcgcttttgcatgaccctcacaataacacgaggcaataacaggaatggcaggtgttggcgagaagcatggcgtgtggnnnnnnnnnngaccatgaatcgctttcgcatgaccctcgcaagaacacgaggcaatggcaggaattgcaggtgttggcgagaagcatggcgtgtggcatgcatggccaggagctgcctcgaggaaacctgcagccttggtcatgagcatgaagaatcttcctgcagcacgcgcgcctgcttcaccacccccccacctccgcccccgtctcggccgccagtcgcgtcagctcccgcctcaacgccctggcaaactccagctgcagtgggaggccggcgcggtacatgacggtgtggcccaggggcagtgcccttgaccctggcaacgccgccagggccagcacaccgagcaggctctggatggcgtgccgcgccgcctcgctgtcgtccacggggaagcggaggagggagtcgtcgtaccagtcctggccctgagcgaccaaagccacaaagtcggcgccgccgcgcagcagtccctcctgcgtcagcgcctccacctcctcgggcgagtcgaagcagcgccgcgcgggcgccacctcgtaccggaaatgctcgtcctggtccgggctccaggtgtgccactgccgcccgatggccggcgcctggcgtggagcggtagtggtggtgtagtgggaaaagggttggatgggggaaggggatccaggggttgcaggctgggagtacagtggctgtagacacggggggaggtgcagcggtgtactctttgcaccatactggtcaaatgcaagcgacctgcggcggggagaacgcccatcggcccccaccccnnnnnnnnnnagggaggtgcagcggtgtactctttgcacaatactggtcaaacgcaagcgacttgcagcggggagaacgcccatcggcccccacccctcgacccggccccacctcaaactccacccccgcggtgagcttcatcacgtcgccagggtaaaaggtgatgaaggcatcgccgtcccccacggtcagcggctgcgggggcgacagccagacggcacgcgtgctctgtgggccgcagggccgcacgccgacggagcgcagctccaccgcccagcccatggccgagccgtcgatgacgggcacctcgctcccgccctctatctcgatgcgcgcattatcgatgccgcaggcctccagggtggagagcagggcctcgggggagaggatgctgcgtggatggcggggaggtggtggagactctcgttcagggcgttttgggctcgccggaggaggggcaggagccacgcaggcatccaggagtccagcattcattcacgcaccccgcagcctggcacctcgccacgcacagactgctgcgactgcatcgactgattcgtgtgcgacactgttcaggccctcgtggaggggcggggtctgctgggcagcagttctgaaggcggcaatctcccgagcccctgcaaaaaaaatcacgcacctgacgtcctcgcgctgcagtttggtgtgatgtgcggatgctgcagaggcnnnnnnnnnnccccgggcccctgcaaaaaagatcacgcacctgacgtcctcgcgctgcaatttggtgtgatgtgcggatgctgcagaggccgaggctatgcaggcaggcacccaggcctcgtgtgcacccctggcttgtacctggcgcggtgggttgagagggcatgaggggaaatggtctaaaattgccatgcctatcgagcagcaggcactccagcaaatcatgcagcacgacctcacctcctcgtctggcagnnnnnnnnnngaattgccatgcccatcaagcagcaggcactccagcaagtcaagcagcacgacctcacctcctcgtctggcagggttgggtcatccagcgcgtcctccttgttgaacagcgcctcaaagtccttgccatgctcctctgagaagtctgcatgggggctggatggtgccaccgtcagtccctgcacaaacgctgcagctctggatctaaagccagcacacgtgggacgcaggtgcacaggccagggacttcagagcccgcctaccatccaatgctcaagatagccacgcctaccgtccaggttgccttcgtatcccgccccccgcgccgccagccacttgaagaacacctctgaccgctcgtcctcgtatgggtcgtcctccggcgcgtcgatgtccaggtcctccaacgtgcgtggctccggctcctccaccacaaagcggcccgcattcgtccccggaggcacgcgcacaaagtatcggccctccccggcgagggcggggcgcaccctgacgtaggcatactcgcccgtgtgcagaccgatgccccccagcgtcagcgatcggcgcagcgtctgctggtatgcttgaggctgtgtgggatgggaggggcagcgcttgtttcagacgatgtacaggcacagcctagcagcacgaggggctgccaggcaatcaatttctgcccatgatcgccactccgactgcgtgagcctccagcccttaccagggggaaagcttcgggatccggctgtgccttctccgggtccatgtcggcatcgtcgtcgcctccctcatcccaggagccttcctccccatcctgcgcgccacccaccacctcggcctccaccgctcgggcagcggctctgacctggcccatgcaaaggcgaaagtgaattctcgtccagttagcaggtctaattgggatgatggttcggaatgcgtaccgccgagcgtctatacagccggagaggcacggtgcctgggattgtgttgcaggaggtgcagcaccgggagccatgcgagccacccgatggccatgcatcgtgccctgcatatttgaaaagacgtccagtgtatgacttaaaccagccaatccatgcttcacgctcctctaagcagggcgtccctccgagcaaaagagcgagatggggttctctgcccacgtcagcacgacccaatttgccaatgccggagaaactcggttgcaccatctatacaaacagcatgtcgctgtaggggtgcgcaccataacttatatcttgcctcgacactgttccaacgcagagcaggtctccaaaagccacttcgcacattcattgggaatnnnnnnnnnnccccctcacgatatgtcgaaagacccgcagaccctctacgccgtggaggatggcgtggccgtcatcacgctcagcttcccgcccatgaatgccctgcatccaaagggtaggttcgcagggctgacagcacgtgcagacccgagcacgtctctcgactcacgcctgcgtccacttttcgagatcgtcgtcgcccgtcctcacccgcagttcttgccagcctgttcgacaacgttcgacgtgctcatgctgacccttcagccaaagccattgttatcacgggtgccaacggtgagtatggctttgggtgcggtcgggagctcataattgttgtgctggtgtcggtggagcattgaccgcttgcatgggtacttggcagggaattggaatctacaagcaccacagctgtaacgcactcttgcggatgatctcaaaccccaattgaggtctcctcacgtacatgcaatctaccctagaacctttgcctccttcgcatccctcttccatgccagtgatttgccagttgtagtgccatgcgagcccgctgcaaaacttgtccaatacccctcatagaaaccatcgcaaacacctactcctccctcctttccctcccactttacacacacacacatacacctccccctcccccactctcaggtcgtttctgcgccggcttcgacatcaatcagttccaggacaagtcacgctccgggggcggcatcgacatgtccatcaacaacgcgttcgtggagctggtggagacggggcccaagccgacggtggcggccatcgagaagctggcgctgggcggcgggtgcgagctggcgctggcctgcaacgcgcgcgtggccgcccccggcaccatcatgggcctgcccgagctgaccctaggcatcctgcccggcttcggcggcacccagcgcctgccgcgcgtggtggggctggagaaggcgctgtccatgatcctgacctccaagcccatcaaggacccggaggctctgtctctgggcctgctggacgcagtggtcccgccgcgtgagctgctggcgacagcgcggaagctggcgctggacctggcctcgggcgcgcgcacgcgccgcttcgcgctgcagcgcaccgaccgcctgcccgccttccgcgaggcgctggccacgctggagttcgcgcg

SEQ ID NO: 42288 - DNA, 61 bp, Chlorella protothecoides
gggcgttgcgttgcttgatggcagctgcggggtcgtactcccttgtccacgaccccttggc

SEQ ID NO: 42289 - DNA, 75 bp, Chlorella protothecoides
ggcagactggcgtacgccctgacaatggtcaggactttagcgttcccatgtgctccacagacctgccctcccacc

SEQ ID NO: 42290 - DNA, 110 bp, Chlorella protothecoides
catcctgggtgagaggctggggccgggggccttgcttgtgttggatgcaaaaccctgcccgaacaggcctggcacttgcccgaccaccccgtccctcatcccagaaccga

SEQ ID NO: 42291 - DNA, 105 bp, Chlorella protothecoides
ggggcgggggggggggggggggggggggcctcagagaggaggggggctgggtgaggtggtcctgtgaataggatgcagagcgcggagtgcggagttcatgggagg

SEQ ID NO: 42292 - DNA, 61 bp, Chlorella protothecoides
gcaggccggcttcgacctggaccgcgccagtgagatggacgcctggcggcacctggtggag

SEQ ID NO: 42293 - DNA, 61 bp, Chlorella protothecoides
ctggccagtgcaacatcatggcttggagaggattctccctttccccaccacctactttctt

SEQ ID NO: 42294 - DNA, 72 bp, Chlorella protothecoides
tctcaaagggtctcatggcagggctgatcaggcactcccacagcaactcctgggggcggcagcctgcgtgat

SEQ ID NO: 42295 - DNA, 61 bp, Chlorella protothecoides
tcaccctgccgagcatatgtgttgcttctgcatcatttctactttgtaaatccacattcac

SEQ ID NO: 42296 - DNA, 80 bp, Chlorella protothecoides
ccatggcgtgtggcctcacacggcatcggagcaggcttgcggtccccccggtcaccccccaccgtctgtcacctccacca

SEQ ID NO: 42297 - DNA, 7758 bp, Chlorella protothecoides
  modified_base (422)..(431): a, c, t, g, unknown or other
  modified_base (684)..(693): a, c, t, g, unknown or other
  modified_base (1100)..(1109): a, c, t, g, unknown or other
  modified_base (1386)..(1395): a, c, t, g, unknown or other
  modified_base (1806)..(1815): a, c, t, g, unknown or other
  modified_base (2173)..(2182): a, c, t, g, unknown or other
  modified_base (2938)..(2947): a, c, t, g, unknown or other
  modified_base (3161)..(3170): a, c, t, g, unknown or other
  modified_base (3488)..(3497): a, c, t, g, unknown or other
  modified_base (3889)..(3898): a, c, t, g, unknown or other
  modified_base (4156)..(4165): a, c, t, g, unknown or other
  modified_base (5295)..(5304): a, c, t, g, unknown or other
  modified_base (6359)..(6368): a, c, t, g, unknown or other
gccgccgccgccccctcccccgccgcccggcaagagcgccagcccgctctcgcgcggcccgccggggacgccgccgccgccgccccttcctcccaagaggggcagcccggggggacctggcgcgctgggcacccccaccccgccggcgctgccgcggcgaaagggctccggggtgccgcccccgcccacgccgccgtccacccccgcggtgggtgccaagaagctccgcgctttctactgggacaccatacgtcgcaagcccgggagcgtgtgggaggagctgggggaggcccagcctctggagcccgtggcgaggaacaccctggagcagctgtttgaggtgaggggtggatgggggctggggcggtgcatgctcttgcgatggcgtggatgctagctggtggctgtctcgatattggagnnnnnnnnnnttttgaggtgaagggtggatgggcccggggcagtgaatgctgttgcgatggcgtgggtgctagctggtggctgtctcgatattggagccatgcaaggtggtcgaggcactgaaccgatcagttcccccccacaacaatacaatctctcgcaggtccaccccaccgtgccggctcggggcagggctggaggggcggggtcaattgggcgtggccccaaggcctccggtcccgtcgtcaaggtgcttcctctcannnnnnnnnngtgggagtggccccaaagccaccggtcccgtcgtcaaggtgcttcctctcacgcgtgccaacaacgtctccatcatgctgacccaggtgccggctcgtgctgcagggatggggttacctgcgttggcttgtcaggactgcctggctgaggcaaaccggcagggacatcttcagcggccacattgcagcttagaatggcaggcattcttgtgggagaggctctcactgagcgacagccttctgatgtatgggcacgtgacactttcacatcaacaccatgccccacctccaccccctctgctcccgcccagttctccacctttcctggattcgagagcattcggaccgcgctgctgaccgggtcgggtgctctggggctggaccacctcagcctgctcatgcaggtgnnnnnnnnnnaacccctctgctcccgctcagttctccacctttcctgggttcaagagcattcggaccgcgctgctcaccgggtcggatgctcttggactggaccacctcagcctgctcatgcaggtgggtgtgggtggggagtgccggctgctctgaagcatgcacaagggcaatgctcgtaatttgggggggtggctttgcagccgtgtggccgcaggcgagggcaccactgctctgaacaagttgccctgtcacgccccgtcccacacccactctgcccctgccnnnnnnnnnngtgaagcatgcacaagggcaatgctcgtcatctggggggggtgcattgcagccgtgtggccgcaggcgagggcgccactgctctggacaagttgccctgtcatgccccgtcccacacccactctgcccctgcccgccggccagatcgtgccgagcgacgacgaagccaaggcccttcgggcctacccaggcccagcagaggagctgtcgccgccagagaagttcatgctggtcatgagcgacgtgccgcgtgtgattgctaaggcgaggagcgcaggatttctgatgtgcagtgcagtcatcgtggggcatgccggggctgcatgtacggtgggtttgagcgaggggactcgaggtccttggggcccacatgaagactctccaccatgccacgccacgccatgctgcgccnnnnnnnnnncaaggcgaggagcgcagggtttctgatgtgcagtgcagttattgtggggcatgccggggctgcatgcacggtgggtttgagcgaggggacttggggtcctcggggcccacatgaagactcaccaccatgccacgccacgccatgctgcgcctcgtcctctccgcaaccccaccaggtcggcgcgctcatgttccgcctccagttccgatcgctctgcgaggacgcggcggccggcatggcggcggtcaggctggccacagagcagctgcgtgccagccgccgcctgcgcaaggtgcgatgcgtgtgcagcaggggcgcagggatttgagagatttgagtctgggccgagggccggcannnnnnnnnncgccagccgccgcctgcgcagggtgcgatgctagtgcagcaggggcgcagggatttaagagatttgagtctgggccgagggccggcatgcagctcagggaccactcttgccgggtgttccctgccctgtggcaggcactgaattctcgccccctgagctcgcagcccaaccctcatcccataccgagcctgacacctcgccacgcctcactccctgtcccctccaatcaccttcccaggtgctggcggcggtgctcgccgcgggcaacgcgctgaacagcggcacggcccggggcggggcggctgccctgaagctggagtccctgctcaagctggcggacgtcaaggccagcgaggggtcccagccccggccacacgccggacggcgcggggagggacctggagcttcacgcgccgacgggccgggcacggagggtgctggcgtcggcccgccgtcgagcgacggcccgccggcggccccgccctttgccctcaagctgcgcagcctgctggactttgtggcgtggattgtgtaccgcggggagggtgcggaagtccgcgccgccacgcaatacctggcctcggagctgggcgccctgtccgaggcggtgcggcgcatgcagagcggtgaggggcagggatgcggtgggtggttgatgagagtgctggtgggctcccttgagcaagggcaggaggtgtgtgagggaggggtggaaagaactgcaggggggggggtacgaccagtgctgcggtggcnnnnnnnnnncgccgggatgcggcgggtggttgatgagagtggtggtgggctcccttgagcaagggtaggaggtgtgtgagggagcgggggaaagaactgcagggggggggtacgaccagtgctgcggtggcgtggagtgccgtgccgagcgcttttgtggtgcggcggggcggcgtcgggcgccgaggccttggcctatgataccatgctggtgctccagctnnnnnnnnnngtgtggtgcggcagggcggcggcgggcgccgaggcctcggcctatgataccatgctggtgctccagctttcctcgccccacccataccttgcctctcttgacccgcgtctttcccctcccccactgcacctgagctcgcaccctcaacacacacccctttcccctccctaccctactcccctcctgcagacgtgcaggaggccctgagggccctgcagggcggcctggcctcggcgcgcaaggagcacgccacagaggtggcggaggaaagcgcggcggaggcgggcgcctcgcccgcggacttcgcggctgtcctgnnnnnnnnnnacacgccacagaggtggcggaggaatgcgcggcggaggcgaatgcctcgcccgcggacttcgcggctgtcctgggggccttcctggcgcaggcagaggcccagctcgccgagctgagcgaggccagcgccgccaccgagcaggaggcgaggcgcaccctcgagtggctcggggctggggtcaaccaggatgcggcctccgtcttcgagctgctgcaccgccacgtgacggccttcgacgccgcctacgccacggtgcaccgcctggccacgcagaaacgataggcctcggggcggggaatggcgcacccggtgacggactgcctgcatgagctgaacgcagcattaacattgcccagcgccgacatctttagcagcataagccagcccatannnnnnnnnnttgaatgcagcataaacattgcccagcgctgacatctttagcagcataagccagcccatatgcccacaactgaagcaaggaaatgcatgttgcgaatagcatagagggctgacgggctcgagcggcaaatgatgtacaagacagtccccaggggaacaactcgtggcattggaaagggcgacggccctggtccacccaaccagcacccccggcaatgaccgggccttcccggctttctgtcaccagatcgccagcccnnnnnnnnnnaaaatgcatattacaagtagcatagagggctgccgggcttgagcggcaaatgatgtgctagacagtccctaggggaacaactcgtggcattggaaagagcgacggccctggtccacccagccagcacccccggcaaagatcgggcctccccggctttctgtcaccagatcgccagccccaacatccccgagcatcagagcaggtgcctcctccctcgaggctgtccacatccgctcccgacaatgtgtgggaagaccttctgctcctgcaagatggtgtacgccctgccctcccgggactgcctgctcagcctcgccgccttggatgggcctgacgaacagtatgaaaaaggcgccaaaggtgaacggcaataatggccatgtcaacagcacccaccgttgctgcgccgagcggaggtgcgcggagaagggaaggggggggagcctggcgtcgcctgaacatgcatgctcgtgggggagtaccagtcttgccgtagtgtatattgccttttgttgtcaaatggacatgtatgcaattcagtgtcatgttgtcgctcccagccgtggctccctacgagggctccaccccatgctgcaccccaaccccaacctccctgccccaccccgccccaccaggctcctggaggcctgggtggcggacgccaggcggcacggcgttcccgccgcgcgcgtcgtgtcgtgggttcggcgcaagtttggcgcgcacatgacggtgtaccggtgccgcaaggatgggtccctgggctgctccacgccctgcctgctctgctcgcgcgagctggcccgcttcgacatcaaggtgcactgctccttggagggcggggcctggtactctgggcgcgtgacggacgtcggcgcaccggcccccatcctgacgtccggccagcggcgcatgatcaagggcaaggcggcctgcatggccgaacgcacgctcaaaaaccccaacctgcccatacccttccgttgacgggctgcactgactatgctcacgtatggcacctctcgcttcattcttttccatgtaaagcttctgcacaagatgctggatcagcgaacagacgatcgctggctcagaacgtgagatccagatggtattggaaccggcaggannnnnnnnnnaacgatcgcgggctcagaaggagagatccagatggtattggaaccggcaggacccaggtcacatggattcaaagtgtgccgacatccggcttgctgggaccatgcacctcctgagaccttccagggttgcgtgatcgcactgagaacacctgaatgcctgattctcctgcatatggttgcgctgttccggcggcatgcatgccctggccggccgggaatggcgtcgggaccctaaacgccctcggacgggccaagaagagttcccgttgctgggtggaagctaggaacaggggaggggggccatctggcattttccgcacgaacaattcctcggtacggcccctgagcaagcccaccccgaaagctacgaccacataccggcagaggcacaaagcatctctgcatttcttcgcctccaagcaagcagcatggcgaccgcagagaaacccagctccgacagcggctgggccagcaaggtcacgtcctccgtgaagaaggcggtcggcatgcaatccaaggatgattccgccagcagcgcacccgaggtcgccgggtctctgaagaagggtgcgctggcatgatcggtggcgcggtgcgggaatggagcacgcttgctgccccccctcgaccctgtccatacgtccgtgctcagccggcatgcaacactctcgatctggttgtaatgagtcctcctatgttttacgcaggtgctggggcccaggcggtccccggaagcggtgcgtgggcgtgagggttggaggtcgcgcgaggcatgaggtcatgctcccccctgagctggatgcccacctgtactgggcctttaagagctcagtagcactcaccttgcccctgatatggggactagctctcattgatggactcaatcggtcgagagatgcattctgcgctgctttctcctcatgttcatccctgctgtccccacctccctgcaggcaagcccagcaccctggagatccctgagggcccccaggccagcgaggcgcccgccactcccggggtcactctgcaccagccccgccaggccacctcccccnnnnnnnnnntttctgctctcccctcatgtttatccctgctgtccccacctccctgcaggcaagcccagaaccctggagatccccgagggcccccaggccagcgaggcccccgccacccccggggtcaccctgcaccagccccgccaggccacctcccccggctccgttacctccgagaacgcgcccaccccaggcgacaaggagtcggagatcggcagcccccgctcccacgccatccaaggcgagcgggtgcaggtcgagcgcctcggcgggcctggcgaggccgcgctggcggccgtgggcgagggcgaggagatcaccactgtggacgcccgccccgacttcgaggtggagtccatggccgccgccgacgtggcgagcatcaagcagcaggaggccgccctcgtggtgcgcatggggcccagagggtggtgggttcggtgattctggggaagaaggaggtggatccctggcgcgtacaagaagatgcaagcctggccttgaacagcagatggctggtgtgcagctcatccgccgtcgctgccttcaaccgcccccattcccctgccaggccgcccagcgccagcaggagctggaggagaaggagggggagctgcagcggttgaaggagcaggccgagacgctggaggtggatgccgagggcctgctggcccaggcctcgctggagaagctcaaggtggaccaggcagaggagaagcgcgccgagatcgagggcaacgaggcggcgctgtacggtgaggcggaggccgcggagaaggagcgccgcgcggtggtagcgcgcgcgcgccccatcgcggcggaggccgaggcccgcgagcgcgacgcggcggcggtgaaggcccaggcggcggacaccgagtaccacgcacaggtgctggaggcgcgatcccgcgcactgctggcggagtcggaggagctgaagacgctgtcggagagcaaggccgcggaggcggagctgtttgctgcggagctgaccatcgtggagcaggagcgggaggagatcgcggccaaggcggcctccatccactccggcgacctgcccgcccgcatccaggccaaccaggtggagatcggggtgctgtcggcgcgcatcaagaagctgcgcgacgagatcgaatgggcggaggcggagatgcgcaaggttcgcgccgacgccgacgactggcagcgcatcgcggcgcggaagaagcacgagacggcgggcctgacgctgcgcatcagcgaggcgcgtgaggcggcgcgcctggcgcttgagcgctcgcgcgaggccgcggaggaggcgcgcgcgccctcggagttcgccgaggccaagtacggcgaggcggccgagctggccaagcgcgccgaggcgctggaggcggaggccgcgggccggcgc

SEQ ID NO: 42298 - DNA, 61 bp, Chlorella protothecoides
catacgtgacaaggcatatgacgccgtggctgggagccggtatgccctgtttggacagcca

SEQ ID NO: 42299 - DNA, 18777 bp, Chlorella protothecoides
  modified_base (265)..(274): a, c, t, g, unknown or other
  modified_base (652)..(661): a, c, t, g, unknown or other
  modified_base (1188)..(1197): a, c, t, g, unknown or other
  modified_base (1505)..(1514): a, c, t, g, unknown or other
  modified_base (2123)..(2132): a, c, t, g, unknown or other
  modified_base (2454)..(2463): a, c, t, g, unknown or other
  modified_base (2693)..(2702): a, c, t, g, unknown or other
  modified_base (2896)..(2905): a, c, t, g, unknown or other
  modified_base (3050)..(3123): a, c, t, g, unknown or other
  modified_base (3765)..(3774): a, c, t, g, unknown or other
  modified_base (4409)..(4418): a, c, t, g, unknown or other
  modified_base (5152)..(5161): a, c, t, g, unknown or other
  modified_base (5555)..(5567): a, c, t, g, unknown or other
  modified_base (5721)..(5730): a, c, t, g, unknown or other
  modified_base (5938)..(5947): a, c, t, g, unknown or other
  modified_base (6169)..(6178): a, c, t, g, unknown or other
  modified_base (6943)..(6952): a, c, t, g, unknown or other
  modified_base (7265)..(7274): a, c, t, g, unknown or other
  modified_base (8354)..(8363): a, c, t, g, unknown or other
  modified_base (10521)..(10530): a, c, t, g, unknown or other
  modified_base (10725)..(10734): a, c, t, g, unknown or other
  modified_base (11669)..(11678): a, c, t, g, unknown or other
  modified_base (12521)..(12530): a, c, t, g, unknown or other
  modified_base (13441)..(13450): a, c, t, g, unknown or other
  modified_base (15138)..(15147): a, c, t, g, unknown or other
  modified_base (15562)..(15571): a, c, t, g, unknown or other
  modified_base (15942)..(15951): a, c, t, g, unknown or other
  modified_base (16146)..(16155): a, c, t, g, unknown or other
  modified_base (16694)..(16703): a, c, t, g, unknown or other
  modified_base (17146)..(17155): a, c, t, g, unknown or other
  modified_base (17454)..(17550): a, c, t, g, unknown or other
  modified_base (17981)..(17990): a, c, t, g, unknown or other
  modified_base (18221)..(18230): a, c, t, g, unknown or other
  modified_base (18362)..(18413): a, c, t, g, unknown or other
  modified_base (18548)..(18605): a, c, t, g, unknown or other
gctgcgcagacccgcagcggcgcagcggcaacgccccgtctcggggagcgcggcgggcgacctggtcggcctcgtgctcctggagctgggggtcagtgtgcacagcacgctggtgggcgtggggctgggcgtggcgcgggccgccgccttccacaccctcctcgccgccctttgcgtgcaccaggtgtgtgtgtgtgggtggggggggcccaagaggggggaggagacggggggtgaggttgagggaaggaggtttgtcaaagannnnnnnnnncgtgtgtgggggggggcaagaggggggaggagacgggggttgaggttgagggaaggaggtttgtcaaagagagatgggtgcttgcacggatgggagatgtgcagggccagagaccgtcacaggatgcctttcggccctgaccttcaggcccatcccgggggcgtactctcggtgccggtcccggctttcgcacctcctgcacatcaaacctccggccccccttcacttcccccttgctgaagttcttcgagggcattgcgctgggcggcgccacggcggacgtggacacgggttactggctggcggtggcgttgggtggcgtcttctccctctccaccccgctgggtgtgctgctgggggtgggcctgcgcgaggcgnnnnnnnnnnccctccacccccccttcactccccccttcctgaagttcttcgagggcatcgcgctgggcggcgccacggcggacgtggacacggggtactggctggcggtggcgctggggggcgtcttctccctttccaccccgctgggggtgctgctgggggtgggcctgcgcgaggcggcggccagcggcggccgccgcggcgcgtcgacgctggaggggtcgctggaggccctggccacgggcatcctgctgtacgtgggcctggtgcagctgctgacgccgcacatgacgcgcacgcggtggatggcgcgggcaggccccgccacgcaggccggcgcctttctctcgctctgggcgggggccgcggccatggccttcctgggcgcctgggtctaggcgcgtcgcggccgagccgtcttgtcttccttttgggcgggagctgggtcagccctcaaggatcccggccctggatgggcgcgtgacgtcccccccacatgcgcccgcgcccacactcttttccagagacccatgctnnnnnnnnnngaggatcccggccctggatgggcgcgcgacgtccccctcacatgcgcccccgcccacactcttttccagagacccatgcttccctttcacagagcctccactcgacctctgtgaggccagtggtgcatcctacttctgtgcatcgctccggttcccaatgcagcaaaaccctctgcactcggatgcagtaactcgaatgccccgccgggtcagagacgggagaggtgattggcgtgccggcaccattctcgattgtgcaagataggccttgggacccccggcagaatccccgcctctgcgtgtcaatnnnnnnnnnntagcctccactcgacctctgtgaggccattggtgcatcgtacttctgtgcatcgctccggttcccggtgcagcaaaaccctctgcaattggacgcagtaactcgaatgccccgccgggtccagagacaggagaggtgattggcgtggcagcaccattctcgactaggcaagataggccttggaccctccggcagaatccccgcctctgcgtgtcaatttcgcgcgaccttggcggcaggttccaggtactcgcgcgtgtacgccttgtccagggccgaaggcgcgtccgcttcgcgcttgggcgcgccgcgctggcgccggcggtgccgccgcggcggctggtccgggtgccgccggctccagtcggcgtcctccacgaagcgccgccaccgcccctcacgctgggcgccgggcagagaggcaaagcgcgggtcgtcgcccagcagcacctcggcctcgcgccagctggtggcctcgcgcggcagggacccctcggggtccttggggatcaggggctgcgcacgatgcagggaggaaaaggtgggagagggggtaatagggtgggtcccgaggctggtgaggcggctgtgcccgggtctgtggagctgnnnnnnnnnnaaggaaagggtgggagagggggtgatagggtgggtcccgaggctggagaggcggctgtgcccgggtctgtggagctgcgacaatgatgaggagcctcccccccacccacttcccaccacatcacacacacaggctaccaaacctaccagcaggagctcgtccaggaggtccacgtagccgtctacggcggcgtcctgcagctcggcgacgtggcgccggaacagggcctcggcctcgtcccgagaaagcgcagcgtcgcgcgcccgaccctgcgcgtcgcgccgcagcgcaggccaggcctcgcgccagctggcgtctgcgnnnnnnnnnnggaaagcgcggcgtcgcgcgcccgaccctgcgcgtcgcgctgcagcgcgggccaggcctcgcgccagctggcgtctgcgtggcgcacgctctccaccagcagcgtggagaaggcagtggccgccgccgcgcgctgcgcggccagccgccgtgcgtcggcggcgcggcgctccgcctccagccgcctctcggcctcggcgtgcttggcctccagggccgcacgctccgcannnnnnnnnnggtggccgccgcggcgcgctgcgcggtcagccgccgtgcgtcggcggcgcggcgctctgcctccagccgcctctcggcctcggcatgcttggcctccagggccgcacgctccgcatgctgggccgcctccgccccctggagtgggcgcgatgcaggttgcaaacatggtcacggcggtcgaaggtcacggagannnnnnnnnntgccccctggagtgggcgcgatgcaggttagaagcatggtcacggcggtcgaaggtcccggagagggcaccattgcccaactgggcctgtcaagatcccaccatgcaatccacccgcagcacagcacagcagtactgtccctgcnnnnnnnnnnnnnnnnnnnnnnnnnnnnnnnnnnnnnnnnnnnnnnnnnnnnnnnnnnnnnnnnnnnnnnnnnnccgactggtgctcgccaaacagcgcctcctggcgttcgggggccacggacgcggccctggggtctccctgcaattccggctgcagctccgaccactccatcgacccagtcacctgcctctccctgagcagatccctgcgatgttgagttgacacgatgttcagcaccacgaaagctgcccctgcccgtaagccaagacaccccaacccttcatccccacccacagacacggccttgggacgcacatgaaggccttttcggcgtcagcggcaggaagctcctcgccgagttgctcgcctgcatctgcacccgccggcttcagccccggaggacccctcctaccgccgctctgggcaggcttcttcgcactcccctgcttcgcgcagtaggcttcgaaggccgccctccgctccgtcggaggcagcgcctgagggtcagggcatcaagcgagtgggactgtcgcacgagtggccctcatctccatgcggtgggaactcttgcaccacgcacaagcatgctggcccaaccagccccttgtgcgcacgaaatatgcacggctccaacctgacatcgcatccttgctcgccttgtatctggggtcgacctgcatcttgggcacctccttctcccagcgcgagaaggnnnnnnnnnnaactgtcgcacgagtggccctcatctgcatgcggtgggaactcctgcaccacgcacaagcatgctgccccaaacagccccttgtgcgcacgaaacatgcatggctccaacccgacatcgcatccttgctcgccttatatctggggtcggcctgcatcctgggcacctccttctcccagcgcgagaaggcgtggatgcccagcgcgcgcagcaggccctcgaacgcctccagcgcgacacgggcagtctccttccccgctgcaccaggcatttcgagcccctgacggagaatttctgcacccggtggcgttgcgccatccagaggtcgggacccgtcgcctgcgacgagggctgcctgcgcgggttgccccgcgcggcgaactggcggcgccaatccagcaggcagggtgggtggcgccatgccaggaggtactctggtgggtgccatggcagtgggcagttctggagtatccattcccgtgggcagtctgggcggagccatgccaggaggcgctttagccggtgccatgccaggaggcgctttagccggtgccatgccggcgggggcctggggcggagccatgccggcaggtgccttgggcggagccatgccggcgggcaggtctggctgtgtcnnnnnnnnnnaggtgccttgggcggtgccatgccggcgggggcctggggcggtgccatgccggcgggcaggtctggctgtgtcaagccgcccggagcttcagaggctgtggcatcagcagctgctgcacttactatcggtccagccggcgtgtgtgagacctctgtgctcccgggagtcgtggaggctgctgtgccagcgggagcgccctcctccgggatggcctctgtaaggccctggtccgtctccaccggcccctcgggttcttcagctccaccagaccccagcccagcctcttccgccgcctccgtcgccccgccaatgtcctcctccgtgaagaatacatcttcgtcctccacatcttgtccggccgcagcagcctcaggagcgggcagcgccaggagggggcctgcatccgcagcgccagcctgtggcatgaccgcgccggaggcgtgcgcaagcggaccgcggcccagccggattgtccgaagggctgcatgggtggtgaggtcagaggggtgggggaaaagtgggatggggcagtggctgagcggggcccagggctgaaactcaaccagggtagacactccaatggatgtgggaggggctgccataacaccagactgcagggaggggtgcctcatggccataagcggtagccacaccaagacccaggcgaggaacatggtcgaggcaggatcctcccctcagccaactgcactcaccgccctgatactcgggtgcnnnnnnnnnnggaggggtggggggggaagtgggatggggcagtgggtgaggggggcccagggctggaactcaaccagggtagacagttcaatggatgtgggaggggctgccatatcaccagactgcagggaggggtgcctcatggccacaagcggtagtcacaccaagacccaggcgaggaacatgatcgaggcaggatcctccccacagccgactgcactcaccgccctgatactcgggtgcggcctcggcccccatggcgacggccctcgccagcatggcagcctttccggggtcaagggggggtggccgattcctggccgccatcacctcgggggggaccttccaggatgtctcgctggtcgtcgtgtggtagtagtaccgccgcccatcggtgcaggtcnnnnnnnnnnnnnctaggtggggcgtaagtagtgttggagggaagcgttgtggtgctgtgcatgaggtttaatttgggggtttgactctgagaactgcacttcctcttccaaggtataatgacgggcagacatggcaaccagcaggcgtagatgtcctccctccgtnnnnnnnnnnatccaaggtataacgacgggcaggacatggcaaaccagcaggcgtagatgtcctccctccgtaccatgccccccgccccacctgcagaggcagggacgggcacggccgtcgccggcgtgggcaccccttcgctaaatcctgggggtctggaataagacgactcctccgtcagcgagttgtagtaatacacgacaccggcaggggaggnnnnnnnnnntgccgtccacgcagctgcagcctggcgctgcctctcctggtggtatttaaaggtgacaggagggtcccttgctgcaagacaagctcacggcaggaggttgggacaggtgcagaggcacgggacgtcctcgtacagggacaggacgctgcgctactcaaagtgtgtgcatgccatcaacttctaccaaccgcgcaccactcccgttccctgccaatcccaccnnnnnnnnnnctgcctctcctggtggtatttttaagagacaggagggtcccttgctggcagacaagctcatggcaggaggttggaacaggtgcagagacacgggacatcctcgtacagggacaggacgctgcgctgttcaaagtgtgtgcatgctatcaacttctaccaaccgagcaccactcccgttccctgccaatcccacctcctcagcctgactagggcggtgaggtggtggaggcctcacagggtttgggccatggtagggatgtgcctgggggtcagtgcaaggggccatggttggtcatgaaagggtggtcagtggcttggagctggactcccataaattctgagcacatactgccctgcaaaggcatccttgtgtcccacctgacttggaggaaatgcaaaccgaggctgaagaaaggggggtggtcccatcgggtgctggttggcattggggtggaatgcaccaggcggggtcccattagacctacatgcagcagcagatgttggtgagtagtgcggcggcactgaattcatccactccatccacacaattatctcctcgacagtaccagacgcctgagcatttgcccctcatgacacactgcaacagaacaaagctcctcttgcctccctcaccctgctggaggcctggcgggacgacctggaggaggatgaggccggtccatacccgagaatcagcaacccgttcaggtcttctcaaattccttcaagcaccatgccactgagtaggcatccgcggaagaaagnnnnnnnnnnaaggaggacgaggccggtccatacccgagaattcgcaaccctttcaggtcttttcaaaaaccttcaagcaccttgccactgagtaggcatccgcggaagaaaggcatcctgccggtgtcggtgatccttacgacatgagtgtaggcaaggaaaccagtgctcaacaaaacttttgtatagagatataacctccccaagatctcgatgcatcaagagtactgccgcatgcagggtgagcaacattaccttccattcaccgttgtgatcgggcaggcttggtcagagggagcgccttgtattgttttggcgccannnnnnnnnnccaacatcaccttccattcatcgttgtgatcgggcaggcttggtcggagggagcgccttgtattgttttggcgccaaaaactcgacccagggacgtctcggctggaagcttagcaagtctaagcagcatggcacagcctctctacccaccggtcctccctcctacttgcccaaatccttctcacgcgcactgcaaccatgactaaggaggaggctcaggtcgagaccgtcgaggtgaggtggcgtgacggctgatggccgggttggcgggatcccccatcgcatacatcttgttggtggagcctgcgtttccgcccatacaatatctaggcatgcggcggctgatctagcgttctgaggttgggctgcaccccgcaggatgtggccgacgacgacgacgtcgtgtccagcgactccgatgcggaggagaatggagaggccggtgagctcttggcagggcagtctcctgaccggattctatctgctttgcggatctaagggtagcgccgtggctctgacctctccccctcccctgccttccccatgggcaggcgatgatgagtcgggccgcagcaagcagagccgatcggagaagaagagccggaaggccatgcagaagctgggcatgaagcccgtgcctggcattgcccgcgtccagatcaagaagagcaagaacgtgagtctcctggtgtgaggcgtcctgagtggggcgtgaaccaatctgctcccggggtcctgaagcagggtttctgtatggcatggcctcctctgcgtattgcacagaacaatggaagtccattgctcacatcatctccccatgccattcccacctcccccagatcctgtttgtgatgaccaagcccgatgtgttcaagaaccccacctccgacacctacgtcatctttggcgaggccaagattgaggatctgtctgcccaggccgccgccggcgcagcagagcagttcaggtgcggagaggcgggttgagttttgtatcctgctctctggtggggcttgagcgtgatgctgcctcgtcgctgccggtccctgcgtgctgagtgcagcatcgtgcatgagcgcgnnnnnnnnnncgagttttgtattctgctctttggtggggcttgagcgtgatgctgcctcgttgctgctggtccctgtgtgctgagtgcagcatcgtgcatgagcgcggatgcatgctggcatgcaggtgcgtgtggaggctcggtgccaccccgctctccaccaggaaactctgtccattggcctcttctcatcccccaccgtcgaatgccatgccgacaggatggcggaggccatggcgagccggaatgagggcggcgccgccagcgccaagcccgccgagccggaggcggaggaggagggcgaggaggtggacgagtctggcgtggaggccaaggacatcgaactggtcatgacccaggcgagcgtgtctcgtagcaaggcggtgaaggcgctccgggcggcagacaacgacatcgtgactgccatcatggagttgaccatgtgatgcacatgcctgtagtggactgggagccagacaccgtggctgcggtcatgggctcgagcaggagtgcgggcccggggcttggtggggctgaagagtcggaggtcgggagtcttttccgcagaccagcgtgctgtgcactccgggggtacagattcccggtttcctggccagcagcacgcgcaatccgttgaccgggagaatccacgcaggtttgcaacgagctagatacgtgatcgcgttcgaagcaatcagatctccaggttgtcgaccggggctcgagggtgttggaaagtgccagatctccatggagtgtgggtgggaccctctatctgacgtgggtacaaccccctgcacaaggagcacgattgtcgcgatcaggacggaaagggatggacccatcgcagtacaacctacagatatgtcaccgcgcgatggactaccctctggatacctgtacgagatcggcgatgccactgcagatcgcttgggtgcgactgcttccagctggcatgtggcggcgaccgccacagccctccaccatgccagccgtgacgctcactaccttcaccccgctgcctcagcatggcgaagctactccttgccacacccccgacagacctgcagtccagactcggtgctgtggaaatcagcccctcttttgtactccaaacctcagcctatggaggctggggcacaagtgcagctcacctctcatgccctcccaagaaagacaccagatgcccagtggaatcaaatgttcgacgatcctgtcaaggagttcagggacgctgtgacgcagaccactcagtgcggcagtgacctttcaagactggaggcagtgaacctgagtctacaagacaggctggacagaggtgcgtggcttggtgatcatttgatgaggggagaaggacgatttggagctggcagtgaactccatcatgccgcacagcatgccccagtacccaaatcgcccccccatgacacccccaccgaagctcggactgccatggccgcagtcctgcagacgcatgccgggatgttgacaaggcaggaacacgctcaggcgctggacacggcggtggctgaagcactggcgcagtcctcacaagagggcagggacacggagggaggtggctcagcgcattgttgcagcagcggatccagtgtgtctggacagccactcgaatccctggggagcacccccagatcccatgccagggagcatcaggagtgcagcccagacgtgtgcgaggaactgtgcaagaagatcacagccctggaggtgggtgatgaagctcatggaaactgagtgaagagctgtctggtcagatagtactcagttccaggggccagaatccctgagccatcatcctgcttccgcaaacccctgcacaggcggagctccacctcacagaaaaatgctgggcccaggaagttcatcagttacagcagtacctgatacacctggagcagaggcgtgagatccagcacgaacgaaaggtgcacctgccagttccccaaagcaggcttcctggacggaatttgcatgctgcaggaaacgactgagaagctggtacgcagcgacactcagtttctcccgctggcctgcctggcacatggatcttcagaggctggtggcggcagtacaggtgggtagcgcaagatggcgctgcagagtgggcaatgatttggtttcccatgatgatacatgcttgatgagnnnnnnnnnntgatcttcagaggctgatggcggcagtacaggtgggcagcgcaggatggcgctgcagagtgggtcatgattcggtttcccatgatgatacatgcttgatgagccagacctgtgcctcccaatggccctggtgcaggcttttcgatgaatctttaaggctgtcttcccaaagccttttcaaacctgggcatcacannnnnnnnnncttcgatgattcttcaaggttgtctccccaaagccttttcaaacctgggcatcacatgcgatgcatgaagaagcatcttcctgtgtatttcaagcttccctcctgaggaacgacagccacgccacacagcgtcgtcgaacggcagcacatgtccagcgtacgtgtacaccccttgggcccgatgcaagccctgtgtttgttcattgtattcaaatgcaagcaggcaagggagggcagggtcatcgtgcgtaaaatcgcgttgccccgacctcacatggcgcacaggtgtgcgctgggcttggccggccccgccgcagggccggccccaggctgccgcagccgttcacgcggcggtcacagccgtggcagcgccaggatcctcgcccagcacggcgtccccggccgtcgcccctgcactcggctgtgcttctgctgtcgtcacggcgccgctggctgcggccgccgctccctgctgctccgtcgtcgtcgccgccgccatcgtcgctgccgtcgccgcctggctgggaggcccgggcaggagcgggcctatcacgtgctcgccgcaggagtacatggccgcggggacgtaggtctgcgcggccagctgctccttgacctcacggtagatggtcgccagctgtgcattgtgtgggggggggaaggtatcgaggggggttcatgagctgcgaggccagattctcattcgtgcaagtgggccggcaggcactcatggggacgtggcacagccccttccagggccggcagcccgaagcatggacacgccgtcctcgatccccattcagccccccctcccttgctggggttctgcaccaatgggactggcatgccctgatccaccgccttctcccccctcccttattcaccccccctcccccactttcctcctcccaagcccacctggtcccagagtcccnnnnnnnnnnaccgtcctccatccacattcagccccccctccctcactgagattctgcaccaatgggaccggcatgccctgacccaccgccttctcccctctcccttattacccccccctccccccctttccacctcccaagcccacctggtcccagagtcccgtcttgcgcgtgaccttccaggtgcgggcgcgcgggtggggggagtgcacggtgaaggcgttggggtgcaccacgaacagcgtgccctgctgcgccaggtgcagcaggtgcaccaccttgttcttgcggtaccccacgaagcgctcgtcgtaccagggcacgaagcggcgcgccaccaggacgtagggctcgtacccctcctcgtaccggatgtggtagggcgtgcgcgcagtgagccagcgcgcgtaatcggtcgcgcggtgccctgcgcggtagcggtccgtgtggaacggcttcagccgcccgtcgcgcgacatggcggccgccgccgccttgcccccgagcaccgcgccgcgcgccacctccacgcccacgtccccagcgtccccgggctcgaaggcggggagcacgatggcgcggcgcgccagcaccgcgccgcgcaggctctcgtacttgcgcggctgggccatgacctccaccagctccgcgctgggccagaagtcgacgtccagcaggaggaccacctggaggtgaggatgttgtccgtgggtggggaggagtggaaaaagttgtttctaaaactggcactgggaggaaggggccgggaggcaatgtcatgcgggatggacgaggccacaagcggcacccccccccccctacacacaccactccaacccacatcagtcttgnnnnnnnnnnagtgagtggggaggagtgggaagtgttgtttcttaaaatggcactgggaggaaggggccgggaggcaatgtcatgcgggttggacgagtccacaagcggcacccccccctcctccacacaccactccaacccacatcagtcttggcgttggccagggcccgattccgcatggagttgacggggtagaggccggacagccagacgttctccacctcctgggacacgagctgcaggtccagcttgcagatgcctggtgaagaatgggaagagacagggtgtacattggggactgtgggatgggaagcatggaagggaggcccagcgaggtggccgagtcgaaggcgagaacgatgcgacgatgcctgctttgctgagggctggaggcctcccacgctatgcgtggggccgaatatgaggcgaggagaggctggagatatcccgatccccgaaaccccattcacaactcaagtgctgatcctagtgctcagctcaaccaggctcatcctctcccttgcacaccccaagcacgcgagccagcgcattgccacacctttctgctccgccagctcgtgaaactgccggaaggcagccaccacccggctcagggctatgaggtgtgggtcttggttgctgttcagctccacgctcacggccttcccacccaccagggcgatgtacacggcagcggagatggtcccgctccagacgtcgcactgaccctccagcatgtacagtctgttgttgggagttggttgtaatcttggggtgggaaacaagagggggatggatgacggcacaaaagcctagtagcccaagcctgtgcaaccatgggcaaggatgtaaacttggacctcccactgcacagacccccctctttgaagtgtcaggaacactggggaggcgaggcaggnnnnnnnnnncctgttgttgggagttggttgcaatcttggggtgggaaacaagggggggatggttgacgacacaaaagccttgcagtccaagcctgtgcaaccaagggcaagcatgcaaacttggacctcccactgcacagaaccccctccctgatgtgtcaggaacactggggaggcgaggcagggatgcacatgcaagtggtgagcatcactgtgtcatctcaaacagaatcatgagccagccgcgcaccgctcgaaggagagctgtgtaaccagggtgacgtcggttggagcccgctccttccctgagctgatgctggcctccgttttcaggatgggcaggttggggatggcgtgcggcgtggggcacaagaactggtcgtcggtcgtgaggtcgccatgcgcggcagccagcaggccctggggagaggggcgcagagacaggtgtgtgtgcacagagcatagggttggttgggggctgcaaacagcagcaggtatcaaggagcgccccataccgccacgggagctgcgcaccgctatgatgagggttctcagcagctgcagccccgggatggagcgccccggtgccatttaaagcccggggagcagcaggcgggccaccgccgtgccgggtgggtcagagggatgaggagtctgcactgcctgacacctgtttgtccaagtatcaaggaaatacaatatattcctcaagatgacgacctaagtgctagcccgaggttcagacgccgtgcgggagtctcccggtagggcttttgcgcagagagtgcagagcaggtcccgcaagcgcgttccctcggggatggatctggagcagggtacacctcagcctactcgaacagtcaaggtatgaatctcacaggcctgggaacgctgtcggcggtgcgagcaatgtcgaggaagccattgtcgcacccggaaaccaatcaggttttggcgcgaatgggaagcattcaaagccgagcgggctgtctcctcgcatgaaactttctcgcgcgctgcggcccgcgctctcaaaagcacatcactaactttctcaaagaattcgatgagcgcgtgaacaggcaagtgccgcagtcggcatcgacagagtcatggtgggggagagcgatgccaggcctcagcgcctcatcatcaccgagatggtgctggaaaacttcaagtcgtacgccggggaacagcgtgtcggcccttttcacaaggtgggatggagcgcctgggttagcagaggtgcttggacgacatcggtacctatgtgcccgacattctgctcattgccatggcacctccctacatccacgcagtgcttctcctccgtggtgggtcccaacggaagtggcaagtccaacgtcattgacgccatgctcttcgtgttcggcaagcgcgccaagcagctccgcctgaacaaggtgtcggaactgatccacaactctgcggggcgccaaggcatcgagcaggcccaggtctccgtccacttccaagagatcatcgacacggtgaggggtgcagcggccgggcttgtacagtcggcgcagcttcttctctgttgcggagattgatggcctgggtgtctattactctctgcacagctgccagcaggctgcagcaccaccggcctgctacccgccccacagcctcgagaggcccacatcctcaaccttcctccaaaccaccagaannnnnnnnnntgctgccagcaggctgcagcacctccggcttgctacccgccccacagcctagagaggcccagcatcctcaaccttcctccaaaccaccagaacgatgatgaattcgaggtggttcctggcaccaatttcgtggtgtcccgaaccgcgcaccgcagcaacaagtccgactacttcatcgatggccggcgcagcaacttcacggaggtgacggagttgctcaaaggcaagggcattgatctggacaacaaccgcttcctcatcctccaggtgagtgtggccaaggaagaggaaggggtccatggcggtagccttggctctccttggtgaccggcacgctgagttcgctctgtgaacagaaagtgacagatctggacgtcctgcaacacaaccatgcccatgatgacacccaaccccnnnnnnnnnnaagctcgctctgtgaacagaaagtgccagatctggacatcctgcaatacaaccatgcccatgatgacacccaacccccaccctgcccacctatagggcgaggtggagcagatcagcatgatgaagcccaaggcccagaccgagcatgagacggggctgctggaatacctggaagacatcatcggcaccaaccgcttcattgagcccctggccgactccgccaagaggtgatgtggtcggttggggggagtggggaggaggatgcagacagggcttagggggtgtcacgcgtgaccaccggccgggctcatggttcacaatcaccgcccatggtagccccgttcaacccccccccccccccccccccccccnnnnnnnnnnctttgtttgggggtgtggggaggaggatgcagacggggctcagggggtgtccgcgtgaccaccggccgggctcatggtccacaatcaccgcccaaggtagccccgttcaaacccctccccctcgcgcgccgccagggcatctgacatcactgttacccctttctcacgatactgattcctcctttccaccccttnnnnnnnnnncgccgccacggcatctgacatcactgttacccttccccacgatactgattcctcctttccaccccttctcaggctggagacgctgggcgaggcccgggcggggctggtcgcgcggctgaagatcgcggagcgggagcgcgaggcgctggaggcggataagctggctgccgaggcctggctggacaaggaacgggaggcctgcgccgcgcagcggctgctgagccacgtgctggcgcaccaggcgcaaatgaatgtggacaagatccagggcaaccaggcgagcctggaggggaagctggcctacgagcgcgagaagctggggcagtacagtgcggtactggaggagcacgaggccaggtgtgtgtgtgttgggggcgggtgagagggatcgggtgggtgagagggatcgggggtggtgcattggaatgaggcagggcttttgccctgtgctctgccattctccgggcatgtcatcccctgtcattggcatgtacagttcatcgacgccacgccggccctccgacccccccccccccccnnnnnnnnnntgggggtgggtgagagggatcggggttgatgagaggaacatgggtggtgcattggaataaggcagggcttttgccctgagctctgccatcctccgggcatatcattccctgtcattggcatgtacaattcatcgacgccacgcctgccctccgaccccaaccccctgaaggtacgacgctgcgtgcaaggagcatgcgggcatggcggcggcactggagcgcgccaacgaggagttcaaggagtacgagcgcaaggacatcgcgtaccgcgaggagctcaagcacctgaaggccaagctggccaagactgcggagcgcgagcgccgcgacgccgcgcggctagagagcgcggaggccgaggccgcggcggccgaggccgaggcgccggcgctgctggaggccgcggccaaactgggcgcgcagctgacgcgggaggaggcccnnnnnnnnnnataccgcgaggagctcaagcacctaaaggccaagctggccaagactgcggagcgtgagcgccgcgacgccgcgcggctggagagcacggaggccgaggccgcagcggctgaggccgaggtgccggcgctgctggaggctgcggccaaactgggtgcgcagctgacgcgggaggaggcccggctggaggcggcgctggagggcgtggcgggggagggcgagacgctgcgcacgaagctgcgtgccgcgcgcgcggagctggcgccctgggaggcgcgcggcgtggcggcgcgggccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggagcgcgagctggtgcgtgccatgcgcgacggcgccagctcggcgctggaggccgcgcgggacgaactcgaggaggcgctggggcgcgcggcgcgcgagcgcgaggcggctgcggagttggaggccggcgcggggggtctgcgggacagggtgtcgaccgcgcagcgcgccgtgagggaggcagagcaggaagctcagagggcggagtccgccgcgcgaaccttgcgtggctctgtggcccagcgccgggcggagcggacctccgccagctcggcctcggcggtggcccaggccctggcctcggccaaggcgcgcggtgccatcccggggatctacggccgcctgggtgacctgggcgcagtggacacgcggtatgacgtcgcggtgtcctcggcggcccccgcgctggatcactgggtggtggacnnnnnnnnnncgccatcccggggatctacggccgcctgggcgacctgggcgcggtggacgcgcggtacgacgtcgcggcgtcctcggccgcccccgcgctggatcactgggtggtggactccaccgccaccgcgcagcgctgcgtggagctgctgaggtcgcgcggactgggcgtggccacctttctgatcctggaccgccaagcggggctggcggccgcggccggcgcaccgccgcccgnnnnnnnnnngcgccgcgcctgtacgacctggtgcgttgcggcgacgagcgcatgcgccccgccttcttcttcgcgctgcgcgacacgctggtggcggccgacctggaccaggccgcgcgcatcgcctacggcccggacccnnnnnnnnnnnnnnnnnnnnnnnnnnnnnnnnnnnnnnnnnnnnnnnnnnnntggcggcgcgtcgtgacgttggccggcgaggtgatcaacgaggcggggaccctgagcggcggcggcgggcggcccaaggggggccgcatcgcgctgggtaccgccgcgccgcgcgccggcgccgcttccagtggnnnnnnnnnnnnnnnnnnnnnnnnnnnnnnnnnnnnnnnnnnnnnnnnnnnnnnnnnngctgcggagctggcgggcgccgagaaggagttgggagaggcggagggggtgtcgagtcgtgcggcggaggctctgtcgcgcgcagaggcggagttgacggcggcccgcgccgcgctggcgtcgtccgagtcggcgctgccgcgtgcacggctggacgcggaggccgccgcgg

SEQ ID NO: 42300 - DNA, 7066 bp, Chlorella protothecoides
  modified_base (136)..(145): a, c, t, g, unknown or other
  modified_base (461)..(470): a, c, t, g, unknown or other
  modified_base (680)..(689): a, c, t, g, unknown or other
  modified_base (1011)..(1020): a, c, t, g, unknown or other
  modified_base (1498)..(1507): a, c, t, g, unknown or other
  modified_base (1698)..(1707): a, c, t, g, unknown or other
  modified_base (2485)..(2494): a, c, t, g, unknown or other
  modified_base (3128)..(3137): a, c, t, g, unknown or other
  modified_base (3653)..(3662): a, c, t, g, unknown or other
  modified_base (3769)..(3778): a, c, t, g, unknown or other
  modified_base (4020)..(4029): a, c, t, g, unknown or other
  modified_base (4788)..(4797): a, c, t, g, unknown or other
gtgcgagggtggggggtggggggggagggatgactgcttgccggtgcacaggggagtcacaacgagggctcagaggcgtggggatgatgcattcggacccacccacgtctcacccatcatgcaccctcaggcgcgnnnnnnnnnngggatgactgcttgcctgtgcacaggggagtcacagcaagggctcagaggcgtggggatgatgcatttggacccacctgcgtctcacccatcatgcaccctcaggcgcgcggcggccccacccgcatccccgcggaggtggtggtgcggcgcaagcagcacggcagcggggagtgggatgtggtgcgcacgcgcggccacgccgacgaggtggaggagctggggggcacctcggtcgccgaggccggtggtgagcggggtgggggaagtgggggaggcatgtcggtccccgcctgcggccctggcgcccacgcccnnnnnnnnnntccggcggtgagcggggtgggggagtgggggaggcgtgtcgctccccgcctgcggccctggcgcccacgccctcggcaccgcaccatgccggtctgggcgcggtcgatcgcccgcgccgccgtccagctccagccgaccccccccccccgcaacccatgcctcaggcacgccgcgccgacagctggtggtgacggagggcatggtgctgnnnnnnnnnncagctccagccgacccccccctcgcaacacatgcctcaggcacgccgcgccggcagctggtggtgacggagggcatggtgctggggacgggggccttctcccgcgtctgcgtcgcgcgtgacgaggccaagggccgcacctttgccctcaagcgcatgcgcaagtctggcgtggtgcagtgccctgagcatgtcttctgcgagcagaccatcacgcgcaacctgacccaccccttctgcattcggcagtacgcctccttccaggtaatgaaaagaaggggggggggtcctcggatgatgtgcagctttagcatctcggagannnnnnnnnnccggcagtacgcctccttccaggtattgaggggggggggatgtccttggatgatgtgcagctttagcatctcggagagcgtcatgttggcaggccctccttcgccgcatgaggaacctttccgacctcagcagcctgcctctacgaggagagggcccagaggaggtcgctgtcttggtgcgcgacactccctcaggcactcacgccctcccccccccaaaaaaaaaaacaaccaggacaagtaccacctctacttccttatggactacatgggcggtggggacctgatggacgtcctggtggcggacgcgcacgtgatcagcgtgcgcaaggacgccggcggcgtgcgccagggctgcttcgcgcccaaggtgggcggtgcccggcgggggccctgcgtgtccgagggggacgggcaagtgcggtccctcagattggtgttcccggagcgtgcgggcttcactgccacgtccatcgcnnnnnnnnnnctgcccggcgggggcccggcgtgtttgagggggacgggcaagtgcggcctctgagatcggtgttcccggggcgtgcgggcttcactgccacgtccatcgccaccctgggcccgccgtcgcctggggttcccatccctccacacagcatggacgcttcactgatgcgccccgctctccaccacacccccgcnnnnnnnnnntgggcccgctgtcgcctggggttcccatctctccacacagcatgaacgcttcaccgatgcgccccgctctccaccacacccccgccaccgcccgctaggtcaaggtgctcaagggcctcgacaactcggtggcgcgcttctacgtggcctccctggtgctggcgctggactacctgcaccagcacaacatcgtgtaccgggacctgaagcccgagaacgtgttcatcgacaccgggggccacatcaagctgggcgactttgggtttgccaaggcgagccgccggttgagggggttgtggagggtcgagggggtccgtggcctgaaggtcttgggcatggattactcagtcatgacgcatcccaaccccgtgcacgcgcagccgctggagaacgggcgcaagacctacaccttctgcggcaccccgggctacgtggcccccgagaacgtgctggcccagggctacaacttctccgtggactggtggggcctgggcgtgctcatgtacgtgctgctgacggggcgccagcccttcacctcgcccaagaccgacgaccccatggtggtcatgcggcgcatcgtggacgagaagttccgcatcgccttcccgccctacgtccaccccgtcgccagggtgaggggttccgtcgtgctttcgtggggggggttgctggcgcgggggtccgatggaaggagtccgtgcgcatgtcgccacgagtaggtgaaagtgccgggatgggccccttgctgccccctcgcgctctcagcgtccctccctgnnnnnnnnnnctgtgcttccgtgggggggggggtgctggcgcgggggtccgatggaaggagtccgtgcacatgttgccacgaggaggtggaagggccggaatgagccccttgccgccccctcgcgctctcagcgtccctccctgcacccgattccgatcctgtcccgcgtgcaacaccccttcaacacaccctttccccccatcctgaacaggacctgatcctgaggctgctggagcgccggcccgcacggcggctgggcatgctggcgggcagggcgggcgacatcaagcgccacgcctggttcgagggcttcgactgggatgcgctggaggcgcgcaagatggaccctccgcgccgccccaaaggccaggatgccaccaagcgcattcaggagctgacggtgtgtggtttaggcgggtgggtgggtgggaggcggatggggggggaaaggcgggggaatgctccctgtacctgagactatgaggggaatggtgtgtgtgatggtggggcccagactccatggcctgctgccatcgggcacatgggcaggttgtcaagggaagcttcaggtgcccctgttcaagcatgctcactggcggcccccccacaccgcaacacgacccaggagggggagcgccacgannnnnnnnnncgtgggttaggcgggtgggtgggtgggaggcggaatggggggggaaggcgggggaatgctacctgtacctgagattatgaggggaatggtgtgtgagatggcagggcccagactccatggcctgctgccattggacacatgggcaggttgtcaagggaagcttcagttgctcctgttcaagcatgctcactggcgcccccaccaaaacacaacacgacccaggagggggagcgccacgagaagccccaccaggaatcggcggaggagatggaggagtgcgaggccgtgtttgcagacttctgagcggcacgtaccgccggaggctccggcaactccgccgggcctcattcccctgctgaatgggagtttccccaacatcccacaaatactgttgctataccctgtagtgcttcccacaactgctccacccatgcaatgtccctgcttgaccacatgttgacgttcaggactgtattcgcggaaaggagacggcctcgcttggctggtgcaggaggnnnnnnnnnncgccgccggaggctccggcaacgccgcccgggcctcgttcccctgctgaatgggagtttccccagcatcccacaagtactgttgctataccctgtagtgcttcccannnnnnnnnntgacggaggaggtaacccataacagtgcaccctgtgggaatgctggcatgagtgagaacgccctcgacgcccccatatggaatatgcagcgcatcaaagggatggcaggagagcttcggtgtccgtctcgccggtaattgctcaagggagggagggcatgtcatgcagttcaactcccttgacatgaagtttgggcgcgcaaatgcctgacaagcaaccatgccggatctcgatcttgccannnnnnnnnnggacgtaggaggtaccccatgacagtgcaccctgtgggaacgctggcatgagtgagaacgccctcgatggaatatgcctcgcatcaaagggatggcaggagagcttcggtgtccgtctcgccggtaattgctccagggagggagggcatgcaacgcagctcaactccctcgacatgaagtttgggcgcgcaaatgcctgagaagcaaccatgccggatctcgatcttgccaaagtcgttgaccaggccttgctcgctcgccgaattcgcaagactgcaccgccttggatcctccgacgtgcatcctcggtgtgtcgtggccagggcaaatgggggaggcagcagcatgcaaccccacttcgtccgactcgccctcggcaactgaggaagacttgctcgcccagctcacgtactttgaggcgcgcgccgacccccaggatcctgagcaggcagccatgctggacaagatgcgggagcatgttcgcaggctgcgatacgcccggggggactggaacaagcccagctgcaaccgggactggaacgaccccaccccgcccagctccgcgactgctcccatggccatcgactcctacaggtgcggaatgttcatgtaatgcacgttgacgaacgttttgctctgctgggatcgcgccaggccgtgctggggacgggactcgggcacgtggaggttgtcagcccggcacacccccatctcatgattgcagggcgtacaagaagcacattgggagcgaccaggcgnnnnnnnnnnagtggaggttgtcatcccggcacacccccatctcgtgattgcagggcctacaagaagcacattgggagcgaccaggcggtccccctgctacgccaagcatccctttgaagggatcgcatggcgccatcgctttgaccctcctgcacacatcacagtgatacccaagcacccgccctatacccactgacagtgatgtctccccttgcccgcatgtccttcattgttacaatgccgcagcgtgtaccatacaacaccctgcgcaccacacagtcgagaggggaggggtctacgcttgaacgcgtgtgggggggatggagcttgggggattgcgagcgtggtggcgtgcgtgaacaggtccgcatcccccccaacgttgctctcacgacacgccctcctgcgtcagcctgccagcacgccgtctggcttggcgtgtccgttctgggcggcctcgtccaccggctccagcatgctcatgctgtccagcacgtggtccaggaggaaagcggagcgcgccaggcggtccaggcgcgcggcgtggcgctgggtgtagggcgccagggcgtccacgatgccggccacgcccggcagcgcgcacagctcgcccggcgcgtggctgcacagcacggcgcgcagcagcgcggcagccgcgtggcagctgcgcgtgtgtgtattccagtcgcgcacggtctccagcaggcgccgcagcgcctcgccccgcagcggcgccaccagcgggcgcagcatcgcctgcatggcgtttgcacgagggcgaggggtctcggcggacgatgcgggagcgtggagatccgcgccgcagaatcagcgatttgtggcaccggaaaatgctcgaagaatgagcacatggcccgatcccagagcacaagtgcctccgcctccgcctccaccacaatacccagcccacctctgcatcagcgggctcgtctgcgccctccagcacgttgttgaccaccgccagcaggcggcgcggctggtcccgctccagcgcggtcttggccgccgccgtccaatcgcggtcggccagcgcgttggcgtaggcctggtcggccgccacggccgccgcccccgcggcggcggcctccccacgatcttcggcagtggcgtcagcccacagcacgagcctgccgtcgccaccgccagacaccagctgcgcgccgtcgccgcgcgcgtccagcgcccagaccttgtcctccgcggcatccagcgtggccgcggcctcccccgcgcgcgcaccccagagcttgaccaggccgtcggcgccggcggagaccagctgcgcgcccaggctgacccagcacaagcgcagcgcggaggcggcgtggccctccagcgcgcgcaggcaggcgccgtcggccgcggaccagatgcgcaggctggcgtcggcgctggccgtcgccaccaggcggtccacgggcgagaaggccacggaccagacgccgcggcggtgcccgcgcagcgtggcgaccagcaccaggtcggcggcgcgccacagcttggcggtgcggtcctgcgaggcactggccaccagcgcgtcgtcgggggagacggccaccgcgttgacgtcgcggtcgtgcgccgccacggccgccacggtgcgtaggcgcaggggtcggtcggaggtggtgccgtcgccgtcaccgccagccccgccggccgtcgctccgacgacggcgctggtgtcccagaccttgagcaggcggtcggagccgccggagacgaggaaggcggcggggcggcggcgcgagaaggccacacccgccaccgcgccgacatggccctcgcccagcgccaggcaggtcccggcgctcacatcccacacccgcaccccgcagtcctttgaccccgaggccagcagctggagggcagagcggttgctttcgccgtcatttactcccgggggggccgccagcagcgctgcgtccagggccagcacggcggccgagtgccccgccaggctggccaggcagtcgaaacggggggtggagaagacgcggatgacgggggagttggtggccaccgccacgcaggcgggggaggggccggcgccggcgccgctggcgcgccgctccacgaagcgcacgtcggtcacctcgtcgttgttgcccaccagctggcgggggggggcggccacgccggaccccggcgcgtgcaccagcaggcgcccgtcctgcgtcgctgcgaccagcgggaccggctgcccggccgtatgtaggccccgcccgccgcccagcagctccacgacgcccgtgcc

SEQ ID NO: 42301 - DNA, 61 bp, Chlorella protothecoides
gcagcgtggtattcttggggtgtggctgggggccagggaggggggagggggagcagtccag

SEQ ID NO: 42302 - DNA, 408 bp, Chlorella protothecoides
cgcctcgatgaggaagaggtgggtgggcggcgcgggcgggcgcaccatgtactctgcggtggccaccatgtccacactgccgcagcacagctcggggcggtcggcggcgtcgcggcgccgcccctccatgtccagcgggcaggcgtagccgggcggcacgggctgctctgcgccgcaaaagttgcagaccatgcggccgccgtcggccacgaagcggaagtaagcgttcacgtaggccttgcactcggcgcagcgcacggggccgccggggcccaggtccaccgtggggatggggtcgtcgcgcaggccaggcgcggccatggggttgatcaccaggccgaagggcagcttcagcttgcggaacagggcgggcgtctgggaggggtgatggttttgggggggggtagg

SEQ ID NO: 42303 - DNA, 61 bp, Chlorella protothecoides
cctttggccgggacttgcagagctccagcatgaagttcatggccgcagtcttggtggagtg

SEQ ID NO: 42304 - DNA, 440 bp, Chlorella protothecoides
  modified_base (162)..(230): a, c, t, g, unknown or other
cggcggcggcctcggcgtcgtagccctccaccgggtccagcagcgccttgcgtgacaggcgcagcttgccgccgtccagcacgtccaggatctggacgtccacggcgtcgcccacggcggccacgtcggcggcgaggcggggctggggcgcgccccgcgccnnnnnnnnnnnnnnnnnnnnnnnnnnnnnnnnnnnnnnnnnnnnnnnnnnnnnnnnnnnnnnnnnnnnngccgcccactcggagaggtgcagcaggccctcgcgccgcggcgccacctccaccagcgcgccaaagggcagcacctgcgtgacccgtgcgccgcgatacactcgcccccgctccggctcgtccaccagggccaggatggcctcggccgccgcgtcggcatcagcctgcgagtcggcgcggatggcggcccaggccggggcgggcgcgccg

SEQ ID NO: 42305 - DNA, 61 bp, Chlorella protothecoides
gagccggacagtccccctgtcatcaaccccgaggtgtcctgcaccaagctgccacactggg

SEQ ID NO: 42306 - DNA, 72 bp, Chlorella protothecoides
aaagattgagtacatcctttgggtccactgttacactcacaatacttcatactcctttgtggccgcggatca

SEQ ID NO: 42307 - DNA, 147 bp, Chlorella protothecoides
gggggggcactagatggtgaatatggtttgggggcatcgacacaccctatccctgacggcctgcatcatcacaccaattcaagtgtgcgaggacatcctaagacaccatgctctttttgttcttggaccatgccctacccccaccat

SEQ ID NO: 42308 - DNA, 100 bp, Chlorella protothecoides
ggcgtcctcctccgtcacaccgcccacgaccagcgcgtcgtcgtcctcctcctcctgctccgccgccagtgccgcggcggcgtcgccctccaccccgtcc

SEQ ID NO: 42309 - DNA, 61 bp, Chlorella protothecoides
cagggccggccaacctgcgctgtgctaatgccaatgccccgctctgccgcaagcccccctc

SEQ ID NO: 42310 - DNA, 129 bp, Chlorella protothecoides
gctccagccgcaaagaagcgcggtcgcccccgggcgaccgccagcaaggtcaaaacgtcgaggaggcgcgtggacgaggcgccggccaccctcgacccggacactgctgcgggtcccgggccagcgctg

SEQ ID NO: 42311 - DNA, 105 bp, Chlorella protothecoides
gtgtccgcgcggaccaaactcggtcactgccacaccaccctaccttcaccgcaagccggcggccgtcaaagccgatggcttcgtggacctgtgccaggctggcgg

SEQ ID NO: 42312 - DNA, 64 bp, Chlorella protothecoides
ttttgaaaatttatattcaatcttttttataatattttgaaaattgttcatatatatttttttt

SEQ ID NO: 42313 - DNA, 61 bp, Chlorella protothecoides
cggagagtacgacgaggcgggccccggcgcggtgcacatgcgctgcctctgacggaatggc

SEQ ID NO: 42314 - DNA, 61 bp, Chlorella protothecoides
tggggggaggaggcacgctggaaggcggcggcttggggctggggctggggctggccttggg

SEQ ID NO: 42315 - DNA, 61 bp, Chlorella protothecoides
gtgtttggggtggcatcctgtatgggcgggggggaaaagcagcgtggaggttgttgcagaa

SEQ ID NO: 42316 - DNA, 61 bp, Chlorella protothecoides
ctcctggcgcgagggcctggtcctgcacgggctggggtacaaggacggcggtcgcgtgcgc

SEQ ID NO: 42317 - DNA, 106 bp, Chlorella protothecoides
gggaggaagcatcagagggctgggggggggcaggtactgggggggcagcagctggcaatcatcaggccacccctgtgaggagagttcgcagacctgtacacatcta

SEQ ID NO: 42318 - DNA, 83 bp, Chlorella protothecoides
cgggtgtcagaaaatgggcacgagaggggatgagtggcgtggtgtgaggaggagggggggggggggaagtgcagagccaggag

SEQ ID NO: 42319 - DNA, 61 bp, Chlorella protothecoides
gctttcatggctcggagagccaccacccgggggcaccacctccccatcctatttctgctgt

SEQ ID NO: 42320 - DNA, 10521 bp, Chlorella protothecoides
  modified_base (1072)..(1081): a, c, t, g, unknown or other
  modified_base (2722)..(2731): a, c, t, g, unknown or other
  modified_base (2825)..(2834): a, c, t, g, unknown or other
  modified_base (3587)..(3596): a, c, t, g, unknown or other
  modified_base (3951)..(3960): a, c, t, g, unknown or other
  modified_base (4135)..(4144): a, c, t, g, unknown or other
  modified_base (6408)..(6417): a, c, t, g, unknown or other
  modified_base (7475)..(7484): a, c, t, g, unknown or other
ggggttggggggagagggcggggcggtggtcatgcgtgccgacttgtctgtgcggcgtctcaccacgccccgaccgcaggcggctgcagggcgcgtgccgagctcatccgtgtgcaggctgcccaccttctctggcaggtgctcggcgaggaccggcaggcgctcggcggcggccttggcgctgtgcgccagcgcggcgctctcgtcgcccaggccctgcttgagggacgccagctcggacgcccagtcggtgtcgtggatggaggccgccaggtccgctgtggtctgcttcacggtctcggtcagggtggaggcgaagccccagagacccgcggcagccgacttgggggaggccctgcaagtgaggaagcagggggctggttgaaggtgagcccaggccgggtaagggacccctccagatggtcaatgactccggcgctggaaatcacgctggcatcccaggctcacgttgacgccgaggccccatcctgaggagatcctccaccctgcgacagagcaggagtggggggggaccggccttgatcctcgcatctcggaagaggcgatgtgcagctcgcgctcaggttcccgtcacgctcccaaacttacatcgtccttactgggttctccgcggagggcggacgtcaatccagagaagctgaacatgaccccaaccaagtgtgaacgacacgacgggcgtgggcgcacgagggactccctacgcagccctgtcctggaggattaagttcaaaaaccaaagaaattaaaagtctttcacactgcaggagcaaaactgtccctgaagatgaggtgagggagggtgctggtcagcggggagaattgattctcgacttctccgagaatgccatcccaccagctttcctgcacatgtaaggcgttcaatgtcagctatgtcaagcccacccaggctccagctcctgtcattgagtcgtgagcaaaggcgtgacgggtatcacactagagagatgcctaaaaagatggtggcgtattgcattggtgacatacgagcgagtcgtgaatcaagcacacacgaacgctgctgggggatgcnnnnnnnnnnccacactaaagagatgcccaaaaagatggtggcgtattgcattaatgacataccagagagtcgagaaccaagcacacacgaacgctgctgggggatgctgctccaccaggtcatttatcaccatctcaacgcacaaatgagtagatcaggggaggtattcacgttatgatgtgttgtataaggtgggtagacagttatggagcagtttgggaggagcacgtgaactgctacaagttgatctagtcatgcatggcttgggccacatgcatcgagcatcacctcagcaggtaaattccacactgaaaggcaacgagtacgcgtgtgtttgcatagcagtgaatgggccgtgctgtcattgcaaacgtgtgttacatcaaagcatctgatcgaatctagaaccacagattaatgaagtcatgtctagaactgcactgattgccacaggggaatgttacatagtggatggctgcaagataagccctggagatttggacaaaatccttgtatctcaagggacgtctggacactgaagtttcttcaggggcaagtctgcagctgttcttgcaggccctctcggcaaggtcccagcgggcgcgcgcgcgagtctccgagtgggaagcataggtgcgcaaggccaataagctttcgatcaagcaccaactcaacacatcaaagcagctcaccgattttcattctttgcatgcaataaaccctggcagtctcttaaggcccagtcacacctccacatgggccgtcgacgagggaagaagggagagaacgcaggcgagaatgccgatgaggccgacacaaaaacagcagccgacgtgcagggggacccactgagggccctcatcgccatcagccccacgagcggcagcgtagctgtggcagccggtccagaactcagggtgctggctcgaagtgcagcagggtgggtggcaatgtgccagcatggggagtgttggcagggctggctgggggggtgccgcctccaatgacgctagcaatcaaccagacttcctccattccttccacccagtgcctatgattcgtccgtcagggtcttgcacgcgcagcaaccccaaccagggccctctgcgatccgcacgcttgcatttgatggcagtggggagttcctcctggcatcgacggacgccaaggtgctctacgtatggaggacagccacctgggagctgcaaaataccatgtgagggtggtttcggagggacctcggactgaagagaatgagcgtgacattgctggggctccgttggctgtatattgcagccctcattggcgactgtggccgctgagcaagcctcgttgctcctgtctgtttacagaactcacagctggtacctcccctgcattacccacccctgctgctctgccctgcgcctgcctccctcataccagcaagctgcccaagcgtgcgacgtcaatggccttcacagccgacaaccagcactggctgctgtccgacaagtatggcgatgtgctggtggcgccgctcgcctccaaacaatccggtgtgtgtcgtggcgctgctgggcgaggggaaggagagctcgcaggcggcccagtgccccctcatgtgggaccacttacccctcacgccttaccagccccttgacccctctnnnnnnnnnnttcctgtctgtttacaaaactcacagctggtacctcacctgcattacccacccctgctgctcagccctgcgcctgcctccctcataccagcaannnnnnnnnnttgttgggcgaggggaaggagggctcggaggcggcccagtcccctcatgtgtggcctcgtaccactcacgccttaccagccccttgacccctctccctccccttccaccctttctcacactccgcaacacttcctccctcctctccacccagacctcgtgcccgaggtcctgctggggcactgcagctccatcctgacctccatctccgtcccccacgacggcgcgctcatcgccagcgccgaccgcgaccagaaggtgcgcgtcagcaggctgcctgtcggcgccggggtcatggacggcgcgccccacatccagtccttttgcctgagccacaccgacgccgtcaccgcggtggccttcatcacacacgaggtgggctgctgtgtcaggtggccagggaagagcgggagagcgtgggctttaacaaaggaggagtggcgggcggggtgtgctgcgtctggggacagccctgctgggtgcagatcgtacatcagccctgggcctgctcgattctttcccaacactgcatcagagcaggggattctgggaccgtcatccctgaaatgtccactgcaactgcccagctcctcaccctccccaacctatgcctcctcagggctccactctactcgtcagcgggagcgcagatgggacactgaagctctgggacccgagcctcggcgacctgctcgactccctgtccctgcccgccgcgggggtcgcgggggcagggaccacgcccggcacagacnnnnnnnnnnaacatgctcgactccctggacctgcccgccgcgggggttgcgggggcagggaccacgcccggcacagacgacgccggcgcggcgacggaattgggagcaggagcggcctcggcgggggcccccaccgacgcggtcctgggcctggtgcccctccctgggacaaaccaggtcgccgtgctggtggacgcccggcacgccgtcctgctggccagcgtggactttggagcgcacgcgctgagctggcgcggcgctgcgctggacctggcgccgctgcagcccaccgacgcggccgtggacggcgcggggcggctgtggctcgctgcggggccctcgggcggcgcgggcaccggtgctnnnnnnnnnngcgcggccgtggatggcgcggggcggctgtggctcgcagcagggccctcgggcggcgcgggcaccggtgctgccctggcgctggccgagtcgggcggccggggattggagcgtgtcggcccggcgggcgtggagggcctgggcatggctgcctggtcagagatgcagggggatgnnnnnnnnnntggccggggattggagcgtgtcggcctggtgggcgtggagggcctgggcgtggctgcctggtcagagatgcagggggatgtgggcggcggcccagggaagccccgccgcctgctggcccacctggccaaggtgccgccgtcggaggaggacgtgaacttccggaagaggcagcgccgggacctgcgggggggttgaggcgctgcagagcggccgggactggccctggcgggcgccaggacgcggtgttcatgcagatcactgcaggcccgtacctgcctgcccaccgtgcagccccgtcttttgagtgggtcagttcaacgaggaaaacgagcaagcatactcgagctatcgaggggcaacgacagctgacgctcacacaggcgaagaggaggatggggtccgccgccagctcggcgtgcgcatcgaccagccgcaggcgcctgtccctcggggtcaaagcgtggttcccaaaatatgcctcagtccgccaccagccggctcagggcctctatgaactgcttgaggttggccacgaccctcttgtcgcccgacagcgtcccgaactcgcctgggcagcagggaaggcatggggagcggcttggctgtggcaggagtgacgtctcaggcggccgagaagaacagcctcgcatctattgtacatccccagaacggcccttaggcccctcctgcaagattatcaagctgacgcagcacctaccattcctcttctctcccctacaggaatatcaaacaatcctacaatgacacccccccacaaaaaaaaacaaacaacaacaaaacacacctgctatccgctcgatgtgggcaagggtcttggtcagggtctggaccgcctcccggagcgcgcgcacgttaccgtcggtgagcacctccacctgcagccgctgaatgtcggctgccgcctcggccgccaccgaggtcagcgcctccacgttgcccagcaagcccccctgcctcagctcctccagcagagggatgatctgtgtggaaggggggttggaggggggatttgaagggagggggtggtcatttacctactggaccgcatgacgctcggaccaaacaccgctgctctccctgaagattccacacatgcgcacatccagcaaggaagccgccgcacacctgctctgtcagcgccatggcgcgctggagaaggggctctgcgccctccagcgctacctgggccgcgtccacggcagagaacatgcggtcgagccccgcggcatccatctgccgcgcgatcttggtgcagatgtacaccaggtcgtccatggccacgcctggggagcgggtgcgaatgcaagaaacttttgttacgggggggcccagggggttgaggcggtgctttgcgcaagggaggtgcccgccgaggggcggcaggagacgagggcgggcgggatgggggcacacggcctattctccccactgcggcacacccctgcccatcccctttgcactaccagaagaggtcattccccggacacacctcgctcgccgcggatgcggccctggtggcacaccaccttgccctcctcctcgcacgagtcgtccagcgggttgcctgagcagcgcggggggcaggccaggggaggctgtcgagggccagcggagcggccgagggtgcaggtgccttggtaccaagcagcccccaccccggtcccacctctcccacccccctcgcaaagcagctcacccttgtactccggcagggggagctggggcgtgatgtcaatcagcggctcggcgatgagcccgctctggttggcctcgatcagggagttgcgggggatgacggtggtggagtcgcggatctccaccagcacctccaccttctccaggctgggctgcacgcccagcacgccacccacgggcacgccccggatgcggacgggggtgcccaccgagatgccgcaggccacggggaactccaggatggcctggtagctctgcccgcgccgccccatgttgttgcccttggcccacgaggccagcatgaaggccatgcctggagtgtgagggcgggggggggtgaggagaggcatagcgaaatgcaggacgcgaggatgaacggaggccccagcaaccatccctgggatatacaccccgcccgggcaacctccacccccactcgtgagaaccggcagactgcccatgcaaccctcccctccaggctgtccctggcccccatgccaacgcctgccacatccaatcctcgccgactcactgatgccggcgatgnnnnnnnnnnaggcaacctccaccccacttgtgaaaaccggcaaactgcccatgcaaccctcccctccagactgtccctggcccccatgccaaggcctgccacatcccatcctcgccgactcactgatgccggcgatgacgaacagaccattggtcgcctgccttaggctggtggcccccagcccaaagtcacgcaggggctgaagcagggccgacaggaagccctgcttgcgaggtggctccagggaggcgggatccatggatgcgcttgccctcgtgctcgctgggaggggccgacaccggcgcaggcgggtggagggagccagcccggggagcactggccggaaccactgcccattacataccccggagcccgcgccgcaggggaggaacgaggctgcaccaggaggcctggtggacaggagctgcatggcgcgtgcttaccagggcatgcttggcggatctctggtgtgagtgtttggaggtgcctccccgattgatgtctgtcgggacacgatgatcgctttccggcgtgctttccagcgggagggggagtgctacgttatgttacaatgcacatgggggcggctcccacgctatacaagcacactgtgtttgcagtgcacgacaaccatggtcatcatcggcatgttgccaggccgactagtcggcgcggcagccttcagattcggtgatgagggcgctcaccccattgtcatggtcgctgcagccatggtggcgggtccattgtcaggtggccccatgccccctgcccagtcagcatccgtttggttgtggggtttggcaccctggagtgcctggtatcgtcgcttgtggggcttggtggcttggtgggtgctgagcgctgcctccgagatgaagtagcggctgcagggaaggcagaagaacttgccgtgcgctggcacgtcttcgtcgagctccgctctatcgacaacaaacggggaacggttttggcaaaagctggtctggcggtgaaaggctcatttgttgccaccaaggcatgcagctgaggattgtacaccatcccaatccctccgctcacctgcnnnnnnnnnnaaaacggggaatggttttagcaaaagctggtctggcggtgagaggctcatttgttgccaccatggcacgcagctgaggattatacaccatcccaatccctccgctcacctgctggtcgtgcccagtggtcctacactgccattatgaacctccgagccctctctccggacatcctcccagacctgtgcaacacagagagaatgttggttcgctgcgggtgcaaacacagcatgtatgcagagcacattccatcccctctccctctcccctgctacatgcgcacctggtctatatgccgtgctctgaaaactttcctaacaccctgcttgttcaccctcgtgccctttctgctggagtgtgtcttcctgctcttgccggagcccatggtggagccgccgacgagagcggcgctaaaggttggtacaaggatgcgaagcactctcagtgtcaccttatttaagtatcgtcgccacgaaaggaagagctcgggccgggtgtcgtatcaataaaaagggggtcattcctcgcccacagcagcgcgccctccccgcaggcgcgctgttgagggacgctggtaagggaagatcaaacgttgcccaagccctccttctctttcaacctgccttgctgcagcaaattccgtctcggaacaaatacgtcttgaacctgtcacagacacaatgccatgcctcacacttgctggcgagtagaattgttgtagcactcctccgggtccatgtcggaccaatacgcccttgccgttgcccgcatcgtcgtggccaagctggcagatggatctgggttcgatgccctccagacctcctcagcatccatcctgtcggagctgctggtgcggtacatggaggaggtgggggtcagctctcatgcctacacagagctggctggccgcaccgagcccagcgccatggacgttgtgagtggcttgatggggagcatcatgatgcatggtggtaggagctgccctgggggatgagagatccatcgcgcaggactctgccttgtgcactttgtgtacccagccagcacccttccccatctcgcccatcctccaccagctctttgccctgaacgacatgggggtctccgtcaccgagctcaacgagttcaagcagtctcaggtgggtaattgagtaaaatatctggtaataggcgggatgtgtggctccagcgcgcatggggccagcctcactgagctctgtaaggatctcaggccccgtctcaatccttccccacattgcagcccaagggctctgccttccctgcccccatcatccccttcccggtggcccgaaagacacgaccgacccccacctttgcagagcgaggggaggcgagtgccatgggcgcatgggttttgggagggcgtgtcccatcaaaggtgcaaactcctgccgctgaccttgcatgcaagggcctgcttgccgctgcaccccagcgctggcccctggcctcgcgccagcacttgaccacgcactctaccgctgcaagccatgcaggccccgcccgcccacatccccgacttcctccccgccttcccggaccggcacacgtactgcgagacgcacgagctccccctgcccgacgcggaccccgcggcgcgccatctggcaggcatggaggcgcagcaggcggccgagcaggcgctggtgaagctgcacgcgcgcgccgcgccgcaggaccccgtgctggcatcggcgctgccggccaaagaggaggggcctgctgcggcggcggagggcggcgcacgtgcgcaccccgaccccgccgtgccagcgctggacccctggtccgccccgccgctgccggacgacggcgggccgcccgcgccaccctttcccggcggcacaccggccgaggaaggggcgccggtggaggatgcggcggacacggacatgccggacgccaagccggagccatcgcgagacccggaggtggcggccgcgctgggcgccacgctggcccccgccttccagccctgggactggcaggcgcggctgttggccctggccgcccaggcacagagccaagcgtgagcatcgttggcggggtgtctgggagggactatgagggttgggatggtgcgcctggcgccgtacggcagaggtgcgtgctgtgtcgatgcgaccgccttacccaaccccacctttcattcgctatgacaaccaccccaacccccccaaaaacgccaggccggaggaggacgcatttgccgcgacggcgcccggcgccatgctgtccaccaagcacgggcgccacgccaagcgctcggcgcgcgcgctggaggcgagctacgtgcccgcggaccccacccggcagcgggtggaggagatcatcgcggcgtcggggtcaggggacgccggggccgcggcgggcgcgcccgcgcccgccgacgtcatgtacgccgctgacgaggacgaggcagagcagctgtgagtgtggtgcactggcacgacgccagacggatgggagcccgggcaggacaccctactccttgcctgcgcgtgtcgctgtgaaagcaatcacattaaaccatgctcacgggcaggctcgcggggggtccaaagcggggctggcagacgggcacgcagggaggttgggtttggcgggccgcagcgcaaaacacacgtcgctcggcgggtggcccctccctctgagtgcgggtggcccggcgggccaccccctcggcgcatgcgaaggcgacctcctccggccgagcgcgcggccccgctggagggccgcacagaccacgcccgagtctccatgatcctctaaaacacgttgcccatctgcgccttctccttctcgtacatctcccagtagttgtagatgatggtgaccgccagcaggatgcccgtgcctgagaggggacggagggaaagggatttcaatgggggtgttgggcagcatgtttgagcagcccaatgcgccagctgggtagcagcaactccaacaggcatccccctgctctgaataccctctcggacccccccctcccttctccgtcccctccccctcc

SEQ ID NO: 42321 - DNA, 69 bp, Chlorella protothecoides
agcacggcgccagccgatgcagatgccgatgactttttgatgctggatgaggtgagccgatggagagaa

SEQ ID NO: 42322 - DNA, 61 bp, Chlorella protothecoides
gaggggtcagagacggcccctgccacaagctcacgcagctttgtcctgcacctgcgacccc

SEQ ID NO: 42323 - DNA, 61 bp, Chlorella protothecoides
ctgcatcaccgaccataaccccccccccccccaagcagacatcttaccaatctcttcggcg

SEQ ID NO: 42324 - DNA, 61 bp, Chlorella protothecoides
aggagcagcatgctgtcggctaccgctcgggactcccaccgatcagaatctgtggcctcgt

SEQ ID NO: 42325 - DNA, 100 bp, Chlorella protothecoides
ggggagatgaatagggccggcaggctggcgtggagccccggcacaccttctcgtgtgcacccacttgggaaatgtgatgctggtcgataccgaggcacct

SEQ ID NO: 42326 - DNA, 109 bp, Chlorella protothecoides
cagcatggcgttctttgccaagacgcccctgaacgatgcggaactgagcgcggcggcggccaagctggaggccaaggcatacgctgtggccggagtgcagggcacggtc

SEQ ID NO: 42327 - DNA, 61 bp, Chlorella protothecoides
tcgacactgagtaaagatggtattggcagggtggagtgctcgccagcatgggctgggggaa

SEQ ID NO: 42328 - DNA, 105 bp, Chlorella protothecoides
gcacctggaagtctccgagtttttgaagtgcgtcggggcgctgggtggattatcgggtggttgttgaagcggtgacgggtggttgagtgggtgaagtcgatgcct

SEQ ID NO: 42329 - DNA, 62 bp, Chlorella protothecoides
acagctcctctggaccctgcgacgtttcaggccggacgttgggggcatgggcacttggggca

SEQ ID NO: 42330 - DNA, 73 bp, Chlorella protothecoides
caggtcgtcatcaaagcctgggctgagcaatggcggcgacgaggagcgggcggcctgcgcctgggctgactca

SEQ ID NO: 42331 - DNA, 65 bp, Chlorella protothecoides
ccgtgcctccccccgctcggcgcggaccctatcttgacgcccccgctcccatgctccgtgcgcag

SEQ ID NO: 42332 - DNA, 61 bp, Chlorella protothecoides
gtccgacatggaccgggggctcgagctctcggcccccaagcgtgcgccatctgcggtttga

SEQ ID NO: 42333 - DNA, 61 bp, Chlorella protothecoides
agcgtcgcgccgctgggcctgctggaggggctgcgcaccggggcgcaggcgcggacgtgga

SEQ ID NO: 42334 - DNA, 64 bp, Chlorella protothecoides
cgccgtcgagggctgccagatctgcatggatgcgggcgtgtctgtggccgtggccggctgcggc

SEQ ID NO: 42335 - DNA, 63 bp, Chlorella protothecoides
ccccggtgggtctgaagcaaggcgcctctgctagtggagctaagcactgttctcgctgggagc

SEQ ID NO: 42336 - DNA, 61 bp, Chlorella protothecoides
ttcacccactcgaggaggagatgcaagaccaccctccagtctcatgcaagcaaggcatgat

SEQ ID NO: 42337 - DNA, 61 bp, Chlorella protothecoides
ccaggagtgggccctgcccctggtccagcgtgccctcaaggaggcgggtgtcacgccccgc

SEQ ID NO: 42338 - DNA, 61 bp, Chlorella protothecoides
aggcggagagggtggaggagagggtggagagggtggaggcggagagggcggaggcggagat

SEQ ID NO: 42339 - DNA, 155 bp, Chlorella protothecoides
tccgagggggacgtggacgagtatcggaacacgcgcgacaagatcctgcaggcaggctggggccttgattttcatatttttgttgaggacatcggggagatcgtggtgcatgttcgacgcagtgcagtgtgagcctgtgcttggtctcgagcaat

SEQ ID NO: 42340 - DNA, 61 bp, Chlorella protothecoides
gaaccagctgctggtggagatggacggcttttccaccaccgccaacgtggtggtgctggcg

SEQ ID NO: 42341 - DNA, 146 bp, Chlorella protothecoides
agcatgcagggggtcccacctcagagtcaggggtacgccaccaaactgagggtctacggtactcctgcaggggaggggccggtgaggaagacctgatcgggggcctttacatcattgaggaggggcgggatggaggggctgagccc

SEQ ID NO: 42342 - DNA, 61 bp, Chlorella protothecoides
cttggatcggaggattggagaggcagccagggattcggcgtctgacactcagcactcgctg

SEQ ID NO: 42343 - DNA, 61 bp, Chlorella protothecoides
ttgcataaagtgagaggttcgaacggtgacaggccaaacagagctgggctggtgcctggct

SEQ ID NO: 42344 - DNA, 75 bp, Chlorella protothecoides
ctcaacatggcgatccctggggagatcgaccagccatacttcctgtggaaaattctccctcaagcagtagcttca

SEQ ID NO: 42345 - DNA, 63 bp, Chlorella protothecoides
ccaccagacacaaccctcaccatccccccccaaccaccagacacaaccctcaccatccccccc

SEQ ID NO: 42346 - DNA, 61 bp, Chlorella protothecoides
ccacaaagacaccgaggacgcaccggctggggatgaaggtgatgccacgccacctgttcca

SEQ ID NO: 42347 - DNA, 501 bp, Chlorella protothecoides
  modified_base (252)..(330): a, c, t, g, unknown or other
cggcgctgggcggcatcgtgcgcgccgcggcggcacagctggcggcggagccggcggtgcgcgcgcacgcgcgcgcgcaccactggcgcgcctgcacgctgtccaccttccccacgcccgcgggggagggcgcgctggagcccacccacccgctggcgctggccaagcgcctgcgcggcaagccgctggcatccttcgccggctccgacctgtacgcgcgggtggccgccgcggagcgcgcgggcctggtcnnnnnnnnnnnnnnnnnnnnnnnnnnnnnnnnnnnnnnnnnnnnnnnnnnnnnnnnnnnnnnnnnnnnnnnnnnnnnnngtgagcctggacgtggcggggggcgcgggcgcgctgaccgccgcgctggaggcggtgtacctgtcgggccgactggcgcccgtggcgcgcgagtgggaggcgctgcgcctgcgcgtgctgcgcctggcgctgggcgagctgagcgaggcgcggctggcggccgaggcgcgc

SEQ ID NO: 42348 - DNA, 61 bp, Chlorella protothecoides
cgccccaaactctcgtggatggggccccgagtgggccccctcgctcccttgtgactggccc

SEQ ID NO: 42349 - DNA, 61 bp, Chlorella protothecoides
ccacctggctcgtgtcgatctgggggggggacgaggtgcgttggccgggctaagtacacgc

SEQ ID NO: 42350 - DNA, 61 bp, Chlorella protothecoides
gcgcatttgcataatcatgtaaaaggggggggaaaaggctggaggttgcgaaggtgagcac

SEQ ID NO: 42351 - DNA, 6890 bp, Chlorella protothecoides
  modified_base (1343)..(1352): a, c, t, g, unknown or other
  modified_base (1726)..(1735): a, c, t, g, unknown or other
  modified_base (2072)..(2081): a, c, t, g, unknown or other
  modified_base (2569)..(2578): a, c, t, g, unknown or other
  modified_base (3123)..(3132): a, c, t, g, unknown or other
  modified_base (3496)..(3505): a, c, t, g, unknown or other
  modified_base (3579)..(3588): a, c, t, g, unknown or other
  modified_base (4135)..(4144): a, c, t, g, unknown or other
  modified_base (5440)..(5449): a, c, t, g, unknown or other
  modified_base (6489)..(6498): a, c, t, g, unknown or other
ccctgaccgtcgcgtcgtcggcggccgaggcgaggcggtcggggtcggtggggcaccaggccacggcggtgacctcgccttcgtgcccctccagcgcggcaaggggggcgtgcagcacgggtccgcccgcggcggccgccgcgggcgggccgtccacctcccacacgtgcacgcggcggtcggaggagccgctggccaggaagcggccgtcggggctgaacccggccttgacgtagaaggaggccgcggcatgcccggcgtagaccgcgcgcggccccgccccggggcgaagtacatcgaaggccaggtggtgcccgccggtcaggctgaccagcaggcgcgcgccgtcggggtgcagcgccaggcaggtcacgccgtgctgcttcagcccgctgcccaggggtggggacgagatgcaggccacggggcgcagcgaggcccccgccgcggcggcgcccggcgcggggccacgccccggtctcgccgctgcggcgcagccgccgccgcggcgcaggtcccacagcctcaccatgccgtccacgccaccggtggccagcgtgcgggcgtcggggaggaagagcgccgaggtgacggacagcttggggcggccctggaggggtgtgcgcggccggccccgccgccgaggctcgcccgctgcgtgcgcgtcctgttgggagtgtcggggtggggtggggtgctgaaagggattgcgggaaggcaaagctggtgggagattcaatgagcatgtctcgccggcccactggtatgtacaacacaggattcccaccctctgcttggaccggacgcccttggtaaggggcatgaggagtgcctggcacgcagacccaggcctgagcagctctggcaaggggatggcaacctgttccttgctctttgccccatcccccttgacatcccacacacacctggacggtgaggacggggggggtgccgccctcgggcgtccgcgagtggatcctggtgtcccacaccgccagctggccgtcgcgcgcccccgaggcaaagacgtgtcggctgccgggcatggggtccagggtcttgacactgccggtatggccgcagaaggttcccagctgctcggccatgcccgtgtcccacaaggagatggtctggtcgcccgacgccgccagcatggcctcgtcctcctgacaggaatgcggtgggtggaaaggagggagagaaggtcaggctcggtgatgccctgtgacagtgtggatgttcatcccgaatgtccagcctgtgggggacccacacaatgatagcctgtgatcctgacaagtatgcccacgatccctgcaccccttcactctctcctcaccctnnnnnnnnnngggtagcctgtgatcctgacaaggatgcccacgacccctgcaccccttcactctctcctcaccctgaaccatgccaggtcaaagattgcgttgcggtgggcgagccactgagcagaggggcgcggcccggcctcgtcagcagtgctgcgggggagggcctgtgaggtgtcaataatggtgaggtacccctcctcatctgccagcgccagcaggcggccgtgattgtacacctgagtgggggtgtgggggagacttggaggcattcgcttgtgacagcaagggaatctggacgtgttccctgcctgtgtcccatattggtgtatctggacagtcacatgcagcgatgcaaggggggttgatgtcctgtgtctctnnnnnnnnnncatctgggcagtcacaggcagcaatgcaaggggggttgatgtcctgtgtctctctcccagacccaccaaagccttgcaggcgtgtgctcaccccgttgaatgatgccgcgaatgctggagagcccaccatggaggggtcattgttgatgactccgctgcctgtcgctgtaccgcaagtaaactcgcccagcggcggcagaggcaggactgcaagggaggacacgaagacgcctatgttggagccgagctatggacagcagggcttgcgtcagaagccggcttaagttccagacatcaaccaaacctgcatcacctgctggcccgaagcattcccggnnnnnnnnnnaggggcttgcgtcaatagccgggtaaagttccagacatcaaccaaaccggcatcacctgctggcccgaagcattcccggcgtctgagttcgtgcagaatgttgagccccggaccggccatccctggcgagacccggaggctgtttgctctgcgaacctctgaagagcgctcaccgagccctacagatcagagcgattcgtgtagcattccgttgtcgactgcgatgctagtaggcgtgggccgtgggcgactcgtgcccgtcgcaggctgttcccgtgcctttttggatttcggatgccgcgtggcatgcgccgcagggtgcacggctgaatctgtcgggatcctcctggagcaacaagttgccggccgggccccctctgcatcgatgttctacatgcacatgctacgatccaaactgtctcctcttacgtccatgaatttgagtttgggatttcaaggttggcactggatgccttggacagagtccnnnnnnnnnnatacgtccatgaatttgatttgagatttcagggttggcactggatgccttggacagagtcccagcggccttagcaagccaacatgctgcaggcaccagcagatctttcctccttacatagccctctcaaactccccctcagggcagggatacgtgcctccagatcttcacgctcctgtcccgctcgtgcccgcaggaagccaggacggggaggtgggggtgggcggccacggagagcaccacgtcgcagtggccctcgccggggtcatcggggccggcccgcccccgcaggaggcccaggagcggtgccacgccgccctgggacccgttcacgccccagacgtagatgtggtggtcctcgctcccacagaccaccgccgcgggcggagcggaggagccagtttcctcgacgcccaggcagaggaaggcggcctgtgggcagggagggcatgcttgaacggcggcacaatactggaggtagcaaccgctccccattgtggcccactcccaccagaagacagtaacaaatcgtgctccttcccccannnnnnnnnngttgaacggcggcacagtactggaggtagcaagcgctccccatcgtggcccactcccaccaggagacagtaacaaatcgtgctccttcccccaacaaaagtcagcccgcatgcaagtacctggaggcagaactttgtgttcttgtgaccctcaaaggtccgcagcggctgcttggtgtggtagttccagagcactatcttgccatccactcggcccgccagcacatacttgtcgttcggggtgaaggcagcgaacgagacaggtgggcctcccgtggcgaggaggcttaccaggcagtttccggtgtctccggcccagactcgtctggaacagaggtggggggggggggggggggggggggggnnnnnnnnnncaatacagcaccccaatctgtcagcccagcgtttatgcaagcactccctggcaggactcacatgaggccgtcannnnnnnnnntaatacagcaccccaatctgtcagcccagcatctacgcaagccctccctggcaggactcacatgaggccgtcaaaggaggacgacacgatggctgggttgagcacgtcccgcgagaaggcgacgctggtgatggggtccgaatgccccgggatcacgcggatggcctgccccgtggcgacgtcccacacgacgatggtctcgtcgaagctgccgctgaccaggagcacccccgtcgcgctgaaggccacgcacatggcaaagtgggtgtggcctcgcagcgtgcgcagcggcgcccccgttcctgcattccagagcctcaaggtgtagtcgtcggaggcggtggccaggtgggcgtcgctgggggcccacgccacgtcattcagaccctgtggtgggtggcgagaggagtggataggcatgtgacgaccagtgttcgaatgacaagagagcgcagtgtttgccctttgatgctgacaccagcccagcccaggccaacccacccccttgaaaacccgcaccttggagtgaccttgcaacacgtgcaannnnnnnnnnaggatgacaagagagcgcagtggttgccctttgatgctgacaccagcccaggccaggccaacccccccccttgaaaacccccaccttggagtgaccttgcaacacgtgcaaacaggagcctgtgtcggcgtcccagactcgcgcggtgccgtcggcgctggcgctggcgagggaggcgccagagtggctaaaccggacgctggagacagctctcgtgtgacctgtcagggtgtgcgcgcactgatagctagtgtaggtgggaaggtcagactgctccgcataatctgagatagattcatcgcgagatggtgtggccttgctgggtccgttttcggggggggccggtgctgttgtgtcggggcttgcttccgccatccagccgtagtgggcttcagagattccaccagcgctggatggatgtcaagtgctctggcgaaagcaaagcattaccatgctgtggcatctccctcttgatcccgaagtgaaaaggacacactgtgtgttggaatccactctcccccattctcagttcgcaagctccgagtcccgcagcacggcgcagcacggcttggaactccgatgccctcaacatactgctcgaatggtcatgaaattatctctgcaaggcctgtcaatcattgacattggtgaagaagcaatcaataacaccaccgatgttgagtgtgctgtccagagcatgcatgctggcagagtaccgcttgggccggaagtgatcaagccaggcgggtacccatgacgaccgccgatgtcgaggccgcagaggccgccgagtgcagtcgaagtagcctgcttgaggaggaacagctgctggacctactcaatactgttgtacagaccgagggtcgctcggctgccgacctccaccatgcctttgcctgcatcgtgcgttggccattggtgtagggtattgtgggttgcagcttacatgccaggcaggccactgatgatttcaagcagccatggcacaacttgctcgcaggtgacccgctaccaggagcagccacagctgctggattccctgctgcagcggttgttggaccccctggggtccctgcttgatgggctgatccggcagggggatgcggtgccgcacctcagcaccctcgttgggttgtctcgctggatctggactctggctaccgtgaggtacatgcgcatgttgggggcctggcgccgtgactgtccatttgcaccatcatctcagtgtgcctgccacccccacacctcgcccagggtgcaccaaccaactcgcaccgcaggggccggaggactgtnnnnnnnnnnagtgactgtccatttgcactatcatctcagtgtgcctgccaccaccacacctcgcccagggtgtaccaatcaactcgcaccgcaggggccggaggactgtatcgcgcttcctgcccaacaacacgcagtgcctggagccggtggttgccctgctggagacgctgcagaccagggtgagtggtggaagttggattgggagtcccagaaatgttggcaacacaaacggcggccccaatatgactcaacaggagacacagctcgtgacatgcaaaacattgaattgtggtatgtcacagctgccaggcgtcagcttgggtccagggtttcggccccatcaagacatcccttcacccacttgaagctcccgctggttcgcacgcagggccccgccggcttccacgacacctgcatggaccacctgtgggaggcagagtgcgtgctcctgctctggctctcccacctcgtcctggtcccctttgacctggccagcctcgactcgcagctgggcgacggggagcgggcggcgctggcccccctggcggcctccatcctgcgcctgtgccagacgcacctgtccagccccagccgcgcgcgggagatggcggcggaggtgctggggcgctgcgtcacgcgccccgacatggccgccgcgctggaggaaagcgtgacctgggccgagacccgcctggcgggcttggggaccgacgcatgcgaggcaggcttcctcgtccccggcatcctcctggcgctggcggccacgctgcgccacggcgaccgggcccgactgggcgccacggcgctgcgcctgctgcccctggcgcagcgcgcgcagcaggcgacgcaggggggcgcgctcgcccgccgcctgtccatgaagctcatgcaacgtatcggcctggtgctgctgccgccggccggcgatgtcgccaaggagccgggactgatgcatggcagcgcaatagaaggcaagattgtcttatggggggtgagggaagtggaggtgagtttccatggctgtcctgtgtctggatcgtgggcannnnnnnnnngatagaaggcaagattgtcgtttggggggtgaggggagcggaggtgagtttgcatggctgtcctgtgtctggatcgtgggcagggagcgcgacaccgacacaggttgcccgtgaggcttgtttgcgacgccccgccctcccctgccagacgtgctggacgccctcctcaccgggctgggggacaaggacactgtggtgcgctggagcgcggccaagggcgtgggccgcgtggcagggggcctgccccccgccctcgcccgccaggtggcggccagcgtggccgaggcggccttcggccacgccggcgccgacgcagcgtggcatggcggctgcctggccctggccgagctggcgcggcgccgcctgctggacccacgcgaggcgggtgccac

SEQ ID NO: 42352 - DNA, 61 bp, Chlorella protothecoides
aacgtctctgcactgcgcgcccatgccggcacagcagctgctcgccgcagacggcgctgtg

SEQ ID NO: 42353 - DNA, 61 bp, Chlorella protothecoides
gggatgacacgccggtcccggaggcggagggggaggagggggtgccgggccgctccaacgc

SEQ ID NO: 42354 - DNA, 76 bp, Chlorella protothecoides
ttccagcctccacgacccagacagggcatgcaaaacccttccacactctcccaggccccaccgctccgggctcagc

SEQ ID NO: 42355 - DNA, 89 bp, Chlorella protothecoides
gtgcctacgagctgaatctgagagcgcggcaggtcccccgccacccgctccgttgctgcagaccacctcacttcttcttgttgctaacg

SEQ ID NO: 42356 - DNA, 19633 bp, Chlorella protothecoides
  modified_base (193)..(299): a, c, t, g, unknown or other
  modified_base (529)..(538): a, c, t, g, unknown or other
  modified_base (855)..(864): a, c, t, g, unknown or other
  modified_base (1837)..(1846): a, c, t, g, unknown or other
  modified_base (2439)..(2448): a, c, t, g, unknown or other
  modified_base (3378)..(3387): a, c, t, g, unknown or other
  modified_base (4326)..(4335): a, c, t, g, unknown or other
  modified_base (4710)..(4719): a, c, t, g, unknown or other
  modified_base (5962)..(5971): a, c, t, g, unknown or other
  modified_base (6271)..(6280): a, c, t, g, unknown or other
  modified_base (7078)..(7087): a, c, t, g, unknown or other
  modified_base (8763)..(8772): a, c, t, g, unknown or other
  modified_base (9031)..(9040): a, c, t, g, unknown or other
  modified_base (9720)..(9729): a, c, t, g, unknown or other
  modified_base (10420)..(10429): a, c, t, g, unknown or other
  modified_base (10873)..(10882): a, c, t, g, unknown or other
  modified_base (11075)..(11084): a, c, t, g, unknown or other
  modified_base (11951)..(11960): a, c, t, g, unknown or other
  modified_base (12533)..(12542): a, c, t, g, unknown or other
  modified_base (12743)..(12752): a, c, t, g, unknown or other
  modified_base (13276)..(13285): a, c, t, g, unknown or other
  modified_base (13361)..(13387): a, c, t, g, unknown or other
  modified_base (13443)..(13452): a, c, t, g, unknown or other
  modified_base (13989)..(13998): a, c, t, g, unknown or other
  modified_base (14564)..(14573): a, c, t, g, unknown or other
  modified_base (14900)..(14909): a, c, t, g, unknown or other
  modified_base (15161)..(15170): a, c, t, g, unknown or other
  modified_base (15615)..(15634): a, c, t, g, unknown or other
  modified_base (16040)..(16049): a, c, t, g, unknown or other
  modified_base (17445)..(17454): a, c, t, g, unknown or other
  modified_base (17630)..(17639): a, c, t, g, unknown or other
  modified_base (19188)..(19197): a, c, t, g, unknown or other
cgcgcgcccgcgcccagcagccgcgccgcggcgtcggcgcgcaggaggcgcgcggtgcgttcgcgccccgccagcgagaagcacgcggcggcccacatgctgaggcccagccagaggcccaggaaggcccgtgggtcggccagcgcagcgcgcaggcgccagtgccgggggagagaggcggcgccggggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtcgtggtggcgggggcgattcgatgagactccacacgtgtgcctcgcgcgagcaggagctgcttattgtggcatggttccacctgctcccacctccatgcaggcccgatggcacctggcccttcaccttgatgactgtcactcccccccctggaaagagccccttcccctgccacacacacacccagcatgcacacccgcacctgctgctccacgaagcgagggtnnnnnnnnnncgcgggtatgcgaccccgggcgcgacaccaccgcctctgcgaggagcggggccgtgatgacgggtgggcctgcacgtcgcttcagagattctgctgccaggtgcaaacgcggagccgtgcaggcaggtgcgcagggtccccaggagcgccgccaggcggtcggaaccctcagggccgtcactccctgagcattcgcccctgacgcggtgctcgcccaaccttggaccactcctgcccaagcccctttgggttgcacggctcaccccacccaagcaagagcgcaccgcagctcaccggcagcgctggtgtccacggcnnnnnnnnnntgcgtcgtggtggcgggggcgattcgacgagactccacacgtgcgcctcgcgcgagcaggagctgctcagtgtggcatggtcccacctgctcccacctccatgcaggcccgatggcacctggcctttcaccttgatgactgaccctccccccccccttgaaagagccccttcccctcccccccacacacccagcatgcacgcccgcacctgctgctccacgaagcgagggtccaggtagtcggacaccgtgggcgccgtcgtgggcggcgcgctgtgcgtgcgtgcggtgatgccctggccaggccccggcagcggcggcgtgccggggccgtgggagcgggtgtgcgaacccgggcgcgacaccgccgtctctgcgcggagcggggccgtggtgacgggtgggcctgcacgttgctttggagatgctgctgccaggtgcaaacacggagccgtgcaggcgggtgcgcaggctccccaggagcgccgccgggcggtcggaagcctcagggccgtacctccctcagcattcgcccccgacgtaaagacattgaactttcctcttgggtaatttcgtaaccatccaaaatttcctcgcggcgctcgcccgaccctggaccactcctgcccaagcccctttgggtcgcacggctccccccacccgagcaagagcgcaccccagctcaccggcagcgctggtgtccacggccgagcggcgcctgaagtgggccgaggccactccgaccccggcgtcccccgcctggcggtcatcgccgctggcgctggcgctttccagggacgtcgtgctgatgtggcggctgtgcgcgacgagggccaccaggctgcccgggtcgtgcgacccggcctccgtgaccgcacggggcgcgggcgcgatctcgcccgcctcgccgtggccctccgacgcagtcgctccctcccccccttcgccctgcgcccggggcgtcacgctgcgcnnnnnnnnnnctccaaggacgtcgtgctgatgtggcggctgggcgcgacgagggccaccaggctgcccggatcgcgcgacccggcctctgtgaccgcatggggcgcgggcacgatctcgcccgcctcgccgtagccctgtgacgcagtcgctccctccccctcctcgccctgcgcccggggcgtcacgctgcgcgcgctgggggcgcgggcgtcgagatccacggcgtccagcgactcctcgccgtcctgggacgccgtgtccggggcggggtgcagccgacgcggcgtgggcggcctgccgccctccgccggcagggcggcgaagcgggccgacaccccttcccagtcgcgcagggggtcagacctgtgggtggggagcgccgaggtgggtttcgtgcagcgctctgctccacaggtctgagggccaggggcagagggggaggggaggagggggcaccgcctccgatgccatgccgcgctcccaactcccctttcgatcggacctcacgccggcagggcctccccccgctccctgccacccacccgtcgaccgagtcgagcagccgcgtcgggccctcgcccactccagcgcggtccccatnnnnnnnnnntgaggtaggtttcgttcagcggtctgctccagaggtctgagggccaggggcagtgggggaggggaggagggggcaccgcctcggatgccatgccgcgctcccaactccctttttggttggacctcacggcagcacggcgtccccccgctccctgccacccacctgtcgaccgagtcgagcagccgtgtcaggccctcgcccactccagcgcggtccccatccaccgcctggcgtcccgccgccacgcggtccagctcggctcgggcggccgcaaacacgctgcccagggccacgtggagggccggggccgccggcgcgtcccccgaagccctgtgcggcggctgcgactggccgggccccccagcctggagccgccagccggccctcttgtcgggcaagggcccgaggtcccactccacatcggacgccgcgctcgtcaccgccacggcctcctccaccggctcgacaggcgcgccggcgcagggccctcccagctgggccggcacagccccgcggggctcggcggcccgtgcagggccccggggccggcgcgcctccggggacgagggcctcggcgccccgccctcccgcgcggcgtgcagcaccgtgctggccagcgtggcgtaggccgcaaaggcccacgtggctggcagggtggaggaggcgggggcggccacgtcgcgctccagcaggcgccgccccgcctcaatgaagcccttgccgcgctcggccagctggagaggacggaggagggttcattggtgattgtgaccgcctgaccgcagtgctttgatgaaagcgggacactcttccatgcactccctgcctatggtcgccacaacccccaagagccatcgccggtcacaccaaactcctcctgcccccccttgccgtcctcactgccctgcggcccacacagagccgcctacnnnnnnnnnngggacggaggagggttcgtgggtgagtgtgaccgcctgaccgcagtgctctgatgaaagcggggcactcttccatgcactccctgcctgtggtcgccacaacacccaagagccatggccggtcacgccccactcctcctgccctcccttgccgtcctcgctgccctgcggcccacacagagccgcctacgcagagcaggcccccccagacatacaaatcagtcgcccatccacctccgtccatcggcgcagcttgagcaggatcctggcctggctggcgaagaggaactggcgcatgacaaagtccgggacctgcggcagggccagcgccatgcggcggatgccgggccagggcatccacatggggcccacctcgtcgggcggggcagccgaggggccctccgggtcgggggggagcggcgtcgccgcttgctgctgccaggcctgcgcctgcgctgcggtgtccgcatggcagacatccagctcggcatactcccgcagcgcatcctcgtacattcctgcatggcaaggcgtggagggggcaagtgggcgggggatcagggagatgtggactctgggccagagtgagatgctggggtgctgactgcctcgtgatcgagggagcatgctgagcacccttctcaggtcccaacacccaaggtaaggcaaccacacgctgggtcaaggcacggtctggcgcatgcaacaggttgacatagccatgctggccacgcgcgaccccacctcggcccacctgcggcctccagcatgaccgccagggagtccttgatgaggaagaggggggtgaaggtccaccccacctccagccgattgctcatgtgcctccggatctgtggggataggaaaaaacggtgggacctcgccaggggaccagctctttgaataacagtgtctcaccagccccatcaacaaatgaggnnnnnnnnnnatggggataggaaaaacgatgggacctcgccaggggaccagctcttcgaataactgtgtctcaccagccccatcaacaaatgaggctgcggcctgcaacatgccataaatgcagccggccccacctcccacctcctcctggtaggctccagtgcgggcctcaaaggtgagcatcacggcctcgcgaaccaggtactccaggatctccagcccagcgatggaccctgtaggggagaggggagcggtgtgggcaggggtgaagtgggactccaacggacctcagttccgacgcagctgcccatcaacagaggactctataattagccatccaatgcccccccccctccccgcttcccaagtctgtgtgcaagcttcnnnnnnnnnnaaaccatccaatgccccccccccccgcttcccaagtctgtgtgcaagcttcctgaacaacactgcatgtctgcaatgcctggctgccctgtgtcacacatccacccagtccgcacctcggggggtgcccatcacaggccctggggcggtggaggggggcggatccagccggacgcaccgatcccgccgcttgtacgcaaaatcccggcgcatggtgtcgtatacctgtgcatgaggagtccattaagggactggtgtgtggagggtctacagcgccgagaatgattgccaaatcttccctacttcaggccccattgaggcacgacattgtccgatgaagtctcaggccagagctgctgcaggtacggccagcgtgccccatgatgccatcataaaacccattggtagtgcaggtgcccttcatgcatcccaaaatacacagcccagagcctgtcaaataagtcccccaaggccccccatgccttggctgtagccctcgagtccgccgcggcgggggcgacgtaggcaatcaccagctctggcgccacagctgtgcgggcttcagggtcggcgatagctcggatctggggccgatgcaggcgcttatactcctccacgtcctcgcaggagaagagcaccagctggcagaaggggttgcggaaccacgtgaccgggctgtaggacagctggcgcaggcgctgcacataggcatcgccggtgttgacgtatctgggaggagggcagtgggagtgaaggggtggcactccatctgggcccccacacacttgagcgcctcctgtgacaatcaagttgccccatcaaccgcgcacctcagatgcagctcgtcgagggtggacgagacaccaaggctgttgcgaaactgggcatgccgcagtgggagccgtgcctccaggtactgcggcgaaaggaagcaggctccgggctatgtgatctcaggcgagacagcctgggcactgcacctggagcattcccccggaccaccgtctcacaggtcttatcttggaccaggtaccgctcaggtcatccacggtgcatgtgaagtggacacctagatccgtgaagcgtagtgggggagacatgctcagactaccaagcgcacctctcaccggcccatcggttgatctggcaagaagatcgaggtcatgtttataccgaaacaatcctgaggaatttggaatccatggacaggcaacgattccgcacattgatcggatggttgttgnnnnnnnnnncaccgaaacaatccaaaggaatttggaatccatggacaggcagcgattccgcacattgatcggatggttgttgcggacctggtagggcgcgcgcgaagagtgacgctatggcgtgatgattcggatgcatagattctgaacatgatggtgttacaaccagaagcgagcatcaagaataacattgcaatatcgaaaccacaatgtcatggcccatgtagcccgcatgcacacagatgggtgggcatggggcggcacgagggcccctcccgctcccacgcggcactgcagcccttacggtcnnnnnnnnnnctgttacaaccagaagcgagcatcaagaatagcattgcgatatcgaaaccacaatgccatggcccatgtagcccgcatgcatacaggtggatgggcatggggtggcacgagggcccctcccactcccacgcggcactgcagcccttacggtcgcatgacgctgcaaggaaggctaaacatcgtttgcctgtccactgaacagaagagggtggctgtaattggtgctggggcggcaggtctcaccgccgcttactttgcagccaaggctggggcccaggtgcttgaggttgggttgcgtatgggtggtcagacagggctttccaagtgaccggcccatccgacgtgctcctatgaaagcttgtatctcaccgtcccaggtgactgtatatgaaaagacagatgaggccggcaagaagatcctcatctcaggcggcaccagatggtgaggccaagcactgcagggctctggactgatatgcatggtcttattgggccagagctccctatagtcatgccacgatacgtcaagcccctcctcaaacacccccaaccctggtagtaatgtgctgcctgggagcgtggatttggacctggatttccagaccagcagccgggctgccggggtgcgcgtcatcctatctcactggagcctatcctcgtgcaaggagtggtgagcgtcggctggggcagcccggcacagtgtgggccgggggtgtcgttgcagaaggtgtttactatcgctcgatggaaatcccttgggagactcaatgcccctcgccccaggcctgcgacctgtgnnnnnnnnnncttactatcgctcgatgggaatccctcgggagactcgatgcccctcgccccaggcctgcgacctgtgcgttcccctgccctccctcggcgtgcaggctggagcgcgacctgggcatccgtctgtccttggacccggccaccaacaagtacttccccaccaccaactccgccaagacggtgcgggacgcgctgctgggcgcctgcctgcgggccggggtcagagtgcggtaccgctcgccctgcggtgccccggtccccgccggcggcggcggctgggcgctgggcctcgcggctggcgctgccacggcccctcgccccgccgccctggtcatggcggccgggggcgcctccttccccgcgctgggcacgacgggggacgggtacggcgcgctgggcgcactgggccacgccgtgcgcgcccctttcccggctctgacaccgctgacggggcggcaccccggcggcgcgcgcctggcggggttggcagtgcacggcgcagcgctggaggcgaggcgcccggggtcgaggcgcgcgttgcaggtgtcgccgcgcggggacgtgctgctgacccaccgcggctactcggggccggcggtgctggacctgtcccaccatgccgtccgggcgggcatggtgcgggtgggcgaggaggcgctgccaaaagggaaggccccacgccaggcgcccggcgccggtgaggaaggagggcttgcggggaggagggtgatgtgcgcggtgcggaagcggccgcaagaacacaggctcccaagggaatagggggtgtggaggtgcagcacagcagacccctggctgcacatctgggcacctgccccctcagctcggagggatcactgttggcgacgcgacgtgcatgcaatcaagcatcccggcgcctgaccatcacctccagcagcctcttccaccgcacaccttctcctttgccccaacctcgcagacctctacctcagctggacgggtctggaccggcagggctgggaggcggtcctgcgcgccacgcccggcggcaagggcgcgggcgccacgctcaaggcacacggcgtgccggcgcgcctggcggccgcgctgtgccaggaggcgggcgtcgcgcccgaggagaggctggcgaacatcacccgcacccagcacgaggccctgctggcgaccctggcggggtggaagctgcccgtcagcggcgacgagggttttgccaaggtgggtgggtggaggagaccggcgtagcctgtgtgagtctggggatgcatcgtggtattggcctgagcctcaggtcgtgtcgcactccttgctggacccctaggatcctcaaaccccccgccctcccgcatgcacacgcaggccgaggtgtgcggcgggggggtgccgctggaggaggtgcactggtcgaccctggagagcgaggtcgtgccctccctgtacatatgtggggagctgcttgatgtgcacgggcgcatcggggggttcaacttttactgggcatgggcgacggggcggttggcaggcctggcggccgctggcgctgcctcgccagggtaacaatccacgagtgattccatgaccacagagcagggagggcatcactccgtgcgcctgcgtgggacaagggtgtacatgccggatggtcatgaatgggggctgggcagcgtgcgtgctgtgcctcnnnnnnnnnnaacgagtgattccatgaccacagagcaggttgggcatcactccgtgcgcctgcgtgggacgagggtgcacatgccggatggtcatgaagggggctgggcagcgtgcgtgctgtgcctcgcgtccgcacggctgatccgatcccgttcattgagagggtcgagcagaggggccccagcacgcaacccagcgattgcatggacctcgccgagaccaggctagtatacagtcgcaatcaaccactgtgccccggtgacgcannnnnnnnnntttcatttagagggtcgagcagagggggcccagcacgcaacccagcgattgtatggaccccgccgagaccaggctagtatactgccgcaatcaaccactgtgccccggtgacgcattcaggcaggatgtctgctctcgctccagctagttgtggcaggtgagcaatggggtcccgcttgcaggagcagtggcacctccatgcgtggacatcccaaccttccgaccctcgccatgcaggtcatttttcggaggacatgtcggcattactgctttcacctcgactcccgcagttgcgaggccccggctcgtcacggtggggtgtgtggggtgggcaggcccccctgcaataccatgcagcatgggtccgatgccgcgagccagagcatcgcaccgaggctcaccggtctgtcatgtccccgcgacaggtgcgggctgccaaaggaaagcagaggctgagacaaggtggcaggagtggtgggcctcccaccatgccggtgagtgatgcgggacatggggaggtcatctggacctgagcaagtcctcatcccgcctggtcggccagagcggcccattatacgcatgaacaccaatgcagactgccttcgcctgccccccacgacatgcagccggtccccaccaccttcactccacacagaaaccgcccactccggagcccgatnnnnnnnnnncctggacctgagcaagtcctcatcccgcctgctcggccagagcggctcattatacgcatggacaccgatccagagtgccttcgcctgccccccacgacatacagccggtcaccaccaccttcactctacacagaaaccgcccactccggagcccgatcccaagaacgaggagtttgtgatgtttgtgcgcagcaagaagctgatgaagtgggtgcccctgtccatcatgaaggggggcaccgcggccaacatgctggtgaagagcatgcaggggaacctgggaaagaagatgtacaccaacaccctcatccggaacatagcgcaaggcctatacaaggtggagtggcctgggcgggctcgttgtcgtggatgcaggggaatgctgcaggccacggcagcctgctggcgggtgttttgcattggacctatagattcatgtgacgcctgctgcgcagtgtgcccttccatgtgcccaagaggttccactttggtccctcccaatccctccatgcaggatcggttggaggttgagcgccagctgcggaaccagtacccatttttcaaggagaccaaggagtttgagtatgccttcaagatcaggtatggggagcgaagtgtatttacaggatgggtgggctcctcttcatgatgtccttgcaattatgagatcagcagcgcgagagttctggtnnnnnnnnnncacaggatgggtgggctcctcttcctaatgtccttgcacttatgagatcagcagcgcgagagttctggtcccatacaatacaattcgcctattcacgctgcaccctggctgaacctgtgaccccaccttgccatttgccagggacaagaccaagcccgaggagtggtacctgcccgccgacctgatcatcatcccccccgaggaggacttggaggacacggtggtggacaaggccaagaatttcttcggccggataaccgggaggaaggactgatacgccctgcgtgatcgggtggacattcactgatgcaatctgcttggcagttgtctgggcgctattgattgctgacagcccaggttctgtcgcctgttccttgttgcattggtgttcaggaccccgcatgtcgcagcccagtgttgcgctctggcctgccagcacatgcnnnnnnnnnncgtcgcctgttccttgttgcaatggtgttcaggaccccgcatgtcgctgccgagtgttgcgctctggcctgccagcacatgccaggcaagaaggagaaagagaggatgcaaccacaaacatactggccatgaaagaaaagcaatgtgagtcgctgaccaagggttccagcgcctacaccgtggtcagctcctnnnnnnnnnntcctactggccatgaaagaaaaacaatgcgagtcgctcaccaagagttccagcgcctacaccgtggtcagctcctcgttcttggacttggccagcgcatcgatgctggcgacgtactcattcgtcagctcctgcacggcatcctccaggtccttgcgctcgtcctccccgattgcactttctttctcacgcttctctatggccttcatcgagtcgcgcctcacattcctgccgaggtggcaagaggggcatatggtgtgaaggtagaggcatgctctccctcgatgcacagggccctgctttgccagggctaactgtctccagagcagcagtgggtgcctatgatagcccaaagatacacgccgctgcgagccagccgcaccttatggccaccttgccttcctcggccagcttggcaacaattttggtcatctccttgcgccggtcctgaggtggcatggggaaaggctcagtgtgagagggcacaggtctctcataagggcaaggcaaagcgaacgagcaggacgcctaactcccccttgggtagctggaggcatgctcccctcccaggccccccattcagtgcccctctggcctcaccgaggtgagcgccgggatctggagccggatgaggcggccattgttgttgggggtgaggcccaggtcagactgcattatggccttctcgatcactgcaatggcggaggtgtcgtaaggttggacgaccagcagggaggcctcgggggcgctgatgcctgccagctggcggagcggggtcggcgcgccgtagtagtccacctggcagtgtgggcagtcagagggtcaaaccagcgctccggggtgggaacctcgacccgacaaggctgcnnnnnnnnnnatcagagggtcaaacctgcactcctggggtgggaacctcgacccgacaaggctgcgcatctctcaagatagccgccgccgctcaggacatatgcaacgagtgtagccaggaccacagagatccctccctctcaccatgacccggtccagggcggctggattggcacggccggtgcggacggtgccgaagctgcgccgagtggcctccatcgtcttctccatgcgttccatctgggaggaatgcaaggggatgcgtgggaatggcatagctaccatcgcacctgcagatgagccaagtaactctagggatctgggggcataccaggctgcacacactggccatgccctcctcgcaccgaggctcaccgtatcctcctcaatgtcgacctcgacagcatcactcccggtggcatgcaggacatgggacgtgagatttgcgggtgaagggatgagtagagggatgatgcgccgttgggccggcctgcgagtatgggtgcaaataagggggggaagggtgagggcacggcccagcgcgtgacataaatctcgcagagggcaggacagggcgccagtnnnnnnnnnngagggggtgaagggtgatggcaaggcccagcttgtgacatagatctcgcagagggcaggacagggcgccagtcacggaggatgccgcttcacacttcatgagtaatatcaacttcattcctagctcagggtgaacacggtcgcggtggcaacctttgatgtacaggaagcctgcatggtcgctttggccgggggagtgtgnnnnnnnnnnctaatatcaacttcattcctagctcagggtggacacggtcgcggtggcaacctttgatgtagaggaagactgcatggtcgctttggccgggggagtgtggccgtgaaggctttggagcttgctgtgctccgctgcgccgatgaggttgacaagatgatcgcagtcattgcaatatacagaacctagttgtctccgaatttctgctcgctcacaaggatctagaggccacagttccgggctccgatcccaatgcgatcagattgccgcgacgcatgcatgatggcccaggagtcattgtgaagaatgcaaggggcactcagtcgtttgttattccatttgtacctaattctatacattcatcgatgccaggtggtgaggttgtggcacccttgaagagtctgtattggaaaagctgtgcaccagccatgtgccccatgcaatgcaggaatagcatggaagttaggtgaagcccttggctgctggaagcgtctccaaatacacacattcgctctttgctatgctcnnnnnnnnnncagcatggaagtcaggtgaagcccctggctgctggaagcgtctctaaatacacacattcgctctttgctatgctcnnnnnnnnnnnnnnnnnnnnnnnnnnnccacggcgacaagggtcatctgccccaactaggaacccagaaagcatcattatctnnnnnnnnnngcttttgcgtgggaccaactaccaagatttgagtgatgactcagcactccccagattcgggggtcatggggcagagcaacacacggcgacaagggtcatctgcctcaactaggaacccagaaagcatcattatctcacaatttgatttcggaggcgtgtcgggaaggctcccttccacgccttgtcaagatgttggtcgttttcggcaagcagcggaagagtctcctttcgcccactaagcggaagaacacgctcatggtgacaccggaagaagaatctttcctggcctcgctgctggataatctgtacagcagcctgcccaggcgccagaggggctacgtccaagagcacatgttcggcgggggtggcaacggcatcgcgtgagtccctggccgggcactagggtttccggtggggttgcggatgctgagacaatggagagaccagggacctttccaagccccatgttgccacccaactttcccatggttggatgaacactttttatatccaccacaggtatttggcctctgaccnnnnnnnnnngcctttccaagccccaagttgccacccaactttcccatcgttggatgaacacctttcatatccaccacaggtatttggcctctgaccgccaccaagttgccactgatggagatgtcagcgtgtttttcaagggttctctaagaagtgagtagtcggcaaggctccaaccccacctcatggttgcttgggtcctgctccacacctagaaatactgtctggagttctgcacggcaactcagtatcttcttcttcctccctccgcttagatcctctggaggatatagaggaggccagttacatccttcaaaagtacgaggatgactggtgcacagatatcgtcagggagcgaccaaacttctccgcactccaagttttccaaggcccttttgcgtttgtcctcttcgaccggaggtaaggtattttggggagatttgagtttcctagcgcaagccttcgtcatttatagaaaggccagcatgcctcgcccgtcaaactgaactaccagtgcacgatctttgcagctgcctacgaatcgtggcggggagggacgcgggtggcgaggagcnnnnnnnnnntgaccggaggtaaggtattttggggggatttgagtttcctagcgcatgccttcgtcattttatagaaaggccagcatgcctcgcctgttaaactgaactaccagtgcacaatttttgcagctgcctacgaatcatggcggggagggacgcgggtggcgaggagcccctctactggggagctgccctgctcagcgacggcctcctcttcgccagtgacaggcaagggttgtgggtttctctcggatgaagagatgagatcaacgtggtaacaagtcatgctctgatactgtgtgccaccgcgagttccccatcttccaaagtcttacnnnnnnnnnnttttctctcggatgaagagatgagatcaacgcggtaacaggtcatgctctgatattgtgtgcctccgcgagttccccatcttccaaagtcttaccgtccacaggtcgttgatcgaggcagacacagcagacgcggccgccttcccacccggcatggtcttcgtgtcccatgaggccgacaccgcgggcgacctagtacccatggcccctgccacacgcccaccctccgtggccgacatgtgtcgcgtggagnnnnnnnnnntgacactgcgggcgacctagtacccatggcccccgccacacgcccgccctccgtggccgacatgtgtcgcgtggagagtacgggggacattgcctccctgcccctccacaagaccgcctcccacccacagctgtctgcggcttgaatcgacctccacatcccaagtgtgtaccttgatcgtccaggccgagcccctcgtcggcgggtgccctcgcgctctcgagccaccgcccagatactggttcctcgctcctgttggagggtggagcgcgcacgagtctgcgcatgacgccctcgcccgttgccctgatcttgtcgacacggcatgccaggatgtacacgctgccattagcagtccgctcctgatgctgacaccccagcaccgttttgtacccctctttcccatcaaagacgttcctgtgtgcatgactgaccccctcccccnnnnnnnnnnnnnnnnnnnnctggcgccggcttaaggaggacatctgagggtggcagatcgcaatgtgcgtgcatgaagcagtgggcatccgtcgcaagtcaggaatacccagggccaaaacctcagcgctgtgcgtacgaggctcgccctcaagggttgctgatgtgtggccacaggatgctggtgagtgggcagggacaatgctgtcagtttggacagaggtgccatgcatcgtgcacagaggggcaggtgtgcatccacagctgcattgctgggatgagtacaagaccaaggactgtctgtgggacaaaggtactcaggggtcctggcgatggggggggcttgatgtagtatagctgccacgacatcttcccaggccaagatgggcgtccaggaggcacagcatgctgtgcccagcatccctnnnnnnnnnngtggtacccaggtggtcctggcgattggggggcttgatgtagtacagctgccatgacatcttcccaggccaagatgggtgtccatgaggcacagcatgctgtgcccagcatccctcgcatggacatcggcgctgcaccttcggggtctggccccctcccgacgagggtccgcctgcggcggcgcgggtcggggcacacgcgctcagggcctggcgttgccgtttggccccgcccccgcggcgccgcccacccacggcacctcctgcgctaccagtgtcaggctgagcgtgcccgccccaggcctggccacctgcagcaccaggggcttgccgatgctgtcccccagcgcggcgacgagggccttggtggtgggaggcgcgccgcgcgccgcgccagcccaccccgtgaccacgtccccctggcgcaggccggcgcggtcggcgggcgacccgggcgtcaccgccggcaccaggatgcccgcggtcacgtccgggaaccccgggtcgcgctcgcggaagcgcgcggcgctgtgccgcgtcagctccagcatcttgatgccgacgtggggccggatgacgcggccgtgcgccgccagctggcgcatgacgtctatcgcggtgtccacggggatggcgaaggagacgccgtcggcggccagggccttcatgcagctgatgcccaccacctcgcccgccaggttgagcagcggcccgccgctgttcccgcggttgatggcggcgtcggtctggatgtagtcggtgcgcgcgccggccaggcccagctccgccgcgcggcggtcgacgcaggagacgatgcccgcggtgacgctgttctggaggtgcaggggggagcccagggccaccacccactccccgacgcggaggcgggaggcggagcccagccgcacgcagggcagcggcgcgccagcctccacgcgcaccaccgccaggtcagagacggcgtcggaggagaccacgcgcccctcaaaaacgcgcccgtcctgcagcgttacggtcacggcgccaccggcgccggcgggggtgccggcggccccgccgccgcggcgcggcgcgggcagcgcgtccgccaccacgtgcgcgttggtcaggatggtgccatcggggtcgcacaggaagccggagccggaggagccgacggggaaggggccgcggccgaccaccacgatgttgaccacgccgggggcggccttggctgccgcgtccgcgatgaagtggggggagaggcaggggggcccgggagcggtctgggacagggcgccgaaagacggcaggtgccctggtggtcccgggggaggagtgaaggggcgtcgtcgttcatgaaggggatgaggagcgttgtggtgggagggagcacagggtggggcgcgaggacgctnnnnnnnnnnggggggaggagtgaaggggcgtcggcgttcatgaaggggatgaggagcgttgtggcggaagggagcacagggtggggcgcgaggacgctccagaaagtcagcctgttccccggcgcatcccccctccatccccgccgctcgtccagagatccctgcgacctccccctggccttccnnnnnnnnnncctccatcctcatcaacacacacgcgctgcacctgccagctggtgggagagggccgacgcagcgcccggcgtagaagatggcgtggaggctgccccgccgtgctgcgccacgcccagcctgtcgtgctgcgcgcccagggcgacgccacccatgaggatgagagccagggcgccctggctgatgctcacggggcgccggggatccgcccaggacaggcggctctccggcagagtgccgctgccgcccagcgccgagggtgcagcctcgggctttggcacccctggggcaacccctcccttggagggcatcccagaccacagctggcgcgatcgcagggccaggagctgcacatccttggacaaccggcgcctcattgggagggtctgggggtctgagtgccccgcggagggagcagcctcacacaaaggccgagagtctccaggcctgggggttcgcactgcatctcggggcctccaggcatttgcaattctctggctaccgtgctggaaatttcttcgtcgctccaagagccacgatgtgctcccaaggtgagggtttcgatccccgggacacgactcttcaaatacaaagtccggaatcccccatccacattcccgccacagtcgaggtgggacaggcacagactctcgcccgatcgccccagcctccggccaagaggcttgccatcgcattgcaacacatactgaaccccttgccatgtctgacatagcgcatcatgctgaccatcgcccctgaccagtccttgcggtgaccgctcttcccccagcccatgctggcgagcactccaccctgccaataccatctttactcagtgtcgagtccacctgcccttccatatatcggatcgagtcctccattccatctcgacacgtggtggcgggggtgagaggggggcggtaccatggaagctttgttaacgctaggcgtctctgtcgtgtccgggctgtcgcaggccacacaggggccctgccccgccacgcccgtgtcatgagcgtcaccaccgctccgcatgcctcatgcagggcctggacgcgcgagcggcagggatgtactacgccccctctcccctggagcccacccccctccaccgcgcagcccagagcggggatgtgacgctgctcacgcagctcctcagccatgaggtgcgaagggcgtgcatgcgattgtaaggggccgatggcagtggccgaggactcaggcactccagtgctctctgtgatgtggcgttggtgtgtcaagagtgcgggattggttgaccctccccacgactgacatgcacatgacgggtagctccctgcagggcagttgttccttcaaatatcatgactgaccagatggtgttcacaaaggtccccacagcctgtatgctcttcctgccatctcccatgtttcagtggtcctgactttcacgagtccaacacctgcctttcacatgctcggagccctttcaacccctttgcacaacccccgcacccccccttctccttctaggatgtggacctgctggccagggacttggaggggcgnnnnnnnnnngccccccccccttccttctaggatgcggacctgctggccagggacttggaggggcgcacccccttacaccacgccgtcatgcggggccacctggagtgcgtggacttgctcctgagcgccggcccccaggtgctgctggcccgcgacttcctctcctgcacaccactccacctggcggcagtggccaacggcgcagcccttgtcctgcgcatggcggacgcgctggcgcgcgacgcggcgggccgcacgcccatgcacgccatggcggcacgcggctgcatgcaggacctgctgggctacctgcacctgggctgggagagtgccgcgctggccgtcggcgccgagcgggggaccggggccgttgcagggccggaggacgcggccccgcagccctgctctgcggcgccgccggcgcccggctcgccgctgtgcgtgg

SEQ ID NO: 42357 - DNA, 93 bp, Chlorella protothecoides
caggacaggcacctaaactgccagctccacgtaagtcaacccaaccccccctccccccactcgcagccggacaatcttcttgcggagaatggg

SEQ ID NO: 42358 - DNA, 61 bp, Chlorella protothecoides
accacctcgcccttcccccctcacccccccaaatccacccatccatcacaggggcctgggt

SEQ ID NO: 42359 - DNA, 61 bp, Chlorella protothecoides
cgcatgccttgccctgcggcttgttttcctaccctgccggtgtttttcactgcagctgctg

SEQ ID NO: 42360 - DNA, 62 bp, Chlorella protothecoides
gtacgctccggctgctccgtcagcgtacgcaccggcatcaccagcgtaagctccggcatcca

SEQ ID NO: 42361 - DNA, 99 bp, Chlorella protothecoides
gccgggattctcgggcatgctggggaggcttgagctgacgaccacccagctctcaagcatacctcacgtatcctgcagcgaggctgcttgcatccactt

SEQ ID NO: 42362 - DNA, 104 bp, Chlorella protothecoides
tcagaacgcatcgcatgcgctatgaggatgcctggcggtggtcatcatcagatgttcgtccctcgttacactttgtgcatcgcaggcagaaacccaaatacaac

SEQ ID NO: 42363 - DNA, 88 bp, Chlorella protothecoides
gggcgtgctgtccccgggaggaaaggacgcccagggccgtgatggggcgggcgccatcgaggtgaccccggcagcctacggcctggcg

SEQ ID NO: 42364 - DNA, 61 bp, Chlorella protothecoides
caggtgaaaggatggcggtgtgcaggggggtgggggggatagatcactgtgcatgacacag

SEQ ID NO: 42365 - DNA, 61 bp, Chlorella protothecoides
ttgtaattacattgcacaagggatccgcctccacaccccaacgctcgtgctctgctccatg

SEQ ID NO: 42366 - DNA, 96 bp, Chlorella protothecoides
caacccccccccccccccccccacacacaccctgcccacttttcagctcccgttcaacccatcttctcccccttttcccaacccccctccacccaa

SEQ ID NO: 42367 - DNA, 76 bp, Chlorella protothecoides
cagggtttcttgggcaccgatctcatctaaccaccccccctttcacccccctcacgcaacaaagaggactgacctt

SEQ ID NO: 42368 - DNA, 61 bp, Chlorella protothecoides
gcacaccagttcaaagtgcatggcgccgttgcgcggcgcgccttggtccatgagcaggcgt

SEQ ID NO: 42369 - DNA, 61 bp, Chlorella protothecoides
ttgcacattccttcccagtgagaggctgggggacaatgatggagagagttgtgtattttct

SEQ ID NO: 42370 - DNA, 61 bp, Chlorella protothecoides
tgcaaggttcatgctcgctgcggcaggggggggagcctgaaagcctgtttgttgagtagta

SEQ ID NO: 42371 - DNA, 61 bp, Chlorella protothecoides
gtgggtggctggggtccgcgtcattggtggtgttatatagggatggcggcttcctgaacag

SEQ ID NO: 42372 - DNA, 76 bp, Chlorella protothecoides
cctgccttgggcctccgtccaacccccacccctccccccctcgcatgcgcacccacagctgatccaaggcaagctg

SEQ ID NO: 42373 - DNA, 61 bp, Chlorella protothecoides
cggcatccgagtcttctgtcggcgccagagagtttgcgaagctgacggacagcactgcgcg

SEQ ID NO: 42374 - DNA, 61 bp, Chlorella protothecoides
tcaaggccagcaggttcgcccgccatattgaggggactggcgagcggatcacgtctccacg

SEQ ID NO: 42375 - DNA, 67 bp, Chlorella protothecoides
gcctgctggtccactgtgggatgtcgcagaaggggtttatggggggggggggggggggggggggggg

SEQ ID NO: 42376 - DNA, 73 bp, Chlorella protothecoides
accacccacacgtgccgtgctcccacaacatgactcaccccataccaccccccctcactaaaatttgcaggcg

SEQ ID NO: 42377 - DNA, 8623 bp, Chlorella protothecoides
  modified_base (1130)..(1139): a, c, t, g, unknown or other
  modified_base (3885)..(3894): a, c, t, g, unknown or other
  modified_base (5262)..(5271): a, c, t, g, unknown or other
  modified_base (6258)..(6267): a, c, t, g, unknown or other
  modified_base (6335)..(6344): a, c, t, g, unknown or other
  modified_base (6644)..(6653): a, c, t, g, unknown or other
  modified_base (6913)..(6922): a, c, t, g, unknown or other
  modified_base (7404)..(7413): a, c, t, g, unknown or other
  modified_base (7925)..(7934): a, c, t, g, unknown or other
  modified_base (8309)..(8318): a, c, t, g, unknown or other
gaacgacggctggcggcggtggcgcgcccaggcggcggccgcacccgagggcagcgtgggcgggtgagcggagggcggcgtctggcgcagctccggcgtggcgcactgcaccaggggcagctccttctggaccatggaggccatggccgccaccaggtcctcggagatctgggggtgcggcgcaggagcagtgtgcgcccgcagcagcctgcgtgggtggcggtgggggatcgagggggtggagagggtggccagggtggtgatggtcttcctcacagcgggggtgagagaagaggtaggcggggcccggcgccgtacatgcctccgccattgcactcggaagggaacccacgggtagatcgaggggggggaggcaggtgtgtgtggtgctcgggcgacgccctgcacccattgctccccccctcccccccaaagtcctgatgtggtcagcccaccagtctcgcatggaaggaagagtgcacacacccatacctggtggggatggggatatcaatgctgccgctgctggccctggaaagctgctcccgctcggtggaggaaggggtccgctcccgctgttccatcagcgcctccacgggggacccggcacccccggcgccctgcgctatgctcacggtcttctttcccaggggcaccggccgggtcttcacgcgcaggcccaggggcgcagcccggggctgctcggtgagtgccttgcccagcgtggagtgcacggccgcgcgctccgccatgttgagcgcgtgatgttgaatttctagggagcgacacacgctggagggggatggctgctcgaagccgaccacacggggagctccgccctcgatgcggggactgtcaaaggaggccggcgcaggaaagctagccctcctctccatgccgatcacccgatgcacgctcgactcagagttgcgatgtcatcaggaacatccaggtccggggccggggccgagacagcgtggccaaaccacctcaggcttcagcgcactggtcccccttccctcgcggagaaccttggtggatgggcggagggcgtggaatggcaggtcgtatggctcctttactctacaattgtgatctgatgacagtgagagacaataagatcgtgtgannnnnnnnnncccctcgcggaaaaccttagcggatgggcggagggcgtgggatggcaggtcgtatggctcctttattctacaattgtgatctaatgacagtgagagacaataagatcgtgtgaggagtgcttccgatgcattttcgcgggggtgaggggaggtacgagagtggtacggactgttcccatccgtggggtcgcaccttccgagaccgacagagaagggtagcaatggggcgcacgcgatctacccctcgcgcatgtacaatttggatgcgcgttgtgatcttctagcttgcattggttccgagtgaggaagcgtgtaacactgctctggatgtgtgtgatccctctgtgcgcaaatcagcggacctttcgtccaacagccagttgagcagatgtcaagcacggacgatctttcctgcgttttggcacccccgcgatagtctttgtgaccaaaatcgcattgtacaagtagaccatggtacaaagacctccccgctagagcccgcctggggaagacgacctgcatgggcagcacctcccgcaggccaagttgcctcgtttgcagaacgaggaacacaccgcgcttcagcggctcagatcggatcaaaggttctaatttggattcagaggagtgaaagcgagcatgtaaggtctgctctgagtccactggcgccagttcctcggtacacaatgccggaattggcccagcattcggcacttccaaccccggagggaactggccgagggaacaagtcatcgcgtccacgtccaccgaagtggggtgttcgccccgaggacaaccgaaagagcgcgcatgagcactatgcggacgcggaggcggcgaggtacaccgaaaccgggcatgcaaaccatatacaggccgagctggccctccgagccgtccaatgcctcggcctccccaaggtggaccctcaatctggtcgggagcatgcacgttgtcaacacggcccatggcaatgcgacacctctggcttgctgggtggggtctggtgggcctcaacccacaccaagcgcttcacatcctccttcttgaagtctccgagcctcacccgcagggagctccctgcctgctcgccgacctgggctgtggctccggcctgagcaccgccgccctcctgtccctgggcggctccaggcacgccgtggtcgggctggatgccgcgggcggcatgctgtcgctggcggcgcaggaccccgccctccggggctgtctggcccgctccgactttggccagggcctgcccctccgccgcgcctccctccagggagccatcagcgtctctgccctgcagtggctgttcgccgccccagaccccgcccgcgccacccgccgcttcttcgccgacctgcacgccgccctggagcccggcgcgcgcgccgctttccagctgtacctccccggtgagcgacctcgggcgggggtgcgcttctgcagcgctgcctggcgttggctatgatcactctgggtcgagccggcgctcaccccctccaactccctcgcaggcgacgtcgagtcgcgggccctcctccgggcggctgcatcggccggcctgcgcgccacctacttcgtggactttccccaccccacccccgccaagaagtactacctgtgcgtgaggcgggatgaccgcacgcggcgcgaaccctcacacggacaccccccctgctgtccactggcctggccccacaccgcggcctgcacgctgagctgggcggcggggcaggggctcgggagcgatctggaccaggcccgcacccggctgcgggcggagcacgcgcggcacgcagcacacgcgctgcgcatgctgcggcgggccgcgcgcgcattcctggcggcgcgcggcgccgaggtggccgccgccggcgccacgcgctccgaacacctggcccgcccggggtccggggcgatggtgccctgcggcgcgccgctgcacgcctggtgcagcgtcgtgcttggccccacaactgccaccgccccagtcggcccctcagatgctgaggactcgattgggcccgcgcccgactcgacgcgagtcggccccatggcggatgcaatcacgatcgcggagcagctcggcatcccgggtgcggaggagtgggtgctggagcccggcccggcgcccccgcccgccccgccctacctggcggcgctgcagctcgccctggaagaatcccagaccggggtccgtgcgccgcgccccgacccctggctctggctggagcccgtgccgtgggccaaggccacgccggcgccccccagcccgccggcgcagacagccgtgctgcatgcggccaagcaggccccgctggtggtgagcctggcgacggcgggcgagacgacgggcgaggcggtggggcgggcctgcgcggcgctgggggcggcggtggtggggctggaggcggagggggcgcgggagggggccattgctgcgtggctggtccacgtgccagcgccctcaggagagcaggcggcgcgtgcctggcagcacgcctggcagcacgcctggctggcctgacgctgcgcgtgtttgtgagtgtacagcagtggtgcggcggcatggcaggggggagggggcgtggaggggcagggtgtcctggagcacgtgcgatctcggatcccggcggtggagtccccgcggcccggctcatgggcgcgctccaggcccaaagtgtgcagccgtgcgtcgacgagcggcccgctgcctccgagttcgtagaggatgctcggnnnnnnnnnntgtggcccggctcatgggcgcgctccaggcccagagtgtgcaggcttgcgtcgacgagcggcctgctgcctccgagttcgtagaggatgctcggacccgggcggcggcgctctccctcacaggcgcacctggtagctcgcccccgccgcctggtcctgggctgccaccgcgtcgagctcaatgtcctccgcatcggcatacaagccctcctgggacagggtgtgggacggggctgggtgaggaggagatacgcagagcagggtacacggttcagggctctgcgtccacgaggacaaggcgtgcgagggagcgggggctggcgccctcctcccgggcccggcccaccctctggcggccatcgggccctacgcaggacgccccctggcagaggggatttgccagacacgtgtcccctccagcgcacgccagcatcctatgcccatcccaccactccgggcccctccctgacgccagcgtccggcaccccaccaggtcgtagaaggcgcgctgatcggcggtctgcaggtgcaccaccacgtccccaaagtccagcagctcccaggtggagcgccccggaccaggccccggcgccggggtcgcgccgtgcctgctcagggcctccgcctccatgcgcgccagcatggcgcgcagctgcgggcggttggtcaccgtgctgagtaccatgacccgggtccagtagaccaggggtgccacgtgcagggcgcgggtgttgccgccctttccctcctcggccacccgtgccagcgtccgcgccagggcaaaggcctcggcggtggaggcgtcctcagaggggctgtcgggggcgaaggagggggcgggcgggccgaagcccgaagcctggggtggcggcgggtgggacgccgccctcagcgcatgggctctggatgcgctccggccctgtgaaggccgtggggggaggggaacggggtcaagaccgtgcccaagcaacgcagcatgggacgcagcggtgtgacacgttgcctcaaccgaccttgaccccgacgctctgccatggcttcgcgtgacaatctcctcggctgctgaagcccggcgcccaggcctgggagggggaagtaagcaggtgtggagcattgagacatgtaaaatgagcaatatgcatgctgttccaagcttcaggaccccggcgtaccgccagcatggctctccctgggtgctgtgcgaagggcgctggcctgtgcagggcatggacgggatcgagacgaactgccatcccctgcgatttgactctccgaaataaatccacaaaaggcaacgttacgtcatggcaaggagggcatgcatgcgtggtgcattgtcccgcacctcagcatgtggaggggttggggnnnnnnnnnntgttacggcatggcaaggaggacatgcatgcgtggtgcatttccccgcacctcagcatgtggaggggttggggtcccaaaaacaaatcatccttgtgtcgtgacgtgtcggcaaactctcagtccagaggacagtaaaacccgcaagacagccattcgtcaatactggaaactctcacaaccgattggggatgctctgtatagaaacgaagagaacctctgacagcgcaggagtgtgacgtgatcgcttgtctgcctggctctcgtgtccactttagactccagctgggaggctgccaggtcgctgcatcactcacacttgtcccgagactcgcgatgcgtcggggtggatccctcgcggtccgcatgctggcggtgaggcctggtcggggctccacagaggtggggtgggcgaggctcgcccatctgcatggcctcactctggccctctgccccccccccaggcccgctccggcatggaatggacaccatccttcacatggacgagcttcatggctccgccccaggcccgctcctgtgccagcagcgcggccgcgacccgggcctcgcctgcctcccccctctccctggccacggacctcccggccccagaccacagcatctccagcgagctcaccccccgccaggtggtggagcttctggaccgctacatcgtaggccaggccgccgccaagaaggccgtggccaacgcgctgcgcagccgctggcgccggcacaaggtggccagtcccatgcgcgaggagatcgtgcccaagaacatcctcatgatcggcccgacggggtgcggcaagacggagatcgctcggcgcctggccaagctggcggacgcgccctttgtgaaggtgggagcgtggtgggagagggtgggggacctgcgctgcctggggggttgggctcgccgctgcacgagacctgcgttgaacggaggagctgcacttctcgctgcgccgcccagtctgggccttgnnnnnnnnnntgtgcccaagaatatcctcatgatcggccccacgggctgcggcaagacggagatcgctcggcgcctgnnnnnnnnnntggggacctgcgctgcctgggggggttgggctcgccgctgcacgaggcttgcgtttaacggacgagctgcatttctcgctgcgccgcccagtctgggccttggtgtttttaggtagctgcaggccccctggcctgttcgtgcttgagagggagtgcccgcgacagcttgtgttgtgctgacccatccccttgccgcccatgttcttgctctggcatcctggagattcggcgtactcactttggcccccactgccacctgtctcacccaatcaggtggaggccaccaagtttacagaggtnnnnnnnnnngtggtcttgctccggcatcctggagggtgggcgcactcactttggcccccaccgccacctgtctcacctactcaggtggaggccaccaagtttacagaggtcgggttccacggacgggatgtggactccatcatccgcgacctggtcgacaatgccatcgtcatgatcaagcaggttggctgaggatggggccttggcggggaaggctcggccacttggccctgcatccatctggggggcggtagggaaggcgtgcgcannnnnnnnnnaggggggccttggcggggaagggttggccacttggccctgcatctatctggggggcggtagggaaggcgtgcgcaggcgtcacagcgcatgcacttgcaccccctcctcgcccctgtgtcgagccctggacccaaccccgggaccgcccgcgcagcgcatgaagcgggaagcgcaggcggccatcgatgcggcggtggaggatcggataatctctgcgctcctgggcgagaatgtgacgcaggagacgcgcagctccttccgagagctctacaggtgctccgggctgctgttggggttgtgtgctgggctgccgcctaagggtggttggcagggcgggagcaacgtgtttgtattggcagggaaactcccctgtgggctggtacctggcccagaggggcgctccgctctgcagctcgtgccttatttggccctgcctggcccacatgttctccctcctccaccctcgtgaaccccccccccnnnnnnnnnntgtgtgtgctgggctgccgcttgagggtggttggcagggcgggacaacgtgtttgtactggcagggaaactcccctgtgggctggcgcctggcccagaggtgcgctccgctctgcagctcgtgccttgtttggccctgcctggcccacatgttctccttcctccaccctcgtgaccccccccacccccccacccccttttccgctgcagggataagggcctggaggaccgcatggtggagatcgaggtgcccagcagccccgcccgcatcctgggcggcttgggggaggcggggggggtggccatgcaggcaagtgttttggtagaggggtgctggggtggggagtgcaccatgtggcgggcccctgctgcggactcggacgggacctctgggccgggggcggatgcgcccgctgcgcccaaacaggtctccgtcgtcccctgcaggtcaccaccccactccccttccccgctcaccctcgcccccccaccctcctcaggacatggtggtcnnnnnnnnnncggtgggcccctgctgcggactcggacgggaactctgagctgggggcggatgcgcccgctgcgcccagacaggtctccgtcgtcccctgcaggtcaccgccccaccccccttccccgctcaccctcgccccccccaccctcctcaggacatggtggtccgggtggacaagctgttcgggcgtgggcgggactccaagcggcgcatgcgcgtgtcggaggcgcggcccctgctggaggacgcggaggccgagaagctggtgagcagcgaggtcgtgctgcgcgacgccatcgccgccgcggagcaggacggtgcgtttgcagggatgggtggggaggaaggcagggggcgaggggaggggtggagaccagggaggnnnnnnnnnntggtgcgtttgcagggatgggtgtggaggaaggcaccgggcgaggggaggggtggagaccagggaggcggaggtggagggcaggcggcggtggcccgtcggccggcccccccctggcaatgggcggtgtgggatcatcgtgcactcacggcagccggggtgttcgtgcggaggctggggcaccgcgtccccagtaaccccccctccccgttcccccggtgcgcgccacacgagcacggccagggtggcaggaggcagtgctctccacacacacacctcagaccccctcaacccccccggaccccc

SEQ ID NO: 42378 - DNA, 61 bp, Chlorella protothecoides
tcgccacctcctttgccggatgaggcggggtgcggtggaatcttgagaagatccagtcgaa

SEQ ID NO: 42379 - DNA, 106 bp, Chlorella protothecoides
gatggcagccggcaccagcagcacccccgccgcctgcagtctctcccggaaaggctccgcggcccccaccgcggcctccacctgctcccgcgtcccgaccatgatc

SEQ ID NO: 42380 - DNA, 61 bp, Chlorella protothecoides
gcccttcagcaccctagaccccagagggtactggggcgctgcgggcgccagcaggtggatg

SEQ ID NO: 42381 - DNA, 18965 bp, Chlorella protothecoides
  modified_base (129)..(328): a, c, t, g, unknown or other
  modified_base (919)..(928): a, c, t, g, unknown or other
  modified_base (1790)..(1799): a, c, t, g, unknown or other
  modified_base (3053)..(3062): a, c, t, g, unknown or other
  modified_base (3313)..(3322): a, c, t, g, unknown or other
  modified_base (4317)..(4326): a, c, t, g, unknown or other
  modified_base (4840)..(4849): a, c, t, g, unknown or other
  modified_base (5579)..(5588): a, c, t, g, unknown or other
  modified_base (6015)..(6117): a, c, t, g, unknown or other
  modified_base (6412)..(6421): a, c, t, g, unknown or other
  modified_base (6952)..(6961): a, c, t, g, unknown or other
  modified_base (7309)..(7318): a, c, t, g, unknown or other
  modified_base (7500)..(7509): a, c, t, g, unknown or other
  modified_base (7791)..(7800): a, c, t, g, unknown or other
  modified_base (8247)..(8256): a, c, t, g, unknown or other
  modified_base (8857)..(8929): a, c, t, g, unknown or other
  modified_base (9266)..(9275): a, c, t, g, unknown or other
  modified_base (11063)..(11072): a, c, t, g, unknown or other
  modified_base (12255)..(12264): a, c, t, g, unknown or other
  modified_base (13771)..(13780): a, c, t, g, unknown or other
  modified_base (17720)..(17763): a, c, t, g, unknown or other
  modified_base (18091)..(18100): a, c, t, g, unknown or other
gaggcagcatatcacttggttcattgattgtgcaacaggcaagcagcggcttgagttggtgcaccgcacacatccacgcaccccacatgctcgcgctactccacctcatcatctccgatgcctatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtcccgtgctgtgcagctgattgggtgcgtgggatcaacttgcgcctcgtggtgaccctcctcctccccccctctcccccttgacaaggttacaacatcaaggcgggggcggggtccatgatcgagatgatgaagatcgacatgggcgggtctggcgccgtcctgggcgcggccaagaccctggccttgctcaagcctgagggcatcgaggtgcactttgtaatcgccgcctgcgagaacatggtggcggggggcggcatgcgcccgggggacatcctggtggcctccaacgggaagacggtggagatcaacaacaccgacgcaggtgcgcttccttcgtgtacaaggggggttcctggcgttcaaggggagtcatcgagatgcgcaaggaccgtccacagtgtctgtcgtcttccgtcgcgtgaatgatgggccttcagggggggggggccatgtagcctttgacctgccacagccccctaacttgccgcagattccccacttgccgtttagcaccgtccctgcgcgaggagcccagcattgacagtgcaatgctgctccaccccccccccccccccccccccccaannnnnnnnnngcgtgtgaatgaggggccttcagggggggggggcatgtagcctttgacctgccacagccccctgacttgccgcagcttccccacttgccgtttagcaccgatcctgcacgaggaggccagcattgacggtgcaatgctgctgcacccacccacccacccccctcaaacacccgaccacgcagaggggcgtttgaccctggcggacgcgctgctgtacgttcagaaccagggccagctggacgcggtggtggacatcgcgacgctgaccggcgcgtgcatgatcgcgctgggccccgccatagctggcctgtatggctccagcgacgcggcggccgaggcggtggccgccgccgcacggcgcgcgggcgagaaggtgtggcgcatgccgcttgagaaggcgtacgccgacgcgctgaagagccccatcgcggactacaagaacgtgggcgggcgggcggggggcagcatccacgctgccctcttcctcaacgagttcgtggacaccgagcgcgtggcctgggtgcacctggacgccgccgcgcccgtgttcagcgacaaggacggcagcgccaccggattcggcgcccagaccttggcgcagtgggtgctgggcgaggcgggcctggccggatgatgcagggcgaggggtgggcaggtgcatgagcgggggggtggaggggtggggggaaagcagcgaggacgacgcaccccgagagctgccgacaggagtgctggattgacacgggggaatctggggccctgcttgaatcatcccatcctcaaccatgctctgctccttgcccttcatgataacgaagacctgtttgcaacggtaaacacacgaccagcaatcaggcagcannnnnnnnnngctgctccttgcccttcataataatgaagacctgtttgcgatggtaaacacacgaccagcaatcaggcagcagggatgacatttggggtgagagcagcccaggcctgaccctcccagggccgggcatgcaccgctcgggcgcagaggcttggccggcgcagggccctgctcaggaagaggaggaggtcggtggagagaggctgaccagactccaacacggccatcctctgcgcctttgaggcaccctccgccgcacgcgcgcccgacttcttctggcccaggcagctctctgctgctgtgccgagggcgagctgcagcgcagtagggttgatgaccattctgcgctgcagcgcgcccagcgccgcgccagccgcggccctgcgcgccaccggccccacgcccgcctgcagcgcgctcgcgaggtgcacgctgccctccagcaggcgagcggcgtgggtcacgctcgtacggtcgtgacggccagcggagcaggccgtcatctcagcggcgatctccagcgcctcgtcatttcggccctggtcccgcagcaggccggccagggtcagacgaagtatagctgagtcgctttgcttcagggtgtctcgtagcagggcctctgcgccgggacggtcgccgtcggggtggagaggagaaagcgcggccaggtgcaggccggcggcggcagcggaaatgggattgcccggcgcctgtgctctcatgaaagccgccgccgcctggtcggcgcggccacccgcccacagcacgcggccgagaacgcacagcgcgtcgccagcatgtacactccccgccgccacgcgcacggcctcctttccagacagcagggcggcgtcggcacggcccagggcagccagcgcctcggcctggctggccagggccgcgaagcgtagcgggagcgctggctggcgctcgctgacgccccgcgccgcgcccgcccaggccgccgccctccgccatccagcctgggcgccagtcacgtcttcttgccccgcagcagcatgcgcggcgacggcagcaccagccacccagagcggcgcggcgtcgggccccgcatgcaccgcccgcgccagccgcgccaggtgctccctcgccgcacgccggctggagcccgggggcagcgccagcagcgccgacgttgcggcctcgagcgcagggtggcgcagccggatcggggtcgcgccggcgtccagcacggcgcacagcatgcccagcgcggcgcgcgccctggccgggtcnnnnnnnnnngatcggggtcgtgccggcgtccaggacggcgcacagcacgcccagcgcggcgcgcgccctggccgggtcggcgcgcaggctggttgccgccagcgccacctgggccggggcggagcgggggcagaggtggagtgctgcggcgcaacgccttgccgcagcgctgagggtggcggcgagatcatctggcgccgctgggagcccagaaccagcagtctgcgtcgccgcagcctgcaggaggcagaggtgcgccnnnnnnnnnnatgaggctggcggcgagatcatctggcgccgccgggaccccagaagcagcaggctgcgtggccgcagcctgcaggaggcagaggtgcgccgcggcctcggcgtccaggggcccgaggcggtgcgccacgccccgcaccgcctcgacatcgcccgaccgcgcctccaatttggcggcacgcaggcgcagcgcacggacttcaccctcccccaccggccagggtccgacctgcgctcgcggcagcaggaccccttccagccgaccgctgggggacagccctgccaaccacgccagcgacacgaggtcctccagcacgccaaaggcctctcctccgctgcgcgccccctcaagcgcagaggaaagcgcggcgtgcgccgcgtccaggtcgcccgactgctcatgggcatgggccagcgttcgctgtacgcttggaagggccaggtcgccacctgcggaggttattcagcgtgtgtttctgttgaaatgaaggtgagtctgcggacagctgcagcagccacgaggcgcataggtttctgacacactttttggcgacaagctccatccgctgcttcatatcgatccttaagacccacccttccaagcacgcgccccgccccgcccatccaacgccccacctcacccctgcctgccgtgtcgagctcggcgaaaatgcgcagcgcggtcgagccgtcccccgcttccaccagcgccgccgcccggcgcaccaacacagccgcctccaggtcgagatcccctctgtgacgcgccagctgggcggcagtcccatacgcctctgcggctccagccgcgtcgccgcgccgctgcagggccatgccaagcgcagcgtgcgcagcggggtccagcggcagcaggcgcgaggccttgagcgcggccaggtacgcccgcgaggcgtcgggcccggccggcgcgcccaaggaaagcgcggcaaagcgcagctggtgcgtcgcccccgcccccaggccgacggcgtgctcnnnnnnnnnnggtcgggcccggctggcgcgcccgaggaaagcgcggcaaagcgcagctggtgtggcgcccccgcccccaggccgacggcgtgctccagcaggcccagcgcggcggccggcgacccctccgcgtcgcccatcgcctcccagacgcccggggaagcggcggcgtgcgtgcgtgccgcctgcaggcaggcgtcggccgcgcccggccggcccgcccccacgtacagcctggccagctgcgtccaggccggtgcattcctggggtccagctggagcgagcgcgccagggcatactctgccttctcagtgtcctggtgcaagggtgagcagggagggaggggtggggaggattaggcgggcgggttctgtgcccctccaccggctcaccagagcatgcaccatgacgccagcatgatgccgttggccgttgacacgaagcccactggtagagtcacagctatcacatgtaatcccagcgaatggggcgctgcccgcacctcgcggcaggtggctgcacnnnnnnnnnnagacacgaagcccactggtagagtcacagcaaccacatgtaatcccagcgaatggggccctgcccgcacctcgcggcaggtggctgcacacagggcccagagccgggagcaggccgggctcagggccagggccccgcgcacttgctcccgcgcctcctggaggagcgaggcggcgtgggagcgcagcgccaccgcgtccccgggcgccactgcccgcgccagctcctccacggccagcgcctctgccagggtcgcggtcgccacgtccgtcgacggcggaggccgagcggactccgactcggcctccccacggtccggtggaacctgcgcgccttccagtctcgccagctcagcgtaggcccgccgcgcaccacacagcgcgcgcagcgcgctcgatcgaccccggaaggcggggcgcagcgcctcgggcgcggcctccacggcgaggcggaccgcttcggggagcgcctcaccgccacccgcagcgtccgcgccaggctcgccggccgccatgcgccccagcgccagcagcgcgtcgcccagcagcttccacccggctctcaggccggggctggcgtccacgcagcgccgcgccaggtcagcggcctccgccagctcggccgctgcgcgccctgcatgcggggagagggttcggagcgcactcgagtgtcgagtgtggcggactcgtgaagggggtcgaagattgttgctcctcccccagcgcagagcnnnnnnnnnncctggcgtccacgcagcgccgcgccaggtcggcggcctccgccagctcggccgccacacgccctgcacgcggggggagggttcggcgcgcactcgagtgtcgagtgtggtggactcgtgaaggggttccaagattgttgctcctcccccagcgcagagctccacacaacccgcgcatccacacgatcgcgagccctcctcctcccttccctcgaccaagtccccgacctggagcctcagcccccctgccaccgtcacgcacccggcagggcatcgcccagggactggccggccgccgcgagcagggcccggcccaggcccagcagggccggcgggtactgcggcgccaggcccacggccgcgcggtactgcgccagcccggcagccaggtcgcccagcgccgccgccagcccggcggcgcgcgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgggaccctgcacgggtcgatccccagcgcgcggtcgaaggcccgccgcgcggcgctgggcctgccctggccctcgtaggcggcgcccagggcctcccaggccgccgcgtcgcgtgggtcgccccgaatggcggcctgcaggtgcggcaccgccgcgtcaaaggcgccgctctcgacgtccagggcacctgggaaaatggaatgggatgctggccgtcgggcatgcagcgcacaccttgatcccactcggcagccaggttcccctccgtgcagcgccgcagccaccccggccnnnnnnnnnngatggcataggatgcgggccgtcgggcatgcagcgcacgccttgatcccacgcggcagccaggctctcctccgtgcagcgccgcagccaccccggcccggccagtccaccactgccttcttgtcctcggctccaagcagccccgaaagagcaccaccgttccattaccgtcccctcaccgagcttcctgtgggcccacgtggcgctgggcgcacgctgggctatcccagcgcacagcgtgcgaacggtctcgcgcctgccctccccccgaagcacccggcacaagccctcccctgcggggcatgggcggacggggcgggcggtcagtccacgccagccccacgaggccgtactggcgggggggttacaggatggggcccctcgggcaatgacccagggaccccgtgaaaatttcggcggcaacgcgttccaaggaaggggggggtaggctggacaagcagggcaagcgtggggtatatggccgagggtcggcgggggggggaaggtgcgtgcaaaacgcgtgctggaccgnnnnnnnnnngtatggccgagggtcggcgggggagaaggtgcgtgcaaaacgcgtgctggaccgccgacgcgcgagtcgcggagggggcgggggtggggcggcacatcattccgggtcgtcgtcgcctgggcgcgagcaactgcttcactcctccaccaccgcgccacctggtaactccagggtggggtccagggccagcgcgcgcttgaagcagcgcgacgcctgctccggcgagtgctcgacctccaggaagtagcggcccagccccgccagcgcgggggcctgcgagtgaccctccgccttggccgcctccaggaactacagtgggaaggggggggggggtcaaagcgaaggggnnnnnnnnnnttcgaagcgaaggggtcgggaaggcatgtgaggtctggtgtcaggagcacaagggtgacatggcacatcaggtgcatgctcgagcgggcaaggctgctcaaccccgccctgccgagcacctccgcgccgccccctcctgaccagacacccttcgatgaaaggccggcaccatctcgtacgannnnnnnnnncgaagggggtcgggaagacgtgtgaggtctggtgtcaggagcgcaagggtgacatggcacaccaggtgcatgctccagcgggcaaggctgctcgaccccgccctgctgagcacctccgcgccgcctcctcccgtccagacacccatcgatgaaaggccggcaccatctcgtacgaggcagggcctcctcgtctcctcccccccgcccgcacctggtggtaggcaaactgcttctcccggcggtaccgcccgcgcatggcccagtacacctctcccagccgcnnnnnnnnnnatcctccccccccgcccgcacctggtggtatgcaaactgcttctcccggcggtaccgcccccgcatggcccagtacacctctcccagccgctggtagtgctcgcccagctggctgtcggtgacgtaggactcggggcccagcgccacgcgcaccgcgtcctccaggtgctggcgcgcgccctggcattgggtggggggaagaaagcacggcgggagggtgtgggtgacctcgctcgtgcggggctcacggggcctgtcctcatgcatgccgtgcccgacaaagcatcaaacttgaaaggagaactaatcccacccccccctccacctggaggtcgccgtccttgtacaacagccagccgtagtcggcgtgggcccagtgctcgcccggcccccggcccatggccgccttgcccaggatgcgctcgtactgggccttcgcggcgtgcnnnnnnnnnngccccggcccatggccgccttgcccagaatgcgctcgtactgggccttcgcggcgtgctcgtcgccgcgcgccagcgcgaccagcgccatcccgcgcagcgcttgctggtggatgctgaccggcgtggcgccgctcatctccgcaaaggcggtctcgccctcggtcacccaccccgccagcaccgagaagtggcgctccgcctcgtccaggcgccccaggcggcgcagcgacttggccatggccaggcgcagggccagcgccacctgcgtcagcgcctcgtgccccgcctcgcgccgcgcctggagccagtgcaagccgcgcagcgcggtgtcggccgcggcctcgtacccgcggttctcgtactgcagctcggccagcgccttccaggccgtggcgcaggtcaggcgcgccgggtcgcgcagggcgtcggcgagcaggcgctccaggtcgcggcgcgtggcctgcggcaccgccaggctgccgtcgcccacggagcggcggcgcagcatcagcgccaggcacgcgcgcgcattggggttgtcggggaagcggtgcatgaagcgccgcgcaaagttctccagcgcggtcaccaccgccgcnnnnnnnnnnnnnnnnnnnnnnnnnnnnnnnnnnnnnnnnnnnnnnnnnnnnnnnnnnnnnnnnnnnnnnnnngtcgcgtgtgcatggcccagcggcgcggcggggccggggttggcgcccagcgccggcgcggcggcgggctgcgacatgcccaccgccgcgcccaccgtggcgtggccagggggcgcgccgccgcccttcatctcctcctcctcctccagcagccagatggcagactcgtagggcagcgcggagcagccccccgcgcccgccgggcaggtcagctcccagcactcgcgcagcgcggcgcggcgcgcggcctggcgctccgcgctccgcgccggcgcggtgaagatgcgcagcagcgagcggcgcagcagctcgtcgaagtaacgcgtgtagcgcagcnnnnnnnnnnaccggcgcggtgaagatgcgcagcagcgatcggcgcagcagctcgtcgaagtagcgcgtgtagcgcagcgccagcggcgcctcggtgcagatggcgcgcagcgcgcgcagcagcggcgtggactcgtcgccgggctcgccctgtccggcgtccaccgccgccagctccaccagcacgtcgcggcgcagggcttcgggggagggcgccggcgcggccatggcgtcgccgcactgcgtggcgctctcctccagcgcggcgcgcaggcgcaggtctaccgccgtggccaccgccgcctcgcgcgcgcgcagctccaggtcggcacgcgcgcactgcaggtccaggcgctcctccgggtacaggtcgcccaggtccagctggcggcccacgtgcttggcggccgcgcagaactcggagcgggcggtgaaggccgccgccagcgcggcatggcagtcgaagcgctgccccgcctcgtcctcgggcagcagctcgagctggagaatgggggcaggggtggggtgagggcatgagctgggactggacggcgcgcatgggctgacaatggcacggcggttcagaggccactggcatcaaaggaggagtcacaaactgggtagaggatgcaccctagactgcaaaattgggccggcacatgccattataagacatacacggagattacaaaaggtgcatgcaccagcgtgcccagatcttttgacgttcaagggctgagggatatccaagaccaaaacatgcctggagggcgcctcggacccccccactcagccactccctcgcaccccacagcatgatcacaatacgcacaagcttggagttggtgcggatgatggcatcggtgtcgtgactggccttggcaaggctggcgagggccttccatgcctctgggcgcgacggtgaggtctccacggcccgctcgagagccttgtgagtctgctcggtctcgcccgccgcgctggcgatctcgctcgccagcctgaacaattcgtgggggcggggaggggttgagggatgtggccccgatgcaggcccggggacagatgccaagtcccacggggccccagactcacaagagcgcctcgtaggatccggggtccttcctcaggacctccttcacgagcacaagggcatccttgtactctttgttggaaagtgcagtcctggctccctcaaggccagcaggttcgcccgccatattggggggactggcgagcggatcacgtctccacggaagtttgggagggcatcgctgaaccagcaagtattgaaagtgagatgcgcgagtatcgtctggtaatgtgtcgaaaacaagcgggcacgcgaatcttgggcgagatatctcgtgattaggttttcctcgcgggtcaccttcaccgcagcatacccgcggcatgaatggcgatgtacagggtggcccatttgaggggtatggtacagattgacacatggaacagtctaaaagcggccacttggccttcgcatgaaccactcgaggacagggaactgggccgccaagctctggagcctcgcttctgcgccagccagcactgggttgctgaatagcagcgctaggttggcgaggcccaggtccaccagcggagctgcctgctttgcagcgggatccagaacatctctggacaatcgcgccgcaccctgcagattttgggggctgtgagtgagtttagaacatctactatgggtagctgtgactcgatgccagggcattgccgccaggggtacccacacccgaaccctgccctacctcaaaacgtnnnnnnnnnntcatctactatgggtagctgtgactcgacgccagggcattgccgccagggataccgacacccgaaccctgccctacctcaaaacgtgggagctgaagccacagcaggaaggcaaactttatgacatggtagtagggcaccctgccagatgggtgcagggtcgaagaggtcagtcacgggaccatacccttgggatctgtgcactcaaacaatctgcactgcaccccctcatcctccctcctaccaggtgactgatttgttgaggagcagctctgctgcggtgagggtgccgtgaacagaccaataccgcagccatttcctgacttccgaggcattctgagaggagcgctggtctgctgccccatccaaggctcgcagggaggcgaaggtggggtaggccaaatctgccagcaaactggggaggtaacgagagtcgggcgtaagtaaagggcatcagatgacacagggatggtggaccattgggactcaccagaaacctcttcctatggcattgtcgtagggcttcaggatgacctgtaagcccaactccgttgccaccccggagaagagggcactcatagcttcgccggattatcccttttctgcaggcctctctcgccaagcactagacagccaccctatacggaaacgtgaccagatcggatgccttgttctgttgatatccgcaaggtcccatcccggtctcgtgcccttgctggaagtgatctcggcatacggcaccgcatgcccgcagcacgccggtcttcaaatgggcatacagcagagggggtccgtcgggataacgaagcacgacacatgcgcacatcgacagctattcagcctctcgcccgaaactaatatctcaccctcaccgactgtgacgtgttcgcggcatggttcggggacccacggcctacttcctctttgccgacgccgtgagggccgatgtccaggaggagctgcaggccagacagcccgctggcaaaatctcggtggcgatcctgggcaaggcgataggcgagcgatggcaagctctcagcgaggaggagaaacaggtcttcaaggaccaagctgcagcaaaggcagcgggtgagggtgggaatgtcctggcaaggccgcatggtgtgacggtgacaagactccacggtcattcttatatcgccagcaatggcatggctgtgctnnnnnnnnnntgtgtaacgttgacaagactccacggtcattgttatatcgccagcaatggcatggctgtgctcgaccctttcacgaacagctgccaacacctttcccgccacagagcttgcggcgagcgaggaccctcagggcgcgggtgaccccgagtccagcgatccctcccccagcaccgcccctgcctccctccccacctccctggtgaagaagatcatgaccatggacagcgacgtgtcgcgagtgagcgcagagggtctgcgtgcggtaggcgctgccaccgaggcgttcctaggcctgctggccgccggggcgctggccagggctgccggcgacaagcgaaagaacttcaggtttggggatgtcctggccctggccctgaaggaccggcgcctgatcgacatggggctggccgaggtcttgcagcaggatccacagtttagagaggtgtgttcattgcggtggatgccaggacagaaactggaaggggtaggagtctctaatctccacccaatctgggctcacatggaccgacccctcactcccaggcatgcgaggcagtggacgcctcggccaagcccaaatctgccagagcagcagctgtgggggacatcgaggacgtgggcatgagaaaattgaccgccttcttccaaggtccgacactggtggcctcttaatgatcgggtacttgacactgtgtgtactaaccgagatggatgttggcggagtgatctgctcgcgccctctcccaaacctcatccattacgaacgcgacaaaacaatcgtcggctcgatggcccgcataacaaaggggacaagattgtagatgtgccaaatgtatatatgataaatcgcagagccgaggtgcgcgaggagcacattgtgtcgggtcaccatcgccagcccgtacgagcttgccgcgacaaccaggcatcagccattgggcccatcgctcctattatacaggaaaccacctgggtgtctcatgagctcttgtggggcatggttgcatcgcctggcaagcggcacccggtgcggcgcccaggctagccggtactcccggaggcaccatggcgagcgagccctgcatgccgggctcaggccccaggcttcaagcgcagccggcaccgccaagcccagcagcacggagaccaagcccaggtgggcggagtttgacgccgagacagtgccatcatcgttgtgatttgctcaaaacatgattcagtgaatacatcccatctgtctctggttcattgcattgcaaagccgtgttgcccaccagcttccccagtccaaatgttcccctggcagaccccgcatcctgtctggcgtgcagcctaccggcacgctccacctgggtaactacctgggcgccattcgcggctggaccgccctgcagcatgagtatggtgcgagcttgtgaggggagggctgtgttgatctgactgtcgggtccgttccaatgcacgattcttccctttctactgggatgtgtctctatgccctgcaccnnnnnnnnnnctccaacgcacgattcttcccttccctactgggatgtgtctctatgccctgcacctcaccctgaagcatgcctgttcatgactaagtccatctccctccccccacccctctcttcccagacgccttcttctgcgtggtggaccttcacgccgtgaccctgccgcacgaccccgcggccctccaggcctccacgcgatccgtggccgccatgtatctggcggccggcatcgaccccgccgtcagtacggtttttgtgcagtcccacgtctccgcgcacgcggagctgacctggctgttgagctgcgccacgccgctgggctggtgagcggtgggcggttgcgcggggcggagggaccgagactgaagcgtagatgggcgcagactccccctcgccctctcaccccttccctcccctctttgtctaggctccggaagatgatccagttcaaggaaaagtccaaaaagacgggggaggaggtgggcacgggcctcctgacctaccccgtcctcatggccgcagacatcctgctctaccaggtggggccgtgggtgcctgtgcgggagggcatgggcatgcgtgcttgggaggtatcaagggtaaggatggaaaacagtcacctgctccgctgtgcttcccaggccctccacaagccatggcagcaatacagcagctgctgccatgtacccgctctgccctggacccagccgtgccatgagttccctcacccctgcccgcaaccgcacagccggacctggtgcccgtgggagaggaccagaggcagcacctggagctgacacgggacctggcggagcgcatgaacagcctgtacggaggaaaacggggcaagaagctgggcctgcgcggctcgcgcctcttcagggtgcccgaggcaggcattgtggaccgtggcggccgctgcatgtccctcctggtgagccaaggacccgtagcaccttgcaggagttgcttggcaggcatgagccatgtgcaatcaccccctcgccagagtctgggcacagggaaggagcctgtccagtgcccgctccaccgcccctcctccaccccgcctcccctccccaggacgggacggtgaagatgtccaagtccgcggagtcggacgccagccgcatcaacctcctggacccgccagacctgatccggaaaaaggtccagcgcgccaagaccgacgcccaggatgggctacgctggggcgacccggaccggccagaggccgccaacctgctcaccatctaccagaccatcaccgggcggccccaggtggggctggaggggtctttgtttgggaatcatggagcggccagcgtacggacatctgcgtactacgctggacagtgtgcgatgctcgatgcattctctgcacccctcgctccgcgtcaaccgtcaggaggaggtggcggaggaggtggcggccatgcgctggggcacgttcaagccgctgctggcagaggcgctggtggagcacttggcccccatccagcagcgctacgccgacatcatggccgacccgcagactctggacgacatcctggagaaggcaagcgcgcgggggaaaggggtatgcagcccgcaaggtcggccagcgcatatgtttggtcctcctgtgcctgatgtgattggtagtgacccgcttgccccctgccacgggacatgctgtgctgtgcatggcctgcgctcacccattcccacacatgggttcctccaaagcacaattgccccagccgcactgccaccatccttccacacccagggagccgaggcggcgggcgccgtggcacatcaaacactagacgatgtgaaaaaggccatgggcttcatgctgccgcacaagagccgatgacggcgctgagacggcgtggcgtcaccgtgcaagggtcgaatgcaatcgacagcccgtggtgcacagtctgtggctcacaacccactccccacagcacgcccggcatggcgtcgcccttgacctccctggagtcgctgctgtacatgagcggtccggtgacgggaaggagagcaagcagattcaggattgggatacgaagagagggggttcaggggtatcggagatcaggctcccacctgatcttcagccacagggtaaatgggggaagaagagcaagggagggtgcgacacggcatgcctgatgccaggctgcaggcagggtcgtgcatcacccgcgcgagcgaagcgcggcgccgcgccagggttcttgacaacatgacggtgcggcgggcgtcgctcacttgggcagcagcgccctgctggcggcgctcccgcccggcggcagcgccagcttctccgggctgacgtagtagaggacgacggagacgcaggccaccgccaggcccagccccagctgcaggctggggtccaggccgaagaaggcgatggacacgccggtggtgagcagcatggccagggaggtggcatacaccttgacgatggagtctgggaggcaaggggggaaggggtggagggtgtgagtttctgtgccccacgagggaggggccagggttgtaacagaacacagcgtggtagcaaagccgggactctgcattccaagcgagagcatacaagccctatgcccttccccctcccctgcatcccatttcccttgcctgcaaacttcatgacccaggaaacaaggaggccgctgaaggccaggttggcaaccaccagccaggtgacgggggtgtagccgtgcaggaggtcggcgagggcggccccgcccgagcccgagccgccgctgccgagcaccagagccaggccgttgaacaccacgccaaagccgtagagctgcatgttctgccagtacaggctgtcgctgttgtgcttcatcacccactccgtgtacacggccgccacggcggagagcgtggcgctcagcgcgccaaaggcatagccctggggcgggaggggtggggagggaagggctgcagactcttgacagcaattcctcatgctatcaaccccttcaacccactatccccttcccgacccttgatccttgtggaaaagatagacaacccaccgcgaggggcgccgacatgagggacttggtgctgccctggctgcagtccgtgttgatctggctggtggtggccccgatggccagcaggcagagcgcgatccactgcagcaggctgagttggcgccgcaggcagatgcggaagaggatgcccgtggtgacgatcttcaggttgcccaggatctggtaggtggctgggtccacataccgcagcaggtagaactgtgttgtgtgggggagggcgggggctgtcaggctgcacgtgctgggtggggatgtctgtacatgcactagagtcttcagtttcattacaagcacgagcctgctctgccaggacctcgatggttccagcctgtacacccttgggctgcaagcagccaaccagcgacgtggagagcatgaacggaccaacattctcccaaacacagatcacagacctgcacgttgttgtgcagcatgtagatgatggagggcaccaggaacagggcgacggtgcgcgggttggtggtgcactgggcggccttggggtcctccttgcgctggcgccgcaggaggttgtagctgatgcctagtttcagggcctcggccaggaatggcactgtggcgaagttgtaggcgtaggacccgccagttttactggcagtggtcagcaggccctgagacgaggtgagggccgtcagcagcgcggccatggtcagcgtgcccgcggcatagccccccggaggtgccatcccttgggacgggctgcggcgcctcggtgtcggcgaatccaacagctgcgcacagatccaattccagatcacacagtgaactacgaggtgccgaagacgctcggattgtgaggatggtcgatcaatgcactatgtccagggcagtgcccggcccggcttagggnnnnnnnnnnnnnnnnnnnnnnnnnnnnnnnnnnnnnnnnnnnnatttgagctgatttctatactcaaaaagaagaaaggtatagaattgggcgtagcgtgcaggaaggggtggtactaggctgaaggtggtattagggcacaatgtgcatgaacatgaaatccttcaattgaaccccgggggaacgtgcaccagcgcgcggtagaaggctagaaggatgcactcaggtccaccttgtgaaacacgagatgtaatgtgatcactcagccggaagcttgccctcagtggcatctcttgagacattctaccacttcgattgtagtttccaaaaaatggatcgtgcagtttttggcaaagagtaacccctgcatnnnnnnnnnncaggatgcactcaggtctatcttgtgaaaagcgagatgcaatctgatcactcagccggaagcttgccctcagtggcatcttctgagacattctaccacctcgattgtaagttccgaagaatggatcgcgcagtttttggcaaagagtaacccctgcatccacccccaatctatagtgttcgaggaccatcaccagcccaagaagtgagtgttatgcacctccactgacaaagcagaggctcagcagtccagtagtggcattcacaaccagcaggggttgacctgttcccagcccgaattttggcaaggcatggagcaatcctgccttcagactatgaacatcaaggtccctgctcgctggcgtcgacagtgctgcagagatggagtctctcattgtatactgggcacgacaggtgaccgaatgtcctcccatgatgtattgaccttctgtcatccgagaattcgaagagcaccagcccgcgacttggtacttccacccgtgaggtactgaacgccgcacggtggggagtgatgagtggcgtggagctcaatttcggctcaatccccaacgttccatatcctaatcgtcagtcaacatcctggttacaatttcccactgttgctctgaggagggccgcgcaacatgcaggcccccggtggcgcctttgaaacgccggctccagtggccgtggtgtacatttgcggcgactgcggagcagaaaacaccatcagagcagtggatgtcattcggtgtcgtgagtgcgggtaccggattctgtacaagaagcggacaaagcgtgtcgtccagtacgaagctcggtgcgtccgtgttgtgtgcagaatgcttcctgaagtcactgtggcgg

SEQ ID NO: 42382 - DNA, 61 bp, Chlorella protothecoides
gaggcccggctggggttctgtgtcggagggggaaagggattgatcggaggctcgagggccg

SEQ ID NO: 42383 - DNA, 103 bp, Chlorella protothecoides
ccgattgttgccgctgccgccgcccactgccgccccgatggcctgcggtgctgctgcgacaggcgctgccgcaacgcccgcccgcgccttgggagctgacacc

SEQ ID NO: 42384 - DNA, 61 bp, Chlorella protothecoides
gtcctgcgccctgtggtagcagaggatgggggtgtgatgtgagggcacagggatactcagc

SEQ ID NO: 42385 - DNA, 71 bp, Chlorella protothecoides
gcgcctggatgggccgccgggcaggacgcaaaccggcccataccactggagtgcccccacccgactgggca

SEQ ID NO: 42386 - DNA, 68 bp, Chlorella protothecoides
cgtttgccacgcatgggcgcagggcattcctcctgcccatcacaccctcatgctgaggaccccccccc

SEQ ID NO: 42387 - DNA, 107 bp, Chlorella protothecoides
gtgcgcggggcctggcgacggcgcggcacaccccacgcgcacccccacgccaccgccgtccgccttcaccgggcccagctccacgccgcagccctccgtctaccccg

SEQ ID NO: 42388 - DNA, 203 bp, Chlorella protothecoides
ggaggtgctggccggccgggacaagggcctagccctccgcaccacgcccgccccacggcccgcagcgcgggaacgaagcgaggcatgcgaggaaagcgcggatcccagcaccacgctgcaggcaaaactgcggtaccatggctgccccgtggaggccgtcagcgtcgaggtggcgctgacgcccgccctggtggcgacggcgc

SEQ ID NO: 42389 - DNA, 61 bp, Chlorella protothecoides
cctccatgcgcgaccaggtgcagtccaccatgcggcgccgagccaccacacccacgcaccg

SEQ ID NO: 42390 - DNA, 80 bp, Chlorella protothecoides
caggggatagcgcagccacctgcaggcctgagattgggtggagggagagggatgatagtgcgctccagcctgaatttcgg

SEQ ID NO: 42391 - DNA, 61 bp, Chlorella protothecoides
gcttcagcaggcctggagcggcagggggggggggagaaatgtgtcatcaaggaatgagaat

SEQ ID NO: 42392 - DNA, 71 bp, Chlorella protothecoides
ccgcttgccccagtcagccctctcacccccacttccttgtgtcctctcgatgcccaggtggcacaagccca

SEQ ID NO: 42393 - DNA, 61 bp, Chlorella protothecoides
gcagagatcgtgagatcgccggcggctcggtctgccaggaagactgccgaaggcgagcgtc

SEQ ID NO: 42394 - DNA, 61 bp, Chlorella protothecoides
ggcttcttggctgccaggtactccggcagggcctgtaattgcggcgccttgaagacatgga

SEQ ID NO: 42395 - DNA, 96 bp, Chlorella protothecoides
gaggaggctgagggcaggtgcgccaagggggtcaggcgtggagtgcaggctgggttccgggcccccctcttccagagcctctgtggcctgtgactg

SEQ ID NO: 42396 - DNA, 77 bp, Chlorella protothecoides
tacaatcactgaaattcactgaagcatctggctgaaaattctcaaatcggcgagctgcagaagacaaagtggtggcc

SEQ ID NO: 42397 - DNA, 61 bp, Chlorella protothecoides
ggctactccatgaacgcagtggaggcgggggccttctccaccatccacatcacgcccgagg

SEQ ID NO: 42398 - DNA, 18863 bp, Chlorella protothecoides
  modified_base (620)..(629): a, c, t, g, unknown or other
  modified_base (751)..(760): a, c, t, g, unknown or other
  modified_base (1860)..(1869): a, c, t, g, unknown or other
  modified_base (2824)..(2833): a, c, t, g, unknown or other
  modified_base (3245)..(3254): a, c, t, g, unknown or other
  modified_base (3739)..(3748): a, c, t, g, unknown or other
  modified_base (3920)..(3948): a, c, t, g, unknown or other
  modified_base (4095)..(4104): a, c, t, g, unknown or other
  modified_base (4484)..(4493): a, c, t, g, unknown or other
  modified_base (5190)..(5199): a, c, t, g, unknown or other
  modified_base (5383)..(5392): a, c, t, g, unknown or other
  modified_base (5699)..(5708): a, c, t, g, unknown or other
  modified_base (6451)..(6460): a, c, t, g, unknown or other
  modified_base (6557)..(6750): a, c, t, g, unknown or other
  modified_base (7501)..(7571): a, c, t, g, unknown or other
  modified_base (7727)..(7736): a, c, t, g, unknown or other
  modified_base (7840)..(7849): a, c, t, g, unknown or other
  modified_base (7953)..(7962): a, c, t, g, unknown or other
  modified_base (8663)..(8672): a, c, t, g, unknown or other
  modified_base (9101)..(9110): a, c, t, g, unknown or other
  modified_base (9460)..(9543): a, c, t, g, unknown or other
  modified_base (10277)..(10286): a, c, t, g, unknown or other
  modified_base (11106)..(11115): a, c, t, g, unknown or other
  modified_base (11375)..(11384): a, c, t, g, unknown or other
  modified_base (11463)..(11693): a, c, t, g, unknown or other
  modified_base (11954)..(11963): a, c, t, g, unknown or other
  modified_base (12359)..(12368): a, c, t, g, unknown or other
  modified_base (12824)..(12833): a, c, t, g, unknown or other
  modified_base (13550)..(13559): a, c, t, g, unknown or other
  modified_base (14382)..(14391): a, c, t, g, unknown or other
  modified_base (14872)..(14881): a, c, t, g, unknown or other
  modified_base (15103)..(15112): a, c, t, g, unknown or other
  modified_base (15458)..(15467): a, c, t, g, unknown or other
  modified_base (15558)..(15567): a, c, t, g, unknown or other
  modified_base (15729)..(15795): a, c, t, g, unknown or other
  modified_base (16829)..(16838): a, c, t, g, unknown or other
  modified_base (17859)..(17868): a, c, t, g, unknown or other
  modified_base (18532)..(18541): a, c, t, g, unknown or other
ccactctgatccagggcggcggcggcgggggcggcggcgcgggcgtccagccgccgacggcgccgcgggccgacgagtgcagcatctgcatggacgcggcggccgacacacgcatacccacctgcctgcacacgctgtgcctgggctgcgcggtgcggctggttgcggggagcgtggagaggcccatctgccctttctgcagggcggacatagatgggctggagggggtgcgggcgcgcaaggccgtggatgtgcccgcgcctgtgctcctggggctggacctgctggtgaccggctgaggcgggcggcggggcctcagtgccgggaggtcgttgtgacggaatctgcggtgcctgaagccggtggccggcgtcaccaggaccagtcgccctgcttgtcggggacgctgtgcctctgcggctcctgtaaccacgccgtggaccccagctgccttgcatgtaccaatcttgtcgctggaggatcacgtgctcatgcttgctatgctcagaaaccttgcatacttttttactttgcagtcctttgacgctgcagggcgttgcacatgcattgggggcagagaaaggtgcaaacccggggactggtctgagtacaaagaaatnnnnnnnnnntgtggtggacttcagtcagatccttcttggtggcatacctgcaccatggggagtaggggaagatatacgggactcctgtgagttgtaagggctctgcaatgccgtgcaacaggcccttcgannnnnnnnnnaaaaccttgcatacttttttgctttgcagtcctttgacgctgcagggcattgcacaggcattgggggcagagaaaggtgcaaacacggggactggtctgagtacaaagaaataccccgtcacatgtacccaatgccttgctcgtagtaggactgcccagtcttaacgaagggaaagggcagttcttgtgtagccttcttgaaggcaaggaatggctccgagacgtggtggacttctgtcagatccttcttggtagcatacctgcaccatgggaagtaggggaagatatactggactcctgtgagttgtaaggtctctgcaatgccgtgcaacaggcccttcgagggtgatgcgactcaaggcaaaacctcaagggcaaggagactgtatcccatgtgggccccccaccgcacctctcgtggatgagcaccagtgtggggtctgtatcggcgatggccaggtcataggagagggtctggggctcatgctccgcaacgtacttggccaggggtctgaacaggtcgatgaagatatcgcgatctgcttcactctcgaacttcacctggatggcgagcacgaacacctgcacaggtatcggcagtgcgctgctgggtggcttgctcgtgaggcttgccgaccctggttttcatgacatttctacacagggttacgatcctgtgacgcaatctcacccctttctggccacgccgacgtctttgatgccatttccctgcaatgaacgcagctcctgttactccaaggagtttcacggcttcgccgaggtgagctcccgcagccatcttcgaggtggttgtgattcaaggagacgcttctccaatactcaggagatctgtaagggtcttcgtactgatacaccttttggatgaaaagggggcgacatttacagttgccagttccgtgatgacaaatcttgcaggtggggagatctccggcactcgcccgccggagccggaaaagatttgcatttcctcttgcgtacatgggagcccttcaatttcacataattgctgttggacaggaaggagctcccacccattctagagccagttatgctacagcaggacgagtacaagggttgannnnnnnnnnatccaagccattctagagccagtcatgctacagcaggacgagtacaagggttgatggaatggcatcgacagggcttactggaatgccgacaggagggattatagcgagccgtacttatgcatgggcaggagctcagacaccctttctgctatagcagactcaggtgcaggcggtctggaactatgctctggaccaatttgctggctctcagctggcggcgctagaggatgtctgtcgtgggcaccttctaagtgcagggagttctcggcgccccttgcggccttgtagaagctgtggagctgcatctgggacacggccattcgctcctctgcaccccagcccacgtccatgacgtcccccactggctgcatggggtggaggcggaagcggctggtgctgccgccgagcactccgctggaagcgccgaggggaggaaggattcgacttccagctgccgcccatcctccagcagcgggcgctgcgcccaccgcctgcacgagcgcttggccaggcgctggcggctcccacgtgggataggcggccgcgaaggaaaggaaagacttttcaagttttccctgatgactcctcgcggcctgagggcattgggtgatgtcccaggaagggtgtgtgtcggtgcaactgcatgtgccacctcgtcacagcaagaatgaacatgcatggtcaccctgttgggtccccccccctagattcagccaaatgactccacagaccttgggtgcctctacaggtgagccatagcgtctgttgccgtgtcgctccaggtcaaatgctgagaatgagcacacgtccccaatgccatccacgtgcacagtgttctgctctacaaacgtcagtatggctcctgcaaggcaaaggaagagtgtagagttggaaaagtcatgagcgctacgtcctgtgcagattgaatcaaagggtgttccaggtgcctgcaagnnnnnnnnnngggaagagtgtagagttggcaaactcatgagcgtcacgtcctgtgtagatcgaatcaaagggtgttccaggtgcctgcaagtgagcgtgcacgttctcagaaggcccgaaattgttcgaccacatctccctggcaccacccaggacagaccctcaccagcacagccgggcagcgagaagtagaggagtaggggagtgagcaggattgatgccatctcctcaaagaagagcactgccttgaactggaacagaccttgaaacgcctcctgtacctccagcgtgtgagccctgagtgattggcagagatatcagtcaggggtacgagagcctgacgccaaccgacagtaatcaccggcccgcaggctggtgccttgcttctgttcattggctgaggaggggccacagggccactnnnnnnnnnntagtcaggggtacgagagcctgacgccaaccaacagtaagctacggcccgccggctggtgccttgcttctgtgcattggctgaggaggggccacagggccactgtggcacaaggtgcacgccatgacacaccacattcgagagcccaccaccccccctcctgccacccacctccctctccagtggcggggcaggtagtgggtgtgcgtcaccacctccgtcagggccgcctctgggtcgaacgcagtggtgctttccacaatgaacgcccgcgacgctgccagaacgatgcccagcagcgccaaccacctgaggttacggagtgcgggtgtggctgaccagcgcgcggggtgcacgtaaagcacatggctggaccaaggcccctgaagcacactgtgcaagcgcaggcgctcgacatcgggccaccccctcaccaaacaacgtgccgacccaggaggtcccgctccagcaaccgcccgtccaccnnnnnnnnnntgacactgggccgcctcctcaccaaacaacgtgccgacccagaaggtcccgctccagcaaccgcccgtccaccagggtcagcaggagtaggagggcagcaaaggagccggccacaaacgccacaaagcgagccacgtggctgtgtgagggggagggggggggggggggggcnnnnnnnnnnnnnnnnnnnnnnnnnnnnnagagtcaagcacctctcttgggcaatttccacgagatgcgttgcccgcctgtaaccctgccgagcgttacggcaagaaccagccttaaaaacagcaccccagcacgcagtcaagcgcacacctgatggcgggcagcgggaattgcgnnnnnnnnnnatttaaaaacagcgccccagcatgcattcaagtacacacctgatggcgggcagcgggaattgcgatatgtacttctcagctgcttcgttgctggcattcaacctgtcgggcaggaacttcatggaaatggtttgagacaggaacagatggagcgatcgacaatcacaaaggtagcagcacatgctgtggtccgttcttgccccacccatcccttttgcccacggaccgacctgtggttcagaaagtgcgggagctcattgaactcccgcagcttccacttggcgagcggcgaccagtaccgcgcccctatatatggggaggaacgggacagggtcgtgcagacgaatacatcttcgcacacctgcgcagaccatcccacnnnnnnnnnncatggggaggaatgggacagggtcgtgtagacaaataaatcttcgcacacctgcgcagaccatcccactcatggcaggggcaagtgcctcgaagggcagcgcatcacggcatggctgcccggtgcagcgaccgatgcactcctcccccaggcaccctgccacccacccagggaggaggggtggtggtaaaactgctcggccttcttcatgaaaaagtacatcagcaggaaggccaggaggaagggcgacatgagcagattcaagccggccatgaccctggcagaggatgagatgggtgtgatgtgggcgtccattgtcatccggtgccagccatgcaccgccgcagcatccctgtctgatcattgtctggcatgctgcactgcatgccataccataacacatacgaccacgcgaccgctccctgcttcaagcacagccacgggaatagcatgcatgccttcccatcaccaaagttgcagcgccatgctcactggaatcgtttctggagcgccgctctgtcatgtaggaattcagcctttatcctgaagttgtcatcaaacatggcatccagcacgcacctggcagccggggccaggggaggaagtcgacgggcgtgggggtgtcagggcatgaccacaagatctcgacgctgggtgcattgtttgggccgaccaggttccattccaggcgcagcagnnnnnnnnnnccagccgggggcaagggaggaagttgacgggcatgggtgtccgggcatgaccacaagatcttgacgctgggtgcattgtttgcgccgaccaggttccattccaggcgcagcaggcgacctcccatgcagacgtcccccttgccctcctcaaaaagcccccacccaccagtacaggttccactcnnnnnnnnnnctgcagacgccccccttgccctccgcaaatagcccccacccaccagtacaggttccactccagcgtcttggtgagcagaaagcgcggcctggcccccatgacgggcgcgttcagagcgaggacccccaggttgagcatgcctatcaggtagttttcgcggcgcatgatgcgcgacacaatgtcgtgctcgctgaggtcgcgggacgcgcacaggcgggtggttcgctggacctgcatcaagggagttggggggggagctcccaggacggcaggcacgctcccgcagcgtcctggaaacccaggcagnnnnnnnnnnagccgctaggagggcaagcatgctcccgcagcgtcctggaaacccaggcagcgatcgatgcggaaccgagcccccccagagggtttgtcttcgacacaagcatggcggtgccacaaatgcaacgccccagtcgcccaaccccctgagcagcacccgatcccacctgcaccaggcggtgcaggacctctggccaggtgatggtcttgatgcggcgctccgagatgcccagcttctggttgaaaaagtgctggatctcagccagaccccgcacctccatgaccaagtgagcctgcacgaggggtgggggatgccagggaacgagtgccagatcgccccttgccatgcggaggtagtaagatgtcaccgacatgttcagtcccctcacttcatgacagtatcaaggtgacactcagctgccacgatgcccccgccctcatgtccacaacccaccagggccaggacgcagtagactgaacagatgaccaggtacagcaggctgagcaggttccaggccgtgagcccgtcctccagtggatgcttttttatcatgacctggggcgacaccgggagggcagcgtgagcattgcgaccagtatgctcgtcgagggtcgacgccaggcacgcatgtgatcagggcgcctgcccagttccaaacctccttcccttagtgttgagccagcactactccccgctccccaaacatgaccactcttcagcacgtcacagtccccacggtctacaannnnnnnnnncggtaataagatgtcaccgacatgtccagtcccctcacttcatgacagtatcaaggagacgctcaactgccacgatgcccccgccctcatgtccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgcctgcccagctccaaacctccttcccttagtgatgagccagcactactcctcgctccccaaacatgaccactcctcagcacgtcacagtccccacggtctacaacctcaccgtccatatgtcacaactgtccttcttcaggcactcttcctggagcccgctgtagttgacccccagcaggagggctccagagatgacgacggtgaagtccagggcgaggaggttcagcacctgggcgatggtgcatacccagaatcccttctcctcccagtacctgcgccgcagcggaggatactcagcattgaacgcaagctctgggtcgcccggacgtgggcgcaaggcctccaactcaccgatatacacgagtgaagaagtgatccaagttgggcacaacctcccagtcgaagctttcgctgtccagcagctgctcatgggtgtcattgcgagcatagagcctcccaccggtcgtcctgtgaggcgagagggtgggactctcagctcagacgcaaatcccgaccatgatttgacgctcacgggtccgctcgagcctacccgatgggctcatcttcgtcgtcgggaaagtccatttcaccgggccatggtcgaaactcaacttgtcaacatattacttgttgacctgtcgggcgaggggacgacgaaacccatgtaagatgtccctcgccctcggccagctgacacgggctcggcccggttcggacagggaaggggggaggggaatgatctcgnnnnnnnnnnnnnnnnnnnnnnnnnnnnnnnnnnnnnnnnnnnnnnnnnnnnnnnnnnnnnnnnnnnnnnngcattttctgccctccatcctaggcaggtaattctgttgtcgcaccctttgccactacatgcgtacacgaagtctgctcgcggagatcaaggttgctttctaacaccactcagaaacacaaaggttattgcatacagcaccaggaggctttcgacnnnnnnnnnngcaactacaatgcacaccagtggaggtgtacaaaggtagagataagcatcatatcgcattaccatataccctgcatatgtgcatagcatagccagcttatctgnnnnnnnnnntcatctacaatgcacaacagtggaggtgtacaaaggtggagataagcatcttatcgcattaccatataccctacatatgtgcatagcatagccagcttatctgnnnnnnnnnnatgctttctaacaccacttggaaacacaaaggctattgcatacagcaccaggaggctttcgactgaggagggacagaggatgtgttgcttctgcgcttggatggtattgtcacagatggttgccagtcatacattctcaaacagtagcctgcccccttgatagatcctttggaattgatactctccacagagctgctgctagttctttgaggcgtcgaggcgggaaggtgagtcgagctcctgaaggacgacttcctactcccctggctgggcggattatccagctgtcctagctcacggcggccattgcaagggggccgcaacggctgcgcgcaccttgtgcgacggtggccagcatcaatgggaagtccgaaggaccctgtctccggtttatcttggcgcttgtctccgttggccatgccagctgatctagcagtggagctggatccggatgtgctgcagccgcctgtcattccatgcggcgagtcttctgttcgaggcgaccgcgtccaggagtcttcatgcttgccaggcttgaagaactcgttttcattaccgagccaggatacccttggcatgcggcaatcggatgcgcagttcgcgacgctgagcgcgcgccgggcacgcacggaaacgttggtcttcgccaccagaaccctactcactcccgaacgtgacacgaagtatcgcgaggaaggcgnnnnnnnnnnctcttcgccaccagaaccctgcctactcccaaacgtgacacgaagtatcgcgaggaaggcgaattactgcacgctcatgaccaaattaccttgctgtaggttaccgatgatgcatgaacatttgctcgcaaaaatgctgaaaagattccgtacggatcgatgctcgtcggcagcctactgctgtcgcagcaggacctgaatgacaaggacctattgggttctatctcgtacccgaggaatcatgaactgcatcgaacacaatctatgtcgatagtcggggacatggcgtcaagggagcatgcccgctccctgccagagtgagggagggattacagtcaagtagcacgtcgcaggtcatatgtgccctccgggagtaccatgctcgagaaaagccagccgggcgttcacaccgtccgattccaaacaccnnnnnnnnnnggagggagggatcacagtcaagtagcacgtcgcaggtcatatgctccctccgggagcaccatgctcgagaaaagccagcagggcgttcacaccgtccgattccaaacacccttctcgatattcagtcccagtacttgatgagcccatcccagccgcaagtggccacccgcgatgtctccagcggatgccaggcagaacctatgcacacgccctcatgcgccttgatggtgcgggctatcttcttggtcttccagtcccacatgaagagcttgccctcgccatctccagacgtcacgtaccggctgtctggtgagaagctcacctcacacgcataccctggcagaggaggnnnnnnnnnnnnnnnnnnnnnnnnnnnnnnnnnnnnnnnnnnnnnnnnnnnnnnnnnnnnnnnnnnnnnnnnnnnnnnnnnnnnatgcctatgatttgttcatccatactcttacgacatcgctgaaagtaaccatttccattccacacagcgcgtggtgatagggaagagccacgccaacggatcactgaattagcaaagggcatggcagtgtcctgccagaaaatgcccgcgacacttacctgcaacattgtgcccggcaaacgtcttcttggtgttgggcttcacacggtcggttgcgctgtatgtaacaactgtaaacgtagaaagggcgtttggaaaattgatcagaatgaccaccagagggcgacagaccactggcagggtgggaaggtccaaaaccagcacgcctgtctcagcacctccacaccccggcaccacctccatgcatgcatttgactccccctcgcaactgctcaacggaccacccactgcccagacccactcactcttgttgtccatcgactggccacaccaccacttcttgttcggggtgacactcacggccgagatggcgtgcatggcagggtcggcaatgtattttatttgcacgggaatgccaaactcccagacctgcatggcaaaagtgtgtgagggggaggggggttgcgtgtaagcttgccttgcgacgacagagaggccaaagtgcaagtctcagcaccacgcgcacaggcagttgccgtcctgaccacagcgctgggactcgtggctgctgttctttccgttcctccccaccagcccctcaccctgatggtctnnnnnnnnnntgggggttgcgtgtaagcttgccttgtgacgacagagaggccaaagggcaagccacagcaccatgcgcacaggcagttgttgtcctgaccacagcgctgggactcgtgactgctgttctttccatttctccccaccagcccctcaccctgatggtcttgtcatcggaggtggagacaaagcgtcgcccctcatcgatgaaggtcaccgtgttcaccgcacccaagtggtaatcatagctctgcaagcatgtggccgcgggagctcagctcggaaagatgcagcatcagtggcgactatggagcggctggcggtcgaggccgtgtctgagaccaactgcacacctcaaagcatgccagtgacagaagccgggctcgtcatcaagtcagccagacacacaccgcctgcgccagcaagcagccaggcctcacctgcacgacgtccccagtgtcggtatccatctgcaggatcttcttgtccgccgttcccgccatgagcatgttttgcttgtcatcgtctggatggaagcggacggtgtatgccatcttgccctccccatacttgctgcaagggggaagcaggggtgacgggaatgggtggaggaggcttgtgatggagagtgaggatcgtgatccgcagggtatatggaatagcagccacacagccgacagaggctgaaaaatctccccccaaagtaggaggaagcttgcacagcccaaacctgtcccgcatacgcaattccccctccctgaactccatgaaaaacacccccgggtacctacccaaggactgcgcccgtctcggagtcccacagccgaatgnnnnnnnnnntaaagcccccggggtacctacccaaggaccgcgcccgtctcggagtcccacagccgaatgaccttgtcgtatcccgtggtgacaaacttgcggccgtcattggagaaccaggcatcgcggacaccctgcatgaatagagacgttcaatggtggtggtgaggagggcctgatacaggacctgaccctgcctccggtgcaggaaagggcgctgcgactcccaccacctaaccgagcgcctccggcaaatgcaggaaggcgcnnnnnnnnnnaggaggaggcttgtggtggagagtgaggatcgtggtccgcagggtatgtggaatagcagccacacagccgacagaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggggacgttcaatggtggtggtgaggagcgcctggtacaggacctgaccttgcctccggtgcaggacagggcgctgcgactcccgccacctaaacgagcgcctccggcaaatgcaggaaggcgccagcggtgctgtcctcttggcactgggtgtggtcccatgacaacaagcagagcatgctatgctgttgagagcacaaaaccggacaatgccagcctgcagttgccccccatgcctgcgtgttgccccaccttggnnnnnnnnnnattggcactgggtgtggtcccaggacaacaagcagaggatgctatgctgttgagaccacaaaacctgacaatgccagcctgcagttgctcccccatgcctgcgtgttgccccaccttggtgtgcccaagataggtccgcaggcacttgcgctggttgtgcacatcccacatcttgaccttgccatccaggccggcagacaggagaaggtggccagtgcttgggaagaacctgcattgcggtatgggcatgtggcatggtgacgagcgcagcgagtctgcagctggcaaagctgcagtgggcagggcgggcgcaatggtggtacgccgggccccctagatatcacaacacatcttcagaggacagtcgccagcacctgatggcattgacgccctttnnnnnnnnnncgggaagaacctgcatcgcggtatgggcatgtggcatggtcacgagcgcagcgagtctgcagccggcaaagctgcggtgggcatggcgggcgcaatggtggcacgccggcccccctagatagcacaagacatcttcagagaacagccgccagcacctgatggcattgacgccctttgtgtggcccgaccaggtgtggaggtgcttcttggggaggaaggaggtggcactgtcgtcccgcaggtcccggggagcctccagccaagagcggcctacgatgcgcgcatggggggcgggtggctgggtggaggatgggagcatgtgagcagggccctcgggtgtatggagatgcatgtgctagcgttggacgccagacaacccatagcggctgcactgacagacctcctggccccacagaagaagcacaaacgtctcagcagccaaacccacccaccctnnnnnnnnnnacggctgcaccgacagaccccctggccccacagaacatgcacgaacgtctcagcagccaaacccacccaccctggtagtcctcgagagctttgccgtggaagatggaggtctcccccttgccagaccctgcgtccttctctgccttctcctcctgtgcctgcaggtgtccatggaccagtgaggcacgccggcacagcagatttgggacgtacgagccctgtctatgactggcagccgcactacagaggcccatgccaggctataactccactccatgccgccgccagaccactctggtctcgagtgcaggcagtacacccacgcagatactgtccacacctcaaaccctcaccttctccaggtatgcccgatgctcctcggtcagctcctgctctgggaaagcggccttctccgcccagggttgccgtgtacgcagagtgaaaggctgcgtcagatccaccggcgcgggggccatcttgctctgctgcgtgcgctgccgcttctgctggggctgagtgggcggcgcgcccacccccggccccagtgagatggccacaggacgggaggggtccatcgccaccccgttgctgcatggaatccaggggggagagtatgcagtttaatacgaaaagatgtggctgtgcctccagcagagccactcctccgatctgatgccgtgcagcctgtgacgcacccagaggctgggaagactgcannnnnnnnnngataccaaaagaggtggctgtgcctccagcagagccacacctccgatctgatgccgtgcagcccgtgacgcacccagaggctgggaagactgcaggtcctctgccacacaccacaaaaggtcacacatgcctgccaacacttcaagcaacctggcatccacgccccttccaactttcttacaaccgcaacccccacccctggcagcccgacctgtggaacgagttgtactgctcgtcaaaggcgtaggacgagaggtgggagtcctccacatgccccgttcggtggttgctcagcccgccatctgccttgcggcctgaagggtgcgtggggccctgcaccggagcatgcatctggtctgcgggcagattgtaccggatcatacgggtgttgggcccctggaagaacttggtgtcctcctggctgaccagcttgctctccacaagcgcgtacccactcgcatccacctgggaggaggcgtagatgccgttggagatgcaactcgagagagggaagtgtctcgcatggcatgtgccgcacctcacctctggtgcagcggaaacaactgccagtgctgcggtgccgtccccggagcgggaaggggagggggccccatcatcgctgcgagatgttgaatgagcatttgttgaggtaaagcgtggtaagatgagcttatccagcagagctcatacaccgagacccacctgtaagcgccgatgaggtccatcggccaggggtggccctgagaactagcagcgaaactttagcttgtgaacggcatctccttgggataatgcagctagagatggccaagtcacagcactnnnnnnnnnngtgggaactagcagcgaaagtttagcttatgaacgtcatctccttgggatattgcagctagagatggccaagtcacagcactcgcgaaccaggtggatcgtcggtaagctgagctccatctgcacctcgtctcgcaacctggaagaacgcgcgcgcgcggtggtccgtgcattgcgatctagatcgttgctcattgtagctcagcaccactctggtgatcgcgaatgcgatgggaaattaaacccgctttcccagcttctgcgcatgcgtgtaatgtactcccacatgtcggcggcatcctatacgctgaaacccctccccaactttggagcagaggtgcggtatgcatgtaggtaatgaagtcgcttcagcaggcatgccgcagcaatatctaaaattaccatactcaagaagatccatgtccatttccataggtttttggattgcagttaagagactccgtgcccggtccggttgtgcnnnnnnnnnntcgcagcaatatctaaacttaccatactcaagtagatccatgtccatttgcgtaggtttttggattgcagctaagagactccgtgcccggtccggttgtgcagagaattaaagatgacgtttccaggtgatgagtgtgtgtggggtagtgtacatctgaggagaacacccagaagtttcaccattgccctatagttggtatgaccacactcttctattcctnnnnnnnnnntgtgtacttctgaggagaacacccagaagttccaccattgccctgtagttggtatgaccacactcttctattcctgccaacgctaacctaccccatacacaggcaccgcctgctgatttttcgcgaccaaggcatcatcagcggaccccggcaggcggagattgggggctggtttggcgatttggagagtacattccggaagcatccgaggtccccgcacccggatgtcttccgcgtctccaatgaccccgccgagggctgcatcggtgagactgtctggccagctctggcacgatgtgctggcgtgccagcaatctggtcgggggccggaagcatctgtgttccnnnnnnnnnntttgctatgcgcttgtatgtgcaccacaccgcatccaccaccgtgcatgcaggcgtcggccgtgaggggtggcacatcgacggctccttcnnnnnnnnnntgccgagggctgcatcggtgagactggctggccagctctggcgcgatgtgctggggtgccagcaacctggtcgggggccggaagcatctgtgttcctgcatctctacacacccgtgtttatgccctgatgtcatggcggtcatcccagtacatccaggtccnnnnnnnnnnnnnnnnnnnnnnnnnnnnnnnnnnnnnnnnnnnnnnnnnnnnnnnnnnnnnnnnnnncagcctgcccccttttctcacagcctgtaccacatcatcgacgtgccatcacgggtgagtcgccgtgtcagaaccaaggactgtgcagcaagtgtggttcgcctgcctccgctgatgcgagggtcagggtcacagattgggccgtgcctccctcctcctgcctcacataagccagtcatgtccccctcccccactctcgctctttcatcccagggcgccactcgcttcgtggccctgaccgagctgctgtccagccttcctgtcgaccagctggcacactggcgtcgcttgtccatgcgcagcgaccgccgcgaccaggccctgaagccgctggtgtatgcgcaccccggcaccggccaccccaccatgtgcttccacacgggcatgacggcagcatacgtggaggatgcagggagcgagcgggagcggaccctgcccgcccagcccctgaaccgcgagatagaggccgccatcgaggcacagcccgtgtacgaccactgctggcgggcgggggacttcctcatcgcggacaacctggcgttggggcacgaggcctcgcccgacacccagtgccccgtcagcgaggtggggcttcgggtcatgcaccgctccacggtgaaggggacgcatgcgcccacatgagggtcccgagggggctgtgatgtgcagagcgcaggcatgtgtgcctggcggccttgtgtgtgcagacgagatgcaactggggggcggtgacggagcttcagcacagcagattccacgatggtttgtaagagagtttgctagacaggcatcaccacacaaagcagtcggagatggcacaggcaaggtactggccctccatgtgtcggggaggtgtgccctctgcaaactccatatgaaatgccgcgctcccaccccagccttgtcaggtgcttcctggctctgctctccaagacacctgacgtgcatggcccggaagccagacgggccgcaatttgaaacacctgctgcacgcgtggagcgaaacctagtcctcaccatgcagagcgggccgnnnnnnnnnnattgtcaggtgcctcctggctctgctctccaaggcacctgacgtgcacagcccggaagccagacgggccgcaacttgaaacacctgctgtacgcgtggagcgcaacctagtcctcaccatgcagagcgggccggagggcacgcagcatggccctcgtcctcttctccagagggagggtctggatcctggggaggatctgccaaccaatcgcaagcgcctcctgcacgttgaaagcaggggatggcaattgtgttggctctgacactgcagggcgcccctgtggggaccagggcaaggtggtgccaggacctggtgcggagggacaacatgcgcagcaatgtgcactccccacccccatctcccagatgcaggctgacccagagcccccttcacctccaggctctggagcggagcacccctggcaagcttggcaaggcgcgcagtggccttctccgccaccgccgctcggcgaggggagactggcgggtcgtatgccgcgtcgtcgcattgctggaccagatcttggggtggcgctgcgtccgtaccctctgcccccagaggctgggcggggccaggagtttccagcggctgcatgggtgacgctgcgcccccctgcttgcccaggacgtctgccccagccctccgatccgcctcctcctgacgcaggcgctgccggatggctcgccgcgccgcctctgggtctgcggtgtgggaaagattggtggctttggtgctcccaggtgcggacagagcccgccctgacagcgcccattcggcacaagagcctcctccccggactcacgcaccttgatgtattgcctccagcgacgcatcccccgtccctggggtggtggtgaggcgggtgctgcgccgggaggtgggcgccctttcctcgggcccctcgtcctccttcacctccacatcaatcctgcggccgcctgcgtatcggggtgggcccacgctaagatcactcggtagtcggttttgatatatcagagacgatgcgttccagttcagcttnnnnnnnnnngcggggtgggcccacgcttagatcacttggtcgtcggttgtaatgtatcagagacgatgcgttccagttcagctttgggtgatccgtcccccacacacatgaaggttcccaacccctaaccccattctactgcccctcgcctccacccctcaccctgccccaggggcggcgcgggggcgggccctcctgcctcggcgatggcctccaggccggcgcagaggtccgatctcgctgccagcgctgccgccagcgcctcgcgcagctcgtcctccagcgcgcaggcgcggctgacggcgcgcgcgccgcgcgggctgtcgccccagtatgcgcgctccgcgtcgggcagcagcgccacgtcggcgaggtagcgccccggggtcgcgtaacgccctgcgtccacgcgcgccaggagcgtggacaggtccatgggccgcggcacgcgcgcggcgtagtccgggtcctcctcggccgtcaccggctcggcgaaggcctgccagcggcggctggacagtgcgcgcgtggtgacgtcgcgtaggaccatgcgcaggctgcgcagcgtcgcctggtccgtctcatacctttttgggggcacgagaggggggggacacgttccgacatgtgaaatctggcgatagggcagcggtgggggacgatccatgcttcnnnnnnnnnncgcgcagcgtcgcctggtctgactcatacctttttgggggcacgagggggggggacatgttccgacatgtgaaatctggcgagagggcagcggtgggggacgatccatgcttccgtgcggctactcaagaagacccctctccctcccttcatctattcggccaatctccccccccctccccccctccctcccagaacacacacacacacatgacgccgaccttgccctggcggcggcgccctccctctcccgccgggcccgctgggcggcctccagcgccgcggggtcgcggcgcaggggcggcgggaccggcgcgggcccc

SEQ ID NO: 42399 - DNA, 66390 bp, Chlorella protothecoides
  modified_base (499)..(508): a, c, t, g, unknown or other
  modified_base (1232)..(1241): a, c, t, g, unknown or other
  modified_base (2364)..(2373): a, c, t, g, unknown or other
  modified_base (3472)..(3481): a, c, t, g, unknown or other
  modified_base (3655)..(3664): a, c, t, g, unknown or other
  modified_base (3765)..(3774): a, c, t, g, unknown or other
  modified_base (3833)..(3842): a, c, t, g, unknown or other
  modified_base (4333)..(4342): a, c, t, g, unknown or other
  modified_base (5707)..(5716): a, c, t, g, unknown or other
  modified_base (6848)..(6857): a, c, t, g, unknown or other
  modified_base (6937)..(6946): a, c, t, g, unknown or other
  modified_base (7026)..(7035): a, c, t, g, unknown or other
  modified_base (7213)..(7260): a, c, t, g, unknown or other
  modified_base (11952)..(11961): a, c, t, g, unknown or other
  modified_base (14435)..(14602): a, c, t, g, unknown or other
  modified_base (14679)..(14688): a, c, t, g, unknown or other
  modified_base (15210)..(15219): a, c, t, g, unknown or other
  modified_base (16581)..(16590): a, c, t, g, unknown or other
  modified_base (16688)..(16697): a, c, t, g, unknown or other
  modified_base (17021)..(17030): a, c, t, g, unknown or other
  modified_base (17136)..(17145): a, c, t, g, unknown or other
  modified_base (17506)..(17519): a, c, t, g, unknown or other
  modified_base (17580)..(17589): a, c, t, g, unknown or other
  modified_base (19142)..(19151): a, c, t, g, unknown or other
  modified_base (19219)..(19228): a, c, t, g, unknown or other
  modified_base (19339)..(19348): a, c, t, g, unknown or other
  modified_base (19703)..(19712): a, c, t, g, unknown or other
  modified_base (21833)..(21842): a, c, t, g, unknown or other
  modified_base (21944)..(22063): a, c, t, g, unknown or other
  modified_base (23351)..(23360): a, c, t, g, unknown or other
  modified_base (23935)..(23944): a, c, t, g, unknown or other
  modified_base (24097)..(24106): a, c, t, g, unknown or other
  modified_base (24788)..(24797): a, c, t, g, unknown or other
  modified_base (25085)..(25094): a, c, t, g, unknown or other
  modified_base (25594)..(25603): a, c, t, g, unknown or other
  modified_base (25916)..(25925): a, c, t, g, unknown or other
  modified_base (27216)..(27225): a, c, t, g, unknown or other
  modified_base (27429)..(27467): a, c, t, g, unknown or other
  modified_base (32453)..(32462): a, c, t, g, unknown or other
  modified_base (35478)..(35487): a, c, t, g, unknown or other
  modified_base (36285)..(36314): a, c, t, g, unknown or other
  modified_base (36529)..(36538): a, c, t, g, unknown or other
  modified_base (36632)..(36641): a, c, t, g, unknown or other
  modified_base (36735)..(36744): a, c, t, g, unknown or other
  modified_base (38076)..(38085): a, c, t, g, unknown or other
  modified_base (38464)..(38473): a, c, t, g, unknown or other
  modified_base (39705)..(39790): a, c, t, g, unknown or other
  modified_base (40059)..(40068): a, c, t, g, unknown or other
  modified_base (40681)..(40690): a, c, t, g, unknown or other
  modified_base (41005)..(41014): a, c, t, g, unknown or other
  modified_base (41513)..(41522): a, c, t, g, unknown or other
  modified_base (41779)..(41788): a, c, t, g, unknown or other
  modified_base (41934)..(41943): a, c, t, g, unknown or other
  modified_base (42273)..(42282): a, c, t, g, unknown or other
  modified_base (42570)..(42579): a, c, t, g, unknown or other
  modified_base (42743)..(42752): a, c, t, g, unknown or other
  modified_base (43528)..(43537): a, c, t, g, unknown or other
  modified_base (44164)..(44173): a, c, t, g, unknown or other
  modified_base (44253)..(44262): a, c, t, g, unknown or other
  modified_base (44825)..(44834): a, c, t, g, unknown or other
  modified_base (45261)..(45270): a, c, t, g, unknown or other
  modified_base (45418)..(45427): a, c, t, g, unknown or other
  modified_base (46600)..(46609): a, c, t, g, unknown or other
  modified_base (46870)..(46879): a, c, t, g, unknown or other
  modified_base (48125)..(48134): a, c, t, g, unknown or other
  modified_base (48229)..(48368): a, c, t, g, unknown or other
  modified_base (49021)..(49030): a, c, t, g, unknown or other
  modified_base (49283)..(49292): a, c, t, g, unknown or other
  modified_base (49634)..(49643): a, c, t, g, unknown or other
  modified_base (49857)..(49866): a, c, t, g, unknown or other
  modified_base (54303)..(54312): a, c, t, g, unknown or other
  modified_base (54866)..(54875): a, c, t, g, unknown or other
  modified_base (56030)..(56039): a, c, t, g, unknown or other
  modified_base (56575)..(56584): a, c, t, g, unknown or other
  modified_base (56658)..(56667): a, c, t, g, unknown or other
  modified_base (56739)..(56748): a, c, t, g, unknown or other
  modified_base (57790)..(57799): a, c, t, g, unknown or other
  modified_base (58212)..(58221): a, c, t, g, unknown or other
  modified_base (58529)..(58538): a, c, t, g, unknown or other
  modified_base (59000)..(59009): a, c, t, g, unknown or other
  modified_base (59538)..(59547): a, c, t, g, unknown or other
  modified_base (60012)..(60021): a, c, t, g, unknown or other
  modified_base (64915)..(64962): a, c, t, g, unknown or other
ggaggcggccgccgctgcctcgtgcgccgcgctggcgggcctgctgcgcgggggcgaggcggccgaggccgcccgcgcgctgctggccggccagggcctgtccgccctgcgcgagctcctgggcagcccctcggagcggctgctggaccgggcgctggacgccacgctcttcgcgctgtctgggacggcggggagagcgtgcctcgcgccggcaatggcgctcggcttcgcgcccgccctcctgcgcttcgcggcgccctcccactcccacatcctcagggtccaggtgaggagaggtttgatctgggttgtgggggagaacacacaccagaatccaatgacaggcacaccagacgggggcatgaacactcagtctagactgtgacgctgcggacaatgtgcgcatgtccctaccgcatactccccggcaccatgttctccaggacgagccatacagacacacttgactgcacacactcacacccctgccttcaggctnnnnnnnnnnccagtctaaactgtgacgctgcggacaatgtgcgcatatccctaccgcatacttcccggcaccatgttctccaggacaagccatacagacacacttgaatgcacacactcacacccctgccttcaggctgcgagggccgcggagatcctgtgcgcctccagcatcggggcgcgggccgtgctttcctcggacgcgctccccgccatgctcgacctgctcctgccgccggagaggggcgacgcctcgcccgcgctgtgcgtggagctgatgcagccggcgctgaatgcctgctggctgctcctacaccgctccgcggcagcggccgaggaaccatccgccgcgcggcagccggcggaggggctgccgccgctggacgcgctgctgcgagccctggcagccgccgccctgcctcagcgcatgacggcggtcctgcgcacggtgctgagcgcctactgcctcaaggccgggctgaacgggccggtcggacgggggccggggaaccactcccgctcagcctccgtgccgctggtgagttcaagcctgcagggaggggtggaaacttatgtgggggatctgaaccaggcctctggatgtggcatccgtgcatcgaagctgttggatttccgaggcgctgccagcctgggtaccaggaagagctaaaggcagagagcgtcgcactcgccgcacaaaagatagcccttgcccgttctcaccgacctggatnnnnnnnnnncggggatctgaaccaggcctctagatgtggcatccatgcatcgaagctgttggatttctgaggcgctgccagccttggtaccaggaagagctagaggcagagagcgtcgcactccctgcataaaaggtagcccttgcccgttctcaccgacctggatgctttgtccacaaacccaccacacatcccctggacacaaccccacccagacggagacagagctagcccagctggcggaggagaagcccacgagcagcggcgagaccacaccgccgcgcacccccagccggacgaacagcccccggggtcaaggcccctcactcaccgccacgctggggtcgccgcggcggggtccctcgcccaccagcgcgcagcagaccgtgtcacgcctcgcctccagtgtctccatgtagggcgggggcacgcacgtgggcgtggtgtcttgggggctgcggggctgtggactcctggcctgcagggcgtcgcgcgcgcgggggccgcggcaggacacatgacttttgattcttaaaataaaagcctcccgaccaccctgccccaggcggagcgaggacgggctcaccgccggcgccccgccgccccgctcgcccgtgaagcgtgcgggcagggcggacgcgcccgcgcccccgccgccggcgccaagcccgctgccgctgctggacgccatcctgaacatgtacgcggccatggtgctcggcgacggcgtggtcaaggcggcgctggtgcagcgcacggtgctggctcctctgttcgaggtcaccgccttcctgccgccgccgctggcgctgacggtggtgagcgcggtgagggcgctgaccgtggacccgaccacgctgggcccgctggccgacgccagcggcgtcgccttcctcgttgcccagctggcgcgcgcgggagagcccctgctccaggaccaggcgctgtccgccctgcacaggatggcagcggcagacaggtgcgtttgggtctttcctggtttggggggggagggggggaatcggtgctgctggcaaggatcaataagcccatcaggagggtcgcacacctgcacagtgacgagtcacccgtgccgagaacttaatctgtgtggtggcggcttgcgaagggnnnnnnnnnncgcggcagacaggtgtgtttgggtctttcctggttgggggtgaaagggggggaatcggtgccgctggcagggatcaaaaggcccatcaggagggtcgcacgcctgaacagtgacgaggcagccgcgccgaaaatttaatctgtgtggtggcggcttgcgaagggttcaacactctgcaaaaagggcccgctgcgatgtgcttgagagcatccacacatctttgctggcaacccctagtgtccccatgtctgaccagtggacacccccccccccttcccatcctcacagagcgcggcaggagcaggcggcggtggcgggcgcggtgcccttcctgtgccagctgggcatcctgccccagcgcggcgcggtggccgcccatgcccacggcctggccgtctcgctgctgtgcgcgctggcgcgcggcggcgcgcgcgtgcgcgccgagctatgggcgcatgacgcgctctccgtcttcctgcacctgctcaaggacgaagcgtgccaggtggaggtgctggatgcgctggcggcctggctggcggctgacgcgccgcgcatcgaggcgcggctggccgccggcgatgcgcaaacgcgcctggtcaccctcgtccccgtcatgtccaccgcgggggagggcgacgcgctgtgcgcgctgctcgtccccctgcagcgcctgctgtcgctttcgccgcgcatggcgcgcgagctggcgcagaatgggctggtgccacgcgtgaccgagctcctgcgccggccgacctcccccaccacgctgcccgcgctggacgtgctggccacgctggtggcagccgccgcgcagccacgcgcgctggccgcgcgcttccgcctcgcccaggtgctcgtgccgctggcgggccaggcgggcatgcagccgggcgtagccgagaaggtggcccagctcctgcaggccatacgcgggtgacgggtcagggaggagtgttgggaggtcagccgcagctgctgctgggagcggtcgtaggggacggcggggagcctgtgctgtcgtgcatgggggcatgccataagacacacctgcatgacggcgcacccccagttcttccacttgccccctcccccnnnnnnnnnngcgcaggggacggcgggaagcctgtgctgtcgtgcatggggccatgccatgagacgcacctgcatgaccgcgcgcccccagttcttccacttgccccctccccccatgctaatatgtaacgaggcttatgcacatactgcagtgctgcctctccgatcaaagaatcacaagggnnnnnnnnnntgtgggttgggagggggccagggtggtgggtcgagagtcttgcgatcacggagccacggccatcgaaggaaagtctttgggagcctcagtaagagggagtnnnnnnnnnncaccctttgtgtgagtgccgtttgacacacctcatcgacatttcaacaccggacaacannnnnnnnnnaaccctttgtgtgaccgccgttcaacatacctcatcgacatttcaacaccggacaacatgggcagcaggcactctcgtatgcaagcaaccacatcccagttacaggatcctatgcgcccaccccaaccgtgtgtgcagcatagaataggaggtaggcctggcagtgctggacgtcggcctcgctggccgccgagatgcaggcgtcgtcgcacagataccactcgcccttgccgcagcgcaggtatgccacgtagtgcccgccctgtgcgtgggttgggaggggggcatggtggtgggtcgagagtcttccttgcgatcacggagccacggccatcaaaaggaagtctttgggagcctcagtaagagggagtaatggtaccgctgggtttcccagacagacgatccacatgtcccacacccagcagccacacggttgtatcctgggagccataaccaggcgatgaccctcccagcttcgcgcagtgatcacnnnnnnnnnnggcagccacacggtggtatcctgggagccgtaaccaggcaatgaccctcccagcttcgcgcagtgatcaccttgaagtcccccttgtggacgacgacggcgtacaggtcgtacaggggataggtgccctctgggttcatcattgtcgctgcagcgcaggtgccattgccctgtgcatgctcccgttccgacctgccatggcgggagagtctgccggcgaggtgaccattgaggggatacgagcatcctgtgcacaggcaaaggacgtttctcttgttacagggccagcacactctctccccacctggccccaagggagctgaggaagggccgcatgtccaggtttctcatggggaactccaggtaggtgttcagtttcgtggccacgcccctcaggccgcctgaaatggtttgggagcgcaagtgatggtgtgaggtcggagagcgggtgacgcccgaggctcgcttgctggcaaggcgcggcggctgcagaccgccctcgtgcacatccgatcggccacccggggccgcctggtgccggctccctcgagagccctcccttccccttccgtccctcccttgcccccatgtatcgtccccctaaccccccccttctcaaacccgcctgggtgctcaaagcgcttggcgtgcaggaccaggagcgggggcagtgcggccagggtcaggcgcttggtggccccccggcccctggccccgcacgcggcgcactgccaggcggcgccctgcaggtcctccgcccgcgtcaggcgcttgagcgcgcccagcaggctggcacccggccagcgcgtgtacgaggccagcgccgggtgctccccgccccgcgccgcccgggcctgggtggccggcgccaccgcctccccccgcacgtcctcgttccaggggcccgccgccgatccggggcgcggggaggagatggcctcggcctcggggccttccgcgccggggctgcgtgatgtggacacacggggaagcccgctccccgagcgcagggtggcgtcgctccacgcgtcactctcttccccgcccgagtcgggggtgggcggtgggggggagcgcggcgccggccgagcgcccccccgacccctgccggcccgcccgcggccccgagcggcctgccagaagagggatcgaccagagggagggagggcttcctcattttggtggcgaatgctctcaatccagcgtagagcacgatcgagggtagagctgccggccagctcccaggcttggaaggcgactgaatctaattcatgcctcccacttcactctgctttgccgccaaccaccccaatgatcttcgaccaacaacaacatcccagcacacccaggcgcctgcccaccttgnnnnnnnnnngccaggcttggaaggcgactgaatctagttcatgccttccacttcactctgcgttgccgccaactatcccaatgatccttgaccaacaacaacaccccagcacacccaggcgcctgcccaccttggcaccgcggccgcgaccccggacggggggcgccacccgcctcccgttggccgcccggggcgcaggcggtgggtcggccgggtcgagggcaatggccggcgcgatgaggtgggaggcgggggggatgtccagggacaaatgcatgaagccgtcacgagtcgtggaggcgtgggcgcacgcccagcacgtcacctctgactgcagggcgcctgagaaggcctgcgccacgggatgccctgcagagggtgtgttgtgatttagccaagtgccctggctgccatattcctggcggcctggaacacctttttcgaggagctggggttgacgagaggcagcggcgcccgcaggccagccattgagggtggcgaggcccctgcatcctcgttttcacggcagcagttgggtctgcagccccacatccaggccccgcccacctgcgtccttcatgctgaccagggcgtccaggaaacataccaggaactcatgggcatcctgagcgaggtgcatgagggtgggggagggctgtatgcaggggagcgccaaaggttttgcctccaaaagtaatacatcaacggaggcgcatcgagacaactaggcactggtctccacatcgaccaagcgatgctcacgaatatcttagcgcttacccaccaagcatccaccaccacaaacccccctcaggcacctgctgctggtaccccaccagctcagcccctgccttgcaccaccaggcatggaggaagcacacggggctgtagggggagcgggagccgcagtatgccgcggagaagagggtatcctggagtttgggagagaatggtcgctgcccaccagatacttcgtggcgagggacgggcttcccaaaaagacatgatgtgtacacatgcaatctctgggacggagcaagcagcgagactcctgctcatcactggatgggccgtcttgagccaacacccctgactgaccaaggcacaaaggaggcagggagagtcgtcatctgagatgaannnnnnnnnntaggatggcgagcaggcatgaaactcacagtggaatggccagcagtgacggtccccgtctggcagtctccatatatgcannnnnnnnnncaggatggcgagcaggcgtgaaactcacagtgaaatggccagcagtgaaggtccccgtctggcagtctccatatatgcannnnnnnnnngtcactgtatgggccgtcttgagccaacacccctgactcaccaaggcacaaacgaggcagggagagtcgtcatctgagatgaagcaggtgtccccattgtgtcggcccatgagatggaacggcaccaggaagggcgagtgtagcagtgcctgaggcaaaggcagggattgttggggannnnnnnnnnnnnnnnnnnnnnnnnnnnnnnnnnnnnnnnnnnnnnnntgcgacaggcagccaacttggactgcgccgagcctcttactttccatctcaaagcaatgagcccacctgaagcacactattcatgaaacatgtgttcccaaggttctgcaagccccgcaggcccggggggaacccatcctggggcacatccacacagccagaggcagttggagtaggggggctctccctcttcaccgcgatcattagagcaccctcctggatgggaggcaccttccataagagttcgatcgtccagtaggaatgtccatcacgcaggggagcgccacatccagcactctacaggcgaacgcacttgtttggtgctactcttccatggtcatttcaatactcgcggatcgctcctcagcccaaatggcaatcagacttgcatggcatgtatgcgcatgccaagcttttggtccaccaagtcctttgttcggcccttcgagggttctctttgcttttcaggctgattgccggttttgttacgagagcggctcttcgctcaacacagccaagcagcaggtcaggacttgtcgtgcgttggaatcagtgaattcagcatgcttgatgtgagtggtgactatgcttcctgtcttgtataagatcgcagcccgtcgaattctgggaccctgagatgcatgatttccgcgctgaatcaccgtttgtcggaatcgcggggactccaggttttccttctgggcagggagttcagattatcatacacagtgctcggcagacgaccaggtgccgcagccatgggccttcacttggataggaagaggatgtcctcgtctgtgccgggtacaagccgcgcagcatttagacgggctgctggcaaccacaaaggcgcggccccctcctcggaggggtccatgacggcaaaccgttcggttctcgggtcaaacccacagaccaggataaagtgaccatgatactcccctcctgggactcccagcattgagcaagtcttgtcgacgagcaggatggcaaggctaccgctgagtcgctcgagcagttcctggtcggtgaggctggcgcatagtacacggatcccaactgcagctgcttcctgcgtggaagtcgggacaggaaagcgcgcaagccttggtctgtctacctgtactaggccaagcttgggaacaacagcagagaccaggcacagtactcggctctctccagagcatccactgacaggatggtccccgaacaaggctccattgcaaccacaaacactctgtacttgggaacctgcctggaagagtcggtccactctgggcgcatcttcctccatctgggctgcgtagaaggataggcgtgcatggctggtgtccacgccaggcatcctggtgcacagcaccaccttcaggccgcgccccgccaggaggtgtgccaggtcgatgctccatgctgcctgctgcggcgcctctcccacaatgtcctgcacgctgacgggtttctggagcagggccgagagagccatagcagcacaggccaggccgcaatccctgttgggagggcacagggggtgggtcgttacctcatttaatggattgaaacctgacgaacgtgtcctggccacctgttgactcatcctaccattcggagcactgtcgaatgtggggtactggaaccaggaagccatcctgcggcgaccggctcgcaccctctcctcctgcctcgcgcatggcagcatgatgccgagctcgtgtggacaccatgcgcctcaaacatcacagcagttgatccatggtggaacgctgttagatgtcatcgcatgagccgaagggcgactgcgagagtctcaccgctcattcgcgcaaatggccattccagggaacccatatcatcgaatcccgcaccactgtcctttagatcgtatgagtgctgcttgatttccacccggggactttagctctgtattgcattgatgcgcattggacaaccccccgcatgccgcagcacggatcctcccccccgattggtacgaggtgaaggagccgggggagggtggaatgctcgccatccagaccccagttcctcactccatcgttcctgtgaccagacaacgccaggaaggatcaggaagtggacgtggaccaaggcctgcctgctgctccttgctgcctgtcagtcacaggagatctgtggccagtctcagaagctccgacttgaacctgtcgacgtcgtgctttgagatctggatgaccgtcgtgtcaaagaggtcgtgccaggcctccgccttgactgcctcagtggccgccgcaaatgcatggcccagcttgttgccctgggaggaagaaggccatggctttgtgtcagaggtggtgttttggcgaagaatgtcatgtaccacgggcgacatgggggttgagtgggactgtgcctggccctgcgcctctaatcccttttctgcggcaccccaccctgggtcgcctgcccctcacaccacaaggtcaccccgtaaacaccgtgctccgctcccacctgcatacggcctgtagcctcgtagccgacggcgaggcaccgcagggaggcgtccgccggcccgatcaggacgacaggcttccgccgattggtgtggtggaagtgctggtcttgaaagaaggcagccatcctctgtagtgccatggggtgactctgtggcaaggggagtggggcaggggtgaatggagaggggaactggaatccagccatggccaagagacggacgcaagtggcctgcaggcacagcgcaggaaaacaagcagatgcgctacgtatcaggatgtcaactcaccaggaggtgctggttattgatgctgtggttgctcaggtcgtagatccggaagtgccgaaagttgtggaagagcttctgctgcaccacacccccgccatcgctgcatgaggcaggagggggtcccatgaggagtgcacggtccacagcagaggttggcatctagaccatggggcccagcaaagtggaccgcggtgggggcagactcgcgaccagcttcagttttagattgagtcccctcatgtggcatctgcgatgcaaaatcccccccgtaggcacctgatgagcgccttctgcacccgctttgccagctccagccccttccgcagctccccttggtcgtgggcccagctcagtgcgtggtagcagcgcctgttggaagtataacgaagggcccagcggtcaaggtagatgagcgagggaagttataggacagctgagacatattttgctcgtccacaggaaggtcgacccctcttgtgttgggcagaatgcgctacttcttgaccccagtacttgtcaatgacccctcccagcctggcaaggagcccaagcagcgccacctaccagaatttgtccacatgatcggcggcccccggcgtcgccgtctcgttcttggtcccgcactcgagcagtgccgtggcggcgtggaccacgtcgataatgttcacgcatcgcttcaatccatcctgcagggggggaggtatggggacgagtgtgagtatcgattcagaatgtgctcagaaggggcccgccaattctagacatggcagttgagaaggcagcttgcggcatcgcctggcccccagaatagtccccaactggggtcggttgtcatgcaagcatgaaaccccagcccaagtgacgcggcgcacaatgccccaccgtgcccacatcaaagttctccctgcagcagtctgccttgcctggagttggaaagagtctagcatcacgtctgccatcctgaacgctggggcatgctgggccagcctttctggcagcgccgccttgtacctcggcttcatgtccactgcaggttggaacgggtaggtggatgagcgcgcgcagagggcaagaccccagccctaccctggaccaccgctgcaccaaaagatgcgtgcaccgacccactgtcacccccttcacaaccacagcctcgactcacagagatatgggctttgagcctgctgcagggggatcccgagcttggcaagcaggagctccagggcggttttgcctttctctgtgtatgtttgcagccgggcggcgacataggggctgtagagcatggactcatacagggaccattcccacaacagcccaaagcgaaagtccctctgaggtctgcaaggaggggacggggaggggtgaggcatcagagcttttacctgatgcatgtcaagcggaaactacgtcatgtaacaatgtgggtaaagccgagaaccacactgagctcccggtctccgagccacaatgacaaggccaagttccaggcaccccctgccctctacacctcccccactcttgctgtgtctcacaaaattcggcagttgatggccatgtttgcgaccgtaacgccatcgtcctctgcagcaggccgctcctgaggaaatgaagggggcagcggaggtcgaagaactgtgcacgtgcgggactctgcccctctgcaccactctcactgcagaaaggctggccaccacataccgtggcgacgtccaggtgacccatgttctgcacatggctctcatacaggttgtaatagcttttgtatttgtcagctgcgcacaggagaggatgggtgaccgcatggacaggccgctgcatgcagcggcagccatcgcggggagggccttgttctatacaatgtcccggcatcggatttgccgggatcacatcccagggaacatgctaccccnnnnnnnnnnagagtgccttgttctatacaatctcccggcatcggattcgctgggatcacatcccagggaacatgctacccccctgggcgattgcctcaccatggatcctgctgtgcaccatgtggtcagtgaggcccaccagtgccagcctgtggggaggccatcgggtggcgatggaaggatcagtcgagagaatcaaacccggctccaaagtgccagaagccacacccatgcctggcaaggcactggtgcgctggctctgcccggccctctgcgccgccgctcccgtccctcaccagagcatgtgactcgtctcctgtcccagcagggccgccaggtcaaagatcatgcatgctgcaggcttgccatacgatacaccctggacgaggagcggcagaaggttcagctggtgtgaggacaccaaacagaacgcctgacgagagatggcagctccggtcaatccagtcaggcaatccataccaattgaccccgcaacacagtcctgcaccccacccgctcgtacctgttcatagtacacttcccgaaactgctctcgctgctgtcgctccctgcgtgcctccatcctgcgtgcctgacggccgctcgtcccgccatccaggcgttgcctgcacggagttggcagggggtttccggcttgtgcatggcctggggctgcatatggaacctcgtcctgggacacactcgctgctacagaccgagggtcagcagggagacaatcttcaacatagaacccaggcatggatatgcaagccttggtacaatccaatagccaaaatacctttgagcattgggttcctcgtcgctgccagcctccacgtcttcccctgaatctgggtcgtcgtccaagtcaagctcatggtcatctgaatatgggtggcgggggggggggcactctgataaaaaagagcatcattcgggcctgggcccactctgcaagctgatgcctgccaggtcagcctgctctaaaagcagggagagactgccggcaaccccagcccatcgcagctggccctacctatgctggcaggggggatctctgccttgtccaggccctcgctctcgtcaaggaggaccgccacgcaatcctctgggctgtcaatgttattggcgtggcaaatcggtcgatgggagtcaacgatgaccacacgcacgtttgggcggttctgcaggtttaggaaggaccgtacgtcctcggcagccccgcagttgatcaggatggctgtccgcattgcctggggtgcagtgaaataggtggaacaaagccggggaggtgtgtgtgaaagacacatacatggtggcattttggcatatccatggtgtggcgacatgcagcaagtgcaacctgaagcgattctgagtacctgttaccatgcatccccatcacatccatagctcaggtcccctacctcctcatcaggttggtagcaggcatcaaagtcctcctcaatctccttgtaacgactgacgggcaaccacccatgcggtatcatgtcattcttgaatagcctctgtggtggagtggcagggtcaaagggggggcctggtgtgtgtatcatgccttagaacgtccaccaaggccttcaatccccaaacgccagacagtttggcaccacagtggctggctagatttgtagacctacagcacataacttcccaaccctgcacacagaacaccatgcccatctccccccttgacacctccaggatgcgtagggcggcaacggagtcggcatctgcggccgaggcgtagatgaagacatgtttctcctcgctgcaggagctctcctccttgatggcgttgtatagggcaacccactcatccggggtcgtcacaatcatgctcggcgggacacgactgatggggagcctgctcaattgctcatcctatgccgggctcagaacggcatgtcgagttctctaatgggccacctgcgggcgcagtgcaacgggccaggccactcgccggtctcgggccacgccttcgtcgagccaaccaagctgatcaggaatccgagaggggacggagctcaaaaacaaacggtaggacgtggctgaggggcagggcgagccctgtcgagcttcaaatcagatggacacgaaatccgagggcagcaaggagcagatgaggggaccgccggatggcgtcctgaacgcaggcgctagctaagttatcgactctaccaagtgactatgcaataggaagtgactgctgtcccagagtgcctggctcggcatccagggtcagcctctctggctgtttgtcgaatttgagtgccgtgtccattaggcccgcaggaaaggacggacacggtgacctccctatggacatcagctcgatgggcactctttgatattcacggggaaactgtcctcgttacaaagctgctgactctttgatcctgtcatctccttgttcatagcccattgaaatcaaaaccatgatcactggaagacatcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgcccacagcagccccaggggcgggtggtgggccaaacgtggcccccacagcctgactcaccgcattgggagannnnnnnnnntattctgtcatatccttgtccaagcccattgacagcaaaaccatgatcactggaagacatcagccagctcgctccgcggaagtgggttggcagcgacgtgctgcttgcggtgctcccttgcatccaccttggcaccatacttcccagactgctgcttctttagtgccgctcggatctgtttggtaaagcggcaggaggggcagtgggtgggagtgcaagaggtgctgctggggatgagcaaggaatgccaacagcagccccaggggcgggtgatgggccaaatatggccccacagcctgactcaccgcattgggagatacaaaggaagggttctcataaatcacaggtccaccaaaactccccgcaaacatcttgatggggttaaggcaggccctgggtcccacctgcgtaagatgaggaggggttcaaactttgtcataaagcattccatgttatgggatggttgcactactggttggcccccacaatcacacgcacctccaccaacgtgacatctccggnnnnnnnnnngaactttggcatggggcattccatgttatgggatggttgcactattggtcggcccccacaatcccacgcacctccaccaacgtgacatctccgggcgccgccttcttcttctcggggttgggaagcacctggtagttcctgatccagatgcggccatctgccaccgtaaaactcatcacatggtcgaagaagggcttcaccttgtggtgccgacgcggcacggcaaaggtctgcgtcagcatctccttgagcacctggaggtgcggctcttggtcaaacgtggcgtcgaaagaaagcacggggcggctccctttcaggtggttgccgctcagcttcagctcggccatggtgtgtactgcggatggacacaggtggaggggggttgatgggtgatgggtcccaaagccagccacaccatggtgcatggattgcacagggtccgtgctgctcctgctggcaggtcagctatcaggctgatggcagcggatccttgggacaccgactcacggtcagcagacgttggacaggcaaacagcggtcccaccccgcgcgccatgcatcccactcaccgttggtgacatggaacttggccgtggggcctgctggcgtcttgcccagccacacatacaggtccttgtgcttccgcgtctcaaagaacatgccggttgtgcatccctgtggtgagagtgggaggaagtggcgtggcagggaaggttcctctgccgtgtccaggcaattaggccagaaattgtgttcaagtgtccaacccatgccctgcacgcatccctggttgccggaccttgagctctgcaacctcattgatgaggttcctctcggttttggtgtccagcttggagtcctttttggcatgtgggagcagctgcatcatgtccagcatcaggtggcgatacctggaggtacagcatggggcacactcagttaagaaaccacctcctctgatgtagcccttggctcattgcaccagtctgatggtggaccagactctgatggcggaggaggaccgcaggacagcacgaatcaaacctcccaagacataatgggttggtgaccatattatggcaaaagaaatgagaggggccctttcggttgcaaatgtcctcacctgaaggtaatccccctggaggttacaatgagcacacgctccttgttcttaaagtccaacccgtgctctgaggtggagggctcgttttcagtctgcttcacatcaggttctaaaacagccacctccctcgctttccgcttggccatggcgccgttaattggctccgtataagactgtgcagggccggtgaggtggtaggctactaggagacgagacggtgcgtgacgccttcaggtgtnnnnnnnnnngagagataatgggttggtgaccatactatggcaaaagaaatgagagagaccctttcgattgcaaatctcctcacctgaaggtaatccccctggaggtnnnnnnnnnnccagttctgcatgcaatgtgtcatgtaccgagagaatttcaggcagcatatagcaaaggtataccaagtccgttatgatacggtgctccgagtccttttgcgggtggaggctcccacgtcagcagtccagggcgcgacgggttgggagatggacgcgacgacgttccgacagagtcggagcttgcaatgttatctttgagcggcaaatcgcatggctttaatgctgtgagtcaggctagtctcgccttaagcagagcgagggtttctcttcgtcctggaatgcacatacaaaccacgaggaggtccacccagccgttccatgcnnnnnnnnnntcagttctgcatgcaatgtgtcatgtagcgagagaatttcaggtagcatataacaaaggtataccaagtccgttgtgatacggtgctccgagtccttttgcgggtnnnnnnnnnncagtctcgccttaagcagagcgagagtttctcctctttctggaatgcacatacaaatcacgaggaggtccacccagccgttccatgcgcatccacgctccattcacgtcagctccagcttcgcatgcccacaagtggggatcctgcagtcggccttggtgtgtgaggcctggtggcccagggacagcagtggctcccccaactcgtgtcagtgcgcttcccacggcgcctctcatcaaagtgtgcggcgtgactcggcccgaggatgcagcacatgccgcagcagagggtgcgaacctggtaggcatgatcatgtggccccgggcacccagagccctgactgcggaagcggcgcaggcggnnnnnnnnnnnnnncgcaccgtggagaggctggctaagagcctagtttgcctgtctcccctgccccatgtctgcnnnnnnnnnnaccagtaggagtctttgtcgatgaggatgcagagacaatcgccaggtgtggttaccttcctggatggtgcaccgtggagaggctggctaagggcctggtttgcctgtctcccctgccccatgtctgctgtgccagagcatctatcatcctcacacagggtggcccagctggggaatttctcgactgtacaactgcatggcgctgcatcacagcgagggctggcccacattcccttgcacctccaggtatgtgcaggatcaagggtgccaacctgagccttacatgtgcctgccttctgtgcccatttgagggcgtttcggattgtaaagagtcattgccatgacccctcagaacggacggaggtccagccgagagagcggtccagccctctgcaacaccctcatgcactgtccccatttgcaggtggtgtttgtagtgacagtggacgctgatgggaagctccagaccgagataccagacccccttcccaggtacagcaataccttcttagcgcggtgcaagggtcccagactctcacagtccataccgatctattcttgttcttgtgggttgcacctgccctttgcacctgcgactgatggtgcatgtttagagtcgcaagggcaggtgccaacacaccttctcccgacgtatatgctcaatcaccaggcccattgatctttttcttgtggactctgcaaaacggaaagggcccagcatcgtccttgactggaggacgctccctccgccacgactagcttcggctcggtggctgctggccgggggcctcacggcagaaacagtcaagggtaagcgtggaattcaattattatcctgtgagtgtggtgcaccccagcgatccaaggtggtcgggcagggtgggccctatcaagctgagccgcaagtcacatgcacacagctgcccgctctatcaccctcctcccagatgccatcatgactgccaacccgtgtggcgtggacgtctccagcggcgtgtgtggtcctgatggactggcaaaggaccatgcaaaagtggcaggctttgtgaaggctgctgcacaaggattttctgccataactccaccagcagtcggtgtatagacttttgtcagttggggattattaccaagctcattggcatatatcaaggagaggagcacactgtgatccttctgcatcctaatgctggcagggatatgctcctgggcttcaccagactccacagcagccatgcatggcaggagacatgctccaacctaatcgtcgcagactgggagggtcagaaacccaatcctgcgtgttggagcactgtggcacaaccactgttcttgtaatctgacaatcttgtgcttcattacaagttactacaggagtatttaaacagtggagtggtcatgcccgaccaaaaccagcatccagcagcttcttcctgcgatggcatgttggaggaagtggcgattagaggtcgcccaggagacaccaccaacgctggcgtcatcaaatatcccacaaacacaactcaatgcacacacagctcacttggcagccttccnnnnnnnnnngcgctggcgtcctcagatatcccacaaacacaactctatgcacacacagctcacttggcagccttccnnnnnnnnnnaattttaaatcaagggtagctgataagcagccagcttgcacacaagtcctcactcatcagcacaggaatgccaagtcaagtgatgagtgcagccagtttgccacctcaccnnnnnnnnnngcgactccctcttaagcatgccctccttggcctcattctccctccgcacggtcaataactgggcaacctataagaatgtaatgaagggtagctgataagcagccagcttgcacgcaagtcctctctcatcagcataggattgccaagtcaattgatgagtgcagccagtttgccacctcaccttgtgcttgatctccttcacagatgaaggtttccagtcctgcggcaaaggggtcgcagcttttgtcgcacatgtacagtagagcaagcaaactggtgaacataaacatagtgaattgctgcccatttccgagcacaatctcactcacctcctgcttggcaaacttgatgcgcnnnnnnnnnntcataaacatagtgaaatgctgcccacttccgagcacaatctccctcacctcctgcttggcaaacttgatgcgcagggcaaagaggtcacgtttgagctggtccacttgtgcgtcaatctcagcgatggagaggttcctgtgtaccgttgagagttaatttgagggcttccaaagcagcgagaagaatccaggactgccacgccctgaggctggacccctttacatgatgtcaccacacaccctccacctccaccgtcacacctcagctccgaagccttgacaggcttcgccatgcacacaggagcttgccgggcatgctggggtgacttgcacggtacaaatggtcgctgcagaggtcttgctgtcaaagaggtggcggaagcgaccgcaaacatcactcgtcctcgaagtagagccccggcctactcactgctgcccacttgtttcctggtatgcagcaggctccgatgtcaagtctgaagtagttaccccacaaaatattcttcgtggtgccctgaggatgctggtctgcccttgcaatcgggggaagcggttcccctcagtgcccgtcctccttatcctgacgccacgggtactgcacctccgggtaccacctgcacgagatgctgaacaccccaccatgaccgcatgcatgactttgtaacccttttcaagtctcttggcgatgacatcgataagcgggatagggcatgcaggctgctgagccgagttgctggtgctgtgaagatcaccgggacgtccgcgaggctctactgtccagaagctagtgggcgatgttctctgcaagcatttcgagcatgggcgtaaggcccgggggaatgcgactggcttccatccctccaggacgccgactcgccaggcccttccgcctcgtcagggggccttacacctccagaccgctctcatccgtccaggacccagtcgtgagtgccatgcggcccgatccccccaccagctcctattggctgaagcagacagcttcaggcgcagtcctgggcatggctgccatgcttgccatggtgctaagaccgcccgtcgcccaggctggagaggacgggaccccctacaggtacagcctgcatcccatgagggggcggggggaagggacagcctagctactcgagaggatactgatgcggtgtcgacgggatcctcaagtgtcactccacagctgcgacacccctgctcctcctgggcatcagctcgagcaatcctcactcttactccaggccggggtcgcgtgtcactctgagctccagcgaggcggagccacggcgctggcaggacaccggcatgctgctgagcatggctggagacgaaggccgggccgggagatctagcaagtcagggaagggaggcgcgagttccaagacgaaggcttctgggaagggcgccaagacgtcaaggggtgcgtcggcgtcggccgtcaagtcggatccgatgcccacagaggaggagtcgtttgcggtgctggggctggatgatgtcccccccggttcgtacaaggacgatctgcaccccaacctgaggatccccccaaagaagaaaagccgcgcctacaggagggagggcaggatcagcaaggacagggtgagtgtgagagagcgttgttgctggcacgcgtgggtgtgtgctggggcgggggaggcagggcagcaccctgatttggtgccgtgccaacaggccctggcgtcgcttttctgtgagaccatgtggcccgtgtactttgtacaaaaggacaatcggaggaggggagcgtcatgctccttccccaaacacgattagcatcttggaagtctgcatacctgatggatccccacactctccctctcctgctcacccctgttgcaggtgcgctggaggactttcgatgagctgacgcaggccaccgacgaggccatccgggagactgccaaccgccgcaaccagaagcactacagaaagggcaaccgtgcgtcccgtgggggtgttgtgggatgcacggtgcacaggatgcggggtgctgggcccggaaaagtgccaacgtgtttgcagctcggcttctggctgcgctcgcgacccctgcttcatgccctccttcgcatccacttgcaaacccnnnnnnnnnntggaggaggggagcgtcatgctccttccccgaacacggttagcatcttggaagtctgcatacctgacggccccccacactctccctctcctgctcacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggtgcacaggatgcggggtgctcggccggaaaaccgccaacgtgttagcagctaggcttctggctgcgctcgcgacccctgctttatgccctccttcgcatccacttgcaaaccctccctgaaccccttcccttccttgcagttcatgcggcggacaagcccgtcagcttccccaagcgcagcctggcccctgtccccttccggaacccccagaacaagaagctcccggagtctccgatggtcagtgtgattccgggacttgagaggtgtttgtgtgtgctcaggggcacgccattgggcgcacgtgctcatgatgagggtttcactccttgccctgccagtcgacaagggctgtgtcaaccaaatctgtcgctcattcacttccctgtcccccactccagacggcctggaggacggacaagctggccgacctcacgtacacccagttctggacgctggtcagagagagggcggttgaaaaggtgagttgcaaatgcgcagagcgagggtgggagaagctttccagggatccctccagtgcacaagttcagaagatgaagacatacagctggtcttgtccctctgcatccttgtggataaagtttgtggatgcattcgcagtggtcagctcccagactgtcgcccacaaccctgtgctccctgcaggcaacgtactcggacgacaggcgatcgctgtatgtcaccctcaatgagcacgctcccggaggggctcggactgagaaggtggtcctgccctttgaccctgacctctttgagcacatgctcgaacatgggtacgatgcgtagattacatgggggagggcagagggctctgtgactttgtgtcagtgttggacacagaggagaattggcctgcgtgaaaattcttgcatggctaacactctggtgggttgtttccactgttcccaagcaggacagctaagcttgcagcagtaatgctctgctgctcaggggcaacagtgtctctgagattccagcacctgccactccctcagcccacctccccaacccacagagtgtacatcgactacgagaagcccaaccccttttaccccatcctccattccattgctcgcctcttcttccccatcaccttcgccctgtggctggtccaattcaccttcaggtgagggctgctgtgctgctgtgtgacagaagacatggccttggacttgtggaaatctgctgggtgatggtggtgagcaagctatcaatcttttcatggtcacccccattgccaggatggggcggaagaagaagagggnnnnnnnnnntgtgacagaagatatggccgtgaacttgtggaaatctgccgggtgatgtggtgagcaagctatcaatctttccatggtcacccccgcttgccaggatggggcggaagaagaagagggacgacatctttggaggcatcaagatgcaaagcatccaggtactggtgggaatatatgtgtagggaattgacccccagtaactggggtgcggaaggggatctgtgcatgcagcctcacacatcctccagagaagggaagatagtgcaacgagagctccttgatatcaacctaatcactccactccccccgtcctacagcctggcaaggcgcagtacgactttaccgatatcgctggaattgactcggtgagatgagatggaggcagtagaggataggctggggcaaacaaagtgcattcaggaggcagtccatgcattccatgacacggagtgccagccatccattgcaagcccactgggcactcgggttcgcagattcattcagtatggtgggaggcaaccacccagcgtggctctctcatcctttacttttgtagatcaaggaggaaatccgggagnnnnnnnnnnaaatatatgtgtagggagttgaccccagtgattggggtgcggaaggggatctgtgcatgcatcgtcaaacatcctccaaagaagggaagatagtgcagcgtgagctccttgatttcaacctgatcactccactccccccgtcctacagcctgnnnnnnnnnnggtgcattcaggaggcagtgctcgcattccatgacacggagtgtcagccatcgattgcaagcccactgggcactcgggtttgcagattcattcaatctggtgggaggcaaatactcagcatggctctctcatcctatgcttttgtagatcaaggaggaaatccgggaggtggtagagttccttaagaaccctgcccgctttctcaaaatgggagcgcgttctcctgctggtgttctgctcgttggacccccaggtgtgttttgtgtgacgctgggtgtgatatcgatcgaggggattgccaggcccactttagcagccatggattttcgagtggacacatagggttggtcctgctactttttgctccaacacaaagacctggtccatcccactccccttctcaggcacgggaaagacgttgctggcaaagtcagttgccggtgaggcgcaggtcccattcttctccgtgtcaggaacaggtgagaaaggtgaaatgagaccatggagggccgatgtgtctcctgcagcctgcacgagcttccttattcccattcacaatgatagagttcatggagatgtatgctggaatcggtgcgtcgagggtgagggacatgttccaacaggctcgagcagcggtgagatggtggtcattgagatggtgaaagagggagggggaggggannnnnnnnnnacccattcccaataatagagtttatggagatgtatgctggaatcggtgcgtcaagggtcagggacatgttccagcaggctcgagcagcggtgagatggtggtcagtgagatggtgaaagagggagggggaggggagaggtcatcctccgagctgggtgtcatccaatgatgctgggagcggcggccattgggtgccatgctgcaatcttcgagggaatgtttccgctgtccggcaaatgctctgaggaggttgctgctcgtatcaggaagatggaatcgcacacgccnnnnnnnnnntggtcatcctccgagctgggcatcatccaatgatgcagggagcagcggccattgggtgccacactgcaatcctcgaggggatttgtccactgtctggcaaatgctctgaggaggttgctgatcgtatcaggaagatggaatcgcacacgccctgggcccacacgtcacgcccagacgtataccctggtccccgcgtaggccccctgcatcctcttcatcgatgagtttgacggcgtggggaaggcccgttctgccacggccgggaacgaggaggcagtgcacaccatcaaccagctgctgtcaggtgcgggtggaagtggcaggggctgtgtgaatagacggacatcagcacgtatgtgctttgcagggaatattatgcttcagaatttggtcttaagacagacttgtgcccctattcaccttttgccgcgcactttcccccggctctgggcaatacctatgtgcaacactccctgaatctccctccaacgcagagctgnnnnnnnnnngacctttcgatgcgcactttcccccggctctgggcaataccaatgtgcaacgctccctgaatctccctccaacgcagagctggatggatttgatgacaacacgggcgtggtggtctttgctgcgtccaacaggccgcaatctctggactctgccctgaccagaccagggcggtttgatcgcatcatcacactgccctatcccaatctggaggtgagaaaacgggcgaatggagggcggggaggctgaatcgaggaattgagtgaggcagaattgcaaggaccctgttctggctaaagctggtgcgccggcaannnnnnnnnntggggaggctgcatcgatgaattgagtgaggcagagttgcaaggacgctgttctggctaaagctggtgcgccggcaaagccaaggactcggtggtacagcagcaaaccttcccggctttttggtccctgtgtggtcagcattgaactcaacccaccatccaacacctgagcatacgcgcagggacgcatccaggtgctcaaggtgcatgctcgcggcaagcgcgtggcccagaacctggactaccacaagatctcacgcgccaccgccggcttctcaggagcccagatcatgaacttgatgaacaatgctggtgggatgggggaggtggtgagggtgttcagggtgggtctgggattcatgccagacccacctttgctcttgcgcggttttgagaaggaatcgtctgggcgccgtagtttccgctgtcttgcctgtgagccagcactgatccgagggttgagcctgcatgcggccctagactcgatctgcatgcgcatgtgtgtgctgcctccgctcacatgccaactgtgcctctcctgcagcaatcgtggcagcgcggcaggggcgcctggaaatctcagatgccgaggtcttcgaggccttggagaggattacgcttgaagaggtgtgtctgaagtggcctataccctgaatcagtgcatctttcacaaggagcaaggacctggtactgggtccatggcgcagcatcatggaatgccaacgcacatgttcctgaccttggtcacatccccgcaccacatacccttcccacagttgggggacagtggagtggagtacgatctcacggagatccctcagtctgtgcgatccagcatcgccgtttacgaggccgctcgcgccctcgtgggctacatcactcccgactttgatgaagtgcagcgggtatgtgttgagggagacctctagcttgtttaaatcggaggagttgggtggcatctgtgcgtgagaagctgccatgcctcggagaggggtgcttgggccaggcaccactttatcagctgcacctcaccctcctatcatgtcaaggagtcccatggatgtccaagtgtgcagcccgggctgatacgcagcctgctctgacaacacaatgcgaatcctttctcgccctgcacaggtatcggtgtgccccaatggcacagcgacgggctccacctacttccttcccctggaggagcaactggagacgaggatcatcgagaggggatatctggaatctaaaatggtagggtcttgggtgcgtgtgcgctgggttgtccctgacgtgcttgnnnnnnnnnnatccacctactttcttcccctggaggagcaactggagaccaggatcatcgagaggggatacctggagtcaaaaatggtagggtgttgggtgtgtgtgcgctgggttgtccctgacgtgcttgagggctgttagccaccctgaagtgaacgcctgcatctcgtggactccaagtccgcggcattctctcggccaggctggggggnnnnnnnnnnnnnnnnnnnnnnnnnnnnnnnnnnnnnnnctgctcggcatcgaatcagcaccggctcgcaccccgtcatccagaaggcccccccccatccacctcaggtggtggcactggcgggtgcggtgtgcggagatgctggtcctgggggaggccaactacacctcgtctgctggcgaagacctgaccctggtatgcgacttgcgtgtgtcgcggattcgtgggctttaccagtttttatcagtgcttttgtggaccctgcctttttggctggctgacggcgtcatcatggtctgtttgcactgccgaacaccaccgttcactgtgtgagctggcatgtcctgattcccatcagccatgcctccccatgcatcccatccccccctgcaggccaactacatcgcgcgtgagatggtctaccactccggctttggcgcccgcatgggcccagtggctctgcaggacgacgatgagaacttcctgatgcgcgagaagtagggcgggggagaggggggaaggtgctgggtgcagtgcgggaatggtgattttgtgtgcaggggtcgccatgctgggtccagacgacgtgccgctgagggaaggggctctgagtcatcaaagctcatcccatgcccccctttccaccctgtccaggtcggagccggtgtccaacatctccacggagctgtccctggtggcctaccaggacgtgaaggacatcctggccgcagccgaggccaaggcctactacggcatcgtcaagaactacgcggccttcgaggccctggtccagaatctgaccgtgcgcgagacgctgaccgggacggagatcagcgacatcctggacaaattccgtgagtgattcagcgggggaccgaggatggttgtgggggatcgggcgtgaagggcggcgtgcccgggggacagtgcgggtgtgtaccgcgtgcagaggctgggccgccgttggatgcgaacccgctccctcagcgacccttgctcaagtccttcatcgtgtcggcatgctcggacaccggtgtctgcccccgctcagccagaaactccatgtccctggacacccgcagcgctggagcggtaccctcggtccaccctgtcgggcttctactgggaggaggatgggagcgtgggctacccgggcaagccaaaggttggtttgagttggtgctggctggggccgggtctcaggctggtcaaagtgtcttgcaaggggcgcgtgtacctcccccccgacccaacatacaccctcccttacctcctcatcctcgccctcccaacccccaagacgcacgaggggcggctggtgaaggtgggcgtcacccgcaacggcgtggagatcggcgcagacacgggcaacggcgccgcgcccgccaacggcgcggagggcaccaacggcagcggcaagggcaagggcaaggagcggtacgtgcccgagtggtgggcgcccggcaacccgtacgccgtgcgcagcaacatgggccggctgctcctccgcgaagggatgtaggggggcggatctgggttatcgtgggcacccccggtcaacacatcttccgtcgagatgcggccctgtgctcaagtctttgagcatctgccaggccctgaggcggcatctggtgagcaggcgtgtgcgcatcttgcccctttccatgcacgtgcctggtccctcccccctctggattcgttgtgctgtacagcccgcagcaaggcaacatcaggggtcaacggcggggctgttgtcatgtggtggtgacacagggggcatgctcctgcacaagcgatcgctgcacacttggctcggcacagttcgccggccgatggaatatcatctgggggccggcccaagagcgccccccctccaggcccaggcccccccacttcctccacaccacaccgctggtggcgccacgcacgccacgccgagcgctcagtcctcctgcttgggcgcggtgagccaggacatgcggtccacgcctcgcagctgcatgcccagtccctccttgtagatgtgggccgccagcacgtcctggcccgggaaatcggcggccttggccgcctcgatggccgcgtccacctccttctttgcctccttctccagcgccttcagctcggccacctccgccagcccggcgtccagcagcagcttgcgcacgtgctcgatggggtcgcggtgctggcggatgttgctcacctcgtcgcgcgtgcggtaggtgctgccggggtccgacatggagtgcccgtggtagcggtacgtgtccatctccagcacgatgggcccctctgccagcgcgtgctgcttggcaaaggccacggcggcgcgcaccgccagcacgtccatgccgtccaccttcaggcccggcatgtagtcgccgcgggagaagtaggcgggggacttggcgctgcgccactccgccgtgcccatgccgtagtggttgttctcgcagatgaagatcgcgggcaggttccacaggctggccatgttgaaggcctcaaagatctggccctggttggctgcgccgtcgccgtagatggccacgcccaccgacccgtcgtccaggtactggtggcccagcgccaggcccgcgcccagggggacctgcgcgcccacgatcccctgcccgccgtagaagttgtgctcgcgcttgtacatgtgcatggacccgcccttgccctggttgggtggagggggatggacaggggctgggtgcggttggggtctgaaagggcgacagcaatgtgcatcgagaggtgtagggcccggagccatgtgcacgaggccgtcacagagccgccgcaccctcctgcaacccctgcagcccaacctccccgccagccctgcacccagccgcccacggatctcccctccaccctcctccgcctctcaccatggaggcgccggtgcgccggcccatcagctcggcaatcacctcggcaaccgtgcccccgcggccgacgtgggtggcgtggtcgcggtagctggtgatgatggagtccttgtaggtcagcgctgcctccatgcccaccgagatggcctcctggccgtcgtacaggtggcaaaacccgcgaatctgcttggcctgtgaacgaggggagccatgtgtggtgggggtggggaatggagctgcagagtgcgcgaaggcagaggtggggacgacccgtgactttgcaacggcgtgtgagatgcactcatccaccacgttaaacagcccggaacggtttcaatgcctaaacccaatgcagagaccgcgcagcagtcttttgaccccccctaggccaggcaccttgtacagcatgtcggcgctgatctccatgcgccggatgaggtacatctcgcggaagtacttgatgagctcatccttggtggcggtgacggtggtgctggggggctccaccttgtgggcagtaaaggggttcacctgcggcacatggacacacaagggttctcaagcctggggtgacgcgagtatgctggcgataggcatgcggagcgtgaccaggccattcttccgttgataatttgggccttacaggccttcaaggggagtgcaggccacaaacgccacccacgagcagccagggcgcggccggtgacccacctccacgctcagggtatcgccatcgactttggcagcgaaagcccgtcctaggatatcgcgaggtgcccctgagctcagccgagcgcgcacagcgctggagctggcctttgagagggctcccagcatcccggggactgtaaatagggcagggtctgcaccagcgcgtgtcgctctgcaaccacgcacgaatgcaactcaaggcctgaggaatgtatggcacagatgtgtacaagtactccaagacctccgagtgtggctctgggtttgggcttgcatgcagtggggtttgcgcctgcatcacacgggatggctcccgccaaaagctgcacatgatctgccccgcacgtcccctccatgatatcggggttcgggttccctgccttgactccactccccagccagaaactggagcaccgccctctaaaccgacatctgcgacgcgatgtccctggccactgcaaccatgtcgaccaccgggtccttgcaggcaccccacgccaggtcctgctcctggctcaagacctccgcccggatccaccactccgccgctttccgtcaagccgtgcatgcctctcgccccaggcccagccttcgcgtgttcgccagcgaggccgtggctgcgcaaggtgggcgcatcctcaaggattccgtgtccttttcccactccccgatgcgcatggccatgccctgtgctagggggcccgggtgggcccgggccacccacgacgtatgcacacaccgttttgccccttcgaccaggtgcaggggtggtaaatgacgagacgtgggaggagctggtgctgaagtcgcccgttcccgtgctggtagacttctgggccccatggtgcggaccctgccgcatgatcgcccccctggtggacgagctggcggaggagtacggggacaggttaaggacacttaagctgaacacggatgagagccccaccgtggccaccgactatggcatccgcagcatccccaccgtcatgatcttcaaggatggtgaggaccctgggtgggggtgcggcagcttgggcatcggctccggtcgggttggtctttggggctcagagctgactcttctccaccctcttccatcccgccacaggcaccaagctggatgccgtgattggagccgtgcccaaggcgacgctcaagcaagccatcgacaagtacctcgaataagcttgagggggtagaacaccctgccgcaattggtcggccagctaccgtgccactctaagcgcaggtcaaaggatctttgtgtccgaaatgagacagactttcatgtacacgttgtaaggcgtactctaaggacaaggggggagtgctggggaatgatgacagtgcagatggcaagggttggggccatctatgtctatcttggcaggggccactcatcttctggccatcnnnnnnnnnnaggtactggggaacgatgacagtgcagatggcaagggttgggaccagcaatgtctattttggcaggggccactcatcttctggccatcgattgattgcatcccccaagatcattccgcctggtcggtgctgcgccctcggggacgatgggccttggcgctgggcccctcctcgcgcgcctgggagacaaacacgcccaccatgataacgatgagggccgccaccagcgtcgcaaaggacagtgcgcctggcctccgcacctgggcccagccgaagacgccgtggtggcccagcagcatgatgtcattcagcccatcgaagttccagtcggccacgagcaggggctgcgccggcaccgatggcaggaccatgctggcgagcacccgaccgtccatgtccagcacatagccatgaagtgtgccggctgtcatttttgagggggcgaggatgggaaactgagaatgttgaacaggagaaactgtaactggcggtgtcaccgtcggcggtgcattgacacaggtgttggcatagatagaaggacaggagaattggagcgctgaggcagcggcagggctgtctcacatgtgacttaaccgcccggcaccctgaccacgtatacccctttcaaaccaaaaacaatgcacgtacaacaccccctccaacctgcaaggatggcggtggggagtccatgcgtgtgcaggggcaggggtcgcagcgtgggcacttctccttcgtcctcctcggggtcaaaggggccaatgcccgtccacgtcgcatccaccgtctcctgtggatgggagtgggggggtgggctgggtgacgcataggtatgtctgcctacgcatgagcaaaggattgcatggcagtgcatgcaaggtgtgccagtcactactctgcggcctgacgactcaaagctcgtcagccctgcccaacaccagcaatgaagggcacagactgctctgggtcagtaccaaatgtccgctcgtagaccctgctcagtctctcgtcccctccctcgacaatgccccccccacctccccaccttccacagtaggtccccctccgcatccagggctgtgacctcgccctggctgtgcaggtacactgtcatgtggcgctgccggatcggctccgggtactcgccgtcggggccgggcagggggagggccatgggctgcgccacctccacacgcccctgagaggcgcgggcgaggcgggcgtgcggcacggcgtcgcagatggtggcgttgaagagcggggcgcgagccgggatgccggtgcgggccaccgcgctgcagggccccaggtgcgtgtggccggcgctggactcgtcttcgtcgacatcctccagtggatcgccgccttggtatggttgatgtaggggaggtgaacacagggtggagtagggtcgcgtgtgatccttgtcaggggatctcgggtggagcgtcgcacaaggggctggctgaagggcatgcctaccaaaactccccacaaaacatcgctaaacacctattgccacacagtacacctccccacctcgtgccacgatgtggtctggcaccccgtcgccgttcacgtcgatgtgcagcccgggggagggcaggtgcaggcggcacaccacgcggccagagaagaggtggaccacctcgatgccctcccctggggatggggagtcaggggatgcgtcgtcagcaatcctagaagggcatcgggcatggcagcggcacacggtgggccctggtggtcagggccgacagaggcatcacgctttgtccccggtactactcactgaggtgggcgacgagaacattgggggacacctcctccccagccttcctcccacgcaggagctgcaggggggggttgggagagcgcaccgctcggtgttccacaggtgcttggatcgcgaggcccgccacaccgaagacacgaaacacaacggctggcacagaggctcctgtgcgaccctcgccagctcccctgaccccgcccaactcaccccggccagggcgttgggcggcgacccacccagcttgaggccggtccgctgggccggggagcttccggccccgccgtcctcgcgggcgaggcgcgccgggtcagccctctgctcccccttcccccgcttctgcctctggaagtgagccaggtgcagcgccgtgtcccagctgccctgccagctgtgtgggagggcttccagaacagaggtccggaaagcgcggcacgactcctcgccatactctcgtgccgctgcctggcaaggagggtgagcaaggcgtgcagttcgacatggcacgaccaatggataacacgtgacctgcccaatccattgtagcaagatggcagggcgcaaccgaaacagggcccacagagctgtctgctgctggaacggagcacccggcccacctgctctgccgtgacgtggaaggagaacctgtcggacagtccgtcctgcagggcacccagatctcgcttgaagtccgacgcctggtgtgagcatggggacaggcgtcctcagcatgaatggcagcacaaaaggtcatcactcgcatttgctcaccttgcaacatccaggctcatgcatcataaggtcatcaccgaaacaatccccttgcccggtcgcccgccgcccgattccgacctcatgcttccatctgagctcgcccttgccaccctcaaaagcaaagtagttgaactggcgcggcgcagcactcagattctgcgcgttggggagggtacagaggtgtcagctgaggagggtgtattccgaactcagcacataatgcatccatgcctgaagtgcttgcatccagacaccacacacccacgtacgtggagaacgtccttgctgccatcctcggaagatgcggcgccgtcctttccaaacccgcgattgatgcgctccagcccctccccgagcatttcctcctccagtgcgccatctagatggatcgtgtccgtgaggggcaacagtcgtcaaagaactgagtgggcggtatcacctcgctccctgtcannnnnnnnnnttccagcccctccccgagcaatacctcctccagtgcgccatctagatggattgtttgtaaggggcaacagtcgtcaaagaaccgagtgggcggtatcacctcgctccctgtcagttgcaacccgccctgcacccaaataccaccgctggactcccccagccccttgccgcggccctcggatcccagcaccagccccaactgatccagcaaagggtcccaccaccctcctacctcggagcttgcgccccgcagcagcggcatgggtgacgcccgcccccagcacgaccaggccccggtcccccttggacacggagtggtgggagacgtgcagggccacctcgccgtgcgtggcgcgcgccgggaagctgggcgccagccgctggctccacagcgggcgcaggttgtggtccaggcagtgcagcgtgaggctgctggtcagcaggaccaccacctgcttgcgtggggccctcaccaactccttgggctcgggggtcaggtaccccgtcgcaagcgccagcagcggcatgttgttgtcgggctcgacctccgccgcggagaggacctgggaggggtgcaggtgacacatggttgggaggagcagcggaagagcgtaccctcggagtgccatgctggaatgggctaggcacaagccgtccgccccagggtcacacccagcctgcccctcacccgaacgcgtgcaaacccatccccgggccgtgctggggcgagcagctggacctggccattgggagcagccacgagcacttcaggcttgccatcgccattgaggtccacctnnnnnnnnnnnnnnnnnnnnnnnnnnnnnnggacatcagcaacagaaggcagacacctttgcgagtcctcaccgcgagaggcttgggggaggggtagggagcagcagcaaacaggtctgatgcgtcctcgaaggtgtggtacctggtgaagatgggaccgggggctgaggttggctagctgatatgcagatcagtattcaagagggaaccaggcccctcccgaggacccatcgcgcaccatgctnnnnnnnnnntgaacaaaaacccggtatggagcgattgagaggggagcatcaagatgctgagcatccaagctacgagttgctctacgaagcgattgcttgggcnnnnnnnnnnggaacgaaaacccggcatggagcgattgagagggcagcatcaagatgctgagcatccaagctgcgagttgctctacgaagcgattgcttgggcnnnnnnnnnnagggggctgaggttggctacctgatatgcagatcagtattaaagagggaaccaggtccctcccgaggacccatcgcgcaccatgctttttggaagtggaaggacccctcgcgctggagggagaagtacagggcactcgcggacagcaccacaatggcgaaatcccggcgatacattgtcaccacagtgctacgcctattgggtgcatgagtacgatcatgccttcccgggcatctctcgagagaggtggcagcttcctgaacccctacctgtgtatcttgcacccccttgctggaatctaaggcacagctgggtggtgagcgtcgaagatggcttagtaagagtactgtatcgtgccctcgtcagtcttgagcgtgattgggccccggcgggtctgtcaaacaagtgatctgtactcgtccgtgtccggcttcccgcctagaaccgcaagtgatcagcgtcgagggcacaactcacaaggggcgacacacgcccccgacacattttcatcctgctagtaatgatacaagcatagaccaaagttaaaaatatgtcgaccatgcgcccagtcaacggtcatgcagtttgtgacggcgggacctgctcgtatgtgtctggaccttccaagcccgcaagcaagggcagagccccttctcgcccccctggagcacccgctggatcctgggaggtattgccctggtggcactgtgagtgagagggcgcgacaagacggacgatgtcacgcagccccagaaccgagatcgcaagcggcccagtggccagggtgaaggtccataccaacatggaccctgcaatgctttttgggcacgaggcaggcagcaccctgtgtcgcaccttgtcaatggccactctcattctccctcgttgcaccaggcgcgtttgtggacccttacgagcgcgtcaacttctggagtcacagcgtgccagcggtgggcctggccatcctctgcgcactaggcttccttcatggctccccctcggtcaccgtgtacgctgcctgcgcagccaccacgcacggcatgtctgccctgacccacgtcttcccagagagccgaaccctggtaggcaggagtctgggtcattctgagaaacaggggcaggacaagactggacagcatcacgcatgcaggccggtccctggtcatactgcttgagtggatgcgcatcagctcctatgctgacactgcgtcccttgccggagacaaagtcgctgcatgatgctccatccagcattctcgtcccccaccccaagccccatgctccatgcaggagaaggcggatcacatcgggatcgttgccaccattgtggggnnnnnnnnnnaccaccccgggccccatgctccatgcaggagaaggcggaccacatcgggatcgttgccaccattgtggggacccctgtgtccgccatgctggcgcacagcgcgcatggcatcagcgaaatgccgctgggcgtctggttcatcttggcggggctctttgcctgtgcgtgggcgcgccccttccctcgcaccagcggattcatcggcctgggcaccggcctaggtgggagaggtggcttctggcagggcacacgaggcgggctgcaacccggcaaatgtattttgaagggggacggatggatcaagtgtgcagtgtatcatgggcgtgatgttcccttgatctcaagcttgcttggggtatgaagtgcaattgctctcgtnnnnnnnnnnatgatgttccctcgatctcaggctcgcttggggtatgaagtgcaattgctctcgtaccatgtaaccctcgcctgccaagctgtccccctaccccctgtccctgtgacccagtgtactactgctgggatgtgatcaacttgaacctaaccactcagatcctgctctacatctgcggcgcggtgctcttcctgagaaactcagggcactccaggtgtgttgggttggtgaggttggcagtgattgctggatgtccttggagggggtctgacactctgttgggatcccccctggtggcctctcagggaagggcgaggcggccccacatgggcctgcccctcgcgctgcaacctccatcatgcattgcaatgcttcctccccatcgcatacacctcatgtcccgccaggtggcccggcttgtcggatcaccacggcttgcactactgcgtcaccatcgccgcatccatgcacctggtctacctctacaacgccctgcacccccagccctgaggctttgattcttgcacagtcactccttgcccttttgccactccgcactcctttccttttgccatttcacgaataaattacccgtgcgtgtctgggacgactcagccagcaaaatggagcaagaggcctgagggcagaagaggtaaggctagggcggccgacaccccaggaacacaaaggtggaaccggcgagagtctctgcggctcgctcagttggtggcgtgcccgttgctggaccgcgtcacgcgcttggccacgccatcgacccggtgcccgttgctgggctgcagcgtcggcgcgtctggctccgtgcaggatacctccacctgcttgggcgcgacgctgccgtttgcctgccgcccgtcttcctgcgcgggcaggagggaggtttgggggggttgaggcttgatgcatgatggctgctcgacgtggccatgcctgcgacggtgtaccaatcgtgcgtggtgacccaggtgcgggcaccaaggcccatcagagcccagccaatcctgcaacaccttgggcgcgctggccagggcagccagcacggccatcgcctccccctccctgcccacgatgtgctgccacgcggcatggtccttgtcgtcgatgttccgcagcgcacgccacaccgcggagttgcacttgaacccggagccaaaagcaatctgtgggaatggcagtgacctggatgaacacggtgtggcacaccaaccctaggccannnnnnnnnnnnnnnnnnnnnnnnnnnnnnnnnnnnnnnnnnnnnnnnnnnnnnnnnnnnnnnnnnnnnnnnnnnnnnnnnnnnnntgccacacgacgtcgccgcgcttgaccccggtgacggcctcacagaacccaaagctgtaccagacggtgctgctggaggtgttgccatacctgcgcggccagaagcacggcacgtgagcaccagccagcggtcgatggtggcagccttgatgacacccgagagcacggctccaggcccccttcaagcacaaagtccggccaggccagcagccccggcctgtgaattctcactcaccagtacagggtgttggcgctgggtgccatctgcnnnnnnnnnngggccagaagcacgtgagcaccagccagcggttgatggtggcagccctggtgacacccgagagcacggctccaggcccccttcaagcggagagtccggccaggccaccagctccggcctgtgaattctcactcaccaatacagggtgttggcgctgggtgccatctgcgtcgggctgagccccagctgcgcgctcagcccctccacgacgcccctcccgcctgcatgggtgggtcagcgagcggcagtgggcggcagcatgagccttgcagcagcgtgccaggatggcagggcgacggggcaggcccacgcctctgtgtatcacaccacatcgccccttcctttcacccaggcctgcgcccctcccggggtctcaccggcgtggaggcagaagtgatcgaaggcccgcgtgaagtctgggacatagggcgcgacggtgcccggctggcagacctgcctggccacccagttgaacgcaaacatcagcttctcgctccatggcagcaccaggggccctgtaccggtgaggcatcgggagggtcgacgcggtgcagggtgactgcagccagttggatgtgccgtgacgccgtgccaaggacgcagcgggggttggnnnnnnnnnnaggtgaggcatcgggagggtcgaagcggtgcagggtgactgcagacagttgggtgtgccgtcacgccgtgccaaggacgcagcgggggttgggaatgcttgccgtacctggccgtgcagccgctcacctgaggaggatcacatgccaccctcacatttccaaccccaatcgccagggcccagccatgcctgggccctggcccctgatccttgtctgagcacgcccagtgccctgcgcaccccctcccccaagacacgtcgcgtgcctcccaccggtcgggccctggcccagccgggtcccactcccaaccccctnnnnnnnnnnctgcagccgctcacccgaggaggatcacatgccaccctcacacttccaaccccaatcgccaagcccagccatgcctgggccctggcccctgatccccgtctgagcacgcccattgccctgcgcaccccctcctccaagacacgtcgtgtacctcccaccggtcgggccccggcccagccgggtcccactcccaaccccctcacccaggcgcgtgaggttggcggtcatggcgcgcgcggccaccttgacgatgtccttggacagggccacgcccatgctccccgcggcgtcgggcgcctggaaaatgcagcggtaggcggcgtcgtcggcgcccaggtgcacgcgcaccaggcgctccagcctgtacttgcagcgccgccgctcggaggcgctgctggtgagcagcacggccgcggcgcccaggcggaagatggtgttggggatgagcatggagcgatcgcggccgcggtaccagttctgggtgatgttctccgtggannnnnnnnnnggcgtagcccccgcgaccccgctcctgggatggtggggatgggaagggggtgggggtggggcggatggacggtcaccaggacgcgaaagcatggcgcgccgcccgacgagcagaggcggactgccggtgtccgacggggcgggcgcgctcgcaactaaggggcgcggcgcaggcaattgccgtgaacgatggcagcgccacggacgccttgggccgtctgagtccttggttcgtcgctgctgcgaggatgtcaaccnnnnnnnnnnaggcgccacgcaggccttgggccgtctgagtccatggttcgtcgctgctgcgaggatgtcaaccatcagggtgggcatgcaccccccccctttcctccccgcaccaggaccctgggcctactttgagcagcttgctggccaggccnnnnnnnnnnactcccccctttcctccccgcaccagaaccctgagcctactttgagcagcttgctggccaggccgacggccaggacccccgccgagcaccccatgcccgccaggttgtaggagtcgacgtcgctgcgcatgcccaggctgttgatgaccatggcggccagggagggcgtggggttgaacagtgagcagttggtcaccagcacgtccacctggcgggcagtgatgcctggagagggtgtggagagggggggactgaaggggatgccaaggaagcttgtccgctggcattctccaatggggagtgaaggtatgccctgctgcggctggaccnnnnnnnnnnttccgctggcattcttcattgggaagtgaaggtatgccctgctgcggctggacctcctgcggcatgacgtcacctgcgcattctcatacctgtcttcttcagcagctgctccacggacgagcacatgaccaggctggcctcctcacgggcactggccatgctaacctccggcgggctggctacggggcacaggtgcggagcgggcagggatcgatgcacgggaattcacgttccgggtgttggtaaggcatggctatgcatgccagccgcccaggttccacctggccnnnnnnnnnntgatcgatggacgggaattcacattccgggtgttggtgaggcatggctgcgcatgccagccgcccaggttccacctggccgcactcccttgcgattcgcctaggggaataaacaagcgcaaagccacagaggtaacctcccgcttctgcagaccagtgcatgcnnnnnnnnnncgcgattcgccatgtggaataaacaagcgcaaacccacagaggcaacctcccgcttctgcagaccagtgcatgccgggggcagtcgctgccggtctcaccatgcaggccgggggggaagaaggtctcctggctcagggcagacttgttcaggatgcggcgttggaagtccagggcctcaacgtcgaagaactgcacagcagggatgggcgacgggctgggtgggagcaagggggctggaggcttgagattatgaagcatggcctcgtgccacaagcgctgcgccacccaggcgtatgccgggtgtcaatgcacgaatcgatccgactcgtaccctgaacccacatgaacttgccctaatttgaccccctgctggtcaaacacatcacaagtcccacccacatcgtacgagtcaccgcgcctcacaacgactcacccctgagtcgacagagccctgcatgaagcggtcataagtgaccttgagctcgtcggggggacggtagcacacaaaatccagcaggtagatgctccgaggccgcagtgcgagcaggaggaggcctcccaacactagaactgctgcaaaagccgccagccatggggtgtggcattcttgagggagccagggtcgaactatgggcccaagctctccccgcaagaagagtgcataccccttgacctgcaacattgtgtgtggcaggggagtgtggcgcatgcaatactggctgagcaggggtctggactccaatcagtttgctcagattgcatatctttacctacnnnnnnnnnngggggagtgtggcacatgcaatactggctgagcgggggtctggactccaattagtttgctcagattgcatatctttacctaccagctaactcacgacctcttaccgcgaaatttccacagattagaccagcggccactacagctgcaacctgcgatttgctaatggcttgggccgcggcagcgccgacccacttagggggtaactctgcagaggatgattcgtggctatgaagatatttttatcgggttcttgagacaatgcagcagctggggtttggccagaggtacatacctcgttgacgcccttgtgggagggacatccctccgggttgcgcgggagccaacccctctgctcgtctgtagaggacacagcaataaaggcaatggtaattgaggttcgaatgtccgtctccagatgtcagctggattcctagaagggtacggcacagacccagctttttggattcgaaaggtgcctcggcatggcgctgacgtggggggcgccgagatccggcaggggtggggacaccctccccgaaagctgccaatcactggttgagtcgcaacacaaaagtccgaatacatactcactcccagacgggttttaaccgatccatcatcacgcgnnnnnnnnnnattgcgcaggagccaacccctctgctcgtctgtcgaggacacagcaattaaggcaatggtaattgaggttcgaatgtccnnnnnnnnnnccggggagggagggccctctcagcccctgtccaacgatgacttccgtcgcatgctggcgacccctcgcccggactcccagccccgtcagaaacagggaggagataagaagaagggtcggccgcacaagggccccagtcagaagccggtggacgatgcagaggacgcagctgcagggcctgggtacaggtagtactggcgttcggctccggtccaggcaccttcatggcactcggtgcaattactatcgtttggtcctaaagatcctgataaaaatatccttccctggtggcacttgcagggatagggccctggagcgtaggcaggggctcggacctgagctgacgggggtgccgcaggacctcgtcagcctcatcaacaacgacggggtgggatgcgtctgttttgagggcctggtctgtagcagaggagtgcccttgcaggtcgccccagtgtctgggggattcacgcccggccttgtcagcgcagttgcagccctggggtgccatcacccgtcagtcccagcctccagaccctcctctctgaccccttctccctcccctgnnnnnnnnnngtcgcctgtcattcccagcctccagagcctcctctctgaccccttctccctcccctgggccaggagaccgccctgcacggtgtgagctacgaggaaagcaaatacctcgggggcgacgtggcccacacacacctggtgaaggggctggactttgcgctcctgcagaaggtgcgggccgaggagcagcgcgaggccgaggaggaggaggacagcgaccgggaggacagcggcgacgaggcccccggaccccaacaggctgctgcagggcggcgggcggcgccctttgtgccgcgccacatcgccccgccggcctcggccccaaaggccaggaccgcgatggcggctgccctgcatgagtacctcttcgcccccaagcccaaagcgctgggaatcagtgagtggggggggggggggggggggggggggnnnnnnnnnntcggaggggggcgatcaatgtgtgcaaccatgaagttgctgtcatggcagagggtgtgactcagcttggtgaggactgttcacacaccagaccacttaatatcattttgtgatgcctttcccggccagctgcccgcaaagcacatcannnnnnnnnnctgaggactgttcgcacaccagaccacttcatgtcattctgtgatgcccttcccggccagctgcccgcaaagcacatcaccatgaggtgtcccgccttctgctcctctgcagccgcggccgagatgttccagccccgccgcacctccttcctgtacgaggcggaggggggcgggctggagaacctgcccaccactctgcatcgcgccaaggaagactgccccaaagtgagacgtggggtgaggatggggacgatgcctgcctgggatgccggagtgaaggacagacagcgactggacgctgctggtcttggtggagcagagggagcgctggaggcaggtgcaccccttcacaggagcacgcctgggcccatgaaaaccctgcccactcatgcatcaggtgaaggagacgctgcagggcgacctggacgcacgcatcctcgagcggctggtgaagatcatggcctacatgtcggccgcgagtggcgcagcagccgtgaagaagaaagtcaagaagaagcagcacctacagggcaccgttttgccaggcggcgtggctctggccgggtcccttcgtcccgacagggatgctgcggcgctcaaagacggtgccggccctgacgcggagggcgctgggcagccaggtgtgtctgctcttcggaaagcgcacagcctctttgcaacgaggaatggggatgtgcctggtggcatgcgggccagagtgatcttgttgaagctctcagcactgcctctgcacggatctcagcattggccggtcggctcgctgatcaccgcatgagcagctgtggcgtgaaggtgtggccgtttcttcagcatgcccctgcccgcttgcactgcaggatcaccaagccatcgcccagcccccgtggatgatgacgagaacatctttgacgacgatggcgaggagtacaagccggagaggagggcgcctggcgcagcaccagtacccccgttgccaggaccggcgggcaggggagcctactttggcggcgcagaggagggccaattggtcagtcctacacaaggtgggcaggggggcctccaaattggagtgcacctgccctatgagctgcttatgcaatgttgttggcaggcggattcttgccggaatctagcttgattgcgcttggacgtggcagaggaaatagccccctnnnnnnnnnnatcagtcccacacaaggtgggcagggggggctccaaattggagtgcacatgccctatgagctgcttatgcaatgttgatggcaggcggactcttgccggaatctagcctagttgtgcttggacgtggcagaggaaatagcccccttaactcgtttggggtggtacggagcccatcgagcctgagttggttatggactgcgtgagtttttgcccccacatcgtcaatccttatgcaggtgtgggtctggcaggtccttctgnnnnnnnnnnggatcacggactgcgtgaactattgcccccacattgtcaatcctgatgcaggtgtgggtctggcaggtccttctggagcaacagagtgtgccccaccacccccgcctctacagcctctcgggcacgaggaggaggaggaggaaggcgcctacccggacacatctgctcagtacccggacacatctgctcagtacccggacacgtctgcgcagtacccagatacgtctgcgcaatatccagacacatctgcgcagtatccagacacgtccgcgcaatatcctgtggcacagacgagtgcaccggcagagactggcgttgctttctatctagaggtatgaacaccgggtgttataccacttgttggagcgacagctcatccagggtgtggcgaatattgacttgagattctgcaacctctgggatcatgtgctggacatccattgggtcttcaagctcagtgagccctgaataccacctgcaggacgataaagcttctgatcagatggctgcagaggacaagcctccagctaagaagccccagaagttggtcctgcaggacgcaggtgtgttagagcgtgtgtgtgctgattggtggatcgaggcttgaggcaccttcctctgtgtggtggggcacgcagcctaaatgatgtcgaccaccggaacggtccctcatgcagtgatgcagccctctagtgccacgacaactcaccgcagcatccccgctcccatgcctgcttcgttgcgcagatgatgggtacgcagagtgctaccccaactactttgatgctgctgggactgtggtggacagcgagggagaggacgagaaggccggggtgcgtccccggtgggggtggcctcggcgcatgtggcaccggcctcgcgcatgatgcaggatgtgctgacggttgggagcggatcgtgcgtgcctgtgtttggaattaggaagcgcagagccttctcctcctgtttaccccagcatcacgatcccatctgtgcaggaggtcatcctcagccggctagactttgactcacaggccgagtgggaggcttacagcgcaagtctcaagccccaggtagccggcaaaggcgccaacccccgcaaggcacaggtgagatgggagtccctgcatgcccgggcatggacacgagcgcatggggagctcgccagggtgcgctggttgcgctgtagggaccacccaccccttggacgagggaccttgccgacgggcagtgctgaccttccctnnnnnnnnnntgtgcctgtgtttgaaattaggaagcgcagagccttcgcctcctgttcaccccagcatcacgaccccatctgtgcaggaggtcatcctcagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgggcgtccctgcatgcccgggcatggacacgagtgcatggggagctcgccagggtgtgctggttgcgctgtagggacccacccaccccttggacgaggggccttgccgacgggcagtgctgaccttccctctcgatcgcacagcgggagcgcaacaaggaggccatcaaaaacaagaacaagatggaagcccagctgggtcagattcgcgatctgatggaaaagaagggacagagtcatgacaaagcttttgagaaggggggagaccgcgcttccaccaagccatcaactctggggggacctactgttcctcagaagaaacgccgcatttagtgccgtacccaggcagcttgtgacaggggtcgatttgatcactgggggagcagggtttcggtcgggttgcaagcgcgcccatgccttggaggcaacccgcgcacgagatcatgcgagcactgaggaggacgagctgccacctctccctgcacatcggggatgggaataaagagataatttattatacacttttcacagttggggcatagcgtcagcaggatcatgctcccgacgtcccagtcaaggagttgccggccccttgggtaatcatatgtcagcatgtaaattgatcgggtactatcgcttcgtgtcattcgnnnnnnnnnngcagtcaaggagttgctggccccttgggaaatcgtatgtcagcatgtaaagtgatcgggtactatcgcttcgtgtcattcgcatcatgttagcccgatcaggagcgccttctcaagcaggcacagaatccactggtgtgcaggctgagtcttgtaggtgggagcagtcttccacaacctcctgctctcgacacaaatcatgagagatctcgacatgcatgcaatcttgcaggctgcaaatttccatccatccnnnnnnnnnnatgcaggctgagtcctgtaggtgggaacagtcttccacagtctcctgctctcgacacaaaccatgagagatatcgacatgcatgcgatcttgcaggctgcaaatttccatccatcctcgagatcgtgttggaaacgggctctagcctgcgcgccgcgctagggacgggcaagggaggcttaggggttgactcctacttcattcaggtgtggccccctcccagggatggaaccccctgtgttggtgtgatgcttgctgaacagacagccagggaattctgtggagaacatagtgatttgggtgcaccgagccagtgacagtcatcgtgcagctccttcccttnnnnnnnnnnatactggccttcctgaacctgctttctgccctggatggtcaggctgcggtgtcggtccgctccgtgagcgaccatggcaggtgagcaaaggcgatgcacggccaagatcccgacatgtgaccggctgcttgtcatagtgttggggaggtgcccaggtggactgtcacggcgcttgctgcttggatatcccccctcaccaatccctcccctccgnnnnnnnnnnaatgcacggtcaagatcccgacatgtgcccggctgcttgtcatagtctttgggaggtgcccaggtggactgtcacgacacttgctgcttgcatatcccccctcaccaatccctcccctccgccaccccgccccagcacgctgctgtacgagtcctggaaagcgggcacggcgcagggcgccgccgcggcggttcacgccgcgctcctggccctggccgagcgggaggagggcgcggatgcagccaggcccacgcggcgtgtgctgcagctgtcggccgccctctcccacgtcctgtgccacgtcaaccgcttgcggcgcggcggcgacacgcccgcccgcgtgctctgcgtcctggcctcctccgagccatccacgcagtacattcccctgatgaacgccgtctttgcggcccaggtgaggcggggatggcggggctgcctgtggagaggacccctggcgcggcagccgggaggggcagggcacgggaaccgcgtgcttcttctctgctcaggcgtacgagtggcgtcgccgagagctgcaccgattccccaatccttcccttatccccacccttccctccctctgaccagcgggacggcgtcgtcatggactgctgcaagctggggagcggggaggccaggtttgcgcagcacgcctcccagctgacggggggcgtgtacctgaagcccagcgagcctcaggcactcctgcagaacctcctggtgcgcgtcgtggaggaggggtaccaggtgtacttgttgcgacgtgacctcccagcatgccgcctcccagcgccctgccaggcatacttgctcttcagaccccgctcaggcaaggccccatgcctctgcagatggtctttgcggcggggccgggcgcccgagcccagctcattctgcccaccagcgctggcgtggacgggggcgccacctgcatgtgccaccgcaggcccctgacgatgggacacgtgtgcagcgtctgcctgagcgtcttctgcgagcccctgcccgtctgtctgacctgcggctccgagtttgtgacaggctgatggagggtagagaacatcaggcaatggggggtgtcaagagcaagcgcagacaacctgtcagggcagaagaaagcccgggtgacaggaacaccagtcttggatagggtcctcccaacataaatcaaggagtgccaatggaggatacgaaaacgacagctctataaaggtgcttgaataatggtggatcaacagaaggagggcgtcccttctttaaggaggtaaggaaacattctgcagaaacattgtgccggctagtattgcaaagagacggcctgcgtgggctagagtggacgcctcgcgtcccctgccgcatccatccgtcgccccatttggggctcccctcacacggggtgcttcagcttgggcgaggcgggcgaggccatgctgagcccggcgtggaaccacgacaaggccagcgagctcagcaggtggcccaccacgagcgtcgtgggcgcgatggcagcgcccatggagaacaagcggcccgtgaaggacttgaggctgcggcgggagggcgatggcacaggcaggctcaggagcaggaggggagaggctttgggaagggcatgccgcggccctcgggcattgtgagttaccatgggagctaggaccccagcagggagcgatcatgcaagacccacaccgatgcccgggccaatcacccaccccagcacgtcgctccaccagggcaggatgcccagcaggcccagcgtgacgccaaatgccagcgccgtctgctgccacaggttccctgcgctggcggccaggaagagccgcccgtccctacgggtacccgaggtatggagggcttcagtggctgtgtccagaactatgcaggttaagtctgctgatgtactgctagtttccacagagacaatggctttagcaacctgacagcagacagtctacatgcactgatcccaaggcctacccttcaactgacgaaatgttgttgcccgcctggcgcagcccgaagccccactggtagactgcccagagactggcaccaaacagcgcagcaaaggacaccgcaatccactcataggccagcatccaaccccacatggggtccacctgtgcgtacggggcagcagggggatgcaggaccttggagacgaagtgggatcatggaaacctcctttgctctggtggagccaatgaatgacaacctcctctaccgctccgaggagggggcggcgggggggggcatatctaaagactcctcctctacacacatcaggaagcgaacggccacagcaccactcccaagcccacaaccctccgcccacctgggttgggaccaagcagacggcaaagccgacggccaggcacagagaagtcagtgcggccagcaggatgacccaaggcatgcacgccaccctttccagtgccagggctccagacatgccgggcgcgccacgtctaaaagagaggttccggaggcagggactcaggctgggggtccggcgcatgaagagggcgaacagcaaccaagggccggcggccagtgtgctgaccagcaggcggctgggccctgtgtctgggccgggcaggcgccgccgcagcgcctgccaccgctccatgttccctgatatgatccagctggaccaccaattccagggcttgaagctggagagcgtgaagtgaaggacaaacagctcatcctgatgtggtgttgggaggaatgaaaggaggggtgtgaggggtgccctgagtgttcgaggtggcttgggatgtggatgttgcacatctacagccccaggtatgtaaggcagtctcaggcgcagtctcgcacacgggggcagtgactcgctgacccatctgcgcttggaaacacatcctccattcaggtccctggctcggtgttgctgaggagatacccacccagcccccacgatgccctgcgagtccacctcgggcaccatccatcggttgctgttgagcacatacaggcccaggtctgcattgtactctgtgggaagcctgcccatcctcacacgggccgccgcgcctccggtggcattgccgggaggcggccgggcccagctctcgctcagcagccggcccctgccagggtcaaacaggggggaggctgcaaatccagagaagtaggcgttcaggaagccctggtcgccgccggtgtagctgggggtctgctcgatgcgcgacatcatgtcgctgaatagctgggcctggggctgcaggaccatgaccccggagttcagccgctccgagtgccgcatgacaccacagagaccgtcgcagaggaagagggcatccaggttacgcagggcaatggtgtcagcatccaggtacacaactgtcggtgggggggcccgaaggaatggcattggtgaggtgcgctgttggccagtgtactcatgtgaatattccctccatcatccgtgtgggagactgtgcatgctgcaatgtgcacgattggatcagccgtgctccttgaaggcgtgcaagccttccatggcccatgacaacgcatgctcatccctcaggccggtacctcgttcatactgagtgagattgaataccagcagcttggtgtaaactgcccagaaacggggtggaaacgacccagaggccgttcctgtccacagtccaggattctgaactgcatcgacctgcacagaatggacaggtctctgatataaggcgggccagcaccatgacaatagcaccacatctagttttcccacacgaacgaggaaccctcgcatggacgcgacacgcaaccagtccccgacagatattgattcgctctccgacgccgcgcacctcgtgtacgatccagccatccttcctcaacacgttcttcgagaggtctgagacgtgagatccaaccacgacggccaccaaatccctgcggccgagaaagtggaatagttgcggacgcccctgcgggttaatgaacggcatgagtttgataatgggaaggcacaccgtcctgtcccaagtacctggtggtttgagactcccgcagtgactggccgagcacacgcattcccagtaggaagtcatccccatacatgagggagacgtaagcctgcttatgtttcgtcccggcctccggcttcccatcaccaaggacttgaactgcatggactgtgcaaaagaccatcaaggcagctaataggttgagccacctcataatggaccctcgagctttctatgaccagggcgcagaggatgacctcccggaagactgcagattgtcacggtcgggtgggtgacctcgggacaccaataatcccccacgcgacgtcctgagcgggagccttcaccaggaagtcgaagtcagatctagtatggagtgggtctttgagcatcgtggggtcttgagatcctgtttgcgcaaaaattacgttgccgtgcnnnnnnnnnncctatgaccagggcgcagaggatggcctcccgggagattgcagactgtcacggtcgggtgggtgacctcgggacacctgtaatcccccacgcgacgtccagagcgggagtcttcaccaggaagtcgaagttagatctagtttggagtgggtctttgagcatcgtgggggcttgagaacctgtttgcgcaaaaattacgttgccgtgcgcatgaagacctcgcgccaccccgatcacgtaattttgatcatggcgcgatatgcgcgctgaactaaagccaagttgagcttccgtgatgggcgaattacaaggagatggtaatactgcattgcaatgtcccatcctaagggcctgtcaaataaatctggtggtctggcaggactgctctcacggctggaggacgggcacgacctgcacatctcgaagaaactggaatcggtgctgagcctgtgtcaggatgatggcacatccgtacacagccaccacttgggtggaaattccagggcagcggggccgtctcgtatcggggaacctcgatggtcggacccatgcttnnnnnnnnnnaggcacatccgtacacagccatcactcgggtggaaatctcagggcagcggggccgtctcgtaccggggaacctcgatggtcggacccatgctttccctcttgcatcgtcgatcatcatcactacggacagcaagtgcgaccttccgagagtcaaagtacgtctctgtgtgagaagaggcaggagaagaaatatgacaatgcgcgcatgcgcgcgcatgcgtgccgggaagtggctgtggccagccaccgctatcagacggacaccccctgatcacccccccgtgatggtacacagccttgtgcgacctgctggagcagagccggacctttgcgtcacccagtgccgaggatgacatggcagaggcatggggattgcaggactgcctggtctccctcaggtgacaagatcaatgcacaggggatgacacgcctggtgcactcttcgcaaactacgcagtgcctgggcccagtccgtcacaaccatgcccatttcactcccacagggggtcgctcttcagtccagtgcccagtgtggatacagtgacccgcttgcgtgccgggatgaaggccagggttgcacggggctggtcgatggaggccctggggagaggggtcaggctggcgagggagggacgagctcctgaagcgatcccacactacctcaaggtgagcgctatgctagccagattgacactgggttgtgagtccaactgcctgccttgcttgccgcgacctctttggcctcggtagggggtccgcataccaagtccgatagcctcacatcggctcatgcagcccaaggccgcagcggcaatgctggcctgtctcgacagctgcccaagtgctctgccttcccccccaggccctggagctggacccgacaaaccccgacgcgcacgtcgcgctgggcgcggcccatgccaacgcgggaagctggcaggaagccgccgacgccatggccgccgccctggccctggacccggaccacgccaacgccctggcctacgagcggcgcatcgcccagcgtgcgaaagaggagggcgtggcgctgacgactttgcggcgcgcagggcagccagggccctcgcgaccgggcccggagggagtgcgaccggtcggggagtcgcctcgggcagcctccccccctgcgccgannnnnnnnnnacgaccgggcccggaggggttgcggccggtcggggaggcgcctcgggcagcctccccccctgcgccgagcgatctgcaggacgacgatgccgtcgactggccccgctcgcccagccccgagcgcggggaagggctggacctgaggagggcgctgcgcatcgtgaagaagcatcgccgccagaaggggggcgcgcatcagtacgccgctggggggggggaggggaaggcatgcgcactccatgcccctggcgtaccttgtgctccacccgcagcgacacacggtgctcacagcgggttggtctcgaccatcacgcaggggccacaagaccaagcacaagcgcaggcacagtaagaggtgcgcattgcaggttgtcgatggctctcgatggcatgctcctccttgggccaaccagttgctgtttctgtgtgcgacgcctggctcgaccctggctcgtctcctccacatcccagcagccgcaagcacaagcaccgatctggcgattgatgaccgcgacacggctcgctcaagctccggnnnnnnnnnngcatcccagcagccgcaagcacaggcaccgatctggcgatcgctgaccgcgacacggctcgctcaagctccggnnnnnnnnnnagactcagcgcggaccctggcccacaggcgagctgcccacccaccgacgcagggccgctgcgcaatcgctcnnnnnnnnnncctcgagccgaccctgggactccccgggcagcacaccggtgtcctccgccaacctgtgagggggtgtgaaagaggggcaatggctgttgaaggaaaccagacttgggaagggcttagacttcatatcagagcacggtttgacatggcaatggtgcatgcagggcaagccgatgaggcccctcgttccgcacagcccttgctggagagggcagcagccacctcacagtgcatcccttgccctgatgactcagcgcagaccctggcccacagccgagctgcccactcaccgacgcagggccgctgcgcaatcgctcaagctctgcaacccagagggtgctgcatctgcgccgtacactccggactgaaggtcccggatcttggatcgcagcgcctggcaaatgggtgggtatcatacagggggttgctggctgaaatgcaacgcttgattctggcagcaacatcactggcccctcccagccagaatatccaacaatcggtcagcgcagtcccgatatcttgtagcttctcaacctcattcccgctcacacgtgccaccgacctccaagttctggggctggctcttggcaggcagcgcaggcagtcggctgcccgcatacagctccaggaggctggagaggcgcagccctgggccctcccccaccgcccccgccgggctgctcgactccaggccgaccccgagcgtgaggagcagggcggccagcagcgccagtccaaccctgggtggcggcagccaggactcgctcgtgtccgtctggaggatgaggaggatggacagtgggaccagcggcacggccgcctggcgcagcaccggtgcggccgccgcggcggcgctcgcgtagcattgccacgccccatacacgtctacgatggggctgaatatcgtgctggtcgccagccgccagaccggatcctcggcgggctgttctgtgggtggggcggcgccgcccgccagctgtgggaagagggttggagaggtgacagtggagctgggcttggtgtccaggcagaggggcagcgtgcnnnnnnnnnncgagggttggagaggtgacggtggcgctgagcttggtgtccaggcagaggggcagcgtgcgtagtgatgttatgcgactgcttctctgcattgaaagcaaataaaaaatctgagcagccagctctgtgatgtgtgcacggcaacaacccagcgtccaaacatcagcagcatcaggcagattctcaggggcgacccctgtcgcatactgcagcctgcaccttgtagtactcgtccagagcccggtggaagccgcgttggcccatctcctcaaaggtcagctgctcccctgcgccgaaggatctatcgcgcttcagcacggcgggcagtgatggcttgcctgcgggattggggggagcaaaatgaccaaggcggaagtcatggctgcagtacaaggatcgtagccacagataacnnnnnnnnnncgatgacttgcctgcgggatttaggggagcaaaatgaccaaggcagaagtcatgggtgcagtacaaggatcgtagccacagataacagggttcaacgcacccaagggtgtcctcatgagcggttatgagcttgggcgatgagcaggctggaggatgtcggcaatcgcaggatggttccgagatgtgtcccgcaggggtgtcccggcctggtgggtgcgagctccaaaacgagagggcttagttccctgattgatgcttgacacaatttgacaactaactaagactaatcatgcactcgatgtctggtnnnnnnnnnntcggcctggtgagtgcgctccaaaaccagagggcttagttccctgattgatacttggcacaatttgacatctagctaagactaatcatgcactcgatgtctggtttcatgtcgcataaaatacggggttgattccatttcttgatcgccacggagcgcctttccaattggggtttcgatgtcaccctaaatgaagtgccgtcaggtcgggcagcaggtttcgtcccattacatctccaaaagcgctgcttgaatgtatgcctgtgagacatgtagtttattagccaagccgttagtggacgtgcatcggtgtgtcgcgcatggcacagaccgtggaatccccctccggcgcctttggcagggaagggcgagagctttcgcctcatcgcgcaatgcccctgggggatcgctgttaccatcgctggttccattgtgggtgtggtgctcggaaacatcttcttgnnnnnnnnnngtgcccctgggggatcgctatcaccatcgctggttccatggtgggtgtggtgctcggaaacatcttcttgaaccccctacgcactggcataaaggacccagggaccgtgtcttgctcgtatcgagtgaattcaagctcccccacacctcagcagtcgggagccgcgcggccacatacatgcgacatcagcctgtcaacaagcagcatccatagactctgcagcatcctgttatgggtgtggtgcggatgtccagacccggaatcccgcggcggctggctttgtgccccctgatgtcctggccaccaaggcccgcttccaccagttggaccagctgctgtgcacaaggtaggtgttgtcggattacctggaactcaagctgattctctttcagtggattcctgcttttagtcatggccggaagggaggatgacgccccgccccccttgtgctgcctgccacgggaacaacaccatccccccactcaccaacacacatttgcacacattgtctccaggtgccaggggctcnnnnnnnnnnatctctttcagtggattcctgctttgggtcagggccagaagggaggatgacgccctgccccccttgtgctgcctgccacgggaacaacgccatcccccccccccaccaacacacattcgcacacattgtctccaggtgccaggggctcaatcacggtgcccccatcccaggggtggctgacctagcagtccaggcagccgaggacggctcacggctagtcaccccagaggagctgcggaacaagatcatgtgagtgtgcgagtgggcatgactccaacaggcggaggagtgaacgctgaggctagatctgcgaccatggtgggcatgctgtgcaggaagccttgcaatgcccgagccagtggccggcttccaaaccggtgagcggttatagcacttacggaccatctcctttacacgcccttctttcctctctctccgaaaggcacctgcgcaccgccaaggccnnnnnnnnnnaccggtgagcggttccagcaatcacggaccatctccttcacacgcccttctttcctctccttccgaaaggcacctgcgcaccgccaaggcctttgtcgtgctgctggtggacctggtggacgtgtctgggacgctgctgcccaggctgcgagacatggtgggcgccaacccggtcgtggtggtgggcaccaagctggacctgatgcccgccggggtcaaaccggaccagctggccacatggctgcaggccgcggtggagttcaagggcatccgccccgtggctgtgtacctggtgaggccgacgctgggcgcagggtggcggggcgctgggacaggccacacggtgcctggcggggctgggacatgcttgctgtgttggatgacgtcttctactctcaccgctgctcgttcaaacattcccgcaatgagagcaggcaccccctcatactcccgcccttgggcaccacgcagaccagcggcaggaccaatgcaggcgtggcagccgccgtcgccggcatccgcagcgaacggcagggcagggatgtatacctcatcggcgctgccaacgccggcaagtctgtcttccttcgagccatggtcaggtgcgcagggcgtgcgtttgttctcgaggccaggcggctgcgtgacgaggcccttgtgtgcgaacgcatcaatagtgttaggctcctttgcggggcgcacagcatcactcctcatacccactgggcttgccagctgcagtgtggaccggccactgcatgcctgtggatcgccgctgcgccccctggctcacgattaagcatgtcctcccccccacgcacagggagatggcggacatggggagcaggtcgtacgaccctgccgccataggggctggccggcggctgcccaccgcctccggcatccccggcaccaccctgggcctcatccgcctacccgtcttctcctcgggcggttgcctggtcgacacccccggcgtccacctgcaccaccggctgccacacgcgctcaggccggagcaccacgccgccctggcgccccgcggccggctaagggggcgtggggtggcagtgccacctggcggcgcggtgctgtggtggggtggctgcgtccgcctgcatgtggcgccccaccgcggccagcacgtgtccctcaccttcttcggccccaagtccctgcacgtggccgaggcaggcggcggcgaggaggccgctggaggtctggctcgcggcgcccctggtgccggtggtgtggacgcctgcggcgatcgacccccgcccccgcccgccggcggggcctggttccaggggggcagcgcggcgctgctggagcggggcctgtcgcgcccccgccgcctgaccaagcccctggcgcccggccagcccagggccatcgccgacctggccgtctcgggcctgcccggctgggtgagcgtgcacggcagcggggcgggcgagctggcgctggaggtctgcgtcccggccggcgtggaggtgttctggaggccacccctgcccgtgcatgtattggcttgattggagtgaaggacttgacaggctgtgatttgttcgatcgaatgttcgacagatttggggaaaggggcatcccttggatcgagtctgagcgtcctgatgggtgccacaaggtatgggagtgaaaacagtggtgggaagaaacaatgccaggaacgtgtaggtgtcaaaaatatcaggtacagatggggggtacatgttgtaggctgataagccgccatcatcataggatctgaaaggccgaggcaacaatcgccagacatgcgcacccctggtcctctgaggagagaaagtagctggtgcgccggcgcgtccccatggtacaccaccactcgctatacgctgcgacctttcaggggcggccgccttcgtcccagggcgacggcgccaccatgagcatctggatctcgctcccctggctgctcctcccactaccgggcggcggcgacggctcggggacggcgccgctgggctgcgcgcgccagcgcagcactgcgtcctgcaccagcacctgggcaatgttgacagccagggggcacacgatcatgaccgccgccagctccagggaggggcggcccgcgaaggcggcgtccagcctggcagccagccgctgcagcagtggggcgcacgcaaagatctgcccagaggggtggaggaaaggcagtgtgagacacttggatgaatggctgcagaggggcatcaggggcagagtattgctgcagcaatgtgcaggtagagaagacaggagcaggccggatgcatggcataaggcactcgccccacaacccctctcgcagctcctcgaccacgcacgatggagccgcaggcggcgcgcgcgccgacgacgcacatgacccactccagtgcctgagcggcccagcgttcccagcgtggaggggtgcctggagtaggagcgaaagatgagtgatgtccaggtctctccagtgggccggtgtgacaccgacggaggtctcacgacattcagtgcctacaaacatagccgctgcatccgacaacctctcggcactcaccatagtcgccacagggcaccaggaccttgagggccccgagaagggtcgttttggtgtccacagcgccctgccctgcctccccggaggccactcgcatgatgagcatgtgcagtcccagggacaaggccatgcccagggttgtgtcggcaagaaacgcaaagaagtaccaggagcactcggaggaagcatggccgttgggggtgtgcgcgatgaggatcgctgcggcaacacctgtcggggttggaggggcggcttcagtcgcgctgaccccagccagtggcccagcatcccgcaggcactggaaactccaccctgtcgacccctgacattgcatcaaggcatacctgatgcatgagcagctagcatgcccagtccctgctttccgacatccaggctccagacagagagtggtcgctgaggcttttcatacgacctgtgcggggggtggcttgcatgtcacgtggagatggcaaggggctcacagaggcagggaagagtactccaaaccacccacatggtacgcagcctcgtgcaccaccttttgaggagcagggaccccaccgccaacagggcgaggaggccttgagcggcgagcgccacgggcccggtcaacaagtgacactcatgctgcggcccgagaggtggcatgctcctctctttttgcagactcgtctatttctacaaatgttgataacgttgccgcagctcatctggtagctgccgagggccaagtgcagacaggctgggggtgcattccgacactgtaaaggagccggagcccctcgagtcgatattgctcacatcaagtggtggatgcatcagttgaaaacttgcttcaggagcctcagtattcaatcagcaatttcattgtttcacatcgcgacgtgcctcgaaaggggttcctacgcggtcagagccatcgccaagcccgagtcaaaaggaagggcatgctacgctttctcttcctgtttccagagccggccttggcaaggacctcggcgtatttgtcatctatccctacttgagccctgggttgttgcctctccatctcttttacctacctccgctcttgttgaacggtgttcctctgacacctgagtagctccccagtactgcgtgcacacccttgcgctgccccgcctccggctcatccgggccgttatgtttgatttctttgagattcttaccgcttcatcgtcagagttactgtccctcttcgcacccttttgtctggtcgcgccgcagcaagcatccgcgggcggagcccattcagtgcgcgcgtcctcctcggacccggtcctcagacgaccgaaattaccttctgacacaaatcgcatccttacggtagatatactctgtcgaatcctctgacccttttccagtccagccacagacatcgcccggttctccccaccgctctgcatctcctcataccacaccgtcccccttcggattggccgactgcacttggcacttattacgagggtctgccaccccacatccacgggcggatccttgtcacttctcactaccaaggtgcctgggtctctgttgcccactgcattcgcgcccacatccaccatcgatgaacatcgtcagcactgctggcaacccccgccccatccttcatccatcatccctcactgcggaggaggatgtgcacaagatggccttcagaatgtatctcgggcacctcgaatggttggtcatgccttttggtcatttaatgcccccgccaccttccaagtccttataaacatcctattcagtgcattgctgaacaggtttgctgtagtgcacctcaacggcgtcttggcacacagccaaactcttgacgaccatcatcttcacctccgccatgtccttcagacctttgactccacccatctccatgccgagcccgccatatgaaagttcacccgcgctcgtctcaagttccatgagaatgtcctcgactcgcgcggcatcttcaccggcccctccaaagtcaaggacgcaatcaaggaactcttagcgggtgcggtaaaaatcgcacttggatggctgcacgtggaggtgggggacggcaagaatccctagtaacctgtcgtaggtggcggtgattgtcctaaaaattgggctgaataccaggacgtcgtcgaggtccacggcaacaaatttgctttgcaacgcgctgaatagggtgttcataaggttttgaatcgtgtcagggtcgtttgttagcttaaacggcaaggccacccactcgtagggaccgttataggtctcgaaggccgtctcgtgctcgttcgtggtcgactcccgccgaaacaccccccccccccccccccnnnnnnnnnnnnnnnnnnnnnnnnnnnnnnnnnnnnnnnnnnnnnnnnatcacctggccctagttcaccaattccaccgatactcgcgacttcttcggactcactgatttattccggtgcttgaaatcccactctgacctcatgttcgcccccccttaccgagctgtcggcgaaagtacctcgctctcccggaaccctgccggcgccgccgacttagagcttgacgatacgcgccttctccttggctcctgtggtggataggcctgtatccagccttgttcaataggggaaagtgtcgcctcgaagctggtaccattgcaactgtgctcctaatccagcgcactttcctttgggaggcacgaccaaaggcattgctgctggcagcctcagcctcatccaccccctccgttccgagtttctcttacctgatcccggaccatgcctctacaagtcgcgcaacaatcacggtcaggcatgtctccgatgccacagcaatgatatagcacccatcggacactgcagtactgctggggctcagccttccaggcgaggcactcttcagcatggtatctctgcgctttggtcctatccaccaatgttcgaaactggcaagcccactgccctgtgctgattgacaatacagacgtgcaggccgggtgccgtactgtgcttgcaagcatgctcaacaaggggaagaaaatacacactctgggctcacgcgatcaacagaggcgaggggttcctcgcgcaatcagcccacgtccggcgtgggccgtcagaagaggtcgggggcgggtccccccgcccccacgccacccagcagcactcccgcgctctccggcagcagcacggtcagcgcgaggagggtgatgccgagggccagggcctgccgcgtcccgctcacccccgacacctcgtcctggatccagccctccgactttcgctggcacaccaggacgtagaggccaaaggggagggccaggggccctcccagggcgccaaagcccagcaaagcatacaccaccaggctggagaaggcgagcgcgcccttgccaaaagccgcctgggtgatggtgatgggggaacgtgaacaatggcgtgcgagactcgtggcgtgcgcgacgtttggcccagctgctgccttgagctcagcgaggcagcaggcttgtccctcgccggccctccgacaagaggagcaaagtttgctgccgagctccggcagcaacatgccagtcaacagcccccaagagctcaccaaggtggtccggccgccgtccaggcagcccacaggcagggcgttcagtgcggtgtttacaatgcccgcccagccggcgacgaagagcggggagacgtacagcgtgggctgcgcgagggcctcctgggtcaatcccaggttgcccagggtggacagcaggaggctgccgtggaagagcgcagcgggcaccgggatcaatccaggctgcatggagggggggg

SEQ ID NO: 42400 - DNA, 61 bp, Chlorella protothecoides
tgcgcatacccctaccagtggatagtcagggggagcgccttgtcttgagcattgaggaggc

SEQ ID NO: 42401 - DNA, 74 bp, Chlorella protothecoides
attgagatcacgcgctatactttgacgatgaacagcccgcattgggcttcacgttgcgacttggagcccgcgcc

SEQ ID NO: 42402 - DNA, 72 bp, Chlorella protothecoides
gcagcgcgacccgcaggaggtgggcgggcggggggggggttagaatggtgatgacgagagctgctgaaggaa

SEQ ID NO: 42403 - DNA, 124 bp, Chlorella protothecoides
tgcggaacatcatggagtgttaccctcggtgaggcatgtgccgctgtgtgtgctggggttataatccactttcccccccgcgcaataatccgatcaagctggggcttggggtgcctggccctct

SEQ ID NO: 42404 - DNA, 61 bp, Chlorella protothecoides
cacatacttgctttacagccggtgtcctacccaccctctccccattctcggcaacgctgcc

SEQ ID NO: 42405 - DNA, 100 bp, Chlorella protothecoides
gatccttgccgtggccagcagcggctccaggctccaccgggaacagaccgtggggtagccgccccagagtaccctgggatctcctcagcaaactcacccc

SEQ ID NO: 42406 - DNA, 14276 bp, Chlorella protothecoides
  modified_base (198)..(293): a, c, t, g, unknown or other
  modified_base (640)..(649): a, c, t, g, unknown or other
  modified_base (1278)..(1287): a, c, t, g, unknown or other
  modified_base (2077)..(2086): a, c, t, g, unknown or other
  modified_base (2987)..(3127): a, c, t, g, unknown or other
  modified_base (3228)..(3237): a, c, t, g, unknown or other
  modified_base (3983)..(3992): a, c, t, g, unknown or other
  modified_base (4778)..(4917): a, c, t, g, unknown or other
  modified_base (4994)..(5003): a, c, t, g, unknown or other
  modified_base (5080)..(5089): a, c, t, g, unknown or other
  modified_base (5304)..(5324): a, c, t, g, unknown or other
  modified_base (6276)..(6285): a, c, t, g, unknown or other
  modified_base (6727)..(6736): a, c, t, g, unknown or other
  modified_base (8934)..(8943): a, c, t, g, unknown or other
  modified_base (9042)..(9051): a, c, t, g, unknown or other
  modified_base (9557)..(9566): a, c, t, g, unknown or other
  modified_base (9764)..(9773): a, c, t, g, unknown or other
  modified_base (10657)..(10666): a, c, t, g, unknown or other
  modified_base (12090)..(12156): a, c, t, g, unknown or other
  modified_base (12431)..(12440): a, c, t, g, unknown or other
  modified_base (12541)..(12687): a, c, t, g, unknown or other
  modified_base (12752)..(12761): a, c, t, g, unknown or other
  modified_base (12862)..(13111): a, c, t, g, unknown or other
  modified_base (13184)..(13193): a, c, t, g, unknown or other
  modified_base (13689)..(13698): a, c, t, g, unknown or other
  modified_base (13763)..(13772): a, c, t, g, unknown or other
  modified_base (14159)..(14168): a, c, t, g, unknown or other
cggcgcgccgagaggcggtggaggggcgcgtgcgcgtgctgtcctcctgggcgcagcacgaggccgcgctgcggcaccgcctctcggcgcgccgcctcttccgcgcggcgctggcgggggccatgcgccatccgggcgggcccatcgccgcgggcgcgccgcgcttcctcctcacctgggccacgcaggagtggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggttgtgccgcgaggcgctgaccatcgaggcggacaacaagtacctgttgaccctgctgggcagcatcctggtgggtcgaggttgggaggggagggggggggttgagatggaggaatgcttcttgaggaagaggggcgagtgcgttcagcaggcccagggctgaccgtccaggccagggtttgtgtttggacgatgcagaccattgctggcgcttgccggtgcaaggggcagctgccgtccgagcatgcaccgacttggggcccagggcctcggcgtgcggctctgctgtcctggccgtctgtgtccgccggaagcaacccccccccccccccccccccaaacccnnnnnnnnnngcagcaggcccaggggtgaccgtccaggccagggtgagtgtttggacgatgcagaccattgctggcgcttgccggtgcaaggggcagctgccgtccgagcatgctccgacttggggcccagggcctcggcgtggggctctgctgtcctggctgtctgtgtccgccggaagcaacaccacctcccctcctcacacccctcacgccgcgcgcgcaggtgacggcgcggaagttcgaggaggcacggcgcgtgttccacaccgcactggaggccacgcagtggacccacgtgcccacgctcctgggcctggcccggctggaaagcggggcgctgaagatggacctggcccgggacctgttcaagcgcgccctggacctgcagccggactcggtgcccctgctccaggtgagaggggctgctgaggggcgaagggttgactgaggaggagaagttgatgacgaagagtaagcaggagatgactgaaaggagggaaggaagagatcgaggcacgcacccaggcgtcgtccagtgacggcatgcagcgtcccgcggcggcgggctcaagcccctgagccttgtgctcaggacccccgccgcgcctaccagcctggagactccacagggtgtcacnnnnnnnnnntgggctcaagcccttgagccttgtgctcaggactcccgccgcgcttaccagcctggagactccacagggtgtcacccacccactcacccaccccgctccatccacccctctcctgattcccaaggcctgggcggtggcggagtcgcggtacgggtcggtggccgaggcgcgggccctgttccagcagtgcatgggcatcgagccgcagagtgtggaggcgctgcacgcctgggccaagatggaggcgggggagggcgacctgaacgccgcgcggcggctgtacgcgcagggcctggccgccgcccccaccaactgcaacgtgctggccgacctggcgctgctggagatcaaggagggggacctggcggccgcgcagaacctgctggacactgccatgcaggcagggcctcggcatccccgcacgctggcggtgtgcgcgcgcctgcgcgccgcgcagggcagccggcgggaggccgccgcgctgagcatgcaggcgcagcagctggggcgcgcccggcgcggccagctcaacgccatccgccaccgcaactggcccgatgcgggcagggggaggggcggcgagcgggaggaggggtgatggggtcccgtggtcgaggaactcttcggtggccttgtgctcaatggctgccccaaagaaagcttggtccgtgcctgctgcccacctcccttcataccttggctgcacaccccctcctaccacttgtcgatgcactgtcagagataccagggcgaatgcgatcacagtgcatcgacagagggaaaggagtgnnnnnnnnnntccacctcccctcgtaccttggctgcacaccctctcccaccactcgtcgatgcactgtcagagatactagggcgaatgcgttcacagtgcatcgacagagggaaaggagtgctctgccagggagacacgttccacccaataacatgaaacccctggggcccggcagcgagcaccacacttcacgaggcacgcctgctgctccgggagggcgtccccgagccgggcccgctgccacgcgccgcgccccgcccaccgcgtgccttggggggaggcgtgatggtgccgcggtcggcgtccaagatgtacccctccgccagcagcttgcagtaggtggccttgcccacgccaatcaggttcccagtggcctcgttcagcaccttgcccgaggggatgagggggctggacaccgcgctgggcgcggccccgccggcggcagcgccggaggcgaggcggctcgtcgccgtcgcgctcctggcctgcgaccgggccgggtgggtgctggactccgcggggcccccgccggcggcctggctggaggaggcctccgcgtcgtgctcagcggcaggtggggcctgaggagccccgctcccagttgacgggggaggccgggcctgggagccggggggcgctgcggcggcggccaggtggctcaggctgcgggggtggtgctcgtgatgtgccgccgccgcctgtgaactctgccgagcctccgggctcgctgcacccccaggatccccctcaccacgcacatgccgcccgcttgcggtcagggacgcgcgacgcgccgccgggtacttgaccagccgcggtacggcccctgcgccgatgcgctgcgcgtcgcgcagccaggccagcggcgcgcggctcagcaggcgggcggcgatcaggcctgccgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgggggggaggggggtcctcaagagggacagggtggtgcatgcgagcagtggatgatgacgaagagagtggccgctgaatacgaggtccacgagcatcgnnnnnnnnnngcggcagcgccttccggaagactggcgctggccgccaccgcgcccaggcccgccacctgcagcgccaccctcaagatcgtgttgacctgacgaggcggggcggggggggtgtcctcaagagggaaagggtggtgcatgcgagctgtggatgatgacgaagagaggggccgctgaatacgaggtccacgagcatcgcccacccttcaccagatcgcaccttgacggaggaggtgtcgttgaaccagtaggtgacgacgaggccggcgacggcggagagggccaggtaggccagcaccagcgggttggtggccagcgagcgcagggagggcacccaggtgcccaggaggtaccgcatggcgcccaggaaggtactgcccagcagggtcgccgccgcgaacagtcgcttcttgtgcgggaaggccctgggcggtggcggagaatggcatgggtgcaggggttgggtggggtcgcttcttccacggcctaggagaggcgatcacgtcgcgagatgcagcgcagctgcgcagcgctcaggcgcacagcgtcatcgccgaggcccctgatcccgggcgcacatccctcagacctgtacagcacgaagaggaggatgagggcggacagggccacgaagccgaggctgcccgtggtcaggcggaagggcgtggacagtgccaggctgggcgcgtgccagaaaagcagtgcgcccagcgccgcagcggccaggcggaagccggacaccgcgtcgnnnnnnnnnnaccagaacagcagcgcgcccagcgccgcggcggccaggcggaagccggacaccgcgtcggtgcggcgcgcggtgcagcgcgccacgccgccggcggcgcggggggccacgcccacggcggcgttgccaaagggggagacgggggccacacaggtggagcggtcctggttgagggcgtgcgcccagccgcaccaggcgccggagcgcgcagcgtgcgcgtcgtgcaggtcgtgcctgctcctctccacgtacacggtgaagtcctggcgacggagcggcagagtgtggcgagaggggtgggatggggggaggtataaccctgagtggatcctgtaacatcagcgacgatctgatcaaccatgctggccccaccctgtaccagtggccccgactgctcgtccacaccaacaccagaaacttcacaccttcacaccgtcacatctgacaatgatatgggaagaggtgaagaggtggcggggcgcagtccaccgggaggcgccctcgaactctgccaccagtaggttagctccgtctgctaccagcgaagatggttgtgctatacaggtagccacgtgtccacagatcacagttgaaataacagtaaaaaggcatgttctcagtcgcatgggcgtgccgatgccttggaattacgacctgcggcaacgacacggtcgaggttttgtgtgctcggcaggaatggcggatggacgaagtgggggagtatacttatctaggcgcccctcacttcaatcagagattatcacgcgtacgatgcatgttctggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattgaaaaaaaccgaaacactggacctggacatacatggtctccgagctccgtatcgattcccaggcgtagattnnnnnnnnnnagattgaaaaagaccgaaacactggaccaggacatacatggtctctgagctccgtatcgattcccaggcgtagattnnnnnnnnnncgtgctcggcaggaatggcggatggacggagtgggggagtataattatgtaggcgcccctcacttcaatcagatattatcacgcgtacgatgcatgttctggatcgcaacaaaaggctgcttggcctcgatgggagcccatgccaggcaccccttttcggaacgagagcgccaagaatctcccagcgcgcgttcgggtgtcgtcgtcacgactcnnnnnnnnnnnnnnnnnnnnngaaatgactgctgtgcgttcgatgcccattcatacctccttcttgggcgcacggccctgcacacggtcctcgctcgtcaggttccgcccggtctggtctcgagcgcggcgagggccaacgggcagagtcttttgcgcatcccccgaacgctttgatctggcatcttttcatgaagctgtggtcggagagtgagtcctagactgcgctttgcttgctgttcgtcgtcgagtgggcctggccctctgtcacggagccctcccccattctcacccgaaaagtccactcgcgcgcgctgcacgcagggtgctcgcgaccgacgagacagggggagtggtcatcctcaggatcaaggacgaacgaaagagcatcttgaaggtcttcatcggtgcgtcgcatgtgcaggggagggtggtcgtggcctgtgccagcagttcgagtgcaggtgtctgtgggcgccaggctaacctggtcgctctctgtggtgtcacctggcggcaggagacatctccccttcctttgcttccctacgcgcaggcagggcagaggctgattccatgcgacatgcgcggggcgagctgcagctggtacgttgtggccggtgcctgggtttcataatggacagccatgctcagcggaagtgccgcggcccgagttctgccctctgtgcgctcacagcctatcctctccacgttttgcgtagcctcgaccaaacacgcatgatgccatggcagaactcatccgagtgctgaagtgtcgggtatgtgtgtccgaggcctattgtggtgcggcggggtgggtgttgctcgccatgccagtccccccacaattggcctcttgttcacagcagcatcagcgaccaaggcagcgtaggtacctggcgttcaaagcagtatattcctcccagcattcacccgttgcccgtattgctcgtgcctcaaggtgaccaaggtcnnnnnnnnnncgcatcagcgaccaaggcagcgtaggcacctggcgttcaaagcagtatattcatcccagcattcacccgttgcccatattgctcgtgcctcaaggtgaccaaggtctgcatcacggagatccgcggcatgacatactacgcgcgcctgtacatgataccgtcgggcaacgcggcaaccgaaaagtccaagctgcaggagatcgtgatggacatgcggccctcaggtgctgagcggatggttttggctctggcccccgaggatcggcatgcccggaggggacttcctgcagtatactttgcaccctggatgtcactgtagagcagaaaggcttcatgccatggccctgaccgtgagtccatacttggtcattggaccccccccggcccacacaaacacacgattctcttgctttcttcctccgacagatgccgtgagcgtggnnnnnnnnnnaagaggctccatgccatggccctgactgtgcgtccatacttggtcattggacccccccccccgcccacacaaacacacgatttccttgccttcttcctccgacagatgccgtgagcgtggccatccgggtgggcgcgccgctttacgtggacaaggacgtggccaagcagatggggcgccccgcttccggccccgagcccctgcccagcaacgagtcccacgcccagattgtgaggagctgccgcgaggaggccgccaagttcgtggaccccaccaccctgtacagcctgcagctggcgctggcggttgccgaggagcgctttgctgacgccgccaagtgcgcttggactggttttctaatggaatgcggggctgggggccgcgcgggggggccggtccggtgtgaggaggggccccgaggagcccggtttgaggacccacggttttcagccacacgatcgatgtgccagcaacgccgggcccagcacatctgcctggctctgtgctggcctgcattcccccctcccccctccccaaccaaaccctcccctccgttggcgctttccaggctgcagggcgtcatcgcggagggctatgcgcagcaccccggggcgcgcgccctggtggccatgcaggcagcgctgcaggacgggcggttcgaggaggctgccaggcaccgcgatgagctgcgccgggtgcggctgatcgagttccaggcctcggccgtgggggtggacccctgggagcagcgcaatcagcgccgcaccgagaccgacgcgctgtgaccccacccccccggccggccgggggactgtcgaggcctggtggaggctggcgaggcgagccttcttactgcagcccgccgatggaatacaccccttctgcgacgcaccagcctcttggtgaccgggttcacatgcatgtacccctgggtgggccgagctccctgaccaaattcacccccccctcgccagccacgcgcaccagccacctgtagtctttccatcatgtatcatcctgttttcatcagccaccctgtgacactgaacgaagctgtatgccccaccccaccggaaaatgctcgggggtgacctagatgtgcaaccctcactccctatggacccaccccacagcccgcttgcttgccctgcaaccctctggactgtaaatctgtagcctatctgtctgaatgttcagatgaggagcattggactcggtggcgtctcggcctgtgggctgctgtagtggggatagtttcaagctgctcaaataaagaaaccgtgccgctcacgcccccgacacacttgccgaaagcggaggctgacgtcagccagttttgcaatggcgaaagagttttctccaaggcgattaagccaaaggcacgatctaactccatatcttcagctgtgacaataattcgaacgccttcgccacagagtgcatccttgcgacaagtatcccaggcctgagcttccgaggtgtcggagaaacagaggtgggtacggtcgtggcgtcctcaccctcaccagccttggagtctgtggtggagcattggtgtctcgcgagttcctgactgtgtttcgtatatgtgattccagcgtgagacgacttctggccgcgagcggcctgtgtttcgggtcgccccctccggctcctgtgcgagcggaaggcccggcaccttttcagatccagcgctgcatcatccccgcattcaaaatatcctacccactctccaccatccagggtgtaagcacagcagtcatgcagcctcagctgatcggcggggtcaaggtgtccgcccccgtgcggcccgagtacagcaccattctcacccccgaggccctccagttcgtggcccacctctcccgccgcttctcgcctcgcgtaacggagctgctgcagcgtcgtgtggaggtccaggcccgcttcgatgccggtgccaagcccaaattcctggaggagacccggcacgtgagcaggggtatcttctggatgctaggcgggcatgggaagcaggctgagggcagtgcttgctccagtcctcgtgcactcaacagcacagtgtggagcttgccctggggccggcagggctccctcgctcgccggcatagaccctgcttgcctgccttaccccctctcccctcccctgatgcgacctgccctcaccctcctttccctacccatctccgccatcacannnnnnnnnngctcaacagcacggtgtggaggttgccctggggccggcagcgctccctcgctcgccggcatcgaccccgcttgcctgccttaccccctctcccctcccnnnnnnnnnncccccctccccgccgacctcctggaccggcgcgtggagatcacgggccccaccgaccgcaagatggtgatcaacgccctgaactccggcgccagcgtgtacatgcccgactttgaggactccaacagccccacctgggacaacatgatcagcgggcaggtgaacctgcgtgacgccgttcgccgcaccatctccatggccgccgccggcaagacctaccgcctcaagcccgaggtggccaccatgatcgtccgcccccgcggctggcacctgtgggagaagcacgtgagcgtggacggcacacccgtccccggcggcgtgttcgactttgcgctcttcttcttccacaacgcgcgcgcgctgatcgagcgcgggtccgggccctacttctacctgcccaagatgcagagccacctggaggcgcggctgtggaacgaggtgttcaccgaggcgcagctgtactgcggcgtaccgcacggcaccatcaaggccacctgcctgatcgannnnnnnnnnctttgagatggatgagatcttgtacgagctccgcgatcactccgcgggtgaggtggctgttgggtgggggggggttggttgtgtgctgttctggtgtggtgtgggtataccgaggtcacccctgcccaaccaagcatgtgctctgctgctcggagccgccttgtcgccgacccctggcatcacctcagacgaccctcnnnnnnnnnntgccccacctgggacaatatggtgcgcggtcaggtgaacctgcgcgacgccgtgcgccgcaccatcacccacaccgacccccgctccggcaagcactatgcactcaaggaggaggtggcggtgctcaccgtgcgaccgcgcggctggcacctgtgggagcaccacgtcatggtggacggcgcccctgtccccggcgccctctttgatttcggcctctacttcttccacaacgcgcaccgcctgctggagaacgggtcgggcccctacttctacctgcccaagatggagcactacctggagtgccggctgtggaacgaggtcttcgtcaccgcgcaggcggcgctgggcatcccgcgcggcaccatcaaggccacctgcctgatcgagacgctgcccgccgcattccagatggacgagttcctgtacgagctccgcgagcactcggcaggtgggattaggtttgtattttctttctccccggggtgggatgttcgtaactccccaccttgtgcaagctggacagagcagagtcgctctggactcagatcctggccgagtgtcctctcaccccgtggactccaagccctcacctcaccccacccaccccctcctcctcccagggctgaactgcgggcggtgggactacatgttctccttcatcaagacgatgcgcaacgacccctcccgcgtcatgcccaaccgctccatgctgaccatggagatgcccttcatgcgggcctacaccctgctggtcatcaagacctgtcaccggcgcggcgcctttgccatcggcggcatgtcggcggccatccccatcaaggacgaccccgcgcgcaacgcggcggtcatggacaaggtccgcgccgacaagctgcgcgaggtgnnnnnnnnnnctgcgcaacgacgcgacccgcatcttccccgaccggggcgtggtgggcatggaccagcccttcctccgcgcctactcccagctggtgatcaagacctgccaccgccggcgcgtgcacgccatcggcggcatgtcggccttcatccccatcaaggccgacgccgcgcgcaacgcggcggtcatggaaaaggtccgcgccgacaagctgcgcgaggtgtgcgacgggcacgacggctcctgggtggcgcacccgggcctcatccccatcgcgcgtgaggtctttgacgcgcacatgccggggcccaaccagatccaccgccagcgggaggacgtggaggtgaccgcggcggagctgctggccgtcccggagggtccgcgcacgcgcgccgagatgcgtcagaatgtggcggtgaccatcggctaccttgcggcctggctgggcggcaacggctgcgtcccgttgcacaacctgatggaggacgccgccacggcggagatcagccgcgcccaggtctggcagtggctgcgtcatggcgtggcgctggacgacggcgcgcccctcaccgcaaccaccgtgaagctggtcatcctggaggagatggaggccctgcgccgcgatctgggcgacgccgccttctccgcgggggcctacctggacgccgccttcctcttcaagctcatggccctgtccagcgagctgccagacttcctcaccctgccggcctacgatgtgagcagatgggaagaaaggcgtggaggaggggaagtggttgggaggcgggaggcatgtctttgattgggtgtttgtgatgtgtataggagggacgccgtcgtacgccgcgcctgcaagttttgccagcgcctggggacccatctcttaccccttcctcctcacacaaccgcagaccctgctctcgtcagagttctccgccagcgtgtctggcggccccgcctcccgcatgtgatgatgcatgatgagatatctcaagaggttcagactccattggtcgcctgaacttaaaagtgcggtggcctgcgccgtgtacagcatgcacctcctcaccagaagcagccccctctctccgctctagcgcgtgtagtgaccccaatcaatttgccatgctggcgcatcccagcactggatcccaacgagcgggacctttggtccaccttgaacgcccacccccatgggaccaacgtgccgccatgtcagcgattggcgcgtccccagccccaagttttccctcttgcaggggcgctgcgtcccacaccctagaattccctttgattcatgcatagcgaactagacttcagacatcaaggtttggaagggttgacaaagtgatccaggagcctgctccagggttgttcccaacatgttcggaagggaggcatggcgtatgggcactgcagcttgagcaaaannnnnnnnnnnnnnnnnnnnnnnnnnnnnnnnnnnnnnnnnnnnnnnnnnnnnnnnnnnnnnnnnnncctcctgccctgctatcctgacatagtcattgctcgggtccgcctcccacgtctgcggcctcacccgctcctggcgccggcgatgagcaaaccactcgacgacctgggatgcagggaggagagggaaaagggaagattctcaaatgaatatcagccaagagcgtgggaggaggcggggctgccaatggtccttcctgggacactgcctgagcaagcaccactttgggaagctgctcgaggctctagcgagaaagacgctagtcatacaggtgtannnnnnnnnnccttgctcacaagcggcacgacaaatgcatactgacaacaatacaagggtgttctgggatattggacgtccagtgtctggtcatcctcggcctgggtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctgggatacagggaggagagggaaaaggggggattctcaaatgaatatcagccaagagcgtnnnnnnnnnntcttgctcagaagcggcattacaaatgcatacagacaacaatataagggtgttctgggatattggacgtacagtgtctggtcatcctcggcctgggtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccgtatctttaatgactgacgagcaatgttcacgacaccttctgactgctaagatcatcttcactccatnnnnnnnnnntttccgtatctttaatgtctgacaagcaatgttcacgacactttctgactgctaagatcatcttcactccataagaatgtcgcacctggtgacgcggcatcctgtggagcacccagaagctctggatggtgtcgtcgcttggccattgtgtagtagcgtacacgagctccagggtgtccagcagctgacgtccaggcttctctgacttgggggagaactgccgccagtttccctgcggtttcttgccggcagagtcctctgcagcagcaatgggggttgggcatgtactaagcttggaatgactaggacgtacacagaggtttgcgaggattggttttgccagagacagttgactacaggttccctcacccgtgagtggcatgagggtgatggccatgctcatactaccgcacattccatctccacccacttggtttcttatcatccctgtctcgtcccagcgctgccaccgacaggagtgagttgcgtctgcagnnnnnnnnnnaggccaacagctccctgcggcttgcctcggtactaggctcggcgaaactccagccacgaatggannnnnnnnnngcaccgaccagcgggagcggtctgtacgggcacgatggtagaggtaattgcgatggcattagggatgaagcaaggaagtggcttcactgagcgctcccaaatatctctctggccatagccagtccccgcccagctccacccacgggccaacagctccagcggcttgcctcggtaccaggctcggcgaaactccagccacgaatggagtaaattttagcatttgaatgcaacgcaacgtatccgtccgggtaatactcgagcagtttgcctacaaggtaagtcgattttctcagggtaaggagatgtgctctcgaaagtgttcacatatatataaaagtcaagtcaagaatatgggggcaacatatgcggcgcacgagtcgaagatannnnnnnnnngtaaaagtcgagtcaagtatatgggggcgctgaaatgcagcatggtgtactcctgggtccatgcagcgcgctgttcgcgcaacatatgcggcgcacgagtcgaagata

SEQ ID NO: 42407 - DNA, 70 bp, Chlorella protothecoides
gaaccggcgctcgccggccgcatcgtcgccaccggcccccgcgccgtgcacctcctcgtcctgccgcccg

SEQ ID NO: 42408 - DNA, 125 bp, Chlorella protothecoides
ccgcaaagccctctccaatccactcccccctcagcagacaggctactcctgtggtccccaaagcttacctcaagaccacaccagaaccctctcccttgtccagtacatttccatccccaccccga

SEQ ID NO: 42409 - DNA, 61 bp, Chlorella protothecoides
acctgccgctgcagcgcccgcacctgccgcagcgcaggtcgacctcctggactggggcgcg

SEQ ID NO: 42410 - DNA, 62 bp, Chlorella protothecoides
gttcacgcgcaagtggcaggtgtgtgtgtggcgtgtactgggggtgggaggcaagcatgagc

SEQ ID NO: 42411 - DNA, 61 bp, Chlorella protothecoides
tccggtgtggattgccaggcgtgtcccggggggccctccccgacactcccgcatctccgac

SEQ ID NO: 42412 - DNA, 61 bp, Chlorella protothecoides
caggagcagggggtcgaagcggtcggtgccaccatccgtgaacacgccgctggccccactc

SEQ ID NO: 42413 - DNA, 71 bp, Chlorella protothecoides
ggtgcctgccattgatatctggtgacacaccgcaaggatgataacgcaccgtgcacgatcaccacaccaaa

SEQ ID NO: 42414 - DNA, 108 bp, Chlorella protothecoides
cccagggccccccgccccggcctgctcttccccacccacaagcttccttgcaccccctcccccaccctgtcacacccatccccaccgcaggcatggtactttctgtac

SEQ ID NO: 42415 - DNA, 61 bp, Chlorella protothecoides
ccatgactgaacgcctcagtcagccgtgagggtgatactcttatcgtgcagttgggttaag

SEQ ID NO: 42416 - DNA, 77 bp, Chlorella protothecoides
gccgagccttgcatcgcctccaggcgcctcagcgctgcaagaggacccccccgaccaccccctctttgaccagcccc

SEQ ID NO: 42417 - DNA, 75 bp, Chlorella protothecoides
gagggggcggcgggggcgcgccccaccgccagccctcgcccctgagcgaacgcctggcggctgagggcctccatt

SEQ ID NO: 42418 - DNA, 71 bp, Chlorella protothecoides
gctgggggagtcccagggcgcggccggcgcggcccagggcgccaaggcctgatgcgccggaggcagggccc

SEQ ID NO: 42419 - DNA, 63 bp, Chlorella protothecoides
cccggcgattaaccggcgcaggattcgtagggtgggcagcacaaggcgcccggggcgccgaac

SEQ ID NO: 42420 - DNA, 71 bp, Chlorella protothecoides
cggcctgtgcgtggcggccgaggcggcgcgccggcgccgcgtcgcgcgcttctacctggacccctccctgg

SEQ ID NO: 42421 - DNA, 80 bp, Chlorella protothecoides
ttggagggaggagaggagcgagggcacgtcagtgcgcgacgaaatcacgactccatctggacgccacgatgccaaacgag

SEQ ID NO: 42422 - DNA, 78 bp, Chlorella protothecoides
gtccaccgacgcctgctggctgagcagggggtttgagtcatggatgatgcggcccagcaggtgcctgccgtgcacgat

SEQ ID NO: 42423 - DNA, 35850 bp, Chlorella protothecoides
  modified_base (971)..(980): a, c, t, g, unknown or other
  modified_base (1170)..(1179): a, c, t, g, unknown or other
  modified_base (1541)..(1550): a, c, t, g, unknown or other
  modified_base (3027)..(3036): a, c, t, g, unknown or other
  modified_base (3106)..(3306): a, c, t, g, unknown or other
  modified_base (3396)..(3405): a, c, t, g, unknown or other
  modified_base (3597)..(3606): a, c, t, g, unknown or other
  modified_base (3922)..(3931): a, c, t, g, unknown or other
  modified_base (4504)..(4513): a, c, t, g, unknown or other
  modified_base (5460)..(5469): a, c, t, g, unknown or other
  modified_base (5728)..(5737): a, c, t, g, unknown or other
  modified_base (6281)..(6290): a, c, t, g, unknown or other
  modified_base (7142)..(7151): a, c, t, g, unknown or other
  modified_base (8013)..(8022): a, c, t, g, unknown or other
  modified_base (8321)..(8330): a, c, t, g, unknown or other
  modified_base (10571)..(10580): a, c, t, g, unknown or other
  modified_base (10920)..(10929): a, c, t, g, unknown or other
  modified_base (12584)..(12593): a, c, t, g, unknown or other
  modified_base (12739)..(12748): a, c, t, g, unknown or other
  modified_base (12901)..(12910): a, c, t, g, unknown or other
  modified_base (13256)..(13265): a, c, t, g, unknown or other
  modified_base (14002)..(14011): a, c, t, g, unknown or other
  modified_base (14435)..(14444): a, c, t, g, unknown or other
  modified_base (14885)..(14894): a, c, t, g, unknown or other
  modified_base (15695)..(15704): a, c, t, g, unknown or other
  modified_base (15800)..(15809): a, c, t, g, unknown or other
  modified_base (15900)..(15909): a, c, t, g, unknown or other
  modified_base (15976)..(15985): a, c, t, g, unknown or other
  modified_base (16278)..(16291): a, c, t, g, unknown or other
  modified_base (17125)..(17134): a, c, t, g, unknown or other
  modified_base (17471)..(17480): a, c, t, g, unknown or other
  modified_base (17725)..(17734): a, c, t, g, unknown or other
  modified_base (18481)..(18490): a, c, t, g, unknown or other
  modified_base (18867)..(19065): a, c, t, g, unknown or other
  modified_base (19271)..(19280): a, c, t, g, unknown or other
  modified_base (20026)..(20035): a, c, t, g, unknown or other
  modified_base (20266)..(20275): a, c, t, g, unknown or other
  modified_base (20616)..(20625): a, c, t, g, unknown or other
  modified_base (21147)..(21156): a, c, t, g, unknown or other
  modified_base (22188)..(22197): a, c, t, g, unknown or other
  modified_base (22530)..(22539): a, c, t, g, unknown or other
  modified_base (23281)..(23290): a, c, t, g, unknown or other
  modified_base (23767)..(23776): a, c, t, g, unknown or other
  modified_base (24129)..(24138): a, c, t, g, unknown or other
  modified_base (25297)..(25306): a, c, t, g, unknown or other
  modified_base (25961)..(25970): a, c, t, g, unknown or other
  modified_base (26502)..(26511): a, c, t, g, unknown or other
  modified_base (26717)..(26726): a, c, t, g, unknown or other
  modified_base (27184)..(27193): a, c, t, g, unknown or other
  modified_base (27857)..(27866): a, c, t, g, unknown or other
  modified_base (28995)..(29059): a, c, t, g, unknown or other
  modified_base (29244)..(29253): a, c, t, g, unknown or other
  modified_base (29831)..(29840): a, c, t, g, unknown or other
  modified_base (32627)..(32636): a, c, t, g, unknown or other
  modified_base (32828)..(32837): a, c, t, g, unknown or other
  modified_base (34298)..(34307): a, c, t, g, unknown or other
  modified_base (35274)..(35334): a, c, t, g, unknown or other
  modified_base (35590)..(35744): a, c, t, g, unknown or other
cgtgggggtggagcggcgtgggggtggagccgggtggacaggcgctccgcgccacggccagcgggcctcgagcgctggaggatgattcccaaggcgcggcgacggcgacgtccagcacgccccatccgacaccaagcccccctgctcaccctggcgcgctgcggcgtgcgctgcggcgtcaacatgacggaggggcgcggcgtgcgccgtgcacgcgtggacgccagggtccgctgctgcggcgccccatcctgcgcggcgccgctgccggcctccgaggcgcgaagcacgctgtcggcgtctgcgtcccccccgcgcgcgttgctgccgctggcggcgccggtggccttctggccgctgctgctgggcgcgggagtggcctccgaccccacgcccgggtcgctggcgtcgttccccgccccagacgaccgctcccggccgtccttgccatcgctgtcctcggtctgcggcgcggagcgggaagggagtggcggggcgtgtgtgggtggaaggatccatgctataccaggagcaggcagcgaccccagctcgatgtgagaacctggggcagacgccctggtgggggccagtcatgggtgcacacgcagcatgcaagctcccacctcccgtctccaccaccccttcccaactaatttctcgtcgcctttccccccttcccctctccctcccaagaaacatctacacagcttgccttcatgaggtgctggctggcatcctccaccatggcgatgaacacgatctccgactggaacttcttgtccagggacagaaaggcctggtgctggcgatgcagggcctcgcactgctccgggctccggccgctgcccaccgcacgggacacctgggcgcggcagggttggcgacggggtcgagggcgcgtccatgggggcggggggatgcccggagggaggagtgacactcgtgcagtcccaggtcaccgaacgaggaannnnnnnnnntcgcgtccatgggggcgggggggatgcccggagggaggagcgacattcgtgcagtcccaggtcaccgaacgaggaatgagccgggtggtccgcctcggcccagagctgtcaggatgagccagtggaccagcactggcatgcgggaggctgcccatacacgtgtccccagctttcccatgccggcctaccnnnnnnnnnngcaggacgagccagtggaccagcactggcatgcgagaggctgcccatacacttgtgtccccagctttcccatgccggcctaccttgtcaaactcggtcccatacttgtggaaggcgcggaagaaccgccgagcctcgtcactggcccaggccacgaggggcttcgcgctgttgctcatctccggccgctgggcatactcctgcgacggcgattgggtgcggcagtcgctggctgttcggggcgcctccgacccgggatgtcacgacgccagggcgcggccacgctcgcgccatgcggtatgccatgggacacgacacgaaacccagtgaggcaccctgtgtgccggtttaggcctctgggcnnnnnnnnnnaggacacggtacgaaacccagtgaatcaccctgtgtgccggtttaggcctctgggcaccctcgctcgtggcgagtggtccctgccaaccttcccccaacgtcacccgctcccagcactcacccggtctcgagccctcaatgagggctgattgagccttgtcgcacgattatgagtcccgaggatggctttcgtgcgcggtgcaggaccgtcgagcgctcgatggccggatgcccggggcaggtgcgcgtgagctcacgcaaggttgggcacaagtcggctgggcaaactactctggtccgcacccaccagtttctcaccgcccaggaccccggcaaagatttgtttccggagatgccgatggcaagcaaccccagctgctctacttcatatcacgaagttttgcagagacgatatggaggaaaggacggccatgtccatgcacattcaccgtcctcggcagctcctcctgatgtctgccaccccgctttgtcggcagcgccctacacatacttatgagctattcgacctgttctgcacgcagcccgagtgcaaggtgcacgagctgagcgttcccgctcgaaacccccctcgattttcgacacatcccgaggttcaccttcgccagaacatttctcaacggtccatcgccgggaccagccagttgtcccatatatctcacaagaaggtggcttggctgcgcgaggggccctccacagccggcgacagcttagaccaagacccttctgtctcaatttctcgctgtcggcccttgccggctgccgacctccggagctgcaatgcgccgcaacttcctctgctagggcgctgctgagctcacgcgtgtagaaacctgtaccatgcccctactagtgggaggacctcagccccttgcggcccgtcagggcagggataaccaacgctacggagagcttggggagcgcttggtggcagggtgagtggcctgtgcggctcctccgtgatgcgtcgaagcccggggcggttgcacgtgtcctcatttgacagcttctactgctgctctctgctgagaaggaatgcagatgggttattgggatgcaatgcttacagcttgcactgccctccagccagacactgttaaaatttcctctccccatcttcctgttccctgcagctgcatacctgtgtgctggacctcgcctcatcagagcacggacaccgctctcgtgttgatggtctcaagccgggcaggcaaaggttacgccttcccaaaggtgtgtcgcggcatggtggcaagggcaggtgatgagcccacgtcggcttgcagggtctcccctcatctgcaccgcatgaccttggcctgacttcacatccagggaggctgggaactggacgagagcctggaggatgctgcccgacgggagacagtggaggaggctggtgtcagggggacgcttgaggtgggatgctgctgggaaacatcaggctgtgtgcgctgcnnnnnnnnnnttctgctgagaaggaatgcagatgggttgttggaatgcgatgcttacagcttgcactgccctccagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatgcgccgtggtggcaagggcaggtgatgagcgcaagtcggcttgcagggtctcttctcatctgcaccgcatgaccttggcctgacnnnnnnnnnnatgcgggggggcagtcggcacaatgggcctggtgggaaagcggcacccactctcgctccgtttcctggtgcttggaagcctggagctgcagcagcgcacccaagcccaggcaaagccccagcttgcatgctcgagcacacatcagccgcctgaacagattcgagggccatggcaacagtagccgagcatcannnnnnnnnnttgcggaggggcagtcggcacaatggaccctggtgggaaagcggcacccactctcgcttcgtttcctggtgcttggaagcctggagctgcagcatcgcacccaagcccaggcaaagcctcagcttgcatgctcgagtacacatcagacgcctgaacagattggagggccatggcaacagtagccgagcatcaccgccccctccgcccatccccccttgcagactcccggcctgggtcgcttcgacttctcctcctccaagttggggcggggcggagagccgcagcggggcgccgccttcatgtttgtcctgcacgnnnnnnnnnnctcgggcggggcggtgagccgcagaggggcgccgccttcatgtttgtcctgcacgtctctgaggaactgcagagctggccggagtcggaggagcgcgtgcgtgagtgggtccccctgaagctggctcctgccaggtgccggtacgcctggatgcgcgatgccctggagtgctgggttgcggccaggggctggcccccgcttgaccccggcaggcactccccctcccttgtgtggacggtggggggcaaggtggagggggaccgccagcaccctcccgagtcggtgtctgtggcgctgtgatggatgctgagcttgctgtgtggatggtatgttgtcgaaggaggttgccacatggccgcctcagcttgtcactctgcacgccggggagacccaggccttcattgtgcacttttggaccatcattgctgttagtttgctgcccgctttttgatttgatccatgcttaagaatgtatttccctctgaaaccgtgcccaccggacgggggtgcaaggagaatgtcgacctcaatacgaatcaagtagggaaggcgcgagcaccacccagccctgcnnnnnnnnnngaagcatgcccaccggacgggggtgcaaggaggatgtcgacctcaatacgaatcaaggagggaaggcgcgagcaccacccagccctgcggaatatgcggcaaagatcgtgtgcaatcaggaacattgcttgatcgcaattgtcgtctagattttgaaccgagggacccgcgtttgaaagagttgcgggacacgatgtccggcaagcggccaactgaccacctcgagccctcggcgaagaaacggggatctgaaaaacagatcaccaaggacgagggagaggagtctgccgaggagcatgtgtgtggggattgggtgcctggggctgtcgcggttccctgctgctgagcttgtccccatccgaccgcccagaccacgaggtggacagagccctgctcatgagacgccctcccaatcctttcgttccaggaggagcccggaacattccagcgagcatcggatgaggtcctgaagcagcgcaagatcatcaaggcacgacgaccagcccagggccctgcaggcgctgcagtcacagcatcccctgcgaaccccttcgctggcatccagctggccccagctactgagaacccttttgcaggaattcagctagccccagcacctgttccagcccagacagcggccccttcggtgggctctggcgaggacacccaggttcagggtgatgtggaaggagccgaggatgtggcaacagcagtacccgacagtgcgcttgcagaggcacctgttaccactgcagaggcatctggtaccaaggaaaccacgtctgggagtgcagccccagaagctcctgccgtggagacagcccctgtcgacgcagtggcttctgctgcaccgacgccggaggcccaggctgcgccctccctggcggccccgacacccgcagtgtcctccatttttggaggaggattggcatcagcaagcgcgggcnnnnnnnnnncggcagccccgacccccgcagtgtcctccattttcggaggaggattggcatcagcaagcgcgggcggcggttttggctcgcttggtgagcgggagtgttgcgcggaaattgagtagctggcgatggccaaggcgtgtgcagtacatgcatggtctagcaggacagaggatcccggggtggagtgttgcagcgggcctttaagtaaatgctgaggctgtctccctccccttcccgccaacgcagcgtccaagggaacggnnnnnnnnnnttagcaggacagaggattccggggtggagtgttgcagcgggccttgaagtaaatgctgaggctgtctccctccctttcccgccaacgcagcgtccaagggaacggcgccagccttctcctttggtgcagcgtttggaggagcctccgggacaggcgccgcagccacacccatgttcagcttcgctggcgggtcggcacctgcattcagttttgcagccccctcgacggcagccagcccccattcagacaaggcagcctccccaggcgagcaagacagcaacggcgctccagcctccccaagtgagggtcacggtcctgtagaagggtggttgggcggtggatggggcgcataatcactcgaatagcaaggcaggatctgccatcgtgcctgccctggggcttgccacaccttgcatgccgtcattatcccatttctggcccgcgccacgctcatacattcgtttgcagagagtcgagctcaaccaccacctccccttgccaaatcccttcaatcagccttcactccagtggcgtccctcccggnnnnnnnnnngcacaccttgcatgccgtcattatcccagttctggcccgcgccatgctcatacattcgtttgcagagagtcaagctcaaccaccacctccccttgcgaaaccccttcaaccagccttcactccagtggcgtccctcccggctgaggtgccacaagcgaccggggaggaggatgagaccacggtcttttctggggatggcgttctctttgagttcgatgcctccaagcagtggcgggagcggggctccggggagatgcgggtcaacctcggcaaggagagcaagcaggtgggggctggggttggtgctgtggctctgcaaggaagactgcgcaagtgggccgggttgatacattaggtggcaggtggagcctgagctctacctgaggtaaagtgagaacctgtgttgacctgatcaagcctgccagcttgcgcacgccctgttgcaagcacatggcaataagagagagcctgcctccccctttgcagggccggctggtgatgcgccagcgaggcaaccttcgtctgctgatgaacgcaaatctctggccggacatgccggcggcgcgcatggagggcggaaaggtgggtggcggggatgggtgcagggggggtctggcagtttgttgagacagtgggtccatgcctcaagctgatggcggcatggcgcgccggggacctcaagaccgccagcaagttcacctcctccgatccctgcggtccagggtgtgacattcgcggtcatcaatgccgtgtccggggaggaaggggaggcggcgggcgagggggcgcctgccccctcgggggagggccagctgtcgacgtttgcgctgcgcatcaggaacccagacgtgnnnnnnnnnncgtaacattcgcggtcatcaatgctgtgtctggggaggacggggaggcggcgggcgagggggcgcctgctcccgcgcgggagggccagctgtcgacatttgcgctgcgcatcaggaacccagacgtgctggccgcgtttctcatggccctggaggcgcacaaggccggtgccaaaccagcagagtgatgtgcgtgccggggatgcaagtcacaatcttgtcgcagctgtggctgtagcccctggttgcaacccggtgtagagcgtttcgtatcccgagacccatcttttccagtcccatgaagaaggcgcggggtagtcagccccatgcttacacgaccatcaggctcctagcccggttccccagaggaatgcgatggcaaagcagctagtccaggtcccgaccaccgtatcaccgggggagggcatgaggttgccgctgatctcatgatagagcgcctgccggagagggtggccatcgacatcctgtcgaaggcctacctcacctcccagccatccgacgggcccctcatctggagggagtatggcgggtgcaatccgttgcgcactgtggcccccctcgtgtgcaaggcctggaacgagctgatccgaagccccgctgccggcaaggtgttcttcaggcgggtgcgcattgtggatgcctgcatcctccccctgcgccgcttcaagcccgatgccctcctgaggtggttcaaggagagggcccggctctacgtccaggtgcgcggtgcttccccctgtactgctcggggccgaggcaagggatggggcccgaatccgactggggggggagcgtggcagggaggggtttccgtctgtcacccaggcaggtggaggacgccnnnnnnnnnntggggccggggcaaggggtggggcccgagtccgactgggggggtgcatggcagggaggggttttcgtctgtcacccaggcaggcggaggacgccccacaccggccacctgaggctggcatggcgtacacattacccaatgtgcctcccaagacgggggattccacctctgccgctgcctgtgcctaggcttacaccaccagtgcctcgcggccagcccatgattggcggccgcccactctcccccactgctcatctgatgaagcggaggagcccttctccctcccctcgggctccctcnnnnnnnnnnatgcctcgcggccggcccatgattggcagccggccactcccccccactgctcatctgatgaagcggacgagcccttctccctcccctcgggctccctcccctcccaacaccagcaccgacccagacacacacacacgcaacggccccacccacacaaacacccccaccccaggagctggaggtgaacctgagctccttcttctccagcccgcccgtgctggagcgcgtctcgcagctgctctgcgagctgatcgcggcggcccccgcgctgcaggttctgcacctgacgggggagctggagctggaccgcgtgttcgacgccatgcccgccacccccggcgcgctgggcgcgctgcgctcggtgcacctcgcgcgcggtggcgccgggaactggggcgtggcctcctgcgtggcggcgctggcctgcgtgccctccctcacccagctccaggtcatcttccggtcggacctggaggagccgccgcccggcctgcccgcctccatcgccgcgctgcgcacgctgcgccacctggcgctgacctggcccacgcgcagcgcgctgcccccggccgccccactcccggacggcctgggcgacctggcgcagctgaccacgctgcagctgcgccgcgtgcccgccacctgtgtgcccggctggctgggtcgcctggcgggcctgcgccacctctactgggacctgtgcctacccgccgacgtccccgccaccccgcccccaggcctggacgcgctcaccggcctccgcacgctctacatcgacctggcgccgccgctggccctggcgccaagcctggccggcctccgcacgctggtcatggtggggcacgctgcgcctgacgcccccgaccaggactgggactggctggctcccttcaccaagctccgctccctgcgcatacaggtgtgggaggggggggttgagggaggataggggttgggggtgtgggtagggagggcctgggaaggatgcggaggggcacgggcggccgggtgaatccccatgtccaaacgaaaatccacggacgggtaccaggagcacacggggacgcccacctcgctccccgaccgcagggcggcggcatgcgcacgctcccccccgtgctgcgcgacgcgacgacgctgacgcgtctgtcgctgaacaacaaccggctgtcggacctgcccgacggcccctggctggcaggcgtcaccgccctgcacctgggcagcaaccgcttcggcgccttcccgcgcgcgctgcgctccgcgcgcgcgctgcagtccctgcacctggccaaccagagggacgagggcggcgcgctgcgccgcggcacgccggagctgacgctggaggccgccgacgtggccgcgctgtgcaccctgccggcgctgcgcctggtggtgctggcccaggcccagccgcgcgtacgcggcgccgcagccgccgcgccgctggactactcctggctgcagcgcgcgctggcggcgcggcgcgtgcgcctgaccagcaacgagctggccttcgagctggagagcctgcccatgttcgacacgccccacgtgggctgggcggggagcgtgaacacgctgtgaggaagtctcctccgactgcccgaccgtcgagcctgggaggaggcccctgctcttcccagttgccggccggccgtggagacctctctccacagacacatgccagccagccagccagccagccagccagccaggcacacccgcaacccctttcaagaatctgcgccggggacacaagcccacgctgacattgcgcgccccggccagccacctccacacagcacccttcgaagcccccacagcagctggctcgtccctcggagctcacacacctgcttgccctgctcattctttgcgtggccctgcgcagaaaccctgaggtccccctcctgtgcagggggaaccagcggagcagagcacgcacccctctcacgttttggttcgccctactctttccatagaactatccctcccaccctcacccacatcatcaaatcgtccctcgattttccctggaaggaccactcacgcgcctcgcccaatgtcttccaaagtataacatccccttctcacttccaaactctgtaaggaaatgccggcaccgaggatgttccaggagtggggtggcgatttgagatccagcgtgaatagggaggcgcagcatccatgctcaccccccggggggtggccgaaggcgcccttctcgatgaacannnnnnnnnngagggaggcgcagcacccatgctcaccccccggaggtggccgaaggcgcccttctcgatgaacaccgcgatccagatagatacatacactgcgcaccccctttctgaaaatccctaactccagtttcgcacgtacgatagtaccttccttccgatccaagatccaaatgaatgcaatgagtcagaagcttgtgatgactgggaggccgctggggctcaccacccggccatgccagcagcgcagggtgagaatgggtggcacatgctggacacaccggaatgcctcgcgatgtgaaaacttaaatccttctttacacatccatcaggctgccaggatggcnnnnnnnnnnacctcgcgatttgaaaactcaaatccttgtttacacatccatcaggctgccaggatggcgcccagggctgcgcacgagctgccgccgctccccttccccatcgtgagtctgggaggaaggtgcctttggacaagactattcctggccccatgcccgcgtatctgaggccgaaaccgtgcttgcacaccccccttgaattatataagtgaggtttgacttttgtacgcaggattccctggagtccaagggcatgagcaaggtgaggggagatggagctgggtaccagctatccctttcgtcatggaggatgctgcatggaaagatcctgacatggctgcagggcccattgctgccaatcatcatagatcccaagtcttctcataaacgtgcaggaaaccttcgagttccactggggcaagcaccacagggcatatgtcaccaacatgaacaaccaaatccagggctctgacctggagaagctgagcctagaggaggtgggcgggcgttttttcccagcattgacgcagcgagcacacattccgtgccagatgcatgtgtagtggccagttctgacttggagtaccttgtaggatgggtcaggcgcaccagcaagcaagcaccccgcccactccacacagctcatccacaagtcctggaacaatggggagcccactcccgtgttcaacaatgccgcccagaccctgaaccacaccttcttctgggagtccctctcccccaatggcggaggtgaagcccgggggttgaagcagagtggggacccatcggcgaacggcctgcaggattgggacaaagaccaggctagggttgcttgctgctgctggcacatggatgctgccctctgcaggctgctccaaatgctttgagcgcgaccgggcgcctggggctgccgatgccagggtccatttgatagccggtagggaaatgtttgagctgatccccaccccccacccgcccgggcaggtgagccgtctggcaagctggcggaggccatcaagaaggagtttggcagcctggacaagttcaaggaggagtttggggccgccggcgccacccagttcgggagcggctgggcgtggctggtggaggctggcgggaagctggccatccgcaagacgcccaacgccgtcaaccccatcgtgaacggcgagaagccgttgctgaccctggacgtctgggagcacgcctactacctggacttccagaaccgcaggtcagacgagggtgcgaggagcagggatgggaggactggttgcatcacgcgtggaaaaggggcagggggctggggacaggagaagaggatgggcgcaggagcacttgttgggggggtcaggtggagggtcgggtgacagaggtggatggagggctgcctctatgcgataaacatctgctgaatacccaagcatgaacctcctgccccaccccaggcctgacttcatcaagaacttctggaacctggtcaactgggacaaggtgcgtctggggtgagcgatgcacgccctgcatggagtggctgtagtgcatcaaactcacatcggcaggctgccatcatgttacaggtcgccgagcgctacggagcctgaggtcgacacctcctgccaccacttttgtttgggtcagcagagtcggttgaattnnnnnnnnnngtctgcctggtgcaggtagttggcaccgaaccgttcctgggcgacccccgtcctcaataatcgggaccagggccagtaagcacaggctgaaaagctgttagtttttctggtcgagttcgacattggctcatcatcgaatgggctgnnnnnnnnnnaatactgcaggcagcaaaagtctttctctgatcgaaggcttctcttcccaatccaatgtaacacgtgtggatgcccttgtgcctggtgcaggtggttggcaccgaaccgttcctgggcgactcccgtcctcaataatcgggaccagggccagnnnnnnnnnnttcttatttgttctggtcgaattcgacattggctcatcatcgaatgggctggcgcatgctgtgtactcttgaatcaacatttgcgtgcggttacccagcagtccgtaccagggaagtttgcggtgggctcgccccttcgtgcgcggccctcgtctctagaaaggtctcatgatcatattcagcaagccgagtcaggaggaccgccgaatgatagggtgagggtgggaggtacgcgcctgagacctgtctgtcgaggctgtgacgtggcctcctgacgtcagcgggacgccgaggacaagaagattcttccctcagcaccaacatcatgccgggttgcgccatcaannnnnnnnnnctgaatcaacattggcgtgcggttacccagcagtccgtaccacggaagtttgaggtgggctcgccccttcgtgtgcggccctcgtctctggaaaggtctcctgatcaaattcagcaatccgagtctggaggaccgccgaatgatagggtgagggtgagaggtacgcgcctgagacctgtctgtccaggctgtgacgtggcctcctgacgtcagcgggacgccgagggcaagaagattcttccctcaccaacatcatgccgggttgcgccatcaagtgcaagaaagattggcttgacagcaatatatatacagaaaagcccctcgctattcctgtagcgtgcaccacatcttacttgtaccaccttcggcctgctccatcaccttcccaggaacagcacggtatcactaccgcggtttctatcctcccttctgagacgcacaccaatcatataatgagatttacctcgctttcgaccctgtgcctgtgccttctcgtggcagcatcatgcgcaggctcaggccgtgcgctgtcctggcccctgtgcgaccccgccggcttggtgtggatgacggagcgtcccgagcgggacgacgtttacccgggctccaacctttggtgtgagtggatgggcccaagcgccagtcatgccggtacttcaacagagtgcggccccgctgtatccttcacgtctgggatgggtcgaccgccagagtcttcgaggctcctggcactgatnnnnnnnnnngtgggcccaagcgccagtcatgccggtactccaacagagtgcggccccgctgtatccttcatgtctgggatgagtcgactgccagagtcttcgaggctcctggcactgattttgcatccccttctccttcgcagtcttctgcaacagcggcatcaatatcctgggcgatgctgtgagcatttgcagtggtaatgggacccgctgcgacacactcgccacagccaccgtcctgtgtcagatcctcggtagggtgcagcgggggggcggcttccggcagctgcctggggttggggaggcggtgtgcctgtcagtcacctgcacgacacagccagatgaagaagcattctgcgtcccgcctgacattggcatccacacccatggcccctcttcgatgcccctgcaggctacgacgaggcctccagcnnnnnnnnnngccccctgacattggcatctacacccatgacccctcttcaacgcccctgcaggctacgacgaggcctccagctaccagtctgacgtgaccaccacgaccaccctggccgagggtcaggcagtgcgctccctctccggcgagttctgccaggcagacggctccttcaccctgcagcgccctgagggcaatgccgcgccgctcagcaatggcccctgtaccgtcctgaacaagctcgtgtgtgtcaggtggggaagaggagtaggacgatgcaaggctgggggtagggacatggcagccccccagcctttcctcatgcagttacaagctggccaggaagctcctcacctgtgccaaagtgtcagccgggctcgtgggtccctcgctgttggggccccccaggagtcatggtgctctgccgcctcaaacagcaccctgtcattnnnnnnnnnncgggccccccagaagtcatggtactctgccgcctcaaacagcaccctgtcattcgcattcgattgcaggctgagcagcagcatggatgccgcggccgagtcggccttcctcgccatatcggagaaccagtttggcggcaaggagatcgcgccggccgccgagctgatcgccgaggtggccgatagtctgcctggcggccggaagctgctgggaaagtagactcccgctggcgttctcccagtatagcacccctcgcgtcacacattcctttacacctctctcgcacaggcagggcccctgctgaggtgcgctccacagaaagcgttccctcccctgatgctgtagtttctgtagcatacctgttctttgacgtactacttgagtacaattctgctcttcccccttcgagtgcatgctctgagccctttcgacccctgtgcgggtgatgcctgtggcgtgctgttgcggccatgttgaaaccgtctgccctcttgttcgcctctggcgagggaggaaggtcgcaggcatgggtgtgtgcgtctgcatggggcctcacccgcccagcaagcctttcctcgagcaacgacagaaccccagccccttcagaagtagttgttgaagtagcgcatggtcactgggacatagtccaggcccagcagcttgaatatgtcggtctcgcaggcgcaggcaatcctgctctgagagaccccgccctcaggcagcagcacggtcacctccttgtccgacagcttgaaccccatggcgctggattcccctgtgcaggtcctggccagctcggcnnnnnnnnnngacccgccctcaggcagcagcacagtcacctccttgtccgacagcttgaaccccgtggtgctgggttcccctgtgcaggtcctggccagctcggcnnnnnnnnnngatggcgggaaggggatgtagaaccgggagtgggtgttttgggggggtgatggtgcgactgagcactggcatggagaagcatgaagggagnnnnnnnnnnaagacccaagacccatcagcagccctctgcacctttacgtctatgcggcgagcccagggcgacgccnnnnnnnnnnagcttgggtggcccagtgccgcgtggcccggcagaaggactggctgttggcaaaatagttgacggcaaagggcaggtgctcgtgcgcgtacacctggataatggcgggaaggggaagtagaaccggggggggttgtcttgggggggtgatggtgcgatcgagcactggcatggagaagcatgaagggagtggaccaggggcctcatgatctgaagcgactcggcatgtggcgtcccatgaagtactgtggcaggcacgcccccctgctgcccttcgccgccatcacccctcannnnnnnnnnnnnntcggtcctgaacagccccatccagctcgcgcgggtcaggggggcgcggcacagcgtggacgtcgcgcccggccccatcatgtcctccagcaggaaccctgcctccagcaggttgtccagcagctgttgagagatcatgggtcgagtcttggaggggctacttggtctggttatactgcactgcagcttttctgattgaacacgtaagtggttcatcacattgagcctgcaagggagcaccgcccctgtggatacaggccagccgccctttgtacgtccacgtccatcgctccgccagcgtcccacatgaggcaacccacccctcctttccaacctgctccaggaagtgcacgcagtccacgtgctccgtgccgggcggcaggccgaccagcatgtccatgtcgctggactccggggcgcctcgccggaagctgcccgtggcccaggcgtaggtcctggccactccgtcggcacccaggccgggcgccagtgtgtccaccaggtcaaacactgcggcgcggaccagggcctccccccttgccacctccgtgcggggcatcttgcgctggatgtcctcatggtacttgagcccggtctgggggatgatgggcaagggaagagaggggggcgttgtaccaagagcctccacacgcaggtctggcccaccaggaacccgggcaggcaggcgcaatgggcaccccggcaggccttgatcgagggaaatgttctaccccgcagcgccctgggagcaggcggcggcatccatgacaactcccgcccattccctcccccggacccccatccccggcgcaccagctgctgcgccgtcaggccnnnnnnnnnnacccggcaggccttgtttgagggaaatattctaccccgcagcgccctgggagcaggcggcggcgtcaatgacaactcccgcccatatcctccctcaaaaccccatcgccggcgcaccagctgctgcgccgtcaggcctggccgccgggccacgtcctcgaggctgcgggcgccatccgcataccatttctgggccgtggtggggccggcgccccacacgccgttgaagagcgccagggtctgcgggtgtggttgtgtgtgagaggcttgagcatcgccggcgccacatgccaggcagatgatgggaagtctgcggcacgggttccagtgcgctcctnnnnnnnnnncgtgtaagaggcttgagcatcgccggcggcacgcgccaggcagacggcggggagtctgcggcacgggttccagtgcgctcctcggcgtgcgacgacgcgccgcctccacaccggtatccccgacgcacaccctaacccacacacggccccgcacctgcagccgcttgtccccggcgacggcggcgacgcggatggactccccgctgcgcaggatgtccctgaccttctgggcgctcttggggccnnnnnnnnnncccggtccccccgacgcacaccctgacccacacacggccccgcacctgtagccgcttgtccccggcgacggcagcgacgcggatgaactccccgctgcgcaggacgtccctgaccttctgggcgctcttggggcccaggcctacgtggtccacgtccgcatcctcctccagcggcgagccatggccggccacctgctggatcgcccgctccagagcctggaaagcaaggggggttgcggggacatgggagcggctcctgggatggcttctgagcagcttggcaagcagggttgaacacccatggagcagctcctcgcacagccacatggagtgctggcagccggtgcccagctgggcaccaccatactgagggacccctgtgctccccacgccgcgacccagccaccgtgacccccgcccacacacacacaccttgatgcggtactggtccctgccctccacgtagacggagcggtactccgccagcttctccacgatgcagaaggggtgcggggcgcaggcagcgtgcctgcacacggtgttgacgcggggggcctttcccccctggtccttgccggtggggggcgccgtcgctgccctggcggtgcggtaccagtggtgccgcagcttctcgcgggtcgccctgctcatcttgcaaagaggggctggtggtgggctggggtgacgctgtgggagcaggcaggaaaaagtgaatgagacgagcggccaatcccaaaccaaaccgcnnnnnnnnnnagacgctgtgggagcaggcaggagaagatgaatcagacgagcggccaatcccaaaccaaaccgcgtcacccacatcgccgtcgcctcatcccagggctcctcccagacgccggcccagccccagggaaggcccgagtcgccgccggtgaatcgaggcagggtgtcaccctcgatggcgacaaactcgctgccgaccctctcgactctgcagggggcgggcggttgcgggcggcgggctttcttgcgcggcagaggctcagcgtcgcagaggggcgccccggagcctcctgtccaagtgggggcgtgcgctggcgaggtccccagccccgagcccgtcttgctgctcggaggactgccagcccgttccctctgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtcgatgtcgagtgacagggagggcctgggtgatagatggggtctggggcttgggttggaggaggtacatgtaatgcccggtgtgcatggctgacggggctatttggcggccccatagttctgatgctgcgttggtggcggggttccccctgtcggctcccaaacaactcatgaccacagccacatgcctgacatgctccgcnnnnnnnnnntcccagccccaagcccttcttgctgcttggaggactgccagcccgttccctctgcttggctcctggtcccttgccgtctgccgagccgctgccagagtgctcacccggcccgctcacagccgcctccccgtgggcctgtgacatggcagctgccagcctttgcccaaagggggagaggtggtcgctctccgcctgccgtgtctgcttcaggatggagtcagtgatccacgtgggcagtacaaagtggacgcccgtcggcgcagctacacgcatcgagtcgatgtcgagcgacagggagggcctgggtgatggatgggggtctggggcttgggttggaggaggttcatgtgatgcccggtgtgcaaggctgacggggccacttggcggccccatagttccgatgctgcgctggtggcagggctccccccgtcggctcccaaccaactcacgaccacagccacatgcctgacatgctccgctttggccaggtgagctgccgctgtgaccaggctggtattcgcgcccgataccacgtgggtggtgtccttgtccagtgccgctgctatggagccacccctgtcgaccacccgatccttcatgcgggacatgtgggacttgtgccagaacaccaggcggcagccctcgaacacatgtttgagggccatgtctccacgacgaccccccccatccggaatgaaactcatgacggggctaacgtgttggcttcaaggcccctgaggaccttnnnnnnnnnntcatccggattaagactcatgaaggggctagcgtgttggcttcaaggcccctgaggacctttcggccctcagcatgggaaggctggtggggcattggagggccgaaagtgtcctgtgcacatggtggcgaccctcgatcccaagtttgggacgctggccatttggtcctcgtgtcatatccatgtggctgtatgcatggcgagatgtctccaccagctaggcccgattccnnnnnnnnnntcctcgatcccaagtttgggacgctatccatttggtcctcgtgtcatacccatgtggctgtatgcatggtgagatgtctccaccagctaggcccgattccacggacctgtgtcggtgatctgggaccctgctgtgcatgctccacaccaccaccagttctctcgggtgagggtcttcgatgcccgtggatcccatgtatgtgtgttcaggaacgcgaatacttgtgaaatattacgatgaccatttgtatgtatttcgcaattcattgatgtagaggacgtactgtaccatggccgcaccttgttcagaacgccagtctgcaccaatggaccactgagccnnnnnnnnnngttgtgaaatattatgattatgatttgtatgtatttcgcaattcattgatgtagaggacgtgctgtaccattgccgcaccttgttcagtgcgccagtctgcaccaatggaccactgagcccaatcccatcatgcgcttcctgatcgagaccgctgctgcaagtcggcgccatgccgcgcggtgtttcggctctggagccatggaagccatcagcctgcagggggtgcgaggtgtgctccggctgcagggttcgcccgtctaccacttcctgcaggcgcttttgacaaatgacataacgcccctggaggctcccgacgccaagcccttgtacgcctgcctgctcagcgcccagggcaggcacttgcatgacatgatcatccacaagatgccaggtggggatgtggggacggggcttcagtgagggacgtggcgctggggttgatcttggcactcattgtgccgcccatcaccgcccatcctccatgcgtgacgagccgttgtacctccattcttgcacctccnnnnnnnnnnaggatgtggggacggggtttcagtgagggacgtgacgctggggttgatcttggcactcattgtgcgccccatcaccgcccatcctccatgcgtgaggagccgttgtacctccattcttgcacctcctcacaccctctaccagacgaagaagcttgcctgctgctggacgtgcacgcagacagcctgcccgacctctcccgcttgctgaagaggtgcggtttgcaggctggtccggccccccgccgtcctcctggctgggccagggcaagtgccagggtgccgtgctgcgccctgaccccccagacctccccccttgaaacaggtaccggctgcggcaaaaggtggacatcgcagatctgagcggcgaggtctcggtctgggctgccacggagcatggcgccgccccatgcccctccgcccacctggcctggggtcctgaccctcgcctgcccgcgctgggcgcgaggggccttggcgcctggggggaggccagcgcgtcagagcaggcgcgcttcgcgcgacaccgcctggcgctgggggttgccgaaggcgacgctgagatcccgcacggtggggtctgggagccattggttggggctcctgggtggggagtgctgggttgcctggttcccgaggcggcctcacccagtgggcggtatcctatcgcggctccacggcgtcgctggacaggaccctccagtgctgctgccattgtgggtcgctcagtgcaatcccccccccccttcccatcacaggccacgccatgcccctggagtacaacctggatgcgctgcggggcgtggcttacgacaagggctgctacgtggggcaggagctggtggcccgaacccattacaagggggtcatccggaagcggctcatgcccgtgcgcttcggcgtcgggggcgagggcggcgcggaggtcgctgcaggccgcgagatcgcggcgggcggcgctggctccggagggcgggccgcgggcgtcgtgcgggccgtagagggggaggccggcctggcgctgctgcggctggnnnnnnnnnngcgctagccgtggcgcggggcgcggcgccgcccctggcgttgaggcccgagggtggggcggggcaggaggtgctgccctcggtgccggactggtggcccagagactggactgaggggagttgatttgccccttttgtgtgccgcggaggttgtacccgttacatgttgatgagtatcatttgcattgaggacctggctctcacgacatggtgacggcagcagggccacgtcctcacactacccaatgcacaggccaagcagcattctccttcctcacgctcgcctagttgttcgcccgccccgcccactgattgccgcgttttcgttcggccnnnnnnnnnngtgtgtgccgcggaggtgatacccgttacatgctgatgagtgtcatttgtattgaggacctggctctcacgacatggtgacggcagcagggctacgtcctaacactacccaatgtacaggccgagcagcattctccttcctccgctcgcctagttgttcgcccgccctgcccactgattgccgcgttttcgttcggcctgcgacttcttgttgaacttggccttgcccgcctcgagcagcgggtcgtgcacggtgtaatcctccacgctttccttcctggccatggcatcccgggcgtccttgacaaatgcgagcctgatgtcgtgggagtaggaggggagaccttgttggggacgccgacaggcaggggaaatccattggacctttccgtggaacagcagactgcttgaaggtcccaggaccctgctgcagctgccatgctctgaaatgccggcgcaattcagccacacacctgtgcttcctcaagctggcgaggtcgtcgtcgctctcgtcctcgccgtcctttcccaagtaggcgtccaccctccaggcagccggcatgtaggcctcgtgcgcgatgtcctgcctcaccctgccgtcataccctgctgcatgcagcatgagcgggcggtggggcagagatttagtcagcacatgagcgacagcccccaggcacgcatcatcgcatcgcgcgtgcggcgcgagaccctctgaacgcctgcatttggcatccactgctccnnnnnnnnnngtgtagtcatcacatgagcgacagcccccaggcatgcatcatcgcatcgcgcgcgcggcacgagaccctttgaacgcctgcatttggcatccactgctcccggggggcataatgccagaatgatccaaatcgaaccttggaagtcggggtctggcgtggcgccctctggcgctccgctgcggtcctgagaggccggtgctgccgcagctgcgccgtctgggccgggccctgcggcttctactccatctgtgctgggccctgcctcggctccggcgctggagccgggccctgcagctgaccggaggttggacgtgaagcgctgcagcttgctcagcgtgtccctctgtcggctgccgccgatccttttccgctccaggtactcctgtcgcgggcgagtgggagggctgggtgtgtggatgcaatcgtggtggacggcacaggctgcagagagcaacaccacaggctgcctccagcaannnnnnnnnncgggagggctgggtgcgtgggtgcaatcgtggtggacggcgcaggctgcggagagcaacaccacaggctgcctccagcaatccacctcccattcaggacacctgagatccgtgctcagcctgctccccaggaggttgcaccacccgcacccgcgccccctctccacccgcgaccccgcccaccttcctccgcttctcccagctgctcagcaggttggcatcggccacggcaatctgcctggagggcaccaccacggcggccatggagcgcttgccctgccccgtccccgccagggagcgcgccgccttcctgcacggccgcccgtcctcctcggatgcgtcctcgtcctcctnnnnnnnnnngtggagcgcttgccctgccccgtccctgccagggagcgcgccgccctcctgcgcggccgcccgtcctcctcggatgcgtccccgtcctcctcgtcctcctcgccgccactcccgctgggcgactgattttggccgggccgcccctccccctcgctcgccttggctgcacgccgggcctgcacccgctcgcgcatgcgtgactccaggtcggacggctggggggcaggcgcggcgctggtcgaggggggagcctcctcctcctgccgctgcctggcggaccgcaaggcctcccgcacactgcaggtgagggattgagtgcattgctgatgagacgctgggcgactgggaggtacggccatggccgacagctcactcccatgcaccagccacagggtctcactcctaccaccagccacagcagctaccaccagccatagcagctggaagcacccacatccacagcccgcgactcgcctgttcagatccacgtccagggccgcctccttggacaggtgggcgtcgtgcagggcgtcgtgcgccgaggcgatcttcagggaggcagccgcctccacggcggcctcctcctccgcctcggcctcgtccccgaatgagatcaggctgaagttcttggcggccttgcgctgcaaggtcttggccctggccgccgccgttgctgctgcctcggcggcctcagcctccctggcctccctacagagggtttagaggagtctgggatcagcaggcagacagattgacgaggaaagatctccatctggagggtccgtgccacatctcgcagcccagaccccgatcacccgcacacgacccgtcgcgctttccttgcgccatgctcatgcacttcacacatgcgctccccggccccacctgtccactcgaggcacaatgtcatcgaaagggttccacagcacgtctgccctcttcaggaccggggggtgctccggccggtcgtcctcgcccacctctaggtcgttaaagcgcagcaggttgtacagggtgtcgcctgcgcaggtgaaggcacctcgaatctaaattgtctgctggcatggtgcgaggtgtgcctgccaaattgcggccccgggtcttctcggctccctcataacgggcccagcatcctcctccgacgcacccgccacgcgtnnnnnnnnnnaagtcctctcggctccctcataacgggcccggcatcctcctccgacgcacccgccacgcgtccaaatatggtgtacttgcgctccagttggggcgtggcatccagggtaatgaagaattgcgagccgttcgtgtccggcttgttctggttggcgcaggccagcagcccgcggtgggtgaagcgcagcctactgtgcacctcatccttgaaggggcggccgtagatggattcgccaccctggcccgtgccggtggggtcgccgcctgtgaatttgttggagttggggtgaagctgcctggagctcaagcgcctggaggagccacactctgccggcagccttcattgagcaggcaaacaccatcaacctccatgagccatgggctcccaccaccaccccaccttgagccatgaagtctttgagcaccctgtggaaaatggtgccgtcataataaccttccaagcagagctggacaaagttgtgcaccgcctttggggcctccttggcccacagctctatgtcaagatcacccaggctggttctcagcaccgcctgcgggatgtgaggagcgctggtggattggagataggacgaaaaagtcaatttcatcaccaggggatgccaacggcattgcgatcctcaggcaccaacctttcnnnnnnnnnnatggattggagataggactagaatgtcaatttcatcaccggagaataccaatggcattgcgatcctcaggcaccaacctttcccttggtggggggctcaaggttgtagacgttggacatggcgacacgttccctgtcgaagccttacgattatgctcgattcatgggactgtatacttcattgtggtcgtaccagtgtcgccaggcgaggacccaccgttgtaaggaagcaaacacgttcgtgcatctgaagtttgatgtcgcgccctgagtccaccgaggtacggccacggcacaactcacattgacgacccagacaatgggttattctgcaggagcaaaactgcgattgagtagctatatcacgttggttgctagcgcctcgggggcttgaagacatcagcgatggcaccgaagaagggtgccaccctccttgtcaagctgctgagcacagctggaacaggatacttctagtgagtgtggatcaaattttgggtgtcgttgcgcatatgggaccagcgtcgttcttgttnnnnnnnnnncaccccaatgctttgtgagctccttataagtttacctaccttcagcttttgacatcaccctcacaaggcgtaacatgtccactggggtgttgcaaaatcccaaggatgtgaagtgagttcccgaggcgctaactttcaccagagttaggcttcctctgtcatggtatgccgtcaatcgctcatttagcaggatggcacatgttgcnnnnnnnnnngttcccctcccggcagtgtggcgaggaagaacccccgcaagctcccccagaagctagagttcgtcaaatatgatcccagggtacagcgacatgtgctcttctccgagaccaagctgcgatgagtcggtagacgtcctcgtcctcgtgtttttaccccactgctctgtgagctccttgtaagtttacctaccttcagctttgatatcactctcacaaggcgtaacatgtccactggggttttgcaaaattccaaggatgtgaagtgagtgcccgagccgctaactttcaccagagtaaggcttcctctgtcatggtatgctgtcagtcgctcatttagcaggatggcacatgttgcagtccagtaggaacaatgctgtccctctcctcagtaagatgttgtctgtcagcaagtgtacatggtctgttgtgcggaaactcgcattccgcgcactggtctnnnnnnnnnncccagtaggaacaacgctgcccctctcctcagtaagatgtccgtcagcaagtgtacatggtctgttatgcggaaactcgcattccgcgcactggtcttagcatcgccctatggggccctggacgccagcttgggtgccttgaagcccgcaccgaatattgctgccgccggcagtgcgtcgcccctggagacagtcagcagcttcctcttgccgggcaccgcaggcttcagcccgccaggcctgtgttggaggaggggtgagcggattagtgcggggcagcctgggcacgatgaggtcgcgaccatcccatacatgcaccaggtcacgctctcttcacgggaactcacgcggccacaggacgttccagggctgggtgagacttggggactggtagcatagcgtgcttcgcagcagcttccaccaccctgtgctcgtaagaacaaggggatgttttaacttggcaaaggcttgtatgcatgtctggtgatccagtaagtcgacacccatgagagcctagggttcatcggagggccaacagcccagcatttatgactgcagacgctatcagactcccacacagcgttccacacctcgggttgagggcgcgcaacggatcgccagccggccgatctatctcagtcgcggggccgacggctagggccgnnnnnnnnnntccagcatttatgaccgcagacgctatcagattcccccacagcgttccacaccttgggttgagggcgcgcagcggatcgccagccggccgatctgtctcagtcgcggggccgacggctagggccgccagagcctcctttgtgggctcaccgacccccccgctcgaattctccttctcagacaggctggtcttggcggcgacccgcgctctcttccccttctgcgcgatgctctccttggcctgccccggggtatccccctcgccccacacgctggcggccaggttgaccttggcctggccggcggcccggcgtgcaggcggcttccgcctgggcgctggctcaactggctctgcagcgacgaggggtgaggacggggcagatgcgccggcgcccgccacacgagcagcctcgaccggctcgggaccgggcgcgggcgaggcctgccttcccaggccagcgtccaggggtgccgcgggcggggcgtcgatcgggaagatgggggcgcggaacagatcgtcgccgcagtcctcatcctcggcatccgtgccctgcaggtggtcgaccagttgatccaccactcgcatcgctgtcgccatctgggcaggtgtgaggggggtgctttgagtgggtaaaggacagcagacagatgactggatagagtagaagcaacggtcttcaaccctgggctgtcctggtcacaggccctgatctcgtggggcgcctatgatctgaaacgctcactgcgacgcacctctctggctggcgtggcattctccctctggcgagctgcctcctccagggccgcaatcttctcgtcccgagatttgatctgcgcgggggtgcagtggttctgccgtgtgtcgacttggggttcttgaccaggaggaaggagcgctgcccctccttgccgttcattactcgtcccacacccacacttgtaagttcatccgcccccagctccccctcttctctccatgtatcctcactcctggtcacccccctaaacccccactcaagcattctcccacctgtgcctgcagcgtctccagccgtgcacgcagcgaccgcccctcagcctccgccgcccccgccctacgctcggcggcggcccgcgcctcgccctccctnnnnnnnnnnnnnnnnnnnnnnnnnnnnnnnnnnnnnnnnnnnnnnnnnnnnnnnnnnnnnnnnnccctgtgcgtgccgccagcccctgagacagggccgccacgcccgccgccaagctctccttctcggccgccaggccctcccgcgctcgcagggcaccctcggcggcctccgcccgcgagcgcgcggatgcggcgatctcctccgccagcgcgcgtcgctcgcgctccgagtcggcctcccgcttcnnnnnnnnnngcgcagggcaccctcggcggcctccgcgcgcgagcgcgcggacgcggcgatctcctccgccagcgcgcgccgctcgcgctccgagtcggcctcccgcttcgcctgggctagccactcgcgctccgaggcggcctcggacctgaacccagcggcctgggcctcctggcgggcggcctcctggcgcgccgcacgggtcagctcctgcgcctgctgcagctgggcgcgcagggcggcgcctgagcgcgtcgcctcccgccgcgcctccgagtggcgcgcggcggccatcgccccgaccgcactgagcctcgaggtggaggcgcagaggcggtcgtagcggtccgcgtcctccaccgcgctggagtgccggaccttgagcagggcactgcgctggcgccagcggtacagctccaccttggacttggacagctggaaggaggccaggtctgccctgtcccccacctcgtccagcgcctacacatgaggagggggggggcaagaagaggctgtactgaaaaacataatggtacgtgttgtgctgaatgtgcactggtcttcaacggaggagtctcgagagccannnnnnnnnnatccagcgcctaccaatgaggaagggggtggggggcaataagaggctgtactgaaaaacaaagtggtacgtgttgtgctgaatgtgtattggtcttcaacggaggagtctcgagagccacgttggtcggaatgactgagtggggaccaaaggctcacgggcccaaccacctacccgtgcatggaggcgactcgcagtccttgtctgggtttcttggcgggccttcagcttttcataccgagcagcatgtgcttcatggatcttggcctcgatggccagctgctgggtgagcccgctgacatggctctccaggtccgcgatgtgcagctgaaccgcccggggcagcccggaattttcggtacccacatcggcctccatctgggtgttttcaagtggctttccctgtgtcgggatcattgacggcgatcgccgctccacgcaacccatttggggcactccgtccctgtgacagcggggtgggagtttgagtgagtcccatgcgatgcgtgccgtggcaggcgcctgcagagcgagaacgattacattctcgtcgcatcgtaatccgttccgggactgagcttcatcacgagaaatcactgaaacatactgactccatggcccgggaagcgagtaggcagtgcggttcttgagaccccccaaacctcgccttgctgaagatcgcttgctggccacaccatggcggtgtcacggaatctaacactgtgcattgctgctgccttggcgtatcttagcttagtagccggccagtccgggacgtacaatccctgcacggagcccaatgtcgtgaataaggtgcgctcgccgtgcctatgacagtgctcgatctgatattctacaggaatgtggaggatcccataaccctgatttctttaccagggggatggattcgtcgtcggtctggcgtactggccggcgggcaccatcgtcaactggtatggggacgtgcttggggtagggttgccatatttggtgtggagtatgccttgaaagggcatggtgggaggtgctctgctgtactgaatgtgaatttgctgaatcttgtgacccctaaattcatcctcccatgcaggggcccagctgtcaacgcctcaggtttgtgaatggaggttgaggtgacgtgcatgcatccctagagataacaatgattcatactggctgcggctgaggacatcatcctctcaacccttacattccgcctaactattctgcgcaggcgcacccggcctgaacccctgcatcacaggaatgcagtgggagggcggcaccttgaactacctgtcgtatctggtgggtcggtgtgagtggggcgggcatggatgcaggggcggcccccatcggtcggcagggctgcatggtgggacctgggcttgctgggactgccattatctacccccccctgactgggagcccagcacatccaattcagccttgctacgcagtgccaaggtctccctgcttcattctgtctcctggtcatgcgccctcaagcgatttgcagtccctgataccaacccacatctcaccttgcactgccccaagtccaatcctcgcgcctagactgagcctgccgcacctacacacacttccccctccacccccccctgcgctgccctcgcccagagcaaccaaggcgtgaccttcagcacctttatggtcaccgtggacacgcttgccgcgctgcgcacgaccaaggcggaggaggacgcgatctggggccccatcctgggcgtgcagcagacggaggtgctcagcgtgatcgccttccggggccagaatcggtcggatgccaagtacatccgcagcaacatggcggcgctgaccggcgggacggggattgtggagcagatgtcactcttcatcggattcagtgagcggggccgggtgggggagcaaggagtccaggtcatagccatggagcctgggaagggttgagacggcgtttggggtggggatggggacccactggatttggggtgcggttctgtgggaggacctgctggaggcggcagtactgctccatggaatggtctgcttggagggcaggaagctgctcaggtctacatctacccctccgtctcggcaatcatcatcacagaccgcggcgtgtttgccggattctcttggtgggactttggccagtgcaccgcttgcggcgggctggtgagcgaccagtgcatccgcacgtcactcagcgacagctaccagctgaccgcccaggcatcatgtgctggtacgagtactcgggataccttacgtgtcgaggtggatgctgagtctgggggcctggccctctgcagccagcgggggggagggatgagcctgatggcgcatgaagagccggggcgtggtatgtgctcttccatgtggccacggccattcgcctcctcgcgtgaccgacacttgttcaccgcaggcagaggccagtgtgcggtacctggtcactgccccttcccagcgcgccatgagcaaaactctcacaccaccccctccccgcccccaaccccatggtcaacctggcagccccgctgagcagctgcacatgccgcgggctgtcctgctccaccagcacctgctccactaccatcatcgcggcattccaggggtctgacgcctctggccgcaccttcacttcggccttcaagatccaggcgctgaacaagtactccatctccgacttcttctcgcagctcatggacaagctgtccggcatcctgcccggcatctctacgaccaccgtcagctcatcgggcagcaccatcagcatctnnnnnnnnnnaagctcatggacaagctgtctggcatcctgcccggcatctctacgaagaccatcagctcatcgggcagcaccatcagcatctcgggcagcggtgagtgggtggagccgggatgaaggagggcggggcggtgggaggggtgcatgaagcggccaaccctctctcgatgccagccgccaagagtgactcgcacnnnnnnnnnntgggatgaaggagggcggggcagtgggaggggtgcacgaagcggccaaccctctgtcgatgccagccgccaagagtgactcgcaccacgcaaaggggccggcagtgggcgccagggcacctccatgcacccgctccactcctccccttaccatacccgtgcagccacggaggctgcgctgcagcaggcccagtcagcggtctgaggcatagccccccccgaccagacctcggccgggaacaaagtctaaccctgccgcgaggacatgctgcagggtgagaccttctcattcagagagcctctctactcaatcagtcacacaaggggcatgcgtgggttagggtggtggctgcaggtcgacacagcctgtacctgcccgatgagtgtgtaacaatcttgctccggtagttcccaaggttccgcgcgctgtaggcaccgacccagcccaaaagcttgtcgccgggacatcgcagtgtcttcagcggtactcgtaaaggaataaaatgggtcatggtctgtagtatctaaatcccatgcaccgctccccctagcgcgcatggacctcggaacctcgggggggagctcagctccccctcccccgaccccagaggaggccatggtggcacgactgtcgagcatcgaccccgccgaccgcctcgtggctactcgtgcgctgaagaacgagtccatcgtcaacccgaggcgcaagctgaccctgctgcgggcgggggcggtgcccgccctgctttcccagctcgtgcaggggccctcccccaagcaagcgacgcagagcctgtccgccctggccagcctcctgctcgtccagcagggctgtgcctgcctggtcgaggagggcggcaccgaagtcctcctcatggcgctctgcagccaggacgcgggggtggcagcagcctctgcatccgccctccgagccctgtgcgtgcaccgccccctccgtgaccttcccccggcctgctgcttggcactgtgccgcctggtggcgcaggctggggcggactctgtggcccccgcccacgtcatggccgccgtggccagcagtcccggccccgcgcgggcgctggtcgccgccggcgcggtgccgcaccttgccggcctgctgggcatgcgcggcgcgggcctggcgcgcacgccagtgctccaggcgctggcggggctggcagcgggcgacccggaggccgcgcggcagctggcggccgcgaagcccgcggtggatgcgctggccctggcggcgcggaacggggccgaggcggcggcttcgcggtacaacgccgcggcctgcctcctatactgctgccccgtactacaggagcggcagggggaggctgagaagcaggccctggtgtgcagaggtttctgtggattgggttggggaggtgtatgtggggggggggaaggccgagagtgccccgccacctttccagtcggtatccatggcctgcgnnnnnnnnnnagggtgtatgtggggggggaaaggccgagagtgccctgcacctttccagtcggtatccatggcctgcggtctgttccacagtatggagtacccctggtgcggcacgatcatcctatagtagcaagggtcacatgccatgctgtccgcgtccccgcacctgaccctgccccactccccggcccaatcccacagagcttgcgctgctgcgtgctgtccacgctggtcgccctgcttgactgcaaggagcctctgggctgcgagcgcgcgctcctcctcctcctgggcacggatgcctcgctgctggccgccgccgtggatgccggcgcggtggcgcggctggcgggcaaggtagcgcgctgcgactgccccccgcagcacctggtgagcatggtgttgggtctcgtggctgtgctcttgggtgtgtgggagccttataagtcttccagaaccgcattcattctcgctggagtgcggactcgatggcctgggccatttcccgcccccctgaatgcgaccctggccgacccaccggctcacgctttccacctccaacccgcctccagcccgacgccctgcggctgctgagcgagctgtgctcggatgaggaggcccagcgtcgtgtggtggaggaggcgggggccctgccccgcatcgcggcctcccttgccccggacagggagcaggaagagcgagcagcagccgtgcacctggtccgggtcctgtcccgcagcaccaagctcctcaggtgtgtgtgagcctgtgttgtggggcgtgggtggggggggcatgctgacgaggcaactatggtggggctgacgcacggtggggccctgccacatggcgccaagcctgccagtgtcctctgttcaacctggcaccgctcaagtgatggcccagcagcccggcgtctcccctccccggccagctgtctgctcccatcaccaaccacgcgcccaaccctgcccgnnnnnnnnnnnnnnnnnnnnnnnnnnnnnnnnnnnnnnnnnnnnnnnnnnnnnnnnnnnnnccccacacacacccatcacaacgagctgcagggggggcttgggcccgctggacctggcccagcccctgctggcgctgacgcgcgagggcggcgacgccgcggccgccgcggccgccgcgctgtccaacgcggtggcggagcccggcccggcgcgcgaggcggtgctgcgcgctggcgggctgcagcgcttcgtgggcatgacgggagagcccgcgctgcgcgcgttgggcttctgggcgctgagcagcctggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcggccaaggcctggctgctgctgcgcaacctggcgcacgccagcggcgccacgctggacgacgcgcggcgctggagcggcggcgagctgctgggcctgctgc

SEQ ID NO: 42424 - DNA, 76 bp, Chlorella protothecoides
tcgtactgcaagttccggtcccccccccccctccacacaccccgagatgtctcacctcgttcaatgggtacgcttt

SEQ ID NO: 42425 - DNA, 61 bp, Chlorella protothecoides
ctcctcgaccctgagcccttcccacgcgacacccccccccccaaaaaaactccacaccttg

SEQ ID NO: 42426 - DNA, 116 bp, Chlorella protothecoides
ctcgcatcccttccccatccccacacccccacaccccccactctggtcaggtccccctgcgccacgctgctgagctggcgtgtggaggctccttgaccctgggccgcgacggcgcg

SEQ ID NO: 42427 - DNA, 61 bp, Chlorella protothecoides
ggccacgctgggcctgcaggactcgggccgcccttccactccgccgcagagcgccgagccg

SEQ ID NO: 42428 - DNA, 42513 bp, Chlorella protothecoides
  modified_base (414)..(423): a, c, t, g, unknown or other
  modified_base (481)..(490): a, c, t, g, unknown or other
  modified_base (627)..(636): a, c, t, g, unknown or other
  modified_base (2199)..(2208): a, c, t, g, unknown or other
  modified_base (2457)..(2466): a, c, t, g, unknown or other
  modified_base (2865)..(2874): a, c, t, g, unknown or other
  modified_base (3502)..(3511): a, c, t, g, unknown or other
  modified_base (3598)..(3607): a, c, t, g, unknown or other
  modified_base (3686)..(3695): a, c, t, g, unknown or other
  modified_base (4861)..(4870): a, c, t, g, unknown or other
  modified_base (5284)..(5293): a, c, t, g, unknown or other
  modified_base (5412)..(5421): a, c, t, g, unknown or other
  modified_base (5474)..(5483): a, c, t, g, unknown or other
  modified_base (6815)..(6824): a, c, t, g, unknown or other
  modified_base (7019)..(7028): a, c, t, g, unknown or other
  modified_base (7687)..(7696): a, c, t, g, unknown or other
  modified_base (7824)..(7833): a, c, t, g, unknown or other
  modified_base (8152)..(8230): a, c, t, g, unknown or other
  modified_base (8588)..(8597): a, c, t, g, unknown or other
  modified_base (8816)..(8870): a, c, t, g, unknown or other
  modified_base (9077)..(9086): a, c, t, g, unknown or other
  modified_base (9832)..(9841): a, c, t, g, unknown or other
  modified_base (9931)..(9940): a, c, t, g, unknown or other
  modified_base (10782)..(10791): a, c, t, g, unknown or other
  modified_base (12079)..(12088): a, c, t, g, unknown or other
  modified_base (12372)..(12381): a, c, t, g, unknown or other
  modified_base (12865)..(12874): a, c, t, g, unknown or other
  modified_base (13101)..(13110): a, c, t, g, unknown or other
  modified_base (13360)..(13369): a, c, t, g, unknown or other
  modified_base (13897)..(13906): a, c, t, g, unknown or other
  modified_base (14015)..(14024): a, c, t, g, unknown or other
  modified_base (14767)..(14776): a, c, t, g, unknown or other
  modified_base (15084)..(15093): a, c, t, g, unknown or other
  modified_base (15274)..(15283): a, c, t, g, unknown or other
  modified_base (15926)..(15935): a, c, t, g, unknown or other
  modified_base (16864)..(16873): a, c, t, g, unknown or other
  modified_base (17425)..(17434): a, c, t, g, unknown or other
  modified_base (17828)..(17853): a, c, t, g, unknown or other
  modified_base (18316)..(18325): a, c, t, g, unknown or other
  modified_base (18833)..(18842): a, c, t, g, unknown or other
  modified_base (19087)..(19096): a, c, t, g, unknown or other
  modified_base (20124)..(20133): a, c, t, g, unknown or other
  modified_base (20767)..(20776): a, c, t, g, unknown or other
  modified_base (21901)..(21910): a, c, t, g, unknown or other
  modified_base (22252)..(22261): a, c, t, g, unknown or other
  modified_base (23159)..(23168): a, c, t, g, unknown or other
  modified_base (23332)..(23341): a, c, t, g, unknown or other
  modified_base (23942)..(23951): a, c, t, g, unknown or other
  modified_base (25023)..(25032): a, c, t, g, unknown or other
  modified_base (25218)..(25227): a, c, t, g, unknown or other
  modified_base (25327)..(25336): a, c, t, g, unknown or other
  modified_base (25508)..(25517): a, c, t, g, unknown or other
  modified_base (25740)..(25749): a, c, t, g, unknown or other
  modified_base (26878)..(27024): a, c, t, g, unknown or other
  modified_base (27106)..(27115): a, c, t, g, unknown or other
  modified_base (28587)..(28596): a, c, t, g, unknown or other
  modified_base (29333)..(29342): a, c, t, g, unknown or other
  modified_base (29579)..(29588): a, c, t, g, unknown or other
  modified_base (29866)..(29875): a, c, t, g, unknown or other
  modified_base (30198)..(30207): a, c, t, g, unknown or other
  modified_base (30289)..(30428): a, c, t, g, unknown or other
  modified_base (31454)..(31463): a, c, t, g, unknown or other
  modified_base (31671)..(31842): a, c, t, g, unknown or other
  modified_base (32493)..(32502): a, c, t, g, unknown or other
  modified_base (32697)..(32706): a, c, t, g, unknown or other
  modified_base (33133)..(33142): a, c, t, g, unknown or other
  modified_base (33372)..(33381): a, c, t, g, unknown or other
  modified_base (34214)..(34223): a, c, t, g, unknown or other
  modified_base (34862)..(34871): a, c, t, g, unknown or other
  modified_base (35817)..(35826): a, c, t, g, unknown or other
  modified_base (37193)..(37202): a, c, t, g, unknown or other
  modified_base (37394)..(37452): a, c, t, g, unknown or other
  modified_base (38299)..(38308): a, c, t, g, unknown or other
  modified_base (38474)..(38483): a, c, t, g, unknown or other
  modified_base (39214)..(39223): a, c, t, g, unknown or other
  modified_base (39375)..(39384): a, c, t, g, unknown or other
  modified_base (41620)..(41629): a, c, t, g, unknown or other
gtcggcgccgtcgccggcctcgccgtgcaggccggtggcagtgggcccgcccctggacgccgcgccgggggcggccacggagtcggcgggtgaggcgccgccgccgcccagcccgctgctggtggccgccgaggcggcggccatggtgctccgcaggttgaacgtgcgcagcggctccagcgagccgggggtccccgccagggccacggagccgacagcaaagtcgtcgtcgtcgtcgtcgtcgctgcgcggcaggggggtgatgggtttggtacacgactgagctgctgggcagggaccatggagatgagaggggtcatcatgtttgaccccatcccacacccaccgaccacttccatccctccccgcacccccacctgccatggcgcttgcgggagcgggaccccggcgggnnnnnnnnnnatcgtcatcgtcgtcgctgcgcggcagggggggggatgggtttggtacacgactgagnnnnnnnnnnggcggggctggggaaggcggcgggggtggcgggtgaggcggacgcgttcagcgcccgcgccctcgccgccgccgcctgctgctgcggcctggccggggccgtgcctggtcgcggtgagggccgggagggcccgggcnnnnnnnnnnttgatcccgcacccaccgaccacttccatccctctccgcacccccacctgccgtggcgcttgcgggagcgggaccccggcgggcggcccctgcgcggccggggctgcggcgcggtcgccggctcggcctccaggccggcactggccggcttggcgacggtgaagcggacgatggggagggagctgggtgcccgctggatggggcctgcagggctggggaatgcggcgggggtggcgggcgaggcggatgcgttcagcgcccgcgccctcgccgccgacgccgcctgctgctgcggcctgaccgaggccgtgcccggtcgcggtgagggccgggagggcccgggccccagggccgacggcgtgtgcagaccatgtgtgctgagcttgatccgcttgggggtgggctggccgggggaggggcggtggtcgggggggcgtgggccggtcaggcgggacggcttcggcttgggccgaggctgctgcacgggcgtgtgggccgggccggtccccggcaccttgatcttgaagcggaacccgggggtgctgcctgccgtgcccggggaggggctgacgtcgtccgttggtcgcggcgtggcctcgtttgccggctggggtcccaccccagaggtgggcccggggctcgacccatccgcaagcggatctagcgggggctgggtgggtgggcgaggggttgtggaaccttcgggagccttgccaagggtgatcttgaacttgaaggcacctgacattggccctgccccgggtcagcgcatggtcgcaggaagatccagcgaggcatatctcgacgctgtgcgtggagggtgcgcgcggggagggaggggtgtcgccctctttccacagccattccctggcccggcgcgcgggaacgcttccgggaggtttccgcgggaaagcgaagctggaggttcacactgcagcagttccctcaaatgtctgtactgaagctggaaactccagaggatgcaataaggtctgcaatgctcctgtccccaggccctgccctgccccggccttgctcagagcacctatgcaggggactgcacagactttgccatgcatctaccggtgcacagcgaccatgcctcattgatacccacccggccaggcagccatggggtatgttgtgggatagtaggcctgcgcaggaccggggtctgggggcagtggcgggaggccctgcatgttcgctgccggggcgtactgctggggcaggggcggatatggcgctgggggcgcctggtacgccgacgctggctgctgactcacatccccacccggccccgcatatgtctgcgccggcgcccacccctgctcctggctcccatgccaataaagcgaggggtggggggggtggctgagcatggggccggcgtgcccaccagacatggagccggcatgcatgccgttgccgggcggccctggtgcagcatacgcgccgccgacgggccccggcggcacggggtagctgctggatccgggacctgtgtgcgcactctgcatggggggcgggtgctgggcccattcctgcccgacgtactgccannnnnnnnnntgggacccgtgtgcgcactctgcatggggggcgagtactgggcccattcctgcccgacgtactgccagccgctgggtccgtatcgccaggtcccctggtctggtggaggcgtgcttgcagctggcccccgttccggcgtccaggaaggaaggggcggctgcgtcgggtttcctacagccggggccgcacaatcagtgccgcactcccaagcgcgggcagtcccggggctgacgcggcccggggtccccnnnnnnnnnncggggtcctgcactcgaggccgcacgatcagcaccgccctcccaagcgcgggcggtcccggggctgacgcggcccggggtccccgtccgcactgcgaccccggcgcggccacatgaggcatgcgccacctgggaccgggcggcgggccgccatcgctcggggtctgcgccctccgggatgggggcgttgaccccagggaaggccggcacctgcagggacagagctgcggcgggcgcgggcgccccatcgctcggggtcgccagggggatgaagtcgtcgccctcggctccagggcgttgcagatgacctggcgcaggtgacaggctgccagtcccgcctgcagggctgctgcggagcgcttcgccgtcgcactcaagcccgctccccccttcagtcatnnnnnnnnnnctgcagattacctggcacaggtgactggctgcgagtcccgcctgcagggctgctgcggagcgcgtcgccgttgcactcaagcccgctccccccttcagtcatgccgccgccagtcggacccagcgcccccgaccctggatcgtatgccggcggcaggcccagcacccgcatgcgatgcagccaggggggcgggtccagcgcggacaggcccagcacccctcgcagctccgccgacagctgccccggctgggcctcgggaaactccttggccaggccagactctttgctcgggcctgccgcgccagggccgccgccggtgcccctgctctcgggggccccgggcaggaagtagcgccggggagcggcgctgtagctccccgcgcttgaggacctggcggggtatgtggggagcagcggtggtttttgcatcagcggggcttgcaggtgcagcgccagagcctgcaaggaccccacaaattggagaccctgcacacggtggccgccccctccctcctcccattgcgcaccccacctggcctcccgagccgcctggacggcatcggcatccatggggtgccagcactgcttcagggtgtgggagtagctgccgcagttgaagcagcgcggnnnnnnnnnncttgcattagcggggcttgcagctccagcgacagagcctgcaaggaccccacaaagtggagaccctgcacacggtggccgccccctnnnnnnnnnnggcacgccccccccgtccccggcggcgccgtcctgcgcgccacccagcgctgcggcagaccgcttctgccccgccaggnnnnnnnnnnaggcacggcccccccgtccccggcggcgccgtcctgtgcgccacccagtgctgcggcagaccgcttctgccccgccaggcgcaggggccggccgggcgccctgtcgtacgcgggcaccgccccgtctgcgctctggaagagaaaggcagcacggtgcgcgatggaattgatgcgtggcgtttgtgggacagccagcacaggagcagggttatttcaaggtgtctcaactggggtgcacaaccatggcgtggcgccaccgaggcggcatcattcagtcagcgcgggggggggggggggggggggggggggtgacgcctcgctgcgcccctcccccactctacccagcatgtaccttctcgtactggatgttgaaccacagggtgtcgacccctcgccgtgcggggtctgccgggacatcctccaccgccggcagctggtcggcgtccctgggagccaccagcccagggtcgacggttagggtgccggacgtggtgtcgggagggacgtagtcctgggtgggggttggaaagggcccgggctcgacagcatgcgcacggccggtgctcctgcatgggccctccatttgagcaggggatcccctttcaccagactcagcccacgcgggaacacacctcgaggtaggtgtcccggtgccatctggcccactctttcagcagagcatccagcttcgtcctgctgtcactgcaatcaccggtaatggagggggttgtggaccaaatcggtgcacaaccactgtgcagagcaccgacacgcggcactgccctcatacctgggcaggttttggaaggtcacagtgagtcgtgcaggtggggcagcgcccttttcggcatacgatcgacggggccgacgctctatctccgccatccccgctccggcttggggtggcagatgtggcgacgacgcggccttccacccaatcaggacattgttttgactccagttctcaatataattacaacatgtataccagttgggggggggggtgctggcggtggtgatccgcaggtgcgactctcttcggtcggcttcagaggggggcggcacgaaacaactcacttcgaaaatggtcttgctctggtgcgcactgcatactccttccgcaatccttggattacaatcattgcaatcttcgtcaggagagattnnnnnnnnnngttgactccagttctcaatataatcagaacatgtatactagttgggtatgctgctggcgctggggtgatcgttcgacatgtcggaggggagggggacggcactgctgccatactccactttgtccccaccccccggagttttaacccaaactgcacagcaattcctagggaactgccggcgatgggaccggctgcatcagtgcttccatggccgtcagccatctgtggatcactgatatgcactattcaccccaccagtggggctagaaagtggcaggacattttttgcatcagatgagaaagggaaggtgttaagtctgctgctgaggcattggcgcatctgtgcgatggggagcctataaaggagccctgcatacccgatgaccccgcccgcatgacacaccgcccatctcnnnnnnnnnngctgcttggcctttgccaacttactctgccacatcaggagcccaggagtttctgtttactcgaggctgtcgattagaaaaacaactctcttcgaaaatggtcttgctctggtgcgcacnnnnnnnnnntataaaacgcagcatgacagcctggactaagccacggcaaacaagggctcaannnnnnnnnngataagacacagcatgacagcttggactaagccacggcaaacaagggctcaaagggcgttgatgaaagctttcaacttggcctgcacaatcgggtcggtgtgctcattgagtgctcgctggctcatgacctgcttgatccggttcatggagagcttcacctgcacgttgtggaaccaaacgtacggatttcctcagtatggccctcgaccttgcagtgggtagggaaagagcagcacaactccctcctcaggcacgcccacataccttcttgtagcgtgtgatctccggcatgttggtcttcagatgttggtgcatcatacgctcggcgtgcagcctgttgcgctccttcaggagcacaaaccagagggcgtgcaggtcgtcccagctcttcaaccgcagctcagcggcctcccatgcccggcctgggaaggaggacgtcgaacaaggtgccatgcaattctcactcgaaagtagcaggcatcagcagacctgctccccatcaccctgccccacggacctgctttgacgaccgcctcgccctccttaggggccttgacgatgagctcctcgagtccacgcacaggcgcggatgtggaaagcctggcgcagccccgcagagccgcgaggcacggtgcttgcctcaagctgtgggctatgcctgccatccgcaacccgcagtgggagcccgagccgatggaggtgcgagcctgcaggggcgactgtcttcccacaacgccaagagaggatcctagacctagggtgaccaccctcgatattacattagcaggtatgtgtgagcagggtaccggccagcccatctttgcgcccagaatgcctaatgctgaacgggggtgctcggcgtgctgggcacgacgtacatgggggcccggggtggggagtacttgccatgcccacgctcgtcccacgatgtgacacatatttggcaaatgaattgccgtaacggcagcctttaaaaatttgggaagaacttggaaggatgatgcggcagacctcgccggtctgcaccaccagcgggagccagggctgcgtgggccctgcctcggcatgccgcgcctccccatctccccgccccagcctgccgacacctcgcccctggacctctagcccccaggcatgctccttcctgccccgggcagagcaccagcatcgctgttgttacaccccacgtgccagtgccaggcctgggcccgtcgcctcagcaggtgggtgattgggcgcctggggattgtatgccttgatcctggatgcccagatggttacccttgaagtgcattgctggtacaggaagcattgcgatatgcacattcgcnnnnnnnnnnggcctggggattgtatgccttggtactggatgcccatatggttacccttggagtgcagtgcggctacaggaagcattgcgatatgcacattcgctctcccaccgcccaccttcagcaagtgtccatccccaccctcccccatgccccccccagagctggagcgggccctggaggcggacctgagcttctcccccnnnnnnnnnnacatccccacccaccccatggcccccccagagctggagcgcgccctggaggcggacctgagcttctcccccgagttctcgcgcttccgggaggcggccaagtccggtaacctcgtccccctgtacgagcgcgtcttctccgaccagctcacccccgtctccgcctaccgctgcctggtccgcgccgacgaccgagaggcaccctccttcctctttgaatccgtgatcaacggtacgcagcaggggcggtacagcttcgtgggggcgcacccgtcgctggagatcgtggcgcacgccaacgcggtcaccgtgctggacaacgaggcggggacgacccgtagcttcgaggccccagaccccctccaggcaagggagtggatgtgctgtttgaatcggggtaaagaatggtggggaggtagagaaagtgtttggcttcgagacgctgcatgcttttctgttgcagtggtgctcggaatgtgcagcggtctacatctcctttatcctgcagaattccatggtggtgcttgcagcagtatactctaggccaacatccctccctggacacctgtgcagcccgctttcgcagccatcttccctttcctcgcccaaagtcccttcccaaccacactctccacctcagtaaccccccgcccccccccnnnnnnnnnngacactctaggccaacgtccctccatggacacctgtgcagcccactttcgcagccatctttcctttcctcgcccaaagcccctccccaaccacactctccaccttagtaaccccccccctcccccccnnnnnnnnnnccaccagcgcaggtagcgcaggacatgtcagcgccctggtcccccgtcatccccgagggcctgccccccgtcttcacgggcggctgggtggggtacgccggctacgacacggtgcgctacgtctacccggccaagctgcccttctccgccgcgccgccagacgaccgcggcctgcccgacctgcacctggcgctgtacaacgacgtcatcgtgttcgaccacgccaccaagctggcctacgtcatcgcctgggtgcacttgggcgcgcacgcctcgcccgaggccgccttcctggcagggcgcgagcggctgggcgccnnnnnnnnnnnnnnnnnnnnnnnnnnnnnnnnnnnnnnnnnnnnnnnnnnnnnnnnnnnnnnnnnnnnnnnnnnnnnnncggcgatgctgggcgcgcgcgtgaacatgtcgctgggccagcgccccgcactctccgccgccacctccaacatgaccaaggcccagttcatggccgcggtggagcgcaccaaggagcacatccaggcgggggacgtgttccagctggtgggcagccagcgcttcgagcgacgcacctttgccgacccctttgagatctacaggcaaggggggtagtgggggggaggttggatgggtggatggaggggggagagggtgggaagggaagggtgtgcggccagctggggtggtcgcagggatgcccgcggggcttgcaatcagtatgataaagctggaagggcacaggggtgtgttgttgnnnnnnnnnnggtgggggaagggttggatgggtggatggagggggggggaggtggaaagggaagagtgtgcggccagccggggtggtagcagggatgcccgcggggcttgcactcagtaaagtaagctggaagggcacaggggtgtgttgttggtgtcagcagtaccaaaaccccctatgctcacgggcgcggattgccccatcccccctgcccaccctgtccgcaacnnnnnnnnnnnnnnnnnnnnnnnnnnnnnnnnnnnnnnnnnnnnnnnnnnnnnnntgaacccctcgccgtacatgacctacctccaggcgcggggctgcattctggtggcctcctccccggagatcctgtgccgggtgggcctggacggcactgtcaccaaccggtgcgttcagcaggggttcgctggtggttgtcgtgttgttgggtcttgtccatccatgtgtgattgtcctcctggcacggtgctttccctgcgatggnnnnnnnnnntagcagggggcggctggtggttgtcgtgctgttgggtcttgtccgtccatgtgtgattgccctcctggcacggtgctttccctgcgatggcaaagccgatgcatgcctggaagtcggcccccacgatcgaggactccctcccactcacgtcggacacggcccccccctcggtcgccagcccgctggcgggcacacgcccgcgcggcgccacccaggaggctgacgaggcgctggaggcagacctgctggccgacgagaaggagctggcggagcacatcatgctggtggacctgggaaggaacgacgttggtcgcgtggcccggcacggcagcgtgaaggtcgaggcgctgatggaggtggagcgctactcccacgtcatgcacatctcctccacggtgacggggcgcctgcgcccggggctgaacgcctgggacgcgctgcgtgccgccctgcccgtgggcaccatctccggcgcccccaaggtcggttagcttgttgcttactagggggaggtggggtgatgagggagagtgggtttccttttggaggcatggagagtggagaccggggtgcggaaggaaggaaacggtgtatgtgtggggggtaggggggtaaggaaggatagtgaaggggctgccgagcacgaggtcagcgcccaggactgcccggacgtccacctccagaggcccttcagcggctccccgtttcagtttgatattacatctgcaatcccccccccccccccnnnnnnnnnnagggtgcggaaggagggaaatggtgtgtgaggggggggtgagaggggtaaagaaggatcgtgaaggggctgccgagcacgaggtcagcgnnnnnnnnnncaggtgcgggccatgcaaatcatagatgagctggaggtgacgcggcgcgggccctacggcggcggcctgggccacgtctccttcgccggcgggctggacatggcgctcgccctgcgaaccatggtcatccccacctccagccagacctcgctgtaccagtatgggcgcggcagcgccggggcgccgccgcgccgggagtggaccgtgcacatgcaggtgagggtgtgtatctgggagggaggctgcagggtgtgtatctgggagggaggctgcatgggaggagaggcaggaggcaggggctgcagggccggggcgggggcggcaagtccatgtcgctgcggtgcgacccggctgcaccatgctccagcccatcaaggcccccctgccctactcatggccccattgctgcagtctggggctggttttgtggcagactctgacccggagaaggagtgggaggagaccgtgaacaaggcggcggggctggggcgggccatcgacctcgcggagcaggcctttgtcgggcaggcgggccgagagcaggagggatgaggcgcggcaggggagcgttccccgggaggactattgtcacccgtgcttctgctcggcagccgcctggatgccctgcacgccaaggattgctcgcactgtacaggctcctggtggcggggagtgtctcattctggcatcgagctggcttgcccattgaaacccacagtctgtgcacacggttctgtccgcccacatcacaacccccactgccagcgtcgtagtctttacaggtcgcgaacgggacgggggaaggggcacctgtcatgaacgcagcagcggtgcatcagcgnnnnnnnnnncttccgtccgcccacatcacaccccccactgcgagcgtcgcagtctttacatgtcgcgaacgggacgggggaaaggggcatttgtcatgaacgcagcagcggtgcatcagcgcttcatggctgcgcgccgcgctttcccgggcctgttctggctggggccggcaccgcccttcttagccgacactcggctcctccccacgccaccctcgcccctgccgccgccgcgcccgccgccgcgcccgccccgccgcccgccggggctgtcggggcggcgtgaggggcggtagccgtccacgtcggcagaagagacggcgtcgttctgcttcagcagcctcttcttgcctccaaatcctgtgggagaggtggtttgggataggagtggtacgagaatatcagatcgtcattgaccgactcaatccagagcagaacctgggccttctctccacccccctgctcaccaaacttggagtccttgcgcgcccgcttcttggtgatgtcgcgtggcttgaaccgctccccggggttcttggccgacgccctgcgctggctcatgtcgtccagggcagcatctacgtccagctcaccctcgaagccctgcagcgtgtgatggatatgaccgggtcaagtgtgcgcacagccagcgggctgtggggagctggtccaagttcaaccgctggcagcggggttgattgatgttggctgcgcccctagcaggcccaacgctcctgctagcatccgccagcacccctgtcaccatatcagctccagccccgccggctgcccccttctactcctctgtcctctgttcccccgccgccaaccctaaaccatccccttctccccacaagacatgcagaaaggacaccatcccccaaacagaacatgcccacgcaccgactgcttgcgctgcttgcgcagcttggacacgtctgagatggaggccttcttctcctgcgcccgctccttcttcttctccgcctgcacctgcttggcaaagcgcttggactcgcggtccttcttccgctgctccatttcggtcaccagcttggactggtgcagcatctgctccttgatcttggccatgtgctcgtccgacttgaccatctccgcgaggtagtccggcggccgggcccaggcctggcccgccgcctccatgcgcgcgatggcggcctgcgtggccgccgcggcctggttgtagaaggccagctcccgctcgaggtcgtcctccacgttggcgatggtggtgggggcctcgcccgtgatcaccagcgtctcctcccaccgctcnnnnnnnnnnatcctccacgttggcgatggaggtgggagcctcgctcgtgatcaccagcgtctcctcccaccgctcctgctcgctccacccaaagtcctccagcttctcgtgcagcacatctgcattgtaaataacctcccgccccgtggcctcggcagcctccgctggcccgacctgtgcagtgggggtcggcaccgggatgggcaggccgctggcactgagagggtccaattcgcgaggcgccacgcccatgttctgcaaaacagtgcacaccgggcgagcaccgcagcggnnnnnnnnnnggaggcgccacgcccattctgcaagacagtgcacaccgggcgagcaccgcagcggcccgctcgtcaccagggccaagggtactgccaggatgtgcgaataacagttgcaacacgtcgatgcgagctcacctccgtgtcgctgtagtccgactctgagctggaggaggtctcctccccgtcacgatacatggcggtgagtgtcgagggtggcccaggacgccaatgcgcttgggatactacttaacaccaatctttaagtatggaagctggtttaccatgcgtacaccgcgcatgcatcctcatcttcctcgtgcaccgaggcatcgccgtgctcttggcgccctgcgccgctgcgggttgaggcgcgaccagtgggtccgatcaaactcccatccgagcacctgccaggtctttttcgtagtgtctcaacgtcaacactactcaacaccccatagtatcgtcgacttgtcacagcgatgggcannnnnnnnnnaggtccgatcgaactcccatcggagcacctgccaggtccttttcgtagtgtctcaacgtcaacactcctcaaaaccccacagtatcgtcgacttgtcacagcgatgggcaaaaacagccgcgaggatcggtcacggtcaccatctccgagtagagctgcaggtacatgccggaacaagtgtgatccaggatctcctttgtggtggtgatcggccccaaatcttcacnnnnnnnnnnttctccgaatagagctgcaggtacatgccggaacaagtatgatccaggatctcccttgtggtggtgatcggccccaaatcttcacacctctcaccatgcagacaagaaggaccacaagaagcacaaaaaacatagcaaggtaagcggaggaatgggaagtgcttgacagtcacattgtaggctgtggcaccttcaattcctgacaaaatgaccaatactgcagttcatcaactatccacccacagcacannnnnnnnnngtgggaagtgcttgacagtcacattataggctgtggcacattccagtcctgacaaaatggccaatacggcagttcatcaactatccacccacagcacaagcacaagagtagggacaattctgaggaacggttgttaagagaggccaaagccttccttaagaagcgtgagtcagcggtgttgttatgcgtatcttgtcatcttgtagtggcatgcatgtcgaggtatcgtgacctgccagtacatgcattctgatggagccgctgtccatgtgtcccaggtcttgagcaagacggtggcaagggtgcctctggtgcagcgacgtcctcccggcatgtctcagaccccagtacgtccaggccggtgaaaccctacaccggcagcttccccctgctcagcgaggacgattacttccagagaaatgcaggtgtgaaagggggtcccctgcactctcccatatgtgttgttttgctccgattcttttgaggtcatcagcagttggatgttgtgcatgaggtaatgttttgatnnnnnnnnnnattcttcaggtaggcgcttgattgggtggcaggggccacgccaggcgaatgagcttgagagcaggcagtgtcgcaggtcggcaatgaatcagattccccagcctccaannnnnnnnnnattgttttgctccagtttttcggaggtcatcagcaactggatgttgtgcatgaggtaatgttttgatcttggagccaatcttcggcttggagtttttgccacccctgcacggctctgccctcctcgcagagctctccacatggctacgagactcaaagcaaatgttcttcaggtaggtgcttgattgggtggcagggggcacgccaggtcgatgagcttgagagcaggcagtggcgcaggacggcaatgaatcagattccccagcctccaagaatggggtagtgaatctggaggcgtcagcatcctcggcacctgccatatctgcaccctatccctccactctctctcatctcgccacagtgacttggactcggagacggcccatgccttcttcagggactttgtgcgagagtggaactccggcgccctgccctccaagttctacaccggcatcgccgctgccgcgacgcagcggacgggctacacctggggtttctccggcgccgggacggcggcggccgatcgcacgtcggtgggcctgacggcggccatcgccgacgacatgaacctggaggcctcggcgcgcgaggcggcagcgggggaccggcgcgaggcggcgcggcgcagcgccgcggccgagcgggagtggatcgacgcggtgcaccccagggcagagggccgggaggcgcgggtggccgcgcgggtggcccgacgggaggagaagcgggcgcgggaggactccnnnnnnnnnnagtgcaccccaaggcagagggccgggaggcgcgggtggaggcgcgggtggcccggcgggaggagaagcgggcgcgggaggactcccccgagcacctccggctgccgggcgggggagatgtgctgggcggcggcgactccttccaggccgccaaggccaggcgagtcggtgcaggttctgccaggggcttggggggggactcgagcgcgaggcttgggagggacagcggactgtatcgctgaggttcctaggcctcgttctgggtaacgatcaagcatgacggacgcaatcttgcagagcacacgagcnnnnnnnnnnacggggacttgagcgcgaggtttgggagtgacagcggactgtatcgctgaggttcccaggcctcgttctgggtaacaatcaagcacgacggacgcaatcttgcagagcacacgagcccttggccacccggtccggtcccctcgcacgaaaccgcgcaggctcgcggcgtctcagggaaagnnnnnnnnnncggccacctggtccagtcccctcgcacgaaacccgcgcaggctcgcggcgtctcagggaaagcgcgcgcagaatgccgtgttgaagcacgaggcgctgcagcaccgactcgtggccgcgcaggccgccgaggacgccaagatggcccagttccgggcgctgctgggggcctctggcggcgccatccagatccccaagcgcctctgattgtggtggctggacacctctgtggtctgtgatgatggcggtcacctaccatgctggcatgcattggtgcctgatactgaaaacataccctgtgtgacatgacaagtacagcagcagcagtgatgatgagtaaagcagggcagtgcacaggggtgctgcagcacatgaatggtggttcaggggggggaggacgagcaagcggaagggtggagggcgtctcgctctccaggtggtgggtcatggaggggtcgggagatgtcagcgccctccctcggtcaaattcctggtccaagccgagtagtcccctgggacgctgcgaggcatcccaggtctcatgtccggctgcaccggccggtcctcgctccagagcatgccctcctcccgcgaccgctcggaaccccgcccaccccccgccgctccagtcatcgcgccgctgnnnnnnnnnnacatgtccggccgcaccggccggtcctcgctccagagcacgccctcctcccgcgaccgctcggaccccgcccaccccccgccgctccagtcaccgcgccgctgggcgcaggtcctcggaccggtcggcggcgatgcagtgctgctccaggatggcaggcatggcggccgcggcttcctccttccccagaatgacaacctggttgtactccaggtccaggcggatgtactcgcccgcgccgccctccgcggcggccaccagctcggccaggcaggtgacgcgctggccgttcaccgcgtgcacctgggtgttgacgatgtcttcgtaacccacattcacgtcggccgccagcacctgggccagcaccacgatctgctgcccgggcgcgtcggccatggcgtgcatcatcttgtccagcagcttcacgggcgcgtcgtagtcaaactccttaccgtactcggagcggagcaggggcacggtgacgggggtgaacaccaggccccctaggatgaagtaggagggcgggcggttgtggatgtgcacggggatgagcttgaagggggtggtgagggggacggtgacctggcgcgcggcgccctcgtgcagcacgtgcagcgtggcctgggggtggaaagtgagaaaagggtggggtgtgaagggtcagagtgtcttcgtgaagcttgtttctggagggaggtaaaggtgtagagagccaggctcctcctcatcccaaggatataaagacccatgcggtcagggaggccgcatgcactgcgggaggcagaccgtgccctgcaaagggacggtgtccggttcccaaagataggctgagccagcagttaaagggtcctccccgctggcaaaacccctccagaacacggccgctcaccatatcgcctgtgtacttttggctgatgaggtagctgaagnnnnnnnnnncgcgcgcggcgccctcgtgcagcacgcgcagcgtggcctgtgggtggaaagtgagaaaatggtggggtgtggagcgtcagagtgtcttcgtgaagcttgcttctggagggaggtgaaggtgtggagagccaggctcctcctcatcccgaggacataaagacccatgcagtcagggaggccgcatgcgctgcgggaggcagaccatgccgtgcaaagggacggtgtccagttcccagagacagactgagccagcagtccaagggtcctccccactggctaaacccctccagaacatggccgctcaccatatcgcccgtgtacttttggctgatgaggtagctgaagccgatgcgctcgccgctgcggaaggggaccgtgcctgccgagaggggggaggctgtcaccagggctggcatcagtagcccgtgccggcgtcgtggaccctggagagagtcgcaggcacggccccgcacgctgcccgtcaccccccagactcagtcagcatccccttgcatgaaaacgacaccgcagccgcccaccgtctgtgccgannnnnnnnnngtgtcaccagggctggcatcagtagcccgcgccggcgtcgtgaccaccggagggagtcgcaggcacggccccgcacactgtccgtcaccccccagactcaggcagcatcccctagcatgaaaaggacaccgcagccgcccaccgtctgtgccgatctcgatgccgtcaaaggccaggaggacgtccccctggcaaaccaccttgctgacgggggacgtgggctctatccggcgcaccatgacgccgcgttgcgagggctgcagccgtggtgagggttggggggtgaggggaattcctgctgtcagcaggcgcatcgtgagcgctggggctctccggacagacctcaaccagacgagatgtagcgggggggaggggggggggggggggggggggnnnnnnnnnnnnnnnnnnnnnnnnnnaatacataccacaccacttgtgagaccgcacctggccccctttgctgtctcttcccccaccgctgcgtcatcaaaccctcccacaaaccctgggtatctcctcccttggacccccacggccagacctgcatgccgagcgccttgcgcagcaccgggctctccatcttctgccactccacccccagggaggggaagcctgtgtaggcctgattccgctcgtagtcgttgatgaagtgctcgatgactgggcaggcgggagggaatgtgcaggccatcctcggcagcttgacgtgcaggctgacgctaccaagacatcaaaccctccatagcgacaggtcaactgcaggggagctctcagctggcacccttggacatcaagcatggcaaggcccccactcccaagagcccatacccggcgtggggatgatgtatgagatgttctccgcgtcctcatgtttgaggnnnnnnnnnncaggccccccctcccaagagtccacacccggcgtggggatgatgtacgagatgttctccgcgtcctcatgtttgagggactggaaggctatgccgacgcactcccctgcaggtgcaggtgggggacggtagaattgatggtctgagggaggcgaactgctgggcgtggcccagaggcacaccaggggctcacaggcatgggaaagcatccctctgtgtgttggccgccgttgtcccatgacaacagctttatcctgcctgaatcctccagcatgacctccttttccccttgacatcccacctctatcgctgaaggcggggccaccgctgttcccgctgttgatcgccgcatccacctgcggcatggagcatggatgggtctgtgatgacttgctcaaaacgaggccttgaaaactgatagtttgcacgccgatccctgcagcagaagacatggaaaagcacgcccttaacccataggagcatgcatcccgcacccttaaagtccctgnnnnnnnnnntttgaaaactgatagtttgcacgccgctccctgcagcagaagatatgcaaaaagcacgccctttccccatagcagcatgcatcccgcacccttaaagtccctgaccccccctctcccctattccaaccacttcccctattccaatcacttcccctattccaaccacttctcctattctcatccctccccacagttttaacccctccccacaatcctaccccccgccccctccccacaatcctacnnnnnnnnnntcatcccttcccacattcctaacccctccccacaatcctacccccgccccctccccacaatcctttaccacccccacccacagttcctgacccccccaccctccatcctctcagcctgcctgcacgcccagcaactcagccgccccatggacgtaggaggtgacctctatcctgctgaccacacccgaggtgacggacatggtgtcgccgccgatggggtacccgatcacggtgatggagtcctggaggcggggcagtgcgccgaagcgcaccgcctccagccccgcccagaagtcctcgtccgccacggtgagcatggcgatgtcgcactcctggcccaccgccagcacggaggccacatacttggcgtccgacccgcgccgcttgaccttgacctgggtgtggtggtccacgcagtgggcattggtcaggatgcggcgccctgccaccacaaaccccgatccggaggaggagaattggcgcttgcgttgccagggaagcgagaagttgggctcgctgtgcacggcaaagaccttgaccacggcctccatctccgcctcgcgcggcgaggcgccgccgtcgtcctccgcggcgtaggcctgcagggcggggggcgcgccctcgccgccgccgccacagtccagctcgctcagcgcggcggcggaggtggagccgggggctgaggcggccagccgctccttgcgccgcttgcggcccccctgcgtgggcgagccgggagcggtgtccacctgctcccgggcctggctgccggtggccgggccggagaggcctgcgggggtgcgccgcttctggggagcctgcgacctcgtcgatacctgtgaagaagggccgttagatgtgtctggatccagtgcgggcgactgtgcaaggctgcatgagtggtatttccggcgagcatgtgaccggggcaccccaccaaagtcgtctgcgacgaggccgtaccttttgtatggaatcctctggcagcttactcgcctgattcttgctccttggagccatgatcaagnnnnnnnnnncgtctggatctagtgcgggcgactgtgcaaggctgcatgggtggtatttccggcgagcatgtggccggggcaccccaccaaagtcgtctgcaacgaggctgtaccttttgtatggactcctctggcagcttactcgcatgattcttgctccttggagccatgatcaagtggcctttcaggtcctcgtgcgagatataggacggaatgcagcccttcggcactctgcgaaggcaggccccacaacttgcaaggtcgtactgccgtcagcaggcccgtttggatggatcagtgcaaactagcattcaaatggtatatgcagggcaatcatgcggctcccgagaatgctcaggcgttccaaagaggtgtcggtgctcgacctggcgatggggagcgcagcatgcatagcatgcgcgtcgagcccatctacatactcactaaatgcgctcttgaggcttgattggagaacacacttgataacatagtgttcatcgagcacaatgtcaccgcttttgagtttctgtatcggggtactgtctacaattgagcccataactgcagttggttgtttctccttcatgtatgcatgaacattccgtatatgactgtgagaacgccatcaagaagcatgtcatcnnnnnnnnnngtggatgtttctccttcatgcatgcatgaacattccgtatatgagtgtgagaacgccatcaagaagcatgtcatccgtcactttcatccacaagaaaccagttaaagacgcgcgcacgtctatgccagcaccgacggcaggttaattctgcgagcagtatagctctttggtgacagctgtctgaaggtgctgagaccaggggaaatgcatccttgttgggcaaattgctgacgacacagcttcagaagagaaccgttgtcgtgttgtcctgtggaaggatgcatttgccttatataggccaccccaagctcatgtgcagctcgggtcgcgacaagtcaggacgtatacttgaaaatgcgcgtagtctccacttgcatgcgttcagtgcattttgtaggtctatcatccttcaatttgagttcagtatgattgactcccgatgcccggggttttctaaatccaagatggtccatgcactcctgcccatcctctctcaaaggcatccaagggccggcgagatccacgaccatatgccaggtctgaagtgttgatcaccagatcagcaccgcaggggaagcatacttagaatagtaccaagagcccaaactctgatcttttcctgagttgactctgactgggtcgccgacctccccgtgttgggagaggcgcgatggctggggcttccgcctccctggactctgtggagtccgcatcgctattggacatgctccaatacctccgccaggtgactattcaccattcggttgcattgaggtcgtggtgtgcatggctatgaagagggagtggagccccgagtggggcgtggaggcacccctcggcttgaagcaccccctcgggccgtgctgcgtccactgatattgcctccctctggccctaacaacaggccagagagctgagaagtcacgactccgaagcagtggcacgctatggaagcaccatcctccgaaagtacgccaggaagctgaatcagactgagcgtgagtgggggcgtgctaggtgggcgaggttggatcctatatgtgccccagctgcagcgttgtcaggggctgctaaccctcctaccgactccctctatgcagtgtggctcatccacgagcagacggnnnnnnnnnntgctgcagcgtcgccaggggctgccaaccctcctaccgactccctccatgcagtgtggctcatccacgagcagacggcacaagcggcaatggacacgcacaatgagccgctggcactcagcatctcccagaacgtgttggcccgattccccaagggtgctcgcggcagccggctggcggtgcgtacggagggagcgtctggaatttccttttgaggagcacattttgtttccctgcctccttctcctgctgtggatggtgtggtctcaagccggtctccctgctgcttccatttgcctgcctcccccaatgctattcctaccttttccccaatttcgctgannnnnnnnnnaggtctccctgctggttccatttgcctgccacccacagccctattcctaccttttccccaatttcgctgacagggcatgctgggcgagagcgccgggcgcacctccgaggccacgcagctctacgccaaggagctggagctggacccccagaacgcgctcatcctcaagcgctcggtgggtatgggtgggaccagcaacccgatcacaacgagatccatgtagaagggacctgttgcgcaatgcatcgcccttgtctgctccatcgcatccctgggtggccctgggtgaagcatggacaccaccagaggccacgctgccccatccccgcctactgtttttccaagttctaagcaaccctctgaccacccaaaaataacccatgcttccatctccaggtcgccatgcacaagggccagggcaacatccctgccgcactcgcggcgctgcacacctacctcgcctcctaccagctggactggggggcatgggaggaggccgctgagctctacatccaggtgcggcctgagaggcggtggcagcatctgtctcacgtggccgctcctttgcccaggcgacaaagctccctgcatggccccgtgttcgacccctgacctgctccgcctaatgtgtctcaacccctatgcttcctttcttcccctccccaggcccagctgtaccagcaagcggtgttctgcctggaggaggtgctgctgcaccagcccatcgcgctggggacccacctgctgctggcagacacgctgtgcacgctgggcggaacccccaacctcctcaccgcccggacccactactctggtgggtgggggaagggggagtctgcagggggcaaggcttctgcatgtatcagctggtgaccgcttggactggccagggtgcatnnnnnnnnnngaggcctctgcgtgtatcagttggtgaccgcttggactggccagggtgcatccccgggcatggcccctttaagttgcgtttcccccggcacgccctacacgtgcaggggaatgagcactcccgcatcaccccgatgttcccctcctcctccctctcgcagccgnnnnnnnnnnctttaagttgcgtctcccccggcacgccctatacgtgcagggggatgagcactcccgcatcaccccaatgttcccctcctcctccctctcgcagccgtggtggagctgagcggcggccgcagcgcgagggccttgtacgggctcacgtatgtggctgcgcagctgggcgccgacaggaaagcgggaaaagggggcgaggaggcagagctggggcaggtcgccgcgcgggcgctgactcagctgtaccagcgcgaggcgctggaggcggagcgggccatgctggcaggcatgctcaaggcccagggccttgcggtagaggctgtggagggcagcaggaatgcgagcaaacgctgaaccttagttcccgtaccagaggcctgatgttgttcattccttgtcgtattgaggaggtccaggcgcggcgtgcccaggggagcggtgccaaagggtgggtggcgggtcaaagatccggtccagcaagcggccagggcatcgcaccctagcgccctcacccctcaatggcgcacctgctggcatgagtgccaaaatcttctgtatacaaataataataattgaaaacactcccagggaaggagggttnnnnnnnnnntgtatggtgcttccaggagcagggggggggccggtgtgcccagggagcgtggagggtcaaagatccggttaggggttacgcaagcgccctgagcacgatggcgcacctgctgccatgagaccgaatctgacaaatatcttctgtatacgaataataacaaattgaaaacactcccagggaaggagggttggggatcgtgactgcgccagcaaaggaagggtcgccatgaacgacacggaggtgggtttccggggccagcgtgtgtgcgtcgagcctctccgacctccctcagcggtaatactttatgtcggactccaaatcttctcatgtgctccccggcgctcccctccgcccactcccccaggtcacgaagacgatcgagcaaatggtccgcttcatccggcaggaggcggaggagaaggccagcgagattgccgtggccacagaggaggaggtgggtgtcgtcccctggattcagaacaggcccagcttagggtcacggtttgtgcaagcgtaggggggaagccaagggggaggaccaccccctgacactctgtcctgagccccaataacgccccagctcctctccaacccctgcacagttcaacatcagcaagctccagttcgtggaggcggagaagcagcgcatcaagagcgagtttgagaggagggaaggcgccattgaggtcaagaagaaggtacccttgggggtggagggagggtagcagtcaaggtgaaaagggcattgtttgccctagtaaggttggtcgccccggagaacatggtcgacatcttgaggcacgtgcctcatacattcatccatccctggatcgcaggtggagcgcagcaagcagctgaatgagtcacggttgaaggtgctccaggctcgcgaggatgcagtacaggtatgggtgggcagtacagcccgctccctcggccccaggcgcctggcatgtcttttgtcgcatccgtgtctcagcatgggccgatacaaggtgtcattgacaagggttcactccctccgtcctttccccatcactgacagaccttgctgaccgaggcgcactcccgnnnnnnnnnnatcattgacaaaggttcactcccttcttcctttccccatcactaacagaccttgctgaccgaggcgcactcccggctcgccaagctggcaaaggacaaggccaagtacaaggcgctgctcactgagctcctcatccaggtgggtactctgtgttataccgacatgccggaagccaagggctccagnnnnnnnnnngggggagcagtcgagatgaaaagggcattgtttgccctagtacggttggtcgccctggagaacatggttgacatcttgaggcacgtgcctcatacattcnnnnnnnnnnagagctcctcatccaggtgggtaccttgtgcagtaccgacatgccggaagccaagggctccagggacgcatgtgcgatggatgtccgaggctccccctccctgcggagaactggtgcggcctgcgttcacgccgcacctcgccagcacaacctcaccggcaccgcgcctgcnnnnnnnnnncagctgatgcggcctgcgttcaccccgcacctcaccagcacaacctcaccggcaccgcgcctgcagggctttgagaagctacgcgagccggagctgctggtgcgtgtgcggcaggtggatgagtcgctggtcaaggaggtgctggagagcgcggcggagaggtatgcggagaaggttggcgtacccaagccggacgtcagcatcgataccaagcactacctgnnnnnnnnnnagtatgcggagaagtttggcgtgcccaagccagacgtcagcatcgataccaagcactacctggccccccctcccgacggcaccaaggacaacgagggcgacagctggtgagtgggggatggatttctcggtttcctgcgccgtcctgctgcctgtgcagccacccaagccgtgctgggccctgctcccgccgcccgcttcaccccgcctcacacctcccatccctgcagctccgggggtgttgtggtgaccaccgcggactccagcatcgtctgctccaacaccctggacgagcggttggagatagtgtactcccagaacctgcccagcatccggaccgtgctctttggcgaggccaactgacggcccgccggccgcagccccctgtacagccttgtgcgcatcctttgcgtcccgccgagaccgccccatcttttaaaattctggcaggttggacaagggcaacgcaggcatatggagggtgattttgaaaaggtatactgcgtcaagacaacacccggcgttcatggggcacttgggtgatcgaggcagggaatctctgatttgaagggtacggccaagagaggtgtcggggcgaaggggttcaaagtgcctggctgtgctattccagaaaggagggtgggagtggcgttccatcctgagatcccagccgagctcgtgcagaaggggtaccaagggccatgatggtaatagtagcaagggggttgggtggaagtacaggcctagtgggggaactggaggacatgggaggggtgccagccactccaggccgcatgcccggcaagccccctttcagcagcaatgggagccctgggtgtggtggggaatgccgcagggcggccgacgctgggtctgaaaggggtagcaatcgggggcgaggaagcggtgacgacgcagtgtcatggaggccgtcacttcccacccatcgagcaggccctttccacatctcatggctgacaggagggaggcacgtcttggtcctggagtcatcagcagcacctcaacccacagcagcattcccggcccgacctggatcccagagccatgtccacagctggcccaatcgcgacaacaaccccaccctcacacccaccaggcttattatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcgggcggggtgcagcgatgcagtcgggggtgggatggggcagggcatggctcggcagggctggccccggcgaccccgnnnnnnnnnnactggaccccagagccatttccacagctggcccaatcgcgacaccaacctcaccctcacacccaccaggcttattatcagggctctcccggcccctgcgccgcgtcggccgcctccgagggagcttgcggggtcagtgcgcactcgtaccaggacccctgcaggggcgagttcatgccctggccttccacctcctcgccgcgtttcaggcgcattcggtacttctgtggaggggcgggcagggtgcagcgatgcagtcgggggttggatggggcagggcagggctcggcagggctggccccggcgaccccgcccagtgcatgcacctcaacacctccgtagctttgtcttctgcagcgccgccgagtggtgacgccgtgcttcctcattccctcccccccacccgcgcgaacaaaagctacctggagatggctggccacattctcccgcgtcagccccgtcacgcccatctcctgcgttgcccgatgggcaaagtgttggtgatgggtgccaggatggcgacggcacagcacagacccacagcggccaagtttgggccgcaagaaatgcccccgcgcagccctccaagccctacaggcagcgcccagagcagcatgcagcgcctcaccttcatgatggccttggggggagccttgtccaccccgccgatggtctccagggcctcgaggaagcggcagtgcagcgcgtccgtccaaatcaggctgcacgggggaaagaaagggcggcatttggggggccatgcacggagccctgccagcgccagccttgaatgagcggctcgcccctgcctggagacactggacggccccacccctcataccaccagtcccccttcccccagccaatcgaataagcttctcaccgcggcctcttcaccgcacgcgcctcctcctcctcctcctccgcctcgtcggcgcttggcgggtctgccgctcccgtctggggcacctgcgccgacggcggggccatggactcgggcagcggtccctcctgcaccgggtcgctgcctgtggagtcggcggggttcgagggactggttgacggcgcgctcggaggcagtactgatggcgcactggcatggggcggctggaggggcgtggcagcacagtcctgctcatccctgcggcgccccgcgccgccccgcggcgcatgcctggcgccccgcgcccgtgcctggcgccccgcgcccgtgcctggaggcaggggccggcgtcaggatctcaccccgccgcagcgcaccccgcaagcccagctcaccaggtggcatgacggggtagggcatgtaccctgcaaactgcccgctgaaggagtaggggtactgttgataggggttgacccagtcgggcgtgtactgcatctcgtactgcttcatgtgctgccccgcctgctggtacgcggccgcctgctggtactgctgggaggcgtaggcggcctgctgctgctgctgctgcnnnnnnnnnngtaggcgcccggacgggaggccggcatgtagcccggaggaggcatgggggcgtagtcggagggcccggtgtcctccccagagccccagggggcgggggcccgctggggggcctgctgctggccgtacccggcttgcgaggcaggggggaacccgggcctgtctctggggccctgtccgccatgctggcgctcccgatcccggggacgggcatcgtggtgggtgtggttgtgggcgtacgtgccctgccccggcccgccccgccgcgagtgctcgagggcggtgtcggactgcccggagggtccctgagcgctggggcccaccgcgacatgccctgggagcaccctggtgccctcagcctccaggtccaaatcgaagcccctcgccagggggaggggcagcagggaggtggacaggctcacggttccgtccatactcgggtggcacgagggccaaggggggaacagctcggccaacggccctgtggaggtaaagtgcggcggatgacgccgatgcactcactgaggaggcatgatgagagacatcgtccgtagaacggcgccctcgccccgtttatctccatgtcgcaaggcgaggcagtaccccactccctgatcgacagtattcattcccaaagtaggaacgcatgggtccatttgcaaggtgaaggtgaccttcacgtggtagggccaaatatcttccatgtttggcattcggtcattagatcaactttcatttnnnnnnnnnngcatcacgtggtagggccaaatttcttccatgttcggcattcggtcattagatcaactttcatttgtaaaacctgccaagggccatgctcactgcggttggaaggatagttgcatgggctggggaccttatatcatacaggaacccctgaacttccagatgcgacccacacagcacgatttcgatatgttaacttgcagtaactccccaccagcagtgggcatgcggcttgatggannnnnnnnnnctcgatattttaacttgcagtaacttccaccagcagtgggcatgcggcttgatggaccgttatccccggggtgatgctcttgccatggcaacaagctccacccagggcaagattctccatactgctgaggcactgcaaaatgagtctccacctcatgaggcccatcatctgcacggccttgggtgggtctggacaaagctgcatgtgtgagagttcgtgccatgcaagcttggaatttgggcacaggattatcccttggttgtaggttgcctacaatnnnnnnnnnnaaaagctgcatgtgtaagagttcgtgccatgcaagcttggaacttgggcacagaattatcccttggttgtaggttgcctacaatctgcaggtcgtgctccttacacctggcagaccaaacaaaactattgccatactcttatttcgcccccaataagaatgatatcataaagctgcagggtgttccgactgggtgtctctatgctccaggagcaatttggcagtgacaccctggctatcatatggtctgcttattcgcatggcatcaaggtagcagctgccaccggggaatctccctgcccggatagctcagtcggtagagcnnnnnnnnnngggatgttccgactgggtgtctttatgctccaggagcaatctggcaacgataccctggctatcatatggtctgcttattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtcgtatctttttgtttttgcgttttcgagtatcgaacacgtaatagatgttgccagcgcaggtcccgcaccttcacggccatcacccaaactcaatctaaagttcatcatggtgatgctcagcagcgcccctgccagcccccgggtcactcgcaagctgcctcctgctgcgcaccggtcccgtctccagcaaagcctcctgtgccacctcatcaggcagcctctgcccggctccacgggcaagcagccggtcccgtgccacgctccaaagcagctggtctcctgggttcagggtcgcgatgcgctccagcagcgccgggtccaggcgcttgcgggcagcgccgcccaaggcaaaagactcgtgccccgccggcgtgaacagacctgggaagcccgtgccgtcgctcctgcgccgctgggcgtgtcgctggcgtggggagagggatcctccgccctgccccttcgccgtctctcgctggcgctgcattgtggtagtgcttgggtgggggtgagatgtagaggaggaggccacgctgaggaggaggccatgctgagggggaggccacgctgagggggaggccacgctgcgcgcggccatggctcctgagaggcgcatcgctccaacaatgcgaaggtgtcaatcatgtgctggccgccgcccagccctcctggtctcgcaccgtttctcaacctgtcgaggcacacaagcctcacctccagcagaccatggcacggacccctgcatcccacacaccataacctctgtacagcatcaagcacccctccccacgctcaccctggcgcatcgcacaaaggcagggccgaggggctctggcaagaggaagtgccggtccggcacaacctgcacgctgggcccctgcgcctcggccaagctcgcgatgaccccggccgccctgagcgcctccaggtgggccgtgaggcgctcgacctcctcctgcttcttggccagcgcggcgtccagcgccgcgatctcttgcccgagggggctggccgccagggtcnnnnnnnnnnaggccacgctgcgcacggccatggctcctgagaggcgcatcgttccaacaatgcgcaggtgtcaatcatgtgccggccgccgcccagccctcctggtgtcgcaccgtttctcaacctatcgaagcacacaagcctcaactccagcacaccatggcacggacccctgcatcccacaccccataacctctgtacagcatcaagcaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggccgtcagacgctcgacctcctcctgtttcttggccagcacggcgtccagcgccgcgatttcttgcccgagggggctggccgccagggtccggccgggcgcgacccccagccactcctcctccgccttcaggatgtaggccaggcgcggctggaggagctggtgattaaggagcgtgagagaaggatcagtttgaatgacaacgcatccggctgccagcctgctggcgatggccttgggaaagcggttttgagcttctggaatcagtgggagcgccctccaacgccaggatcagcacccgagtggcgcgccgattggtgcagcccttgctcatgcacaccgacgcctgcacaggcacgaccagtgcagtggaacgacatgccacctaggccctcctgcccaccacaaccacgctcatgtcatcccaggttcgtccctaccgcctgggcctcccgtgctgcgatgaggctttcgtgcagggacatgaggtgccgcctcgcttccctcagcgtcatggtgctgggggcgctgggcgccgagacccccgcccgcgccgggaaccgcacggtcaggcgggcgtccaagttggccccctccacagggtcaaaggaccatgcccactcgtccgggttgcggtacgcgggcccnnnnnnnnnncggccccctcaacagggtcaaaagaccatgtccactcgtccgggttgcggtacgcgggcccctccagtgagatgcctgggtggtgaaggggggatgaacgtggtgggttgtgaggtgtggatgtcggcccgacgcggtcaacaccctccctggcgctcgagttccaccaggcgacggccggagcgaaaccctccnnnnnnnnnntggtgaagggaggatgaacgtggtggattgtgaggtgtggatgtcaacccgacgcggtcgacaccctccctggcgctcgagtttcaccaggcgacggccggagcgaaaccctcccaagcttccggacgctcacccagcgcgtccgcatgcgcctccacggaggcatgcagctgctccagggtgcccgccccagccaggccgtccaggcggcgggccgccagcgccgccagctcaacacgcgccggcgcatgggcgtggaagcagcggcggaggcgggtggcctcgccaccccagcgcgagacgttgctgatgcccagcagctgcagggtagcgccctcgtgcaccagctcccgcgcaatggggtgctctatccactccgccagcggcatgactaacgggttactgtatggctccagcgtcgccatgnnnnnnnnnnatgcaccagctcccgcgcgatggggtgctctatccactccgccaacggcatgactaatgggttactgtatggctccagcgtcgccatgggggtgggggcctgtggcggggaaaacagggaggccctgagttgaggagagggaggtggtgggggcatgcatctcagctctcttttaaatctacaagcaagtggcccggcggaagggggggtctgacagtgggaagctcaannnnnnnnnnctgaggagagggaggtggtggggacaagcatctcagttttctttgaatctacaagcaagtggcccggcagaagggggggtctgacagtgggaagctcaagtggccatgtggaacagtgcacccgtgcaatccacccagcctgctacccacggtgagggaggtcgcgttggtggacctgttccaccagtacacctgccccttcctggtcttgaacttcagccatgtggtggtgccatctctggtcgcctccttcctgagcccctccagctggggcagtggggatgtggagggggtcagtggcatggcgcggcagccctgtgtacctgtagacactcccagtggtgtacccaactctgataccagcagggcagcatgaaggttcagcacaattcccccgactctcagcaaggggcccaaagcaaggcagcacctcattccaagacgccctgacactcacgcgggcttgcatgttgcgcctgaaccaggggatgaggatggaccagggccagacctccatcgtgttcacatagttgaggtgctcaggcgcctggaggctcgggccctcccccccggcccccaggctctctgccgccacgctcacggcaaattcgtaggcgctgatcacgcgggaggtggggtccctgagctgagtgaccaccgccaccccaggctggagactctgtgccatgggggggcggaggggagggggttacaaggctggtgggcatggctgtgtctcaggcatggaaggggtgggctactgtgcgtgggagggtctggggctctcaggaggcgatgtcctaccaaacaccagccgagcacgctcacatccnnnnnnnnnnttgtgcatgggagggtctggggctctcaggatgtgatgtccgaccaaacaccagccgagcacgctcacatccaccaggctgtagtcatcgtggctggagatgaggccgcagctggggctgctgagggcaaggcgaggcccgtcatacgccttgaggcagcgctgggagggtggcacagctgacttgaggaagcaggagaaacacgtcttgccgccggtgcgggggatgtgcatgaagtacacctggctgggccgagtgccgttcagggcttgcttgtccagcacaggatgatcggctcggtatgctgcgatccaggcggcacactgctcgtcggatgggttcgtttcgagggaggcacggcagatcacggcctgggccgccgtgagcatcacgaggaggagtagaggtcgcatgatcgatgcagatcgagctggttattggcttggcggtgtggacatgttgccggtgcaacccacgaggacgctatcatgtgctgaaacacttgagcgtcaaattctttcacacacaccaaaacaaatcgagtctggtgacccggcgtcgtgcatgcgcaatatgtttgtcgccctgtcgagccgggaactcgaaagtcccacgtggttccagggcgcgcacccatcnnnnnnnnnnaacatgttgccggtgcaacccactgaggacgctatcatgtgctgaaacagttgagcgtcgaattttttcacacccccaaaaaatggagtctggtgacccggcgtcgtgcatgtgcaatatgtttgtcgcctgtcgagccgggaactcgaaaactcccacgtggttccagggcgcgcacccatcacacctgcctacagccaaagcgaaagccatcctcacctcagttccttgtttccatttgttatcgactcgttcaatcaacacacgccaagggggctggatgcctgggctacggctgtgatgggagtctaggcggggagcacgatgtccatacggcctgcctcttcccggcctccccaggcccctggggccaagatcgacttcaatgccctcagggcaccagccaactatgtgccgggactggggcgtggagctgcgggcttcacgacccgctcagatatcgggccgtccatgcctgcccccgacatggcctcacaggcatgcatgtttgtgcgcggaggtgcaggcatgcagcgaggtggtcaacatcatgtgttacatacactccatcggaatgcatgcgctgcggaggtttcctcacgcccaatcaacagtgcatccatgctcctggctgcagggcggggacgacgactccaagtttgatgagttcctgggcaacgatgggggtgtgctggccgggacgggggcctacgacgacgaggaccgggaggccgatgccgtgtgggaccaggttgaggaccgcatggacgagcggcgcagggtgagggcaggggggtggggacgggaggggaggggattgattcagggctcgccccccggtgccaccccactggcgcctcccccgcgtcgttaccctccttgaagcccgtcagcccgcgccttcctccccctctaatgcgcaggagcaccgcgacgcgcggatgannnnnnnnnntgcctcccccgcgccgttaccctcctcgaggcccgtcagcccgcgccttcctccccctctgatgcgcaggagcaccgcgacgcgcggatgaaggaggagctggagcgcttccgcgccgccaacccacgcatcggcgacctgttcacggacctgaagcgcgggctggcggagctggacgcctcggcctgggaggccatccccgagatcggggacacgacggtcaagcgcgcgcggcgcgccgagatcttcacccccgtccccgactcgctgctggcgcgcgcggcggccaccgcgggcgacgcccccgggctgaccagcctggaccccggcggcgtggggcccggcacggagaccccgggcgccgccaccagcctgaccgccatcggcgcggggaggagcaccgtggtccagctcaaactggaccgcctgtcggactcggtcacggggcagacggtggtggacccgcgtggttacctcaccgacctcaagtcggtgacgctcaagtcggacgcggagatctcggacatcaagaaggcgcgcctgctcctcaagtcggtcatcaagaccaaccccgcccacgggccgggctgggtcgccgccgcgcggctggaggaggtggcgggcaagctccccgccgcgcgcgagctggctctgaaaggctgcgagctcgcgccggggtacatcgacgtctggctggaggccgcgcgcctgcaggagccggagaacgcgaaggccatcctggcgcgcggcgtcgcagcgctgcctgaagcaggtatgtctggatactgcgcaggcgtcaggggaggagcagggggtcgaaagggcccagggatggggcaggcgtagtctcacaatgtccacgggagagttggccaggcaaagaggacgtgcgcccaagaatacactctgggattcaggcagtgcggcttactccctcatcctgggttgtctccacctgcagctgcgcaacctcctccattactcacacactctccctcccccccaaataccatgcagtcacgttgtggatggcggcggccaagcttgagaccagcgacgaggcacgcaagcgcgtgctgctgcgtgccctggagcgcatcccgcagtcggtccgcctctggaaggccgtggtcgagatctccgacgaagacgatgcgcggattcttctggtgggctggtggcctgggtcttgggggggtccgtatcagaggggttctgggagcgggtgaggttgaagggagtgcagaggtgtatgcgcctcgaggcatatcgcaagggggagcgagtctgcttctcggcatgtgttgcggcgttgagacgcgacacgtagttgctgccatcgggggcccccctcccccaccacaacnnnnnnnnnngggtgtatgcgcctcggggcatggcgcaagggggagcgagtctgcttcccggcatgtgttgcggcgttgagacccgacatgtagttgctaccatcgggggcccccctcccccaccacaacaaatatctgccctgcaccccgcacccatccgcccccgcgctctcataaccctctccctcccccccaccctcnnnnnnnnnnnnnnnnnnnnnnnnnnnnnnnnnnnnnnnnnnnnnnnnnnnnnnnnnnngcctcccagtcgcgtgcggtggagtgctgcccgcagcacgtggagctttggttggcgctggcgcgactggagagctacaagaatgcgcaaaaggtgctgaaccgcgcgcgccaggccattcccacctcggccgaggtctggatcacggcggccaagctggaggagagcgcgggccaggccgaggcccccgccaagatcatcccgcgcggcctgaagtcgctgcaggccaacggcgtggtgctggaccgcgagtggtggctgcacgaggcggaggccgcggagcgcaccgcgccgcccctgcccgccacctgccgcgccatcgtggcggcggtggtggacgagggcgtggaggccgcggaccgcaagcgcacctgggtggctgacgcggaggaggcgctgcgccgcggcgcggtggagaccgcccgcgccatcctggccgccgcgctggccgccttcccggggaagaagtcggtgtggcgccgcgccgcggcgctggagaagctgcatggcacgcccgagcagctggacgcgctgctgcgccgcgcggtgcagtactgcccccaggccgaggtgctctggctcatggccgccaaggagcggtggcgggggggggacgtgggcggggcacgcgccgtgctggaggaggccttcctgcgcaacccggacagcgaggagatctggctggccgccttcaaggtggagttcgagagccgggaactggaccgcgccaggtgagagtgttggggtatgcgggtggggggggaggggggaaggggcccgatgactggcagtgggggcctgtggatgaggtggatggtgcaggggctcggtgagccagagacatggnnnnnnnnnnctggcggtgggggcccgtggatgaggtggagtgtgcaggggctcggtgagccagagacatggcaatcagatggcggtggagatgcaggatcggtgatggggacttggcgtccacgcgttctcccttcccatgccgggggtgctggtctgcccactccctcacaccnnnnnnnnnnaggggtggagatgcaggatcggcgatggggacttggcgtccacgcgttttcccttcccatgccaggggtgctggtctgcccactccctcacacctctgtgccaacctacaggatgatcctggcaagggcccgggagcacccgcccgcctccacccagcgcgtgtggatgaagagcgccatcgtggagcgggaggcgggggacgccgttgccgaggcggcgctgctggaggagggcttgaccaggttccccaccgcctggaagctgcacctcatggcaggggcgctggcggagcgacagggcgaggtcgagcgcgcgcgtgccgcctaccacgccggcatcaagcgctgcctggactgtgtgccgctgtggatcgccgccgcggcgctggaggagcgtgagggtgccctgggtgagttgggtgtttggggtggggaggaaaggggggggaatgggggttgcagatgcagatgctggacagcgtgattgtgggcggattgcacgtctgtttgccggctcagatcactctgtcctgcattgagtggcaggaatcaggaccccgctcaccctgcagtgcatgcacctgcgccccgcgtgctcacccaccgttgctgttgtcggcgaccgcgatcttccatccagagcagccgctgtgccccgatggctctcctgacgtcccctccacccgccgcacatgcctctcaccatcaacaaccacaaaatcccagcaacnnnnnnnnnnggctgtgccctgatggctctcctgacgtcccctccacccaccgcacatgcctcccaccatcaacaaccacaaaatcccagcaacctccccccctcccctcggccctcaaaaagcacgcgcgcgcgctctgctggagcaggcgcggctgaagnnnnnnnnnntcccctcggccctcaaacagcccgagcccgcgctctgctggagcaggcgcggctgaagaaccccgggcagccggcgctgtggctggcggccgcgcgcaccgaggcgcgtgccggcaacggcaaggcagccgaggcactgctggcgcgcgcgctgcaggcctgccccgactctggtgcggtgtgggcggagagcatccgcgccgcgccgcgccccgcgcgccggagtcgctccgtggacgcgctcaagcgctgcaacgacgaccccaccgtcgtggcggccgtggcgcagctcttctggggcgagcgcaaggtggagaaagcccgctcctggttcgaccgcgcggtcaccctggaccctgacgtgggcgaccactgggcgctgtacttgcgcttcgaggccgcgcacggcacgcccgaggcggcggccgccgtgctggagcgcgcggtggcggccgagccacgccatggcgagcgctggcaggcgctggccaaggaccctgtgaatgcgcaccagccgctggggacgctgctcaagaagctggcacagaccatcgagaaggacatggccatgtgaaggctgtgatgcgtgtgtttggggggtaaccgcggcagtgagctgcgggcggccaggtggaggagctgggggactgcaaggtggtgcggaggtggtgggaaccaggcggcggcaaggagggatgggtcctcagctacacggcgcgagatggagcccggcccctggccactgctgccccgaccgccacaccctggcacgctggcagagccggctgtcagcctgcccacctagccgcgtttggccccagacatggaatgtctccaccctgtacttggggcggtgcccaatctgcatgtctccaccgtgagaaactggcggcagaactgcttggtgagaaccaatccagctgtgtaatgttgtcagacaaataagtgccgagtcatacctatcttatggccaaagctttttgcacacacatgtgtgggctggttgtgtgtacctgtcggaaggctcacccctcttggtcatggacctgtccagtgaagccgagccgaaaccgcctcgcaccattgatcctgatttcatgtcgcatccggggcaggcccccatcccggagcaccgacatcgatgctggtcattgccgcctgcgccaggaatttcgcgttgaagccgtccattcctcgacaaagcttgctggccaccgcagcggcgtgcccccatcccccgacccgcgacagcatggaggtattcgcagaggcgcgccgggacatgcgaccttagtcatgcatgcgaccgacacgcgggcctgaactgccgttccaccgccctaatgtgagatttgtgtccgaaaggggaggaacacgagacgccatgcgttcgctggctgggcagggtccctgcagtggggggcctatcatgaggccccccccctctgaccgcgagcctccccaccagcgcaggtccggcttgatgaggattgtggcggtaggatcgcgcgcataggcccatgtcgcgcccccatgccatgacaccacgtggccgcctcgcggggggaaagtactccagcctccagcgtcatggcccccctcaagccttctgccatgtcggggcccaggctcccgcgccctacaaccccatcaagccgtcatgcagacccagccttcccgcaactggggccaggaacgtcgatacctgcgccgtgaagaccctgaagaagcggcggctgcccctgaataccacccgctccccgctcaacggtttcaatggcacgcccgaggtgctccccgcggcccaggaggccccaaaaatcccggatacctccccctggtggatgcagctgggccccacctggagcctgtgcgtcctgaccttggcctacctccaccactccaccacgggctatgccctgcccgccctcctgcccataatctccgaggacctgcacctggtggatacccaggccgccaccctcaccgcaggctacacggtgaggagtgggtggttgttttaggatgtctgcggccggaaggttttggtgagaatgaaacgggaaacggtaggaccttgcaaagagcgaggggagaaacataacagcacgggtctcaagcggaccgacggatgctcgtcgccctaactcacatcagctcgggatgccacgtactttttccgcccccgaaaccgcccccaatcaaccccatccccaatcctcccaggtgttgtatnnnnnnnnnntacaatagcacggttctcaagcggaccggcgtatgctcgtcgccctaactcacatcagctcaggatgccacgtactttttccgcccccgaatccgcccccaatcacccccatccccaatcctcccaggtgttgtatgcgctggccatgctgccgctgggcattgcggccgaccgcgtgcagagccggccgcggctgctggcctggggtatcgccgcctggagcctgctcacgctgggcgcggcgcgaacacacagcttcgcggagctcctggcggcgcgcgtgggctttgccggggcgcaggccacccagaacccagtctgcttcgcgctcatccccgacctcttccccaagaaccggacccgcgccatggccctgtacaacgccgccatctacgccgggcgcgcgctgtctttcggcgtcctcatgctggccgtcaagctgggcgtgcccaaggtgcggggtggtcgtcgtcgtgctgggcggcggtgaggtccgtttgtgtggtggcacgcagaatcaccacctcatgaccaatcccccccgcggaacgacgcccccttgactcccttcgctccacctccgtcaccccaggacctgatcaacgacaccagctacgtgctggtcccgctggacaaggtggacctgagcctggtcagcatcatgttcatccagggcgactatgcggcggtcagcccggtgttcaactacgccgccacgctgaccggcgaggtgcccatcgagagcgccttctccgcctggcgccagctcatgacctgggtgggcgcgccgggcctcctcctcgccggcctgtgctggctgacggtgcgcgagcctgcgggcgcccgacgaggcggcaagggccctggcggcggcggcggcggcg

SEQ ID NO: 42429 - DNA, 76 bp, Chlorella protothecoides
tcttcccattcctggccccagtcaatcgcagtttcccttgagcgggggctccatacacctcacccccccccacaaa

SEQ ID NO: 42430 - DNA, 61 bp, Chlorella protothecoides
aaaggaagtcctgtcccacgtcgagggtttaattatccatacgaggaccagccaccaggtc

SEQ ID NO: 42431 - DNA, 61 bp, Chlorella protothecoides
gcgcgacgtgaccgcagcaagccccgccgcatagccgtgcacttcggagccgggcgggttg

SEQ ID NO: 42432 - DNA, 61 bp, Chlorella protothecoides
agcgcgtgtcccggtcgctgacgaagacggggggaagaccgtgtaggcgggagacgcggtc

SEQ ID NO: 42433 - DNA, 670 bp, Chlorella protothecoides
  modified_base (108)..(117): a, c, t, g, unknown or other
  modified_base (319)..(328): a, c, t, g, unknown or other
ggccttgcgcgcacgcgcgcgcagacaggcagcggaccaacgggcccagtgcggagaggccagggagccttctgcaggcgtgggcaggccccactcctcttgcaggtnnnnnnnnnnagacaggcagcggactgacgggcccagtgcggagaggccagggagctttctgcaagcgtgggcaggccccactcctcttgcaggtgggtgcaccatcggtcacctccctggcgtgcctaaggcaggacacttcacacccgcacccgcatacccacccacgcccgcccgcctagcccatcccgccagcgccgacgcatgccgnnnnnnnnnngcaccgctcacccgcaccacagcacacacccccacacacacgcccgcccagcccatcccgccagcgccgacgcatgccgacgcaccaggttgcgccacttgtccttcaggtcgaccgcggagcgcgtgctgagcagggacacgacggcggaggaggcggtgcgcttgatctcggcccacttcccggcccccacgccgcgcactccctccaccagcgccctcgtctcctccgcggaccaggggttgtgcttcttcttggcgccgccggcgccgccgcgcgccgacccgcccgagccgtcgagcccggcggagcacgcgtcttcgccctcgccgccgctcaggc

SEQ ID NO: 42434 - DNA, 408 bp, Chlorella protothecoides
gtgggcggccgcggcggccgcccctggaacaactggcgcgatcagaacagggtgtgtaggaggggggtggggggggtggagcgtgggacctgcctcccagacgctcctcatattgcataccattggtgtcaccaccatgacccccccatacccatcccccttttctccaccacccacccccatccaccgtcaccccaggtgacctactccagctcggtggacatccggccggagtggcgcgtgctgggcgacgcggtgcccttcacctccctgcacaagatgagcagccgggtgggggagcccgaggacctggcggtggcgggcagcctggcgccctacgaccgcgccgcggaccgcgtgacgccgcgcaccgcagtgcgcctggcgcgcgcgcccgcggccgcgccg

SEQ ID NO: 42435 - DNA, 1281 bp, Chlorella protothecoides
  modified_base (439)..(448): a, c, t, g, unknown or other
cgggggccgggggcgcggtcgcacgccgcgcgccggggcgccagcgccaggcccccgcgccggcctctgcgtcagtgggggacgcagccatgccatcccccacctccagcgtgtcggccgccacggggtcggtgaggggggcctggccgcgcaggcgcgccaccaactggctgccggggaactgggagggcggcttgctcgctttcacgggctccgcctgggagtgttagttttgtttttgggggggggtgagtttggatggtgaaccatggggcgccaggtaccttaccagtggaaaacaaggtgtatttttgggcaaccatcggctcgcaggggcttcgaggcaggcacgccccggacgggccaggcatccaccccatccatacaaagaccaaaactgacactgcacctcgagcgcacctgcagctgccgcgcctcnnnnnnnnnnagcttgctcgctttcacgggctctgcctgggagtgttagttttttgggggggtggggatgagtttggatggtgaaccatggagcgccaggtaccttaccagtagaaaacaaggtgtattcttgggcaaccatcggctcgcaggggcttcgaggcaggcatgccccggacgggccaggcatcaaccccatccataccacaaccaaaactgaccctgctcctcgagcgcacctgcagctgccgcgcctcggcatcgtgctggacttcatccgtgcttttcgggacctgggccctttttcgtcgccagaaacccttgtccgccttctcaggcacggtgccgacctcgacaggcgcggaggaaactgcctgcgggtagctgaccctctggcagcgcaaggagggcctcgccgagcgcctgcgcggcttgggagcgtagggcgaccccttgaaccacacactccgctccaggatgcactgtggacaaacttgctgcatgtcgctccgggggcaggaccttaaccactgggaaaggagcttggtatcagtccgaagggaacctctcggccagactctacagaaactcaaagtcgctaaacatccttcaacataatgatgagcacgaagggaagtgggagagtacgatgggtgtggagacccagtggtatgtagcctctgcgcgtaccccttccccgcttccccgctgcccccaatgcaagatcgggtcggattctgccggtgccttgggccgcgttgaggggagtggtcttctccgtgaggtactcccaccgaactcaatactgagaaggtgttggtacttcacagtgttggtacttca

SEQ ID NO: 42436 - DNA, 611 bp, Chlorella protothecoides
  modified_base (159)..(168): a, c, t, g, unknown or other
  modified_base (454)..(463): a, c, t, g, unknown or other
cgcagcgcgcctcggcgtccgcggcgcgcgggggcaggggcgcggggaacaggcccgcccgccgcgcaatgtcgcccccggccgcaccctggccccgctttccagatgcgccgccgggctccgccgcaccactgtcgtcgccgccgccgtcgccgcgcnnnnnnnnnngtgcgccgccgggctgcgccgcgccactgtcgtcgccgccgccgtcgccgcgccacaaccccagctcaggggccgtcagctccttggccagcagcgcgtagaactccagcgtcggccccaggcctgccacgggggatgaggggtggatggtgagcagggacggggaagtggggtcactgatggggccaggggttcctgccttgcacatcagaggccgccccagatgtgcccgcgttgtcggaaaagcgaggagcgagggctgcctcctccccgaatgggccatggnnnnnnnnnnggaggggtgggtggtgagcagggacggggaagtggggtcgctgatggggccagggttcctgccttgcacatcagaggccgccccggatgtgcccgcattgtcgggtgagcgaggagccagggctgcctcctccccgaatgggccatgg

SEQ ID NO: 42437 - DNA, 647 bp, Chlorella protothecoides
  modified_base (105)..(223): a, c, t, g, unknown or other
  modified_base (288)..(518): a, c, t, g, unknown or other
ctcttccccacgcccaccctgcccttgctctcaagcaccccctccccctccctccaaacaccccctcctctccttccgcaggcgcgccccagaccgtgaccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagcgtgggaggtatgaggtccccatcgcgcgtggcaccttccgccgcctggcgtcgcccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggcattcgacggttcgggaagcccccacttgtcccaaggaggggtccacctcgcagctggcagtggcaggggtagaggggggggatgtgggaccaaagagagcaggggaggtgcagggcctgcagg

SEQ ID NO: 42438 - DNA, 112 bp, Chlorella protothecoides
ggggctgggcggcgccccgggcaggacctggggctgcgcccactggggaactggaaggggtggcaaggggtggggggttggaaggctgtgttgcgatgggtcatgccgggct

SEQ ID NO: 42439 - DNA, 61 bp, Chlorella protothecoides
cttgctctcttctggaattcaagcccctcctggggccgccctgcaggaacaccgctgccct

SEQ ID NO: 42440 - DNA, 61 bp, Chlorella protothecoides
tcctggagctggtggacacggcggggtgggtgcggcgcacgcgcctcgacgcgcatgaccc

SEQ ID NO: 42441 - DNA, 70 bp, Chlorella protothecoides
caggtcgccaaacttctcgatcttcagcgcagcctggtggtttattttttttgggggggggggggggggg

SEQ ID NO: 42442 - DNA, 61 bp, Chlorella protothecoides
tggaagaggcgctggaatcataccggcagggcatcgttcaggtgctgcccagcaacaccgt

SEQ ID NO: 42443 - DNA, 148 bp, Chlorella protothecoides
tggcctgtgcaacacctttgggaccctggcgggggtggccggtgtccaaggtaagggagggattttgtggaaaggcggagtgggggatgctcctgatggacaaaggggccaagacactgttctggatggtgtcaatggtggggaatgg

SEQ ID NO: 42444 - DNA, 73 bp, Chlorella protothecoides
gcgagggacggcgcggcttcgacccagccaccggggtcgcggagggccccgcccccacgcagcgcggcgctgg

SEQ ID NO: 42445 - DNA, 6383 bp, Chlorella protothecoides
  modified_base (1263)..(1272): a, c, t, g, unknown or other
  modified_base (1614)..(1623): a, c, t, g, unknown or other
  modified_base (1939)..(1948): a, c, t, g, unknown or other
  modified_base (3282)..(3291): a, c, t, g, unknown or other
  modified_base (3682)..(3691): a, c, t, g, unknown or other
  modified_base (4901)..(4910): a, c, t, g, unknown or other
  modified_base (5763)..(5772): a, c, t, g, unknown or other
  modified_base (5987)..(5996): a, c, t, g, unknown or other
ccacccaccacccccacctccgatgctccgcccagatacgagctcggacgccagcccgccaacaccaagttgtccagcaacgtgaccgtgcgtcgcgtgcgcgtgcgcgggggtaactccaagttccgcgccctgcgcctggactctggcaacttctcctgggggtctgaggccaccacccgcaagacgcgcatcctggacgtgtcctacaacgcgtccaacaacgagctggtgcgcacccagaccctggtgaagaacgccatcatccagatcgatgccgcgcccttcaagcagtggtaccagcagcactacggcgtggaggtgggcctgaagaagcggtccgccgccgccgcggcccccaccgaggaggtgaagcagtccgaccacgtccagcgcaagctcaagctgcgcaacaaggacaggaccctggaccccctgctggacgagcagttctccgtgggccggctgtacgcctgcatctcctcccgcccgggccagtgcggtcgcgccgacggctacatcctggagggcaaggagctggagttctacctcaagaagatgcagaagaagaagggcaagcagacggcatgagtgctttgctgtaacgtccccttccttgcttcagtcagggagggatggccgggccacgagggaggggtgttccgggtttccacctcggaggaacatggtcttgggaccactagggaggtgggactcggactaccatttcaggcatcgctgaccagagccatcgacgctaaagaacatcagggcccatttgagtgcatacgcggatcttgtcgacatcacacgcggtgtccagtctcggcaaggatggtccgcaccaagactttcaaggaggaacacccgctcggtgcgtcagggggtagacgagcacatgtgaccccgtacatcgcgcagaatttaaaatcaaagagcctcgctccaacccctccctggcccgcagagaaacgccaggctgaggccacaaggattcgcgagaagtatcccgacaggattccggtgagtgccctgccctcccacgacacgcatccatgcccttcacatgctctgaaaaattcccatgacccgtggactgccccccgcaggtcatcgtcgagaaggcggagaagagcgacatccctgacattgacaagaagaagtgggtgtggttggcgaagcacccgccctttggccctcgtaaccctgtagatgcgctcaatcgccttgattgcgcaccccgcaggtacctggtgccagcannnnnnnnnnggtacccgccctttggccctcgttatcctgcagatgcgctcaatcgccttgactgcgcaccccgcaggtacctggtgccagcagacctgaccgtgggccagttcgtgtacgtcatccggaagcgcatcaaggtcagccccgagaaggccatcttcatgtttgttcgcagcgtccttcccccaacaggcacgtgtattgatggatttgagacagtgctgcagggagaggcatcacaactggcgtgctcgtgcacgtcactcagtgccctggaggtgggcgatggactgggtcgggctgtcgtatctcaaagggaggcctcttacggccccccccccccccccnnnnnnnnnnttgggcggtggactgggtcgggctgccgtatctcaaagggaggcctcgtacaacacacacacacacacacacacacacacacacggatttccatgcagccgccctcatggccgatgtgtatgctgatcacaaggacgacgatgggtttctgtacatcacctacaggtttgtgttgctgtggctgggctgggcttctgtctttcatttcctgggtaactgatgtcattcctctttccttcaagccaggcatcatttgcctgcactgggcctcaagttcaccatattatccccattccacagcggggagagcaccttnnnnnnnnnncctgtacatcacctacaggtttgtgttgctggggctgggcttctgactttcatttcctgggtaactgatgtcactcctctttcgttcaagccaggcttcatttgcctgcactgggcctcaagtttaccatatcatccccattccacagcggggagagcacctttggctgctaggcctcttagaaagggcagccccgccctgcgctcgaagcccctgtaccaacgtggctgccaagaacttgtactttgacggtgccccatccctgtacctaccttgccatgatgtgtgtacccgtggccctggatgggggccctcccaaccacaccctcccccccgcgtatgtcctgcccttcacatgtgagatgtacctgtcccccggggacgagcggcgcggcgcatgggtgctggcctcgcttacacccacgcgcacagcaagtgatcaggggcgggatggctcctcggtacagtaggaaaatgcgccctctcggcttgaaaaccaggggggaatgccgccccctgcccggcccccacccgcgcgtgggtggcccccctccctgctgtgcgggacccctcacaggctgggggtgaacttggtggcgaaggcccaggcattgttcgcgccagggtcggccaggtggtcgctcaggttctggatggggcccttgcccgtgaccacggcctggacgaagaagccgagggccgcaaccatggccaggcgcccgttcttcagctccttgacgcgcagctcggcgaaggtctcggggtcgtcggccaggcccagggggtcgaagtaggtgccgccggggtacaggttgtcgaggccgtcggaccagtcgaagggcccgccgctcacgcggtagccctccaccgcgcccatgagcagcacctggatggccagggtggcgatgatggactgggcgtgcaccagggaggggttgcccaggtagttgagcccgtcaggggagaagatctgggcgccggccttgaaccacacggcctcctggaactgcacgccactgtacttctgcaggatctcagggaagacgatgccgagcgttcctgtgtgggcgagtgaaggtggggaagggagtgggcggaggttgcatcggcacggcaggggaagccgaatggtgctggccatgggagtacagggggcctgtgacagctgggacagcccagagtggtacagatgcaggagagtctaaggcaggtccataccttccagtggctgcctcccccccctgcgcccaattcctcgcggcgccctccccaccccttgatggattcagccaaagatgcgacatcacaacctctcccagaacgcacccagggtnnnnnnnnnnaacgccctccccatccctcgatggattcagccaaaaatgcgacttcacaacctctcccagaacgcacccagggtggcccagcggcagtgaatgacctcgatcaccctgtagcgggcaaaggtctcggggtcggcagacagaccggccgtgtcccagccgtagtcgcctgggaggggcagggacagggcgtgcatgagccgagcagggatcacatgcatgagcagagcggagcaacagcagggctcggtgaacgagccggcccagcacgtcaagacgccataccgccgacagcaggtgatcgccagcaaccagcacatgattgccagccaccacaaccccatcgccagccaccaacacccgatcgccagccacatggaagttggcgacatannnnnnnnnntgccgagcagcaggcgatcgccagctaccagcacatgattgtcagccaccacaaccccatcgccagccacatggaagttggcgacataccagcaaactctccgttcaggtagctgggggtgatgccatcagagaaggggcccaggaacttggggcggtcggggccgtacctgcggcggagggaggagaacaccgggggtggaggcgggtttgcacaggccatggtgcaggtgcggggaatccaccggctccgatcatgcgcgaagattctacaaccggccaactcaccagacaccctccgacacctttggcttctgctgctgtaatgatcagggggggaggtatatacttagtatgagcagcggtacggaggcgagcatgcatagtacacatgattccggttcgcggcccaccccggggcccaccttcagcgtgcgcctcatggtggtcaccgcacgctgcattggggggagtacaagttgttcaatgagataagcatcgatgatgggacatgcaagggcgttcgaactcttaaaacaagggttccgacagcacaccttgccggtgctggcctgcgcggcgacctggggccgcagcgctgtggcattgccgaagaaggtggaagcctgcatgacttcgtttgcttcgatgaatggagtttagatgggagggtgggagcctggtcagagaagtatggagcgcggcgccgctgcgcaccagacatgaagctaaatgtttgcacggaaggaggcaggtctatcccggcagattctgtttggggggggggtctgcccccgggggggccctttctccactttcaggtcacaatgtaatgtcagccgaatggcaatgatctcctcatccaaaccattctggatccaactccatacatccaagcgtatgtcaagcgctctggctgttctgctgtgctaccttttatagacctgctctccctacagaagctgagtatatacatgcacatatccatgatcaaccacgccaagcaaggggaggattcggactgccagtcgctctttggagaaatgcgtcagtgcaacgtgaaaaggtggcttgaaggaagagatcaatttgaaaaacgctgaagaaaaggctgggcagagctccgagggggctgctcagggaagagaggggtgggagggtaacacgatgcgccggcagcagctgttggcctcctgctgctgcagtctgcnnnnnnnnnnagtgggagggaaacacgatgcaccggcaggagctgttggcctcctgctgctgcagtctgctgaagggggccaagaacatgtcgaagctgcaaccatgggccatgctgcacggggcctggctattcaggaggacagtgtgggacttgggaggaaaatgtgtcatgcagccacttggaagggggtgcaactgtatgcttgggcagccccaatcgggaaagaatttcagagtggagctggcacgggaaagggggacgggggtttaattacccccccccccgactctccctgccactgctccaaccagatgcctagtgatttctgcaatgctcgagttcagggtgagaggagatgctcatgcaggggtgaccctcctcgtcgcgtagggagggctggcggccttgccgcatcacatgagctggcccaaggggtcctgcacctgccagttgtatggcagcatgtggaggggggccgaatggggcccctgcggctccagctgcatcgccagcagcccagatgtgtccatccgggccggcagtgccccgtggcatgcgctccctgtgcgtgtcatgagaaggggcgagggcggaacgtgtgaggaggcagggccactggcttgctcaggtgctggcgtgcagggcctcaagaatggggggtccgaggaaacccacccgcccacccacctgcagggtccaggttccagaggagtgggtcgagggcacccagggagttgggtgcgagagctggtccaccatgcccccctgcaaggacgagtgggtgcgaggtgagccggcggtggagggacggcctgcatcggcatgccctgtgcggggggaacatcgtcccctgcccattnnnnnnnnnnagtgagccggcagtggagggacggcttgcatcggcatgcccggtgcggggggaacatcgtcccctgcccattccctggcacgacatcccccaccgcgacgcaggctcccgcgccgcagcgctcggcggccactgccgatccgagcgttacaccagggcccccccgccccgatcaccccctcccgactccactcacggagcagggacgcggcggcnnnnnnnnnnaacgaccactgcccatccgagcgtcacaccagggggccccccgccccgatcaccccctcccaactccactcacggagcagggacgcggcggcgctctgggttgggaagccagggtcggcggcggccagggcctggagggccagcagctgctgcgccaggacaagcgtctggtgctgctggtggggcagctgcaggtccagccccaccgcgcgcagcccgcccggccccaggccgcaccccagcgaggcggaggtccgctgccccagcgcctccagcagcgcggcggtgtccggggcgggcgcaacgccggagccgtgtcccgcccgctcgccggccacaagggcgggggctagacgcagcacggggggcgggcggtccgccggcgcc

SEQ ID NO: 42446 - DNA, 100 bp, Chlorella protothecoides
gcttccaccccgcctcctccgccaggtaggcggaggacttgaccacgccgttctccactgcacgagggtgggtgaccggttgaacgttcatgtgagcttg

SEQ ID NO: 42447 - DNA, 61 bp, Chlorella protothecoides
tggtgttggatgtaaagcatctggcggaggggctcttcggcctgcctgcagacgcttctct

SEQ ID NO: 42448 - DNA, 73 bp, Chlorella protothecoides
ggcgcggaaggctgcggggtcgggcacctcccgcagtacggtatcggtcacgcggcagccgttcaggctgcgc

SEQ ID NO: 42449 - DNA, 61 bp, Chlorella protothecoides
ccgcgccagcccgggcaacatgtcctcggccgtggacctgctcgagtcgctggccggcccc

SEQ ID NO: 42450 - DNA, 61 bp, Chlorella protothecoides
cctggtccccggtccatcagccttccacctgccccaaacccccaaccaaaccaaaccctgc

SEQ ID NO: 42451 - DNA, 79 bp, Chlorella protothecoides
caggggggaatgccgccccctgcccggccctcctccccgcggtgcggggcccctcacaggctgggggtgaacttggtgg

SEQ ID NO: 42452 - DNA, 82 bp, Chlorella protothecoides
atgcgctcatggtactcagcctgttgcagtatgatcagggtttgtaagtaaaacagggcctgcagtgcggtgctgcgcgtcc

SEQ ID NO: 42453 - DNA, 66 bp, Chlorella protothecoides
tggcgagaggcggtgctgggggtgctgttgggtgccatcgccaggatgcccaggggatggcaaggc

SEQ ID NO: 42454 - DNA, 61 bp, Chlorella protothecoides
gcccacgccctcggcaccgcaccatgccggtctgggcgcggtcgatcgcccgcgccgccgt

SEQ ID NO: 42455 - DNA, 61 bp, Chlorella protothecoides
gagactccccctgaccttcttatggcaggggctcctacttgccaagtaatcagttgacaat

SEQ ID NO: 42456 - DNA, 469 bp, Chlorella protothecoides
  modified_base (120)..(398): a, c, t, g, unknown or other
gcactgtggtgagcggggtgggagggagggtgagtcggcctcgcatggggaagggagtcgtaaatctggtgccgacggggccgccggaaagccatgccctcctcacttgctgcggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccccatctccttgctcgacttgggactgaggaacaaggccctcgactttccaacgtgttctcgcactt

SEQ ID NO: 42457 - DNA, 75 bp, Chlorella protothecoides
tgcccctgatcgcgggcggcatgggcgcggcgcccgccccgggccccgcgcccatgccgcccgcgatcaggggca

SEQ ID NO: 42458 - DNA, 480 bp, Chlorella protothecoides
  modified_base (186)..(257): a, c, t, g, unknown or other
gtgggggggtggtcaagggagaggaaggtggtcgccacgagggggtggaagggggatgtccggcggcggcaccccgtctccaggccgcgtgaagccaagggcaaggggcgagctgttcccctacaaagggcgcgctgtccagcggcgcgccggcacgctggggcagcagactccgcccgagccccnnnnnnnnnnnnnnnnnnnnnnnnnnnnnnnnnnnnnnnnnnnnnnnnnnnnnnnnnnnnnnnnnnnnnnnngtccgtgcctgagccacgatgtgcgcgccgcgccgcctccgcccctccacccctctcggatcggcatccctgccagacccctccaaatcaccatcaatcagatgcgggcccgccccgcccatatctttgcctctagattttaggcctgcccctccttcacgccttcgtcccaagtcccccgaccccccatgatgtgcctcccccccctccatcccctcagctc

SEQ ID NO: 42459 - DNA, 61 bp, Chlorella protothecoides
gtcgtcggacaggcgccggatcatgtccagtgccttgcgcaccagcttcttcttgatcacc

SEQ ID NO: 42460 - DNA, 66 bp, Chlorella protothecoides
tgggccaggccagcttccttggcagccccctctcgcgggggctgccaaggaagctggcctggccca

SEQ ID NO: 42461 - DNA, 71 bp, Chlorella protothecoides
gggatgctgtgcatgctgcgcatcgtcccccgttggagtcgcgcgcgcgcgcgccatccagtcggtgcgac

SEQ ID NO: 42462 - DNA, 61 bp, Chlorella protothecoides
aaagcgtgcccggcaccgagtggcaggaggggacctgcaccgacgggcggcggtactacta

SEQ ID NO: 42463 - DNA, 863 bp, Chlorella protothecoides
  modified_base (220)..(229): a, c, t, g, unknown or other
  modified_base (302)..(311): a, c, t, g, unknown or other
cagcagcgcctcggcgccggaggcctccggcccgctcaggagcgtgtggagcagggagccgtcggctgccgcgcactcggccaggggcgcgtcggcggcgcagattccgcgcagcgcggcgacgaggcccctggcggccgcttctgtgccgccctcgagcgccccgcccgcttcagggggccgggccggggccgcccccggtccgggcccaagcacggtnnnnnnnnnngtggggtggcgcatggggactcagcaggcagccttcacccccgacgttgtcctccctcctcccatcgtagacnnnnnnnnnntcgtcacgcgccccgcccgcttcagggggccgggccgaggccgcccccggtccgggcccaagcacggtgcggaggatggagggaaggagggcggggtcatcgcgcagctgcgccaccggggcccgccagtcggcctcgctcgaggcgcctgtggtgagcttgtccggtggaggtggggttgtcgacgacgatttggggtggcgcatggggcctcagcaggcagccttcaaccctgacgttgtcctccctcctcccatcgtagacaggagtagctcccgcacctcccaccccatcccaccgagcccttcaccttgcccgggcgcccctgtctctgtctgcccccgcccgccctccaccgccagcagcacgagcgcggaagccagcaggcccgggggcgaggccggatccctcagcacctccagggccaggcgaggcagcgccatcacggcgcgcagccgccgccagggcgccggccagcgcccgcgcgccgagcacgccgccgccgcgacgcgcatgagctgggcgcggggctcggccggcagctcacccccg

SEQ ID NO: 42464 - DNA, 76 bp, Chlorella protothecoides
ccgcgcgctgctggagcgcccgggcctgcttggcctcgtgcacgaactgctggagcgcctggacgcgcacctggtg

SEQ ID NO: 42465 - DNA, 785 bp, Chlorella protothecoides
  modified_base (159)..(378): a, c, t, g, unknown or other
ccccccccccgctctcacctgtggcgagggtggtcccagtcccacctagggtcagggcctcgctgggggtaacccagtcggtgggtggctgcccagcccaggattccggcagggacaagcggtgccagcatggcatcaagacctggtctgacatgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgctttacatccaaaaccaagctgccaacacaaactgactcatcacacgccgacacagggttcatcgccacatccaaggccggaaacagcagaaagggtggtgacgggccagtgccagtgtccgacccgccacatggcacctctcctgacctggttccatattccctggagcctgacacccagggactggacagagcccctgctccacaccttgcggacagtaatggcgcactgacctcactgatgggcattcctggcaacttggtcttgccactagactgccggtgagtgattcccaaggtgatacggggtgaggcacccatcatcatctccctggtcgcgaagaagggacggtgggggaagcgcgatgcactctacaaattcatgacggaagctgtgctgcct

SEQ ID NO: 42466 - DNA, 85 bp, Chlorella protothecoides
agaagaggccacccagcagaagaggccaccagtgagacactgctgatccccacatcctcgtcatacacactctcgcagcacgccc

SEQ ID NO: 42467 - DNA, 14003 bp, Chlorella protothecoides
  modified_base (492)..(501): a, c, t, g, unknown or other
  modified_base (1020)..(1029): a, c, t, g, unknown or other
  modified_base (1097)..(1106): a, c, t, g, unknown or other
  modified_base (1332)..(1341): a, c, t, g, unknown or other
  modified_base (1807)..(1816): a, c, t, g, unknown or other
  modified_base (3310)..(3319): a, c, t, g, unknown or other
  modified_base (3972)..(3981): a, c, t, g, unknown or other
  modified_base (4057)..(4149): a, c, t, g, unknown or other
  modified_base (4229)..(4238): a, c, t, g, unknown or other
  modified_base (4511)..(4520): a, c, t, g, unknown or other
  modified_base (4777)..(4786): a, c, t, g, unknown or other
  modified_base (5318)..(5327): a, c, t, g, unknown or other
  modified_base (8327)..(8336): a, c, t, g, unknown or other
  modified_base (9510)..(9519): a, c, t, g, unknown or other
  modified_base (10552)..(10561): a, c, t, g, unknown or other
  modified_base (11086)..(11095): a, c, t, g, unknown or other
  modified_base (11642)..(11651): a, c, t, g, unknown or other
  modified_base (11938)..(11947): a, c, t, g, unknown or other
  modified_base (12576)..(12585): a, c, t, g, unknown or other
  modified_base (12787)..(12796): a, c, t, g, unknown or other
  modified_base (13571)..(13580): a, c, t, g, unknown or other
ggcgcgcccaggtcggaggcgtcgccgtcgcggccggcgccctcggcgctgtcgccgccgccgccgcctggcgcgccgctttcctccgccacgtactccacgacgtcgccgttgggcagcatgcgcatggcgccgtagcgctgggtcagcgtgtaggcgcaggccacggcgcgcagcagcgcggactgcagcccaccgtccagggaggagctggcctcctcgggcgtgggcgcaaacagtacgatcatggaatcgcccgcgaagcgcatgacgtcgccgccgtacagcaggatctggtcgatcacctgcagaatttgaggggtgtaagggcttgagaggagtggtaagaggtgggccagggatcggcaacgtggcgagtgtcaggtcataaggagctcccggcatctcgaatgccttgggcgctggctcccccccccccatgcccactcccaccctctttctccccggcacccaccacaggaccccccagtnnnnnnnnnngagattttggggggtgtaagggcttgcgaggagtggtaagaggggggccaggggtcggaagcgtggcgagtgtcaggtcacaaggatctcccggcatctcagatgccttgggcgctggctcgccccccccctgcccactcccaccctctttgtccccggcacccaccacaggaccccccagtcccccacaaacaccgtacctgcgtgaagtagcggttcatgcacttggttagcagctccaggcccacgctgccctgctgactcagcagctccgtcagcgcggtgaagccggtgacgtcggcgatcatgaccgcgcccagctggcgctgcagtgcggggagcatggcctgcgagacggcgggcgcgggcgcgccgtccggcgcggccatggcggccgccaggctgggcagctggcgtgggacgttgctggccagctggcggcgcagcgtgccggggacgaagggggtgagcaggggcagggtgcgcgccgccgccgccgcgcgctcggccacggtgggnnnnnnnnnngcgtggcctggggtgggaggaaagggaggaatttgaaggggaggggttggggatgctcggcacggtgnnnnnnnnnnacgtggcctggggtgggaggaattggaggaatttgacggggaggggttggggatgctcggcacggtggcgattgagaggcattggggacaccaaggaatccacttgacaacggcgtggcgggcaggagggcatttgggggggggggcccatgtcaccctcccgggagtctgctcccaatgactccaccacatgccatgcgcctgatgtggccttgccatgcagatnnnnnnnnnntcacaatgtcaccctcccgcgagtctactcccaatgactccaccacatgctatgcgcctgatgtggccttgccatgcagatgtgctcgacacagagagggagcaggtgggacattcagcgacactggctcatgctgtgccagcccatcgtgccctcgtgacctccccgccctacaccacccaaacctgcatccaaatccctcgcggatcaccttcggctgtctgtggctgctggacctgcacaggctgtcccaccccgagccccgccgagatgctgggcctcgtccagccggagatggacatgttgcgccacgaaaacttgccgtccccgtcaccatgggcgtcccctgggcccggggctgcgcgccggccctcgttgccgtcaaggctcaggttccgggtgggccgaaggatgcgctggcgcagcacctgccacgcgtttgtcgtcactgggctcctgggcaggnnnnnnnnnntggggctgcgcgccggccctcgttgccgtccaggctcaggttccgggtgggccgcaggatgcgctggcgcagcacctgccaggcgtttgtcgtcactgggctcctgggcagggctggggataccctgggggcgtaggggttcggggcgtcggtgcggggtgggtgggggggtggcagcctcccaggggtgccgggagaggtgttggtggagggggaggggcaggcctccgagcgcccgcccccgggccccgtgacgggttctccgagggctttggaggggtcgatgggcgcggagctggggtggaggggtgcccggtcgattcgctgggcgtcgaaggcccccatctcagccactccccggccctccgtcgcggcccgggcagccgaggcgaagggcgagggaggggatttcggggcctggatggggatctccatggcctccgcgcttatcttgggtgtcataccgggaaatcctggctggaacagacggccgaggagctgtcgatgttgtggcacatgctggctggggcagcggggaccgcaggtgcctgtccctaaggacacatcgtcgtcgaagaggagctagacaaaatatcgaagcatatgtgtagcatttaattcaaggccttcctgctccaggggtggggcatgttgaggagtggagtcgagcccaggtttacaaagctccaggcgatgggaagtatccttcattgcaggggcgcccagttcccttcccaaaggtctcggcctcatgcatgcaccgacccctccaccatgacccacctgctgcttcacaaacatcgggtccctcctgccatgctcaaagtatgacagtacctgcctgtttgggattgggcttctggaattcttccgtttccaccgcacgcagcatcgacaatatgatctcgtggcagagggcgcgacacatttgcatagcctactgtgcacttccctcgaggaagcaaaaccccacgacgatgaaattggtgtgattttacattccttgatgcaattgtaagcaaagcaccgacctgctggtcagaccaacaccaacactcggccgggctgcgtgtcccctgcacggcagtgcgagtggtcacgcccctccctcggcatgctgagaaggttcaaagacctgcacagacatgccataaggggtgtttgccagataaatcttcgaggacccgtgccgtctggcgccagcaccgcgcttgtaaggggagaactgcctcctcaggtctttcatgatacccagcgacgaatagcgcgcagacttttcaccactggaaggtccctgcacagtcctcaacatgtgtatgagaggacgaaagcagcatcctctgagcatgccttgtacttggtgcggtgtcaaggacggagattgagggggaaatgcctgtgtggcctgccatgcccagggaggccgggctggcaatgggggcaattgcaattatgctgaaatatactgttggtgttcgtggtcaaagcattccnnnnnnnnnngaggacggagattgagggggaaatgcttgtgtggcctgccatgcccagggaggccaggctggcaatgggggcaattgcaattacgctgaggtgtactgttggtgttcgtggtcaaagcattccctagtggccgcttatacagttgcatccctggcgatactctgatttgcaccacttcacccttcgcttgctattgatacacccaagcagactatcatccaatacaatcccatcctacaccatcaggtcggcatgacggtggcactggtcggcgcgacgtacggcgcagtccccgtctatcgcatgttctgtgccgcaaccgggtacggtggcaccgtccaggagggcgcaagcgtggaggctaagctacgagccagggaggagaacccgaatgcagaggtggagacggcggctgctgcccgccaactcaccgtcagcttcaacgccgatgtctcggacggcatgccctggaagtttgttcccacgcagcgcagcatcaaggtccgtagctgtggtatgctcccagagccaggaaagggcgaatggtcaaacctttctgcatcgcgggagcgttgggaggcactgtgatgtttaaaggggcctatgagagcaacttcagccgtctcgacgtagttcgcctcctgcatcgatgnnnnnnnnnnagtagctgtggtatgctaccagagccaggaaagggcggatggtcgaacctttctgcatcgcgggagcgttgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatcctcgcacccggcacagattcgacctggggagtcttcactggcgttctacacggccacaaacctcagcgaccatnnnnnnnnnntctatcctcacacccggcacagattagacctggggagtcttcactggcattctacacggccacaaacctcagcgaccatgctatcacaggagtctcaacatataatgttaccccgatgcaagccggcgtgtactttaacaaaatccagtgtttttgcttcgaggtaggaggagttggattgggccgtcaactaccaatggcggagtttacatggcacagggccaggcttggaggcgctctttactattatttactgtaattattgctttctcnnnnnnnnnnagcggagtttgcatggcacagggcctggcttggaggcgctcttcactattatttactgtaattattgctttctcggagaagaccgtgcaggaatgagtaccagatgtcatatgtcagtctggtcagggcagccacatgcctgacaccatgcctgcaaggtctgagccccctctgccctgctcctcaacgctcaccatctcccctgcaccaccgcggcaccctgccctcgtacatgcaggaacagaagctgaggccgnnnnnnnnnntctgcaaggtctgagcccctctgccctcaacgctcacaatccccctgcaccaccacggcaccctggcgtcgtacatgcaggaacagaagctgaggccgggtgagtccatcgacatgcccatcttcttctacgtggacccagaatacgccacagacccgcgcctgaagcatatcaatgccctcacgctctcctacacctttttcaaagtgtccgaggacgaggttgaggcgggtgaggaaggcttgccggcagcggccccccttccttccggggccctcgcaacgcgagtgacggcttgactcaacaagctcgtgatggccttgtggatccatgctgtggtctgccgaggctgggagggcggggtgcacccaccttaccccagcggcatcagatgcactgtccctttaagtctgtcaagctcacagaggctcacatagcacaccgggaggggttgaagctcgtggggcagcgctccgccacctcactgcatgcaagctcgcaatcactcactcgccggtgaggtacctgaagnnnnnnnnnnggcacaccaggagggttggagctcgtggggcagcgctccgccacctcaccgcatgcaagctcgcgatcactcactcgccggtgaggtacctgaagagcgcccaccctacaactaggactgccagggtggcgagcgcggtgacgctgaccacggcagccttgctcacctggctgccccatgcatcgctccttgaccctggagcggagtggtgtggtgtttggcatgagcttcttgggaggatgggattgggcggcctgggcgtgcatgccaagccccggaggcactggtctccttcgggagcaagctcatggacccggatgtccaccgcgcgatgcccccccctgccaagtatgctaacaattcagcctttccagggaggctctgcaatggcactctgcgcacccattccccctctcacctgcgtcgccctcctcctggacgtaggacttgggttggagggtgtacacgtcgtctgccagcgggacctctgccccaccctttgcggcccgccagccgggacccgagtctccggtggatacgtccacgtagattgcatcctgcgggtggatgcgatagagtgtgtgctggttttgcaaatgaggaaggggagacatttgtgtgatgagaaggaagaggcacgggagcggcgctgccctgcatccaggggtattgaatcgaaatgcacttatagccttcacacaccttcttacttactcactccaaaaagaaaaccaccgactccaggtcttgcctcccccaaaacacacccaccgcacctctttcagctgcaccgggaagatgcggaggggccggcaggtgttggagggggtcaggactcggagcaccgggttggtggggtaccactccagaatggacccatccttgagggagaagacggtgccggtggcggggcactcaatgccgtagttctgcgtcagcttggccttgatcaggccctcgctgtatgcgccctccgcaggcgaccttcagtggagggtcgtgaggttgattgggacaatccatgggccgtcctttgggcacatcagcccatggatgacggacctgtggtattctgccctgcaccatgcccatcgttcccacgaccatgtcaggcctccactccctcaccgagcctccagggcatagatggtgtcacggtaccaaagcagcaggatgctggtgccgttgatgcgcacctccttcctctcccctgcagatggattaggaagagttggttcacacaagccctgggtgctgtgtccttgcgccaggggtcgaggcacatcccatgcctgcctgcaagatcagtcatgaacgctccctaggtttcaatccgccccatgcactcacctttggggaggtcttccggagcgattgcgggagtgaagctgccagaggctgtcgatgaggaggcttgagcacctagagggccgatgcaggtgacaggtgtctgagtggcagggaggggcctccatgacatggcctcagccactcaccccaacaattgcgcggccatgtgcaacccccgcgtcacactcacgcatactccttggtccttgtgatatccgcgcaggcatgcccgccttgcgaaggctgaacaggggtctgcgtgcctgcgggagcgccatcatcctggcagtacagccagggataccagggcatcccctggaaatggagggtgcatgcagggcagtcagggttgccatggtgtcaatatgcgctgattgtgccgagtaccaccccgccgcagtgcatgaggccgcgcatggcccgtgtcgtcgccctcatgatctgggagttgcgcgctcccgggacctcaggaccccaacggaccggtggaagaaagcggaactgctgggcacatatgctcgcccggggaaggggcgtcgtacaaggtctacatttacaattcgcacataatctaggcatggaggagcgactacgggcccaggtgccgactgtggcagctgcctttcgggactcctgtcaactcgccagcgacagtctgttcgaagctcccggcttcgccatgcccgcgacgccgcgggatggccagcatccggggcagtacataaaatacagtcaggtcgagtctttcctggcgatggcggagcaggcgctgcgggcgcgtgaccgggctgtggatgctcttcgggacgaaaccgctgccctgatgtcggacttggacaatctccggggagagaagagcaaggtcggttcacggttcggagttttcccctttttatctcgagagcttcgatggcccgatttcatcccccgcagccagctggcctcacgcacccaatgatccgctccaggtggaggtggcagagtctgtggcggttgaggaggcccagcagttgtccagcctggtgcagcagctgcacgccgagaaggccgccatgcaggcggcgatgcagaagctgcagcgagaatcgcagtacctgacggacgagaacgccctgctccgaaaccagttgaccatggccatgaatggtgggtgggttgggggccgggcccaggggccaggagtgagcgcctgctgcaggtacggggtgcagttctcaggcagaaacccaccgtacagagcacggcctgtaccacttcttccaaaccatgctgaattggtagatgttcacactcatgccatgcatccgcgttctcatcatcggccccatctcgtcatcacccccccacccccccaccccccctcccgcgccgcagagcaagccagcggcgacatggaccagaacgtcagtcccctgggtccacacaccgccctgatcgcccacctgaccgacacgctgagcgtggagcaggatcgggcgacccaggtggacaacgagaacatgctgctccgggcgcgggtggccgccctggagaaggccggcctggtgagtcgcgggccgggtggagcgaggggggagaggggcggtgcagtcctggcgcgcgcagcacagttttcgacggtgcacttggcaggcgcaacggagcccttcnnnnnnnnnngcgcgggccgggtggagcgaggggggtgaggggcggtgcagtcctggcgcgcgcatcagagccttcgaccgtgcacttggcaggcgcaacggagcccttccgcaaaccccctcctctcacccgcgcccccctcacttgcaatcgcccctgccttcttccaggcccagcagagcgcgctggtcagctgcatcgaggagggggagcgcagcctgctggccagtgggcgccgcgcgtccctgtcgccccaggccgtcctctcgccctcgcactggcgcagcgagaacacggaggaggacggcgccgggtcggaggcggagagctcctcgggcggcggcgggggcttcagcacgcccgtggcgcgccgcctcggcactgggctcgggcctctgtcccctcgggcctccctgcaggcccaggcctcgtgaggacaggagggcaggcgccgcccggacctcagcccacacaggcgggtctcgtcctggcccagccaggcggcagcacgcagggcccagcctgcgtgactggcgggaggcggctggcgatgtgcgaaagaggcttgcgggccccacacttcccccgctgcatgactgccgagcggggcacgccggtgcgacgaccatgtgccgacaacgagctcccctccctcacagtgtatcattccacccagaccatcgacctgaccttctcctggaaaccctgagaccctgacctgtgttcccgcctatttttatcggactggaccccttttccagccacgcagacagacgcacgccctggctgtaaagctaagaatgccgaggaagcagtgttctgccggactctgcacgccgtcagtcacctgtgtcccttctcttgcaaggattgcaacatgttactgggtggccgacacagcctccatgctgtcccgcaggacctccttgttgcgggtgtagtggtactgcagctggctgtcgcagtacctcccagggtgccctgtgcagtgccggggtccagagaggcgccgcgtccaacacgtggttctagctggctgccagcccgtcggtggaggactggggtgcagacatatgacccatcccagcagtacaatgcctcagagttcccctcagccgccacgccctcgccacccgagtgtcacctgggcttagggcctcccgcgtggccacccacatctccnnnnnnnnnnaccagcccgtcgatggaggactggggtgcagacatatgacccgtcccagcagtacattgcctcagacttcccctcagccgccacgccatcgccacccgagtgtcacctgggctcagggcctcccgcgtggccacccacatctcccagacccgctggacctggtcccgctgggggatcgagccgcggctcgtggcatgcagcgcggcctcgaagcgggcccgcaccgcctgctgcacgcccggggcgagggggcagggcaggggcggcggctgggcctcggcccaggccaggtcgtcgaagaggaggaggcagcgcagggagagccaggggccgtggcgcgggtgcacgagcaggtggctgcaggggtccagccacgctgtgcctgctgcgacggccgctcgctgcatggccacgtaccccggtgcctcgctggcgaggcagtcggtctgggagtgggaccagacgacacgtgcagggggctggggcagactgcgttgatgtgggagggaggctgtggactgtagaaggtgtgtcggtaggaatgggatgtggtggtgggagaatgccagctgatgcgatcagggcgattcgtctggacgccggcacagcccaggccatgtgccatgcctgtaccactgccagcatgcaccattcctcgcgactcgatctaaccagtcatgcccatcaagcacacagcagaacaagagtaccacacctggccagcacagcgctcacggcgcactcgacgtaggcctccagtgggtgcggcagcgccgcccactccccattcgcggcgcagtattgcagaaaggggcgccacagcacggcgctgctgcccaccaggactgcgaatgcagcactgccagccctaccagcgggacgaatgcgattggaggagagggtgccgggcagcgagtcgttgtacctggggtgggtgggggcatgttactcgaggttgatgccatcgcttgcatgacaaggggggtaagtcagtgagaattgcttgccccatcgtgcaggtctcaagagaaannnnnnnnnnattactcgaggttgatgccattgcttgcacgacaagggggggaagtcagtgagaatttcttgccccatcgtgcaggtctcaagagaaactgggggatgagaaagaactgaatacatgggcaggtctctcacacaccagctcagtgctaatggactgatgatgtcgaagcctcgaggtgccaatgcttctgacagttgggtgacgagctgaccaggtgacaatgcacccatcacccatgcaggtgctggttcatcgatggccaatcccagcgctgatcgacaatgctttgccgctgacttgcaaccgcaatgagaccaggttttcgcgcaaatcagcagccaagcagtgctcgtcaagcggggtgcaccaccgaattcgcagatccagcgcgcgcaattcttgactggagtgatcgaacctttcggcgaacgctctcgagatcatggcaggcggcacccccagcgtgctcgtgaaacagaatggctaggaggtcgcagcagcaagtgtcgagtcggtgctgggtcnnnnnnnnnngcgagatcatggcaggcggcatccccagcgtgctcgtgaagcagaatggttaggaggtcacagcagcaagtgtcgagtcggtgctgggtcgctgcccacctctagtgtcacagacccaaccacccctcaaacgcggaggccggtctgctgcaaagctctgatccgggaccgagacgcgggtctgtttcgagatctcggtagaaacgggctaagtcgggaccctgcgccctccgcgtcgccatggtggccgggctggatctggccctggccattcgcccagtccaggaccagagccgtggcaacgtcctggtgcaagcgtgagtaccgagctgtttggtacactcatatcaatgtctcatgccgttctgtgatcgccgaaccgacgcatcgtcaccccctgcaggaagggcatccacttcctcacggcctgtgacgcggtggccgaggcggggcaggtgatctcctcctatctcgcccaatcccctgccaatgacgggtgggttggtgggaagaggacacaccatgagcatgccaggggctggtttgnnnnnnnnnngcctcctacctcgcccaatcccctgccaatgacgggtaggttggtgggaagaggtcacaccatgagcatgccaggggctggtttggagttgtgcttggtgatgctgcccaaggcaagagtagacacgagtccctggctttgaaggagggagggtgccgcctggtgtgggtctgcattgtccacgtacgccgattttgagcagcccatgctgtcaatgacccggagatggagcacctcctcctggacaggtctggcgacctcccgccccacggcgccgccggccgccnnnnnnnnnncctgcattgtccacatacgccgatttcaagcagcccatgctgtcaatgacccggagacggatcaccccctcctggacaggtctggcaacctcccgccccacggcgccgccggccgcctggcggtgctgggcgagcggtacaccgtgacgtaccgcctggtccacggtgtcctcctggccctggtcaccctgccctccgcctccgccttcctgtgcctcgaagcgctggacgccgtgcaccgcgtggtggcgggcctcctccgcggctccgcgctcacccccgccaaggtggcggtgcgcttccctgagatctatgccgcgctggacgacctgctaagcctgggcctggaccggctcccgcccggcttccgccacgcccccctggacgaccgcgtccggctgtccatgcccgtgtccaccaccgacgccaagcgccagttccggcgcctggtcaagggcgcgcggggtgggggagcgagcgaggcggggagcgtcgccggggacgaggccatgcacgctgcggaggaggccgccgccgcagcagcagagtgagtatttcttatttttgagaggggggataagggtggattctgaaggggatcccccactcagccagttccgtccgtaccnnnnnnnnnngtttctttttttttgagaggggggaaaagggtggattctgaagggtatcccccactcagccagttccgtccgtaccggtgttggcagctgcgctgctctcgtgcggccactgcgtcggcgagagtggatttcatgcagtcttcctcccctatgaccccccaccaccaaaaaccatgtccctctgcaggctcaacggccggannnnnnnnnncttcatgcagtcttcctcccctgtgatcccccaccaccaaaacccatgtccctctgcaggctcaacggccggacttcacccctggagggcgtgagcttcgccatcccgccggacgcgctgccccctcccccactgcgcgcgctgcgccgggcgcccgccagggcccccgtggtggtcgagcagcagcagcccgtcggggccccgcccccggccttcgagggggccgtgcccgatgcgccgccgccaggtgggcgcggcagtgtctcctcatgcgatgtggcccagcatttggcaggggaaggggcgaagtatgagtacagcgcaggcccaagcactgcaggatcgccctctgctgctgtcggggcccgggcactggctggatcctgcaacactctgagctcctgctgcctcttgccgtgccaatgcctccacgccccgattccctcaacctgcagcggcggggcccgagcctgcacccgccgccgccgcagaagacgagtgggccatgtttggtgccgaggatggcagcgggcggccggtcacaggggacctggggaccgagaacgaaaagaaggccgaggccgaggccgcgccggtcgcacccaccgcgtctgacgaggtgcgtgcctggcatgggtgggcgggacggggatggggtgatgcgcgctccgccggctagaagccggctgtgcatgccaggttccttcgtgccggtatttgccttgctgtatcccatgcctcacggccgcccccccccccccccccccccccgggnnnnnnnnnntcgggaccgggatggggtgatgcgcgctccgccggcgtcgggcagaagccggctgggcatgccaggttccttcgtgccggtattttccttgctgtatcccatgcctcacggactccccccccacccctccctctcccccccccaggacgtgatggagagcctgcagctggtggaagtgtggcgcgccagagccgcgggaggcgcgatcgtggaggccggggtggagggctgcgtgcggcgccgcctggcgccctacggcctggacggcaccgagtttgcggtgctgggcccgcgccccggccccctccccaccgccgtcacggccgcctgcctgcgcgcggcgggcgtgcacccggtacacacacagaccgcgggggggggagagggcggcgtcggcgcgcacccatcgtggcgcgcggcctt

SEQ ID NO: 42468 - DNA, 71 bp, Chlorella protothecoides
cccttcactgccacgtgcagcgctggcccgaaaaaaaaatccatgctccctcacctgtgacagccgcccct

SEQ ID NO: 42469 - DNA, 484 bp, Chlorella protothecoides
  modified_base (217)..(353): a, c, t, g, unknown or other
ggggtcgttgccgcgcggcccccccggcccggcgcccccccgcggctctggcggcggcactccgcgaccacacgccctctcgggctccgcggggagcccgtccccctcgtccacgggcggcccccggtcgagctcggccgaacgcccctcaccgcgcattttcgacaccgccgtcgccgcaccgcctccgcggctgtacgacgcagcggcctcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctcctacaacccctttgagctggagcggggcccctccggcgcctcccccggccccccggcgccggcctcccccggccgctcgcccatgctggcctcaccccgccaccacggcgcgcgccttgcggccc

SEQ ID NO: 42470 - DNA, 504 bp, Chlorella protothecoides
  modified_base (124)..(133): a, c, t, g, unknown or other
  modified_base (243)..(343): a, c, t, g, unknown or other
ggatgccccaagtgccggtatgcgtggaaggggtgcggcgcctgccgcgcgcggcgccccgcctttgtccgcccgcgcgagctgcgctggcggccggaggaggggcggccgcaggccgtgcccnnnnnnnnnnggccgcacctaccgccccagcgccgaggagtttgctgaccccgtggcctacatcgcgcgcatcacgggggaggcctgcgggcagggcgcggcgcacatcatacccccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgggacccgccctttgcactggagcgcgggacgacgggcaccagcatggagtccttccgcttcgccatccgccgccagcccaccgccaagctctgcgtgcgcggcgccggcgtcggcaaggggtccggcggcggcggcggcggcggcgccacgcacgcc

SEQ ID NO: 42471 - DNA, 61 bp, Chlorella protothecoides
aggtctgacccgggtttctgccgcagacggaggctggcacggcctggaagccagcatgcgc

SEQ ID NO: 42472 - DNA, 72 bp, Chlorella protothecoides
aggtccagtcctgacctggtggaaggggggtggggtgggggatcagtggacagagatcgggccggcggcggc

SEQ ID NO: 42473 - DNA, 10313 bp, Chlorella protothecoides
  modified_base (132)..(141): a, c, t, g, unknown or other
  modified_base (712)..(848): a, c, t, g, unknown or other
  modified_base (917)..(1165): a, c, t, g, unknown or other
  modified_base (1235)..(1244): a, c, t, g, unknown or other
  modified_base (2929)..(2938): a, c, t, g, unknown or other
  modified_base (4464)..(4503): a, c, t, g, unknown or other
  modified_base (5161)..(5170): a, c, t, g, unknown or other
  modified_base (5402)..(5411): a, c, t, g, unknown or other
  modified_base (6547)..(6556): a, c, t, g, unknown or other
  modified_base (6963)..(6972): a, c, t, g, unknown or other
  modified_base (7176)..(7185): a, c, t, g, unknown or other
  modified_base (7371)..(7380): a, c, t, g, unknown or other
  modified_base (8428)..(8437): a, c, t, g, unknown or other
  modified_base (8739)..(8748): a, c, t, g, unknown or other
  modified_base (9897)..(9906): a, c, t, g, unknown or other
tgtcgctgctggcggggctgtggggcggggatcgcccgggcgacggcgccgaagacgcctcgccgcggcagggcgtgccagcgctgtcgccgtttgacgtggcgaccccggcgcccgcggcggggcgggggnnnnnnnnnnccgcggccgggcgtgccagcgctgtcgccgtttgacgtcgcgaccccggcgcccgcggcggggcggggtgtgcccggcccgctccccacctcgccccacgacgagtggagcatggagatccggccctccggcctgcgcatggacgaggagtacgactccgacgacgggggccccgcgtcacgggggcggcccacccggttccgacccccgggccagtgatggtgccggctcgtgggggcacactggcgccaccatggccccaccccccgcaccctggccactgtgtgtgcgcgcgtgtgctggcactgtgtactgttggttgtgactgactgcagcgtgggagaagcagagaagagggagagtcccggacgggcgagggcgggggaggcagcccagggattgcgagctgcggcccgggtgagactcatcgcgttgatggccgcaccgtttgcccaccaagctgaaccgccgagacttggtccatggcctacggacgcatgacacttccatatacaaagaggtattgtcgacattattgtccatgtaccttctcaaagctgtcaggggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaagtttcgaggcgattggattgacaggaagctctgtgcaggcttcgagagcagcttttgtagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacacgatcaaacaggcagaacgccaaatattatctacttgttacggcgaccaggagccatcgaacgannnnnnnnnnggactcgtcgcggtcctggcgagcgttgatggccgcacagttcgcccaccaagctgaaccgccaagacttggtccacgacctacggacgcatgatacttcactatacaaagagatattgtcgacgttattgtacatgtaccttctcaaagctgtcaggggagaccctcctctgcagatataagctgcgcatggggaatgcaacctggcaggcaccaaggggcatggtactcctgtcccacaatgccggtacgaaagaagtgtcgaggcaagtggattagcaggaagctctttgcaggcttcgagagcagcttttgtagaggtctgccaacctccctggcgtcatgcaccgaggcagcctttcaggtcctgcctcatgatctgggttggccgtccaaccgtgcacctacacaccacagtaacacatgctccaggtcaactccagtacctgaggttcgctcgcctcgactgtgagtaaatcttaaattgagcgccgagagaatggtcgatgcgaaaaatcatacgagcataacaaaaagtttgccgtgaggtttacgttaccttatgtgacttgacacaaacagataatttccctgtaacacgatcaaacaggcagaacgccaagtactatctatttgttacggcgaccaggagccatcgaacgagcttgggttcaggcaaagacggccggagggcacgagcatattcatatcgcggccaggaacagcctcaggttcaacagcccatatgacaggcctggacggcgccgggtctcttgtaccggttgcctttggaaatgtcgaaggacgaaatgattcacgcctgtcgcagaggagcgcgatgtccaataatgaccgcgacttccaggtaggtgcagccgtcacacccccaccaccagccgtgccttgggctcgattcaggtcaaccctcacgcccactgccccccgcacacgcttgcaggccctgaaagagacggctctgagtcagttgaaggccaagcatgccaggaggtctgtcgtcctgaaggatgcggatggccaaggggtcaaggtggtggacgccaagcggctcaccaagatcggctccgtccagctgctggaccagctggtgccgatccagaagcacaacgctgaggtcgacatgatggagggcgtccatgcccgcctcacaaagtgagtttgacgaagggcaaggaggagagtggatggctgtgctgtgattggctgcataaaagtacatgccagggagtgcaaggggcactgcagatcccgaccctccctccatggcgccacctgttcacagggtcgaggtgtaccctcccacggtcaccattcggtaccatcacatgtcggtggagaccaatgccctggtgggcgacaaggagctgcccaccctcccccactccgtgtcgcacgccttcctttcctggaccgagcctaagcgccccctgtccatcgtgcacgacgctagcggcatcctgcggcccggcaggctcaccctcatcctcggaccccccagctccggcaagaccaccttcatgaaggcccttgtggggcgctaccgccacagcagcgatctcaaggtgagggcggcaggggagggggaaaatgcgagggtgcatggtggcaggtgcgggcctctgagcggagggagtgctttgccccgcctcgtctcatgcagcctgtcnnnnnnnnnngaatgcgagggtgcttggtggcaggtgtgggcccctgagcagagagagtgatttgccccgcctcgtctcatgcagcctgtcttctccccctggctctcaggtcaccggttccgtgacatacaacggcaagaacttcaatgagttcatgcccgagcgcgttgcctcctatgtcaatcaggtgtgtggtagtgcattgctgggcatggattatgtgtacctccctgcagcattcatccgtggaacggcctcgcagacgatagtgctggctggctgggtcccaggacttgagggttcggggtcagtcttgtaggggtcagggggttccgagctccagagctcatgtcatttcaccccccaaccccgcagttcgacacccactttggggagctgaccgtgcgcgagaccatcgactttgcggcccagtgccagtcctccagccacatgaaaggtgagcttggagtgcgtgctggcgctggcgtggaggcggaacgaggcatctgcacgcggggctgcacgctgtggtgggactcagggtcatgcagattcaatggggggtcactgttggccttcagcacccaagccatcccctgccctgctcatcacctccacataacacatccacccacccacagacctgctggagacggtgctggcgcgggagaaggaggcgggcgtgactcccgaccccggcgtggacgcgtacatgcgcgccatcgcctttggccactccaactccatcgccgtggaggccatcatccgcctgctgggcctggacacctgctccgacacgcttgtgggcaaccagatgctgcgcggcatctctggaggccagcgcaagcgcctgggcacaggcgaggtgggcgtctcccagtccctggtcctggtggcggacgagatctctacaggcctggactccaacaccaccttcaacatcaccaactccctgcgcgccatcgcccacatccgccgcgccacgctgctcgtcgccctgctccagccctcccccgagacctacgagctcttcgacgacgtcatcctcatctcgggcgggctggtctgctaccatggcccgcgcgagagcgtggctgacatcttcgagcgctttggcctggcctgccccgcccgcaagggcgtggccgacttcctgcaggaggtcaccactccctccgaccagcaggtgcctgtggggtgggctgccacggtctggggagtggagccactgacgcagggcgtctgaacgaagagagtgctgggcgcgggtggcttcatcggcggcactccggctttgagcggctgcaccctgccgccgctccactgtctccccccctcctttcccccccacagaaatactgggtggacaacacgagggcgtacgagtacgtcacggcttccaccatacgcgatgcctacctcaagcatcccatcgcgctggacatggagaacgagctggccgcggcctacaggccggagccgggcgccctggacctgcccacctacaagtgcgcgggaggcgggggggggggggnnnnnnnnnnnnnnnnnnnnnnnnnnnnnnnnnnnnnnnngtgcgtttgggcctgggtgaaactggaggtttgctggcccgcttggcagagggactcttgccccaccccgcgcctggtgccacgccctggtgatgccgcctgcgcatctggatcaggatcgccccatcccatgcactcagcgccccgactcagacccccgttccacccccctcaaacaaaacaggtacgcggtgtcgtacaagacgctgttcctgagcaacctcaagcgcacgctgctgctgcagacgcgcgacaagctgttcgtgtacgtgcgcgtcttccagatctgcctgatgagcgtggtggtggccacgctcttcctcagcacgcccaagacgacggtgtcggatggcaacatctactctggcgctgccttcttctccctggtctacatgctgattgggggactggccgagtcccacctcctcaccatgcgcctgccggtgttctacaagcagcgcgagatgatgttctacccgggctggtgcttcgccgtccccgccttcatcttccgcctccccttctgcttcgtggacgccaccctctggtcctgcatcgcctactttgccgtcggctttgacgtcagctccaggtgcgtggggttgcatcctggagaccaggggggtgggggagtgtctgtcactcccggccagtaccnnnnnnnnnnggtgcaccctggagaccagggggggtggggagtgtctgtcactcccggccagtacctgtgacgggtcgctgccgcgctccgtgggcgcccagccggggtgtgtgtggagggagtggggggcatgggaaaggtcagggctggactgcgtacacgcctccatccgctcgtgcccgctcccccacccccccttcgttcccctcttctgtttgcaccaaggaacacctcacaaacnnnnnnnnnncgctggcacgcctccatccgctcgtgcccagtcccccgccccctctccgattccctcctctgtttgcaccaaggaacacctcacaaaccacacgcaggttcttcgtcttctggctgctcatgttcctcacctgcgcatggtgggtgttgaccctgcggttgttgggcgggggtgccaccctcatgccctggccccgacgaggctcgcacctcctgcaatggagtgcagctcagccgccagcgcacacctgcttctgcccggctcctgtccccatgggcaagtgcatgtgccccgtccccacctcccctgctgacgccccatcctcagttcaatacctccgacccccttcccattcataactccgccccccaccccccccttccccagggccacatccctgttccaggccatcgcctcggtgtgccgcaccgacaccatcgcctcagcggtgggctccttcttcctcctcgtcttcatcgtcaccggcggcttcgtcatggtcaagtccgccatccccccctggtggatcggcgcgtactgggccaacccctgggcctacctcaccatgtccatctccatcaacgagttcatgggcgcgtcgtgggacgtgcccaaccccgccgaccccacgaacccgctgtccctgggcgagcaggtgctcgccttccgcgacttccccacctccacgcgcatggtctggatcggcgtcgccgcggggctggcctccaccatcatcaacgtcgcggtgttcgtgctggccaccaccttcatgcccccgcgccactccaagccggtgatgagcgaggaggcgctggaggagctggagtttgcgcgcgaggtcgcgccgcagcgcccgccccccagctcggtcacccgcgacatccagctgggcatccggcgcgccgcctcgacgcagagcatggccgccagcgccgaggagggcggcgcgggcccgcgcacgccgggcatgacgcccgtgccctccgcgctggacctgcccgccgtgccggaggacgtctccttcaccatggccgccggcgacaggcccgtgggcggccgcgcggcgccaggcaatggccgccggtcgccgaccgacggcgccgacgcgcgccactcctcgccggggaacggcaccnnnnnnnnnnctcgccggtcgatggcgccgatgcgcgccactcctcgccggggaacggcaccgacgggcaccactcgccggcggtcaacggcgccaacggtcgccccgcctcccccaccgactcgtcgctggccttcatgaagggtggcgagggcgcggccaaggccctggagtcggtgcgctcctccctgcccttccgcccgctggccatgaccttcaaggacgtgtcctacagcgtgcccctgcccaaggtgacctgggtttgggtgtgtggtgcattgtcttatctttttgtgtgtgtggggggggattgttgggagagtgtggtcgagtggaagctgtagaaacgttggccagcggggcctgcgagcgctggggtgtagggaaccgtcctccgcaggcccgcgcaacacctcnnnnnnnnnnaggtccgggtgtgtggtgcattgtcttactttcttgggtgtgtgtggggggggggttgttggggagggtgtggtcgagtggaagctgtagaagcgtcggccagcagggcctgcgagcgctcgggtgtaggggaccgtcctccgcaggcccgcgcaacgcctcacaaactcgtaccccccccccgctccgcacttctcaccccannnnnnnnnntgcagacgtccccgcgcagggtccccacaaagatgctctgcgcttgctgtcgggcatcaatggcatcttccggcccggcgtgctcacgtgaggagggcagggggtggtgggtgtctgtgtttgtcgtgggaggggagagtgtgctgcggtcccctccccatgggcatcgtgggcaggtcgtccccnnnnnnnnnncgcagacgtccccgcgcagggtccccacaaggatgccctgcgcttgctgtcgggcatcaacggcatcttccggcccggcgtgctgacgtgaggagggcagcgggtggtgggcgtctgtgtttgtcctgagagggagagtgtgctgcggtccccgccccatgggcatcgtgggcaggtcgtcccctctcatcgtccccggccgtcctctgttcctggaccccacccaccacgccacctcccctgcgcgcagggcgctgatgggcgcgtcgggcgcgggcaagacgacgctgatggacgtgctggcggggcggaagacgggtggcacggtgacgggtgaggtgcacgtcaacggctaccccaaggtgcagaagaccttcaaccgcatctccgggtacgtggagcaggaggacatccacctgccccagaccacggtgggcgaggcggtgcgtttcagcgcggccctgcgcctgccgcgcggtgtgtccgccgccacgcgagccgcctttgtgacggagatgatggacctggtggagctggaccgcatggacggcgcgctggtgggcatcctgggcgagagcgggctgagcatccaggcgcgtaagcgcctgaccatcgcggtggagctggtggccaacccctccatcatcttcatggacgagccgaccacgggcctggacgcgcgcgccgcctcggtggtcatggccaccgtgcgcgcggtggtgaacacggggcgcaccgtggtctgcaccatccaccagccctccatcgacatcttcgaggcctttgacgagctgctcctgctcaagccgggcgggcgctgcgtgtttgcagggccggtgggcctggagagcagccagctcatcgactacttcatggccaccccgggggtaaagcccatcaaggagaggtgagtgattcggggagagggggggagccttttgacggggggaaccttggtgtgtgtgtgtgtgtgtgtgtgtgttggacgggcagggtgatgtgtgcacggcaaggccaccgaggcaggggcccctgggagtgagtgggnnnnnnnnnncaagcccatcaaggagaggtgggtgattcggggaggaggggggggccccctttgacggggaaaccttggagaatgtgtgtgtgtgtgtgtgtgtattggactggcagggtgatgtgtgcatggcaaggcctccgaggcaggggcccctgggagtgagtgggtgcctgcgaccagtggcccaggcgcgcgccccgtctggcgtgcactgtggggcgcgccacggggccccctgagatgagggtgtccccatgtgtcacgcgggcgacgtgccccacgctccgcgctgcgcaccgcctgctgcnnnnnnnnnnagactggcgtgcactgcggggcgcgccacggggccctctgagatgagagtgttcccatgtgtgacgcgggcgacgtgctccacgctccgcgctgcgcaccgcctgctgccagacacccgtctgaggccaggctctgcgtgctggcctttccccttcctcgcccgcgccccctctcagctgccgagtgccgacccccatctgagcccccccatcccacccacccgcctgaaaaaccaggtacaaccctgccaactggatgctggagcagaccaacccgcacaacgagtcgttgctgggcgtagacttcagcgaggtgtttgccggctccaagcaggcgcgggagaacgagaagctgatcgaggccgcgcacgcggtggccccgggcatgcccgacctgcagtatgccgacatggaggtgtctggggcctgggtccagctgggccacctgctgcgccgcaacttcgtcatgtactggcgcgcgccggactacaacatcacgcgcttcggcgtgaccctgctggtggccttcgtcttcgggtcgctggcctgggagcagggcgaggcgcgggacaccacctccggcgtgctgaacattgcgggcctgctctttgcctccaccctcttcatcggcgtcagcaactgcatgtcggtgcagcccatcgcggagtcgcagcgcagcgtcatgtaccgcgagcgcgcggcggggatgtactccgtcgcgccctactccgtggcccaggtggtggtggagctgccctacctggtggtccagaccctgtcctactccgtcatcgtctactggatggtggccttcatcgcctccgcctccaagttcttctactttgtcttcatcttcggcctgaccctcgcctacttcaccgcctacggccagatggtgagctgggatggaggggaagggggggttggggggggatgggacaggggccgagggtcgtacacagatcgacgagggtgctggcgacgagggcgctgcctgcggcgggagcaccacaagtgtacgtgtggctgtggggcgcgcgcccagcgtgccgctcgcgcagcaggtccctggaagggatggtcaccctgccccgcgccgcgacgtccccccctccctcttccccccacctgccccgcagtgcctcaacnnnnnnnnnnaatggtgagctgggatggcggggaaggggggggggattggggtgggatgggacaggggccgaggatcgtacacagatcgacgagggtgctggcgatgtgggcgctgactgcgacgggagcactgcaagtgtatgtgtggctgtggggcgcgcgcccggcgtgccgctcgcgcagcaggtccctggaagggacggtccccctgccccgcgccgcgccgttccccactcccttttccccccacctgccccgcagtgcctcaacctcatgcccgagctggccctggccaatgtcttcacctccttcttcttcggcttctggaacctgatgtgcggcttcctcatccccgcatcggtgcgtgggcttggaggcgagggctgcctgggcgccgccgcggcctcgcccggccc

SEQ ID NO: 42474 - DNA, 398 bp, Chlorella protothecoides
  modified_base (104)..(304): a, c, t, g, unknown or other
gacggcgctggcgcacagcccgcgtgacggcgccacgctgtgcgcgggccaggccaacggtcagctgctggtgttcgacgctcggcgcgggccgggcgcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgggcgagggcagcgtggagtggtgggacgtgcgggccctgggcaccgccctggagaccctggtgggaggggaagcaagggggggggggggg

SEQ ID NO: 42475 - DNA, 62 bp, Chlorella protothecoides
ccccccccccccccccccaaaaaaaataaaaacacacacaggagtcgcctgccgtcgtggct

SEQ ID NO: 42476 - DNA, 72 bp, Chlorella protothecoides
aaggtaggtgtgtgtttctccatgttctggatggtggtgcttctcgcaaagccttccgaccttgcaccccga

SEQ ID NO: 42477 - DNA, 424 bp, Chlorella protothecoides
  modified_base (136)..(217): a, c, t, g, unknown or other
cgccgagcacgaccacgaggtgcgcctggcacgcctgctggaggcgggggcctggcgggaggcgcacgacgtgctctgcgcccacgtcgcggccgggcgcctgctggcggggggtggcgaggagggagggagggannnnnnnnnnnnnnnnnnnnnnnnnnnnnnnnnnnnnnnnnnnnnnnnnnnnnnnnnnnnnnnnnnnnnnnnnnnnnnnnnntgggccaggccatccatgccggcacagggagaggtccggcatcgccccgcccgaccttcgccgcggcacccgtttcgctctcccacgccctggagacgctggcgccccacgccacggccatcgacggctgggaggcgggcgcgggcgcgtacgtgcggcacctggccctccgcgtcgcgcacgccggccaggcgcgcagcacgggcg

SEQ ID NO: 42478 - DNA, 63 bp, Chlorella protothecoides
gcccgcgggcgggcggtggagcatgacggggtttggcaaggcctggtgtcggaggacgatggc

SEQ ID NO: 42479 - DNA, 106 bp, Chlorella protothecoides
cagccaccctggactccttccaaggtgggtttgtcggagggggcttggggagcagggtccagtgtgtgaggttccctacggatcactagccgtgctctgggcatgc

SEQ ID NO: 42480 - DNA, 4319 bp, Chlorella protothecoides
  modified_base (110)..(119): a, c, t, g, unknown or other
  modified_base (613)..(622): a, c, t, g, unknown or other
  modified_base (838)..(992): a, c, t, g, unknown or other
  modified_base (1062)..(1071): a, c, t, g, unknown or other
  modified_base (1563)..(1572): a, c, t, g, unknown or other
  modified_base (2063)..(2072): a, c, t, g, unknown or other
  modified_base (2470)..(2479): a, c, t, g, unknown or other
  modified_base (3113)..(3122): a, c, t, g, unknown or other
  modified_base (3677)..(3686): a, c, t, g, unknown or other
  modified_base (3999)..(4008): a, c, t, g, unknown or other
ggtggcgtaggcggacccgacggcggtgggggagtccacgctgccccggaaggcgacccgggtatctttgggcagcacgtccaggaagcggaggttgcggcccaggcgcnnnnnnnnnnagagtccacgctgccccggaaggcgacccggttgtcatggggcagcacatccaggaagcggaggttgcggcccaggcgcagaaccagggtgactctggggaccatggcagcggtggtgaccaccccctcgcagaccacctcggtggggctggtggaggtgcacatgatggagtccagggtcatgaagggggaggggtcggagccggcctgcactggatgagggggcaaggagttgggatgggggcgcgtgtgccctcccacaggcacgtcacatcctccaggggctggggccggcacaaggatgcctggtcctacctctgtgggggtgtggcgcgcggcggcaatgcccgagattcccacgagcatcacgacgaagcaaagggctccttgtgcacgcattctggagttgatgagagctggaagtggaagtgccgggggcttaatttgttgctgctccggagtgagcggccgatggtgccgtgctctcgcctttnnnnnnnnnngaggggctggggccggcacaaggatgtctggtcctacctctgtgaggaggtggcgcgcggcggcaatgcccgagattcccacgagcatcacgacgaagcagagggctccttgtgcacgcattctggagtggatgagagctggaaatggaagtgcctggggcttaatttgttgctgctccggagtaagcggccgatggtgccgtgctctcgcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttaaggcctcctgggtgcgcactgcatataaagaggagtgccctgccgcgcgcggtgtccgggccgnnnnnnnnnntggtgcacgccttgtcaggtcggaagcacaggatataaacgagaattaagaagtgatcactgggtctgcctcgtctgtgtttcgagtgactctgaatagccgcgtgtgttcaggcctcctgggtgcgcactgcttatgaagagaagtgccctgccgcgcgcggtgtccgggccgcgttgcaggtggcgtacgggaggcggccctcgatccggcgtctgccacgttttggggagtaagctttgaaacctctgcctacagcgactaatgcgacaaatggattgttaatcctccagcgaaatgccgaggtaaggatggccggtgtttaccattgccggaacccgagtcgtcgccctagcacggggcagagattctagtctggtccaatggaatcatctcgactgccttgtctcatgaaatcccagcgcatgacgtgctcctccaatatccttagtgcgtttgcgtgaaacttatcatttccgcagtctcccgttnnnnnnnnnngtgcgacaaatggattgttaatcctccagggaaatcccgaggtaaagatggccggtgtttaccattgccggaacccaagtcgtcgccctagcacggggcagacattctagtctagtccaatggaatgatctcgactgccttgtctatgaaggcccagcgcatgacgtgctcctccattatccttagtgcatttgcatgaaacttatcatttccgcagtctcccgttcagcccttacgacctcgacgccggtgtgccactgatccctgtaacaccgatgcatcatcccactatgcctataccagcgacatcctggacatattataagatctctctactgttcacgccgggtctcagggcctcgaattagagtaaatgtgcaccacgagctcccagatgtccgtggggtaccgcaaaaaaattctcaaacctccaaagaatgccgcgacaaattcagtctgctacatctacctaccgctccatctaatagcannnnnnnnnnaataccagcgacatcctggacatgttataagatctctctactgttcacgccggatcttagggcctcgaattagagtaaatgcacatcacgagctcccagatgtccgtggggtaccccccccaaaatcaaacctccaaagtatgcggcgacaaattcagtctgatacatctacctaccgctccatctaatagcagggaaaaggaataatatcacaaatcctcgctctgaacagagtcagtcagggtccgctctctaggtgcctctaacacagagccttgggcgcaggcgcgaagccatgcaggggatgaggccatgggcattttgcctggatgaaaggagctccagcgcccgagatgccaagatggttgtatatgtataccacatgaaagaaaataaannnnnnnnnncgatgaaaggagctccagcccccgagatgccaagatgtcgtatatgtataccacatgaaagaaaataaagaatgtttgatcgattgtaggcggtgctcttcgacctcgcccccggcactgggatagctttgctgcccacgtcggggtccgatccccccgccatgctgaatggttccggacggctgtgcctcaggtacgccatgccatcatgtaggaaacgtttcctagtagtccatgcactcgcctgtcgctgccatgccagagggccccatccctcctccgcaggccttttcgggggacagtgctccaccctcgcatgctctgggcgagggcagcgcactccgggccggaagacgccctgctgtcctccccccgcctcaacaagacgcggctgatgcaggagaaggtggcaaacctccgccagacctgcctgagggtgggcctccccgcttcgggcaccaagccgcagatcgtggagcgccttctggacctgcaccgggccgccaagcagtctgagggaggggccggggaggctggcgacctctcctgcagccccggagatcccacccgtacgccgatctccgcagcagcaacagcgcccgcgggcgcggggacgcccgccctgccctggcannnnnnnnnnccagccccggagatcccacccggacgccgatctccgcagcagcaagggcgcccgggggcgcggggacgcccgccctgccctggcagccaggccccgccgcggcgcccccacctccgtcctcggcgcccccacccccgtcctcggcgccgccctcccccgcccctggcgcacccttcccgtcccacctcccccccgcggaccccttctccgtgacctggctgggcacgagctcgggcagccccagcgtgcgccgcaatgtgagctgcctgggcgtacgctggggccccgacgcctcgtacctggtggactgcggggagggcagcgccgcacagctccgcgccgcgcgctgggacctggcatcggtccaggccatcatgattacccacgcccatggcgaccactgcttcggcctgcccggggtcctccaggcggtggatgaggtgtgagggagtcagagccatgtgtgtgtcctggagtggtttggaggggatacctggagggatagcgtgctccctttggtggcaggcgggctgcgcagcatgggcctcggcgagnnnnnnnnnnggagggagtcagagctttgtgtgtgtcctggagtggtgtggaggggatacccggagggatagcgtgctcctttcggtggagggcgggctgcgcagcatgggcctcggcgaggacaagcggacacggcgtttgggcctgctgcgatggcgagaaggggcttcccggagggagtggtgggcggcgtggcgtgccccgtgcatggaggagagagcgacccggcgactgccccacaacatgggcacacactcccgcgcagctttgcgcaccaacccccccgatccccgtgcctgccctgtatcgtggtcatccctgnnnnnnnnnngcactcccgcacagctttgcgcaccaagccccccgatccacgtgcctgccctgtatcgtggtcatccctgggggcctcctccctcctcccctgtcctgaacgtactgccaaccagccaaccaccatccccccctccctgccaggcgcggcggaggtccgggcgcaacgtcggcgccccgctggtcgtggtgggccctctggagctgcaccgcatgctggactgcgccgcgcggcgtggcacgctgcacgcccccgccaccgcgctctccttcgtggcgctgacgctggggcccaccgccgccgcggcgcgc

SEQ ID NO: 42481 - DNA, 63 bp, Chlorella protothecoides
tacaaggacggcggtcgcgtgcgccccgtcgtgtaccgcgccgcgctggcggagatcatcgtg

SEQ ID NO: 42482 - DNA, 61 bp, Chlorella protothecoides
ccccacccccaccccgtccgccagcctctcccccgacgcacccctcgcgccatccagcgat

SEQ ID NO: 42483 - DNA, 122 bp, Chlorella protothecoides
cagcatgaaccccgtggcccccgacctgttggaagggaatgaggtggtaatcatgtgtgtgggaggtggggatcggggtccacgcgccacacgttgggggcggggcatgctgctcggggctg

SEQ ID NO: 42484 - DNA, 15379 bp, Chlorella protothecoides
  modified_base (159)..(168): a, c, t, g, unknown or other
  modified_base (403)..(412): a, c, t, g, unknown or other
  modified_base (641)..(650): a, c, t, g, unknown or other
  modified_base (906)..(915): a, c, t, g, unknown or other
  modified_base (1128)..(1137): a, c, t, g, unknown or other
  modified_base (1236)..(1245): a, c, t, g, unknown or other
  modified_base (1540)..(1549): a, c, t, g, unknown or other
  modified_base (1799)..(1808): a, c, t, g, unknown or other
  modified_base (2101)..(2110): a, c, t, g, unknown or other
  modified_base (3254)..(3263): a, c, t, g, unknown or other
  modified_base (8154)..(8163): a, c, t, g, unknown or other
  modified_base (8958)..(9004): a, c, t, g, unknown or other
  modified_base (9089)..(9098): a, c, t, g, unknown or other
  modified_base (9781)..(9790): a, c, t, g, unknown or other
  modified_base (10212)..(10221): a, c, t, g, unknown or other
  modified_base (10583)..(10592): a, c, t, g, unknown or other
  modified_base (11805)..(11814): a, c, t, g, unknown or other
  modified_base (12170)..(12179): a, c, t, g, unknown or other
  modified_base (12396)..(12473): a, c, t, g, unknown or other
  modified_base (12564)..(12573): a, c, t, g, unknown or other
  modified_base (13561)..(13570): a, c, t, g, unknown or other
  modified_base (13667)..(13676): a, c, t, g, unknown or other
  modified_base (14152)..(14161): a, c, t, g, unknown or other
  modified_base (14768)..(14777): a, c, t, g, unknown or other
  modified_base (14945)..(14954): a, c, t, g, unknown or other
  modified_base (15178)..(15187): a, c, t, g, unknown or other
aggagcccatgtcggttctgtgacactgggaaaatggcagacctcgggcgtgcctgggactccctggtgccgaaacaaccagacgctgcggggtgggtccagggcacagcctgcgtggatgcgacgcatcgccgcacgcatctacgcttgactggcggnnnnnnnnnngaattggcagacctcgagcgtgcctgggacctcctggtgccgaaacaaccaggcgctgcgggttgggtccgggcacagcctgcgtgaatgcgacgcgtcgccgcacgcatctacgcttgactggcggtgtgggcgctggggacccgccgcgaccccgagagcaccgactggatccctattgtttcgaccgcgcccctccatgcacggcgcaggccgcggcagaggccgcggcaannnnnnnnnnttttttccgaccgcgcccctccatgcacggcgcaggcagcggcagaggccgcggccaacacagcggcgcaggcaagggcagaggcggcggccaatacagcggcgcaggcaagagcagaggcggcggagcgcgcctcgcagacgctcaccccgaacgacctccatgccctggagcggatgatgggggtgctaccggagctgacctcggagtgcggggaggtggtggacgnnnnnnnnnnaggagggggcgtggggcgggccggcggcggcggcgttcgcgggcgtcctgccggacatcctcgctgtcccgccgcgcctggctgcgctgggtgagaggatcgcggagctgcgcgccgcggcgtcggcggctcggggtgcggggcgcgccggggtcggcgcgccccgccccgcgtccgtgcgggagctgatcccggtgctgatggccgaggcggcggagatcgcggccagctgcgatgcctggcaggcggcgacgcnnnnnnnnnngcagcgcgccccgccccgcgtctgtgcgggagctgatcccggtactgttggccgaggctgcggagatcgcgaccagctgcgatgcctggcaggcggcgacgccggcgctgctcaccctggcggacgagcaccggggcagggcgaggctgctgatggcctccgccaaggccgaggaggagcggcgggggctgcgcgacgagggggctgccgcgnnnnnnnnnngccgccctggcggcgggaaagagcctggagcatggggccgaggccgcggctcggccggtgcctccgatggaggcggacctggcggccgcgccgcgcccnnnnnnnnnnaccgcactggcggcggggaagagcctggagcacggggccgaggcgccggctcggccggtgcccccgacggaggcggacctggcggccgcgccgcgccccgtcgccacctcgctcttccaggcccagccccgcgccaagccggagtggatcagggcgacgatgcagcgcgtgggcggacggatgcagggccaccagcccgtggaggtggaggtggcgggcctggtccgggaggccaccgaccccggcgccctggccgccatgtacgagggctggatggcgtgggtgtgagctcggnnnnnnnnnncaggccaccaaccccagcgccctggccgccatgtatgagggctggatggcgtgggtgtgagctcgagggagcgatggacggaaccgtctggcgcagtgctttccgcagcgcctgtgtgcccctgggatgctgtagactgggcgaggagcttgctgccggggttccgtgaggagggacggcgggggagggacgatgccttcccggtccaggtggaggatgagtaatagtccaggccggtagttgcggagcnnnnnnnnnnctgcccctgggatgctgtagactgggggaggagcctgctgccggggttccgtgaggagggacggcaggggaggacgatgccttctcggttcaggtggaggattagtaatagtccaggccggtagttgcggagcagcttccctcggggccactggcggtccattatttggtacgccaatggccactggcgcaatcagagccttaaacagtcacctcgagatataatatacacatataaataccaatagcttgaactccagaaggccagtaatcgaaacatcatgtccatgatgnnnnnnnnnngtataatatacacatataaataccaacagcttgaaatccagaaagccagtaatcgaaacatcatgtccatgatgacgagagtgggtctgcttaagcctgccatgctcgggtaccgggcctccctgaccccgatcacgatgtcggtaaggaacatcagcatgacgccggcctgctcgggcgacaagaagggtgagtctgatcattggggttgctgtgtgcgcagaggattgtgtgttcgtgcgcagggcagagtgatccagccccagtagtcttccgaggccgttccggacacgttcctcggcggctgatatcgcagatgaggccgccacctcccaagcaaagaagtcgagtgtcccagagcactgggaggaggagaacgcgtctgcgagtgaggccaccgtcaaggctgacaagacggaggtcaccagtgtccaggagttgcaagagctgtcagtgaagaccatcaaggtgtgggggagagtttgctggtggtattatatctgaaaggggcatggcactgtatgccaggcgcttacattgctgaaacaaacgcaaactccttgtattcctcttacgtccccacagggtgagaagaaccacatcaaggagaagatgacctccagcaagtgaaggggcatgcagtggctttgtagcttcaagcgcatccccgacaatgtgtccctcaaagcatcatatggcgtatcctgaggcctatctcttcgtaccgtgtctttgcccgcaaagggcaggctacctggcctgtccactcacattctgtgcagcattgcatctgttgtagaaccgacaagtagcatttgcacaatcgtgaggggcagcaatcttcaggcgcaattcaaccaggattggctcggtttagctcgacccatgacttgcgcacgccagtcctgaggtaatgcagcctttcttgacgctgccttcttctcaggtcgtccctctcctgtagcatctcccgcttgctcttctcgagagcctccagcgtccgctcttgatccttctgtgcctcacatatcctgtcacacagtgggcatttggtgtccgtttcaaattccttgggaccgatcaggcctgttgtctactaccaactcgaggtttttcacaaaagggaaccattggtgtgcatcannnnnnnnnnagtttcaaattccttgggatcaatcaggcctgttgtctactggcaactcgaggctgttcacaaaagggaaccattggtgtgcatcatagcaccacatgcttctatggagctgacatcactgaccccctgctacgccaaaccctccttgcctgtggtgctgcaacacttgctctgggaggtcagagtagtccttctcataatcgtcccaggcaatctctgagtgatgccggagaaggcgaggccaccacatctcggagtgcatccagtgccttgccagggtgatggggagagcgaagcgccgtgagtccagggacccagactctggctgctttgcttgctgggacatgcagaaaggccagcgcattcccatcttcaaggcatccgcggcaggaccgtcacatgccatgccccaaccctttctcacttttgcaagagctccaggttcatcttctgaaggtacagcatggtcccgtcctcgccgctcccaccgccatgcgtccacacagagtcctcgggcacgatgccccgctccagggtgccctccaggtacacctcccccgtgtccttgtttgagactgcaggagtgcccgtaccaatttggacgtgtgcaagaggctggcccaattttgcattacaggagatcccctccgataacgacagaaggcaagcgcctggccgccactctcagggatcacctttgatggagtagggctccagggtcacgctgagctggcgggggcgcagcgtgtgcggcactttcagcacgcagaccttgacctcagcaccggtctgcctccaacggcaagatccatccgccagctcggcccacagctggtggaattggtaaaggcagagcatgtgatagcactgtgcaaccatttaccagcacgttcatgcgaaagccttgaaaaccagttcctttgccgggcgccactcacctcctccggcttctccgccgcatcatagtacactcggctcatgcagaaggggtgcttgtccaccctgtccaccgtggatccatcgatgcgggtgatgcgatacatgcgatacggcacctccagctccattttgggtggggtggctgggacgagcggcccggccgagtcagggccgccggcatccaggggctggacgcccctgggggtgatgtccaccacgtctgccgaactggccccatgatccacaggtcccaggcttgaaaccgcggataggacgctctccaaggcagcctcctgcgctgctggagtgccctgcaggcatacagcacgagtgagagatttgggacccagcccaggaaggggcactcctgatcatgcagaggtgaggatgtccaagaagcttcaaaggcaatgcatgcccggcatcctcccaccatttctcatgcccacacttgtctccccacctcgacaagcctcaggatctggtatgcggcctcctcattcccgcccacagcagcctccaggcgaactcccaagtagggagagtctggccgagggtttgacacgcggtccagggtgactcgtcgcagctcaaggccggcagcagaagcaagggcggcacggagtgcctgtcgcacgcccgctgtcagggccttggtggaggcctgtgggagtacgacagtgagagcgtccacacgatctcctgaggcctcattgaaaatcgtgcactaccgtgcggcacccccccccgcttcccccacaagagctcctcctatcgcatacctgccacacccctcctcttaagagtctttgcacacacctccatagcaccatgtactctgcagacccctgctgctctgacccaacatcctcgtcaccgcctacctcggggaaggcgagctggatatccaccctatacaaacgggctcctgctgctttgctgaccccatccacgaatccaagggcctctgggtgacacaggcccccatctgccctggagccggtgttgaaaacctctgcacgcacctgcaggcacccagggcagcttcacttgttcagcaggccttggtaagcgcaggttgcacgtcactcgcacgcatccccgagagtttgaggtacggcaggaccacggatggatggcaccgcccaggcctcgccaccttccttacacaggccagcgaacccctccaaggccccagcatcggggtatcccagccacacctggtcatactcctccttggtgaggtccttcacagcctcttccaagctcgcttgcacagacagcagcccctgatcgttgtccagagccttgaggaagcaggcggcggcaggcgcaggggcccggtcggcatggccctgcaccgccaggtatccggcgccctgacaggcatacgcctgcgccagctcaataccgtggatatcggctttgaacaggaggcggacgctgtgctcggcatccgcagccgcctggaggaagcagcggcccgcggcgtgaatgcgagagcgctctatcagggcggctggtggggagatgcccgatgtgagccaggagaggtacctaggcagaggagttcatggggtatgtttgcaggactggtggcgaggggggggcatgcaaaccctgcacagaagagcgacactgacttaatcatgggcctgcatgcaacactcccaaccaatcacacaatgcgccccaaatccctccaattggattgccagtgccaatggacaggatgcaaaatcacctggcatagtaaggccccggactggggacgccgtgatgagcttgcttgacaaccaggaaagcagcttcgtgaagagcatctacagggacacactccacagtagccttggggatggctccctgtgcgatgtgtaagtggtgtgtatatgatgtgcgggcgttaagaaaacacgaatgatatattcctggcatggtttacactaggaaaggaccacacacacacggccaagcacaactgacctcctggacggcagcttctatgagtcccagcatcccactgcccagctgctctcgggtgagttttcgaaccacggcctgaagccttgcagtgctctcgctgtctcctgcactgggtggcagctcgtcaggcagggagcatgggatgccgcaaatcctgcctccaaccatgcctgggtctgcctcacctccatttattgtccacaccctcagaaaggcctgcacagcgtctgcaatccgatgcaagccttccagtgctacacccttcctccagtatcctttgtcccaggatggagccagggccactgcagcctcggcatcttccagggccttctcgaaccgcctagccttggtgtgggccagcgctcggttggataagagagcccgcatgaccgaggaactgggttgtaaatcgatggcctcgtcgtacctgcccgtttttgaagggccgaggagctctcaagaatttgaatgctgtcacagggcggttattcaaccagcagccagaccatccaacccatcgcactgcacacatatacttgcttggcgcatgcttctcgcagattgccgtctttcaaggctgcatcccctcgcttttttagatgttcaactttcagctgcctgcaggttgacgcggcatggtgtcaaacatggagtgtcagggtgttgtcaccaacacgcacgatggcggcgatgaatgactacagcgttctatataatgtcgaggcctcagcagcagcacccacccacctcaggctggccgacatggagttgcacgggactttgctcccggtgcccgactccacggcgtcgctcaccgcccgcaccattgcaaaaggccgagccaatctttgcagctcatgaatctcggttttcagcaccgtatcactgccacatccccactccacgtcccctgatattcagggggcggggtgtttccgtagtgcaaagtcaacgcgcgcgaaactgagcatcctggttcgaccggaggtggcaagtttgatgccctaagcaccccccacgcacctccagcgatgcatgtgacaaaaccccaagatcgtgctcaggttgaccagatcattccttcagctcatcccgctggcaaggcgacgctgtcctcacaagcctcagggtacccctattcagaaaggcctccccagcccgccctgtcctttccatctggacagggctggacagctccagggcattggtaattgcaaaattggcacagtatagtgcaatcgaaatacagtatggattcctcactgcgtccccagtctcgatgggagacactggcactcggcatcgcgttgggcacctccgtcactgccgttgcggcgtacctgggctacaagtacggcacccagtccctcatcgaacgccatggcggtcgattaaatgctggaagacgcaaaagcgcggctcggtgagcaccctggagggcagatgctcccaccgttgcattgctctttgctggtgcaactggagtgcctcccccacagggagtgctgaggcactgcaggcacagtccgcctcagaggaccctgaaacccttgtacagggctccaccaagccgtgcaaccagccctggggttccaagatctgctgcccggcgggggctggagctcaatggcggtgggtcgggcgacggtatggacatggtcgaagcggccgccgcacgagcctactacgaggccggtgcatcgctgacggtgaggctactgcaacagcagttggttggggaggcgcgaggtctttgtgagaattcactgcctgcatggtggtggcattcagcttgcaaagtatgtgagcagccttggtgcatgtaccacctgccaccccatcactccatgcctcgcctcgacagcgtccaagctcccgggctgcccctcccaatggccatccccgcacccgtgtgtcaaatgtgaggaagcttttgcctgggattcacgacctgtgcaagcatggagcnnnnnnnnnncggccatccccgtacccgtgtgtcaaatgtgaggaagcttttgtatgggattcacgacctgtgcaagcatggagccaatcgacctgtggagcatagcaggcttgctgcgcaaagaacctcacgtgaggtgttttactcaccactcccccctcacccccgcaggaggcgtcgccggcgctggcagaccccatccgccgtcccaactcccgccccgccatggtcatcgcgcccaccccggccctgaatgcggagggcggggacaccaccgagtactacgccacggacgccgacggcatggcccacttcccgcacgcgcccacaagctccggcctcatgagcgcctccgaggcggagctgggcggccccctccacggcttggcccccggcgcccagacccacgcccacgcccacggcctgcagtacatcccccgccccgccagcacctgcctgtcgccccgcggcggcgccgccggcgcgggcgcggcgccgcccaacggcggcgcggcgcgcgaggcggtggttgccacccccgcagtaccgcagtacctgaagccggggcaggggccggccatggtgcagccgcccacggcggggcatgtgcccaacccgggggggaatgtgctgatgcacacataccacacgccctgcgccggggtcgcgggggtggcgcccgccaccgtgacgcagtccagcaccaacgcctccttcatggcgcatgaaggtgtgtggaagctgggtgagggctggtgaggtgcagggagtggcgcgtggaaggggggggggggggacgggggnnnnnnnnnnnnnnnnnnnnnnnnnnnnnnnnnnnnnnnnnnnnnnntcgcggcctgagcacccgcgaactcacccccccacaggcaagatgatcgaggatgccgcgatgcacgaggcctacgtccgagtgnnnnnnnnnnccgcggcctgagcacccgcgaactcacccacgcgcaggcaagatgatcgaggacgccgcgatgcacgaggcctacgtccgagtgatcacgcccgagcattccccctcggaggagacggaggatgtctgctacatgctccaggaagccatggagctcaggcatgttgaatggcgcattttatcgcgtatgagggtgtttcagtggccacgtatgggtgccgggctgcgccgattcctgtgctgcatgccccgtgcatggccgcgcagcggttgccgtggcggcggcccagtgactgggattcaggctgcagcgcagtgcatgtcgattgtgcatgcattccacccgcaggcatctgatgaacttgcttgccaatcccaatcggaccccacgctgaacccacacatgcacgtacaggcgaaagtggctgttcaagccggtcctatcccccgagcagctgtcgcacctggccgaggccaaggagctgtctgactgcatcggcgaccccttccggtggacccctgccccctgcaagcccgactggcacttcaggatggtggacggcgtgtactgcgtctgggacggcgccgcaacggcggcggcgcccgcgccggaggcgcggggcaccccgccccccccggacctgcaaaccgcctggctcaccccccccggcacggccgtggatnnnnnnnnnngcggcggcggcgcccgcgctggaggcgcggggcaccccgccccccggggacctgcacaccgcttggctcaccccccccggcacggccgtggatttcttctccgacatgcactggctgctgcgtgtgtcggcgctgggcaacgtgcgctccttcacccaccaccgcctgctgctgctggagcagaagttcaacctgcacgtcatgctcaactcggacaaggagttcctggctcagaagtccgccccccatcgcgacttttataacgtccgcaaggtctgttcctgggtcgaggtggtgcagggtgctggggatggaggaccggagatctcctgtgcggctgagttgttgggaactcggtgtccccgacctgcaacaccccgccatgtctcaccactcaaaccccacaccccctgcctgccagnnnnnnnnnnggttgtggggaactcggtgtccccaacctgcaacaccccgccatgtctcaacactcaaaccccacaccccctgcctgccaggtggacacacacgtgcaccactccgcgtgcatgcaccagaagcacctgctgcgcttcatgaagtccaagctgaagaaggagccggacgaggtggtcatcttcaggcgagcggtggcttaggctgggatgaggagatcgggtgtgatgcagcgagggcattgccgatggaatcaagcgggcctctgcaatgatcccccatcgacatggttctccacaatcaccccatgccctctcccgactccgatcgccaagcaccgccgtcctgcctgtgacgccccacnnnnnnnnnnggggctgggatgaggggagcgggcgtgatgcagcgagggcattgccgatggaatcaagcgggcctctgcaatgatcccccattgacatggttctccacaatcatcccatgcactctcccgactccaatcgccgagcaccgccgtcctgcctgtgacgccccacccccctccgatgaacatccaccgacagggacggcaagtacctgaccctgcgcgaggtgtttgagtcgctcaacctcacgccctacgacctcaatgtggacatgctggacgtccacgccgacaagaacatcttccagcgcttcgaccgcttcaacctcaagtacaacccctttgggcagagcaggctgcgcgagatcttcatcaagcaggtgggagagggggtcggcccccccctgcatccacaaacatcctccccccatggtttgcctcagtccagcggatccctcccccccctctgccgcatgcacccacccgacacccaccctcccctcccccctcgtaaacacccaagaataccccccttgccaggacaacctgctgcacggccgcttcctggcccagctgaccaaggaggtgtttgtggacttggaggcctccaagtaccagcacaccgagtaccgcatctcagtgtacggccgcaagcccaacgagtgggacacgctggccgcctgggtggtgcagaaccggctggcctcggacaacaatatgtggctcatacaggtgcctggggagctctttgcacgtggctatgtaatggggttggggggggggcgggcacccggcgtcgggagacgaagcggtgccggtccagcctggtccttgcgggcatgtgcgatccttgccaacatcgtttcagctgtccagggtggtgccatcggcctgagaagagggtgttggtgcgtcaggggagatgtggactgcgccgctggtcgcagaaggcacaagctgtctctgcctgtcgtaatcactcgagtgttccttgtttccacacacacagatccctcggctctacaatgtgtacaaggagtcgggcatcatcgacaactttgaagaggtgagcggctgtaatgggggttggaggtggccgcctgggtgccatactcagctgctgtatccgatctccgtctttgtgtgtactcgcaccatgcatctgggcacgtttgtgtgtagatccacagtcagaatgagcgagaacaccatgcctgtgccnnnnnnnnnncctgggcacgtttgtgcgcagatccacagacagaatgagcgagaacaccatgcctgtgccgtgctgcgccattccttccatgcgtcgccgtccctcacaccacagctgctggtgaacatctttgagccgctgttcgaggtgaccaaagatcccgagtcgcacccgcagctgcaccttttcctgaaaggggtgagtgccgaggtgcaggaagataatgaagcgattctgacaatgccgaatgtccctccagcacgccgagtgcttgaaacgaggtccccccttggattgcaggtcctcgctcccaagcattcccctcgactcccttccccccaaacaggtcagcggctttgatctgnnnnnnnnnngaaacgagatcccccccttggattgcaagtcctcgctcccaagcattccccttgccctcctcccccccaaacaggtcagcggctttgatctggtggatgatgagtccaagccggagcgacggcccaacaagcacatgcccagccccgcagcctggaacacaaagtacaacccctccttcgcctactatgtgtactacatgtaggcagggaggggggnnnnnnnnnnnnnnnnnnnnnnnnnnnnnnnnnnnnnnnnnnnnnnnnnnnnnnnnnnnnnnnnnnnnnnnnnnnnnncgggtctgtgtccaccccaagcctggccatgaccatcaccccaggtatgccaacctctttaccctgaacaagttgcgagaggcccgagggnnnnnnnnnnaaggggtgggtgtgaccccggtgtgtgggcctgtggactgccgctgttgctgggccggcttgaggcatcaggggagggagtcaaggtgatgggcatgggtctgtgttcaccccaagcctcgccatgaccgtcaccccaggtatgccaacctcttcaccctgaacaagttgcgagaggcccgagggctgaacaccttctccctgcggccccattccggtgggtgaagttcgagttgtgagtgttggctgagccagcatgggtgacccatgattcaagcccccagactgcatgcctgctgtcggacccacagacaggaatgtctgagcacctgagtcttgcagacagagtatacccctttcttcgatatgccatgccaggcgaggctggagatgtagaccacctggcagtcacgttcatggcggcggagaacatcgcgcatgggatcaacctgcgcaagtccccctccatgcagtacctgtactacctggcgcaggtgtgatggtcagtcgggcgcgccgggcagggcgccggctgcatgcccgcacggagttgtagccgtcaggtttgctggacattgcatgcagtcaatggacccggggcaactgccgcatcccacccttggctcaggtgggcctgtgcatgagccccttgtccaacaacttcatcttcctggactaccaccgcaaccctttcccaaccttcttcgcgcggggcctgagcgtcagcctctccaccgacgacccgctgcaaatccacctgacaaaggagcccctggtggaggagtactcggtcgctgcccaggtgaggagggtctggcgggtccagcagactgaggaggaccagcggcggagcgcggcacatgcgcgcaccgaaccccactccatgccatgcaggtgtggaaactgagcgccaccgacctctgtgagattgcccggaactctgtgctgcactccggctacccgcaccaggtgcagcggggtgtggagcnnnnnnnnnntagctgtgccatttgctcaccaatcctcgtgcatgagcatggccatggggaaatgtctgccctcctctgcccatgttcaggtcaagatgcactgggnnnnnnnnnntcgggtgaatccatgcacggtctgggcgacgagcattgctgtgtgactgcatgcagccctccccacactccacagctgtgccatttgctcgccaatccacgtgcatgagcatggccacgggaaattgtctgccctctcctgcccatgttcaggtcaagatgcactgggtgcacaccaagtactggaagatgggacccgaaggcaacgacatccagaagacgaatgtgcctgccctgcgcatgagattcaggtcggtaggaggttggtgctacagagccagcacagggcagggattggtgtggcaatgtgtggcaaggtactgtcgtgctggcatcctgccccttgtgccttgcaccatcccctccctctgtgcatgccgatgaacgaggcaccctcactcccaagcaggaaggattgtcatactgaagaggtcacgctcctgcagtctggcgcatcagcccatgccaacaggctgnnnnnnnnnntatgaacaggggcaccctcactccctagcaggaaggactgtcatactgaagagtttacgctcctgcactctggcgcatcagcccatgccaacaggctgcgggaacgtaagccaaaggactgagcagcttctgtcccctgctcccactcttatcatggagcttgtcaagtgctggcgtgtaggatctgtgcctgctggggctgtcccaggcccagttgtgacaagtgacaggcaaagtggggccattgtgcagatgttgtgccagatcaatgccccaggatcccccctgccgggcgtgcaccggccgcacagggcctcccaaagatgacactcgtgcgaagtcgaagctacgaaggctatgcatgagcgagatgaggggccagatcaccagcgcacggtcagagcacttgtgctgccctgtccaatcttgacggccactacttgggcgtacgacgcgagtgctgcaccggaagcacccaaggtcattgtggctgtatacggagcgacaggcttcagagtggttttagtcttaattatggcatcacttgccgcgaagagtgcggagtagataacgcttgggctgaagctagtgatcgtcaaagagaacnnnnnnnnnncgcttgtaagtgaagtcgttctgaattatggcatcatctgtcgtgaagagtgcgaagtagataatgttcgggctgaagctagtgattgtcaaagagaacgcgaaggtagaacctgttcgactgacagttccactgacggccccaaaccttggcggtggtggggcagcnnnnnnnnnngtattccttcatgatgctcaccaacaatgacttcgatacgatggttgtgacggagggtgaggggctcggctcggttgtcgtaaaactcaaggatagtaaagatgtataaatgttgcacgtgatgtagttagcaatgtaccccggagtggtaacaacacacgttatgtcgacaagtccatctttcggaacactaaattgaagtgtggcagttgcgggtgccgatnnnnnnnnnngaaccttgtgtgtacaccaaagcggagccaagaggatattccttcatgatcttcaccgacaatgacttcgactcgatgggtgtgacggaggatgaggggctgggatacgttgtcgcaaaaagtaaggctggtaaatatgtatacaagttgcacgtgaggtaattaggaatgtaccccggagtggtaacaaca

SEQ ID NO: 42485 - DNA, 89 bp, Chlorella protothecoides
ggtgttgggcaaggcccactgcagcggcctagaaaggcggaagactcccaccacccacgagtttccccaatgcatccgtggcaatgtga

SEQ ID NO: 42486 - DNA, 5927 bp, Chlorella protothecoides
  modified_base (135)..(144): a, c, t, g, unknown or other
  modified_base (599)..(608): a, c, t, g, unknown or other
  modified_base (696)..(705): a, c, t, g, unknown or other
  modified_base (786)..(795): a, c, t, g, unknown or other
  modified_base (1486)..(1495): a, c, t, g, unknown or other
  modified_base (1778)..(1787): a, c, t, g, unknown or other
  modified_base (2284)..(2293): a, c, t, g, unknown or other
  modified_base (2803)..(2812): a, c, t, g, unknown or other
  modified_base (3366)..(3375): a, c, t, g, unknown or other
  modified_base (4477)..(4486): a, c, t, g, unknown or other
acccagacccgcaacatggtaatcttcagggctcggactgcagcccagctggggggcaacccagttctccgccgcgatgacgcccgaggacggcggcgcgcagaatggtactccaggcgcctggcagccgcccannnnnnnnnngcacgattgagatgctctgtcacctcatagtgcctctggccaacccagacccgcaacatggtaatcttcaggtctcggactgcagcccagctggggagcaacccaattctccgctgcgatgacgcccgaggacggcggcgcgcaggatggtactccaggcgcctggcagccgcccaggccggagcctgtcgtccaggtgagtgcgcgtatcggcgtgcctggggatgagtcacgactgcatgccaccatgcacattgcagctggcgatgggcacaggagcccgagatcccactgtgcagtacttgaaccccccgccacactccattcgaccccatgatgccaggcccggccaagcgaaacctccactcagccaccaccctcattgggcggcgtcagctcatcagctgtacctccagaggtgtggcttgttgtgataaaacctgcactgggcagtnnnnnnnnnngtgtgcagtatttgacccccccgccacaccccattcgaccccatgatgccaggcccagccaagcgaaacctccactcagccaccaccnnnnnnnnnnggggtttgcatctgaggactggtcccaaacacagacctctgaccatcgagtgcgcatgtgagcagcttgctcaccccgcannnnnnnnnnagggtttgcatttgaggactggtcccaaacacatgcctctgactatcgaatgcgcatgtgagcagcttgctcaccccgcatgctcacccccaggaggtcttgggtgggtacaaggatgcacctgccgcgctggccgccgccgagaactatcggcgcctggccagcgccgccgagtccgcagcagcccgcttctcgcgcggatccggcgccggcgacgactctggcgccagccccgacggcgacaatggacgtgcccccgagggcggcaatggcggcgccccgtccagcggcagccccccaggctttgtaaagcgatccaacagcgagatcaggcgggcatacgacgccgcgcccggctaccccagcaagggcgagattgcggccccaggcccaccctccgccccccctgcggcgcccgggccaggttcgccagcgacgggcgaggacgcgcccagccccgccgccacgcggcctcaaggcaccccccctccccctggcaacgacgagctggaggagctggaaagtttgacaaagaggtttgaggcgctgaagcgccgctgaaagaggaaagcaagggagcagaggggcgactctctgtggcccatcaccctctattctgttcggtgtcccttgcccatcctcgttggatctcaactaacacctggccggccaataacacgcctgttgtcannnnnnnnnngttctgtccggtgtgccttgcccatcctcgttggatctcaactaccccctggccggccaataacacgcctgttgtcagtgtacagtacaagttgcctccgggtgccgcggaaaatcatcgggcgggggccttaggggaggggtcacgggtcatctctgcgacggggagctcctgggctggcaacctggcaggcaccagggtcatcgccaggaagccgaccaggatggtcaggccccccgcggccgtgagcaccagtggccaaaaggcacgcagccaggcgggnnnnnnnnnncgtctctgggtgctgcggaaaatcatcgggcgggggctttaggggaggggtcacgcgtcatctctgcgacggggagctcctgggctggcggcctggcaggcaccagggtcattgccaggaagccgaccaggatggtcagcccccccgcggccgtgagcaacagtggccaaaaggcacgcagccaggcgggggacctgaacagagcgtcggctgtcacggccagtgggatctggagggacagccccgccgtcgccagggtggggcctggcaggggccagggtggcacgatgagatcaacaaaactgttggaggatcagaaacaatttggcatgcctttgctttgcattggcagggcatgccggtctcatggctgccctcctcaggatgccaaggaacgatcaacaagtgctctgtgacggggccattcttcctccctgacccaatgatactgcaaattccaatgccgccctccctgttctcaccgatgagaaggatgnnnnnnnnnnctggcagggcatgtcggtctcatggctgccttcctcaggatgccaaggaacattcaacaagtactctgtgacggggccaatcttcctccccgacctaatgatactgcaaattccgatgtcaccctccctgttctcaccgatgagaaggatggctctggcccacaggtagtcggagagcacattgtccagcaagcccttggccacgatggcccagaaaacgggccaagtcagcgtgcccagcccggcgccggcgagcagcgcgaccaggcccaacgctgcgccgcagacgaagatgatgctgcccatgtacccgaagaacagcagcacgctcgtctgtgtgtatgcatgggggttgtttgggggaggggccgcgggttttgtggggatacaggaggcgctgcggtgtttatggagcaccggcaagctgccgtcatatcaaaagacgccgccgtcagcgaccctgcctcatggctgcagtatcatgcatgattccccccctctttcctcccnnnnnnnnnntggaaagctgccgccatatcaaaagacgccgccgtcagcgtccctgcctcacggctgcagtgtcatgcatgattccccccctctttcctcccccgcctcaccgtctcgtcctcgcccagcatcctgcgaatcgccacggtgtaggtgccgtagagcagggcgctcagcaggcacagcgcgtcgcccagcaggctgccccgagccgccgcggcgtcggggctggccagctcgtcggccagcgccacgccggctgtgcccaggatgagcagggcgatgcagcccagcttgcgcagcgtatagcgctcggagagcagcgcgacgctgagtaggtaagtgaagagcacggaggtggaggagatgagggtgttgctggtgacggaggtggagagcagggaggcgttgaaggtgaactgagccaggtaccacacgggcgcgacctgggcgggaaggggttgtttgtttgggaggggggtggggaggtgagagtgtctgattgggaaaagaagcaagggtcccttgctatactgctgcgggggtgatgcacattgacgtgnnnnnnnnnngtggttgggaaaagaagcaagcgtcccttgctacactgctgcgggggtgatgcacattgacgtggtgcagcaaggaaggaggtcaactagtccagggctgcgggctctgccgaggtcctcaaaggctcatgtacgacgagagatggggcctgtggggctctaaaccctcccacataaagggtcaagccactcaccaccaccgaggcgttgaaggtctgccaggctgtgatctgcgcgggcgcagcctcctccaccaccagcagcgcatgccgttgctgggcacccccctcgatgcccggcggcccgtcgagcaatacccgctccggggccgcccgtgtcgccacgagcctgccccgctcctcttcatcctgtggcagcccagctgccagtcgcccggcacggccgctcagccaggccttgaagtagtacaggggcaggtacagggcgaacagactgttggcgatgtaggtcagcaccgcgggcttggcgccagctgcctgtatgtcctggaccacaaagctggctgccacccagatggaggccacacacaccacgaagaagagcccggtggtggcacgcaggctcagccccaggcgcgccgcgatccaggcgtgtggagaagccatggcctcgggcagtgccggggccccacctgccagcgagggcgtgccagtctgcctcgggggcgccccctggcgacgtgcctactatactttgcctcccctcatgcccatcgattggactgtcgtgcgaaggactctgtgtgacgaggagggctgcgccacgcgtatatctggacgaaccagcaaatcggaccaagctcgcgcgctggcgcccgggatgattgtcccacaagaatctcagcccaccaaactcttcgcttgtcactgggagttgctatagttcacggtcgatccggtcggtgcaaaagtgtcccaatcattctgtcaggtcaggctgtcacactcaaaaggggtccgagggtctggcaagcgacaccccagcgtcgcgctcacaccaaaagtcacgcgacgggctccaggcaccgcagcgtcactccgcgccgggccccctggagggggccatgcggacgttgcccgcnnnnnnnnnngccccggcgtcgcgctcacaccaaaagtcacgcgaggggctccaggcaacgcagcgtcactccgcgccgggcctcctggagggggccatgcggacgttgcccgcgccgtacaggcgcgccagctccttcatggcgtgctcctccttctggatggcggccatcgagcgcaccggcgccacggcctcctccggcacgtaccacttccccggcggcgcggagtgcggcgagctgcccagcagctggcggccgccgcccgccgcgccaggcgtcgcgagccccggccccgcccgcctccgctgctccacgcggctccactgctcctccagcacctgctgcatggagggcgcgggcgccggggacggccctgacgtgccccccgccgtcttccaggaggccccagccctgagcgagcgcgaggcaccctccccacccttgaggaaggccgccaaggggaggcgctgcgcggcgccgccctcctcgccccgcgccgggacggtggaggggggctgctgcggggcggcgggcctctttgaggccgtgggccgctgggcagtggggcccggcgaatcggccaggctcagcgacgcggcctgcgtggccacgccggcgacgccggtgcaggaaggcacggcgggcctggcgccaccccaggcaggcccaggggaggtcgacgtcggtggcggctgcggccctggtttcgagcgcgtgggcgcatccagctcgcccttcaagaacagcgacaggccgcctggcgcaggggtttacgtgagggcagggacgtctgtgatccgacccctcgttcccgcccagcaggcttgaacagcccagccccggtgtccagcacaccatgctcccctccccccaaccgccctcacctcgtcgctcggtggccttgtgccgcacgggtgcctggggcgacgccccgctcgtccccggccgctctggccaggggcgcgacccggcgtcgccccggcccgacggagcaaacccgagctgcaccaccctggcggggggcgcggaggccggcacgatcgcgggcagcgaggcgctgggtgggggctcgggttccgccgcggcagggatgaccgcggcacgcttgcagccggcggcggcccccccccgcgcagacccagtctccctgccgcccgccttcgccacgccggcgggctcggcggcgacccccctggacgccagagcccccgcgacctccttggcacccttcctcgcggcctcgcccctgccatcaccgccctctttctcgtcgccagcgtgcaggatggccagggcctggtcggagggcacgcccgcggccagcgcggcggcggccgcctcatagcagggcgccgccgccagcttggcggcctgctgcgcgtccaggcgctcgcccgcgctcctgcgcgcggccagcacgccgacctgctgcagcttcttggccagcgtg

SEQ ID NO: 42487 - DNA, 68 bp, Chlorella protothecoides
tcgtttggcatcgttctgtgcgagcttttatttcggattcagatttcatgctgtgggtggcgcgccac

SEQ ID NO: 42488 - DNA, 61 bp, Chlorella protothecoides
cccctgctctacacaggcgcacacaccgttcacgagcgggaactccgtgtcggggccgagc

SEQ ID NO: 42489 - DNA, 83 bp, Chlorella protothecoides
tcggtgggtggtctgggccctggtgtgccctctgacactggggtgctcgtgatccccccgccctcatcactccatgcaggtgg

SEQ ID NO: 42490 - DNA, 76 bp, Chlorella protothecoides
gttcaccgtggcgtcgttctgcgcctgttggtccctcttctcctcgtcgtccagcttgttgaccgcgccgggtggc

SEQ ID NO: 42491 - DNA, 232 bp, Chlorella protothecoides
tcgccccggagctggccgcggctgatgtgaatgacctccctgtgctcaaggcagatgccctcaagtttgcaaccacctttcggtcacagctgcccaaggccaccgccctggccaccttcccacacctcgtcaagtgcgcggggggggtgtgggggctgcagcgaccgagttccattgtctgggggagtgagtatgtatttacatcttgaatgctggatgatctggtggaggg

SEQ ID NO: 42492 - DNA, 61 bp, Chlorella protothecoides
aacgaccatggcgccgaggaggaccgagagaatgccctggaccacaatcatgacggagacg

SEQ ID NO: 42493 - DNA, 61 bp, Chlorella protothecoides
ccgagccccaagagcccaagcccgagccccgagagccccagcccgagccccaagagcccca

SEQ ID NO: 42494 - DNA, 72 bp, Chlorella protothecoides
gtgcgacccggcacactcctcccctctcccaccgccgacgatcagcgcgcaccttcctcgcctttgccagcc

SEQ ID NO: 42495 - DNA, 68 bp, Chlorella protothecoides
ccctggtgcgtgaaagggtgccgttcccaccgctgccgtacgggtactcgaggatctcaccgcggatg

SEQ ID NO: 42496 - DNA, 61 bp, Chlorella protothecoides
aggaggtcgatggcgaggctctgggcgaggggcgagcctgtggttcttctggggtcgctgc

SEQ ID NO: 42497 - DNA, 376 bp, Chlorella protothecoides
  modified_base (126)..(310): a, c, t, g, unknown or other
cacggtcccctcaccatgcatggttccggccccgcccaggattccccgcccggcccaagcgctgcacttgcctgccaccgtccaatacccccccctccacgtaggtgtgtgggctgcagcgaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagcgacgcgagccgttgctggggacactcactgcgcgacgccctcctgcgtcttccagacccc

SEQ ID NO: 42498 - DNA, 61 bp, Chlorella protothecoides
gcacctagagccagtccaggtgcggcttggggtgcaagctaggcaatcaaatctctggtcc

SEQ ID NO: 42499 - DNA, 61 bp, Chlorella protothecoides
tggggggcgggtgtggtaggagcagcagggggcacgcttttcgggtggcaggggaaaggtt

SEQ ID NO: 42500 - DNA, 172 bp, Chlorella protothecoides
agcagggcgccggcgtgccgcgccacctgttgtggcatggagatgggtggtggggggaatgtgaggcttgggaagggggagaggtattggatcgatcggcctgatgcctttggacacaccaaaatcagtacatcattcaccatcatggggtgtaacccagggcccccgccat

SEQ ID NO: 42501 - DNA, 61 bp, Chlorella protothecoides
ggcaggagtgggcgcgggcgtaggctgggctggagtcggcgcgggggtgggctgggcagga

SEQ ID NO: 42502 - DNA, 88 bp, Chlorella protothecoides
tccggcggccgcctcgcgctgcagggccgccgcctctgcaggcaccggtccaggaaggggtggtaggagggaggcaacaaggtgaccc

SEQ ID NO: 42503 - DNA, 61 bp, Chlorella protothecoides
gtcctcggacccggcgccatgggaggggggggggaggggattgaccgataccacgatccaa

SEQ ID NO: 42504 - DNA, 16726 bp, Chlorella protothecoides
  modified_base (827)..(836): a, c, t, g, unknown or other
  modified_base (1021)..(1030): a, c, t, g, unknown or other
  modified_base (1612)..(1621): a, c, t, g, unknown or other
  modified_base (1703)..(1712): a, c, t, g, unknown or other
  modified_base (1988)..(1997): a, c, t, g, unknown or other
  modified_base (2500)..(2509): a, c, t, g, unknown or other
  modified_base (2703)..(2712): a, c, t, g, unknown or other
  modified_base (3833)..(3842): a, c, t, g, unknown or other
  modified_base (4071)..(4080): a, c, t, g, unknown or other
  modified_base (4846)..(5018): a, c, t, g, unknown or other
  modified_base (5090)..(5320): a, c, t, g, unknown or other
  modified_base (5401)..(5410): a, c, t, g, unknown or other
  modified_base (6169)..(6178): a, c, t, g, unknown or other
  modified_base (6768)..(6809): a, c, t, g, unknown or other
  modified_base (7138)..(7147): a, c, t, g, unknown or other
  modified_base (7512)..(7521): a, c, t, g, unknown or other
  modified_base (7858)..(7867): a, c, t, g, unknown or other
  modified_base (8525)..(8534): a, c, t, g, unknown or other
  modified_base (9205)..(9214): a, c, t, g, unknown or other
  modified_base (9828)..(9837): a, c, t, g, unknown or other
  modified_base (10017)..(10026): a, c, t, g, unknown or other
  modified_base (10180)..(10219): a, c, t, g, unknown or other
  modified_base (10282)..(10291): a, c, t, g, unknown or other
  modified_base (10539)..(10548): a, c, t, g, unknown or other
  modified_base (11256)..(11265): a, c, t, g, unknown or other
  modified_base (12129)..(12138): a, c, t, g, unknown or other
  modified_base (12390)..(12646): a, c, t, g, unknown or other
  modified_base (13719)..(13728): a, c, t, g, unknown or other
  modified_base (13797)..(13806): a, c, t, g, unknown or other
  modified_base (13862)..(14121): a, c, t, g, unknown or other
  modified_base (14230)..(14239): a, c, t, g, unknown or other
  modified_base (15362)..(15371): a, c, t, g, unknown or other
  modified_base (15762)..(15771): a, c, t, g, unknown or other
  modified_base (15832)..(15841): a, c, t, g, unknown or other
  modified_base (15955)..(15964): a, c, t, g, unknown or other
  modified_base (16440)..(16449): a, c, t, g, unknown or other
cccccccggcatacccccccctttgccaggtggcatccggctctggcccagcacgcagaacaaccaatacttcatcggcatcaacttttccaacctgaaggagctgctgacctccgtcaccctctccggcatcgccatggcctaccagagctacggtgggtgccgggccggatggacgtggggcgggcgggccaaaccgtgtcctactgcgcacctgcgctcctgccccgcctcctgttcccccgctccccaccaaactctccacttcccacccctctgccccaggctattggaccatcaacacgcccggcacccccataccaatctcggcaccctacaccctgcagctcaccgcacagaccggcgagacgctgagcctcaacatccccagcatcatccccctggacctgggcgtgaacttctcctgagggcgttacacaccttttgccgtccccttggacccacccctcgtgaaacgaaccattgcctccccatcccaccctgtgctggggtccagggccagctgagaagctgtgcgaccatgcccccacctccctccttgcttccccttccgcgcggctcaagggtccgaagaggagtctggcgggccggggtgcgccttgcagctgtcatgctgccccaccctggcttgcgatccccactcctatgctctcaattcattgcactgcaggtgtgcctgaccacaccatgagcctaatggcaagtgtagcaacgcttatctagatactgagctgagaaaggggtcagcgggtacatgcaccgcacgtgcgttaggcaccgaaaccctgccggggtggatgtcggtnnnnnnnnnnggcgggtacgtgcaccgcacgtgcatctggcactgaacaccgaaaccctgccggggtggatgtcggtgtttcgagtgctccccccctcgtcaacagccatacatattgaaatcttacgttctgactggcatcctgggctatcctgtcgtgtaccttgtatcaggagcacggtcggttgggttccnnnnnnnnnntcgtcaacagccataaatattgaaatctcacgttctgactggcatcctgggctatactgtcgtgtactttgtatcaggagcacggtcggttgggttcccgacacccacagtcgcggcgctggtgccgggcctcctcagcatgtctctgttcgacgagggcagggatctgctgagcaaggtgcactctgcggactctggcagaatacagaccaatcggttcctggacgtttgtcgactcgtgctgcaggctgtaggcaagtcgatggtccaggaagaggagggggaactggaaagatgggggccatattattgactttccctgctgaggcaccctcggacacctgaaagccagatggttttctgctcatggcgtcgtcctcccactacactgcacagatcacctgggcacagggtttatgctggtgaagagcgatgtcgggggaaacatcgacagactggccaggagcgccgcgacaaacccagagcgctacgacgccgacatattcgccatcgtggaggacgaggtcctggccggcggggctgcctcctcatcctcctccaccaagggcctgctctggctgnnnnnnnnnngagtcgatggtccagggagaggaggggaactggaaagatgggggccattccattgactttccctgctgaggcaccctcggannnnnnnnnnagtcatcgtggaggatgaggtccaggccggcggggcagcctcctcctcctcctccaccaagggcctgctctggctgaaaaggtgggttcgggaaagggatttttataccgccctcggcagagcgctcagctccctcttggcgccggggatggttgaatcttcctgagcatggccttgtagcatcacctttggatgcatgcccatgaagttgaattttgcgtctcagcttcgccccttgctggtcatcagggccatgcagtttgtgacggcgctccnnnnnnnnnngcgggaaagggattgtcataccgccctcggcagagcgctcagcccccttctggcgccggggatggttgaaccttcctgagcatggccttgtggcatcaccttgggatgcatgcccataaagtcgaatcctgcgtctcagcttcgccccgtgctggtcgtcagggccatgcagtttgtgacggcgctcctgaaccgtctgacggaggatgaggaggagagcctgtcggcagccgccagtgaaacctattatgcgaccctgcagcaataccatggctggattgtgacgggcacctttactgttgccctgaaactggtgcctgccaggtgagcccggcggcggccattgcatgcggggtgaaggcaagggcctccttacgaggctgcgtactccggcagattcctcaccaagtcgtcctcaccacccatcctcccgctacatatgctccttaggcaaagtttcctcgacagcattggtgcggcgagcccggaggggctggcccgcnnnnnnnnnncgctccttaggcaaagtttcctcgacagcatcggtgcggcgagcccggagggactggcccgcatgcacacgttctgtcaggagttttcggttctactgctggagttgcaccagtttctatcagaaaatggacttgatgaccctgcaaaagtttgagccaagttgggctatgcgtgtagatggacactgtcagannnnnnnnnngtgcaccagtttctatcagaaaacggactcgatgaccctgcaaaagtctgagccaagtagggctatgcgtgtagatggacactgtcagagggttctgtcaacacagggtcagggtcacctcgaggcagtgagaccggagctgaggggaagatcctgcagaacacccgctcccacgatgggcgccagcctgcggcacgcctcacaacaactcagtcctcaaacaatagcgttccatcttaaactcctacgtggatgtggtgacagtacggttttgaccttgggcttcgaagagccatggcccacgaggggcctgaatttctgccaagactgaccgccgcgtttgtggagctggggacccgagatgtcctcgaaactcgggagtttgcagacgcctgtgtcacggtgctccccatcttcaactacctgggtgagaaggcggggccccagtgggtgggaaggcaggcttcttcaaccctcgcatcgcctcctaacgacatttggcggggtcctcccaccccacccgcgcaggcagcgtcttcctgattgcaaggaacgagttctcctccaaggtgagtcggagaggtaccgactgtccggccaaggagtgtcttcaggtacccactgcttttcaagggcggtctccccttgctgcgccttaatgctcctcgtttcctgggcatcctcctacagagggacagcattgctgccgtcgctcaccgccttcccatgctgtatgatatcgtcgaggaaggaaaagcggtgcgtggggtttggctggcatcccctgtcctgtgcagaatgggtctgctgtgctgcctgttcgggagccccatcgcgtacctgagcattatcccagcacccaccccgcacatgaccacctgcagaacaacacggtgaccgtgaagaacagtcccgggcggaacttgcaccgactcatgaactccatcctcttcatcagcctcatcttccagaacctggcaaacggccaggccatgaaggaggctgtggcaggtgggggcgatcgcggcgaggtgccagcggatgccctgcaccttcctgcggcggggaaacacagggaatcgtgggtgccatcctttgcggtccgctgagacgtcaggccnnnnnnnnnntaattgcggcgaggtgccagtggatgccctgcaccttcctacggcagggaaacacagggaatcgtgggtgctatcctttgcggtccgctgagacgtcaggccatgtgccagtggcggccgctgctgtgcttcatggcgcctcctccctgcgtcgttcggcccggccgctgcccccttgatcacatgttaaccccctccccccaccacccccaccccagagtcttacgannnnnnnnnncgtgtttcacggcgcctcctccctgcgttgttcggcccggccgctggcccctcgatcacatgtcaaccccctctccccaccacccccaccccagagtcttacgaacgctcgctggcgcccatgcacacgtgggtggtgcgcgccgggatcaagaccgggatgatggcgctgccgacgagggaggacttcctgcgggccctgggcgagacggagtccagcgcgctgacccacatgcaagcctttgtgaaggccacggagcgcgtggtgcaggagatcgcgcgtctgtaccagggagtgacgatgcccaggtccgacttcactttctcttggtggcagtgagccgccgccgctggtggcgccgcggcgccgggcgggtaccaatgatgcggggaggccaggggggggggggggggggggggggggcccccccccccccccccccccgcgttccactgtaatgcccgttgatgaagctgtacacatggagtagatcggcgaggcccagcatcgccagaccccaagcaccaccccaccccttctcaacgtgtctcaggagctagaggggagtgggtggggtgggaattgcgctctgcttcggccgcagacccgccagatctcctcgccccttccacatcgacacaagcttctgccgattcatgcggcggggttgagccctgcatgaacacagctgcccctggtcagtacattgacaccgtttttccaaacgagtcggctacctctgtaacgtgaactctcctgaatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatgccttgagatattgattgagcctggattgaagtgggaccccactaccgcaccgcagactcctgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcgatgcgagcgtgcctcccccacctgcactgcggccccctgccatccctggatcccggtctcggctgtcagcctggcnnnnnnnnnnccgatacaagcttctgccaattcatgcggcggtgttgagccctgcatgaacatagctgcccctggtcagtacgttgacacccttttcccaaacgagtcggccacctctgtaacgtgaactctcctgaatgtggctcctcgatctggacggaccacgcactgtgctgggcatgatttgctgcgtcggccagtaccggaccgtctgcatccccgacaatgcatgcagcgtcgtccaggacgacagccacgccctcagcacctcaaatacatgccttgaagatattgattgagcctgggttgaagtggaaccccactaccgcaccgcagactcctgcctgaatactggcgaggcccggctgtccgtgcttccctgtcccgcaccgcacccccgccatggagcggcagcacctggtggctgccttggcggggtgcatgaatcccgaccacactgtccgacaggccgcggagcatgcattgcaatcggtgcgtgggccctgggtgcggtgggagagcaccgtgactactccacggtgctgagccctgtgagcgggtgcagcccacgcagcgatgcgagcgtgcctcccccacgtacactgcggccccctgccatcactggatcccggtctcggctgtcagcctggcaaggggactgggaaaccgcatggtcttctgccccccccaaccaccccctccctgcccgtggacgatacgccagcccgatgtctctccgctccaacccatcaccccaggcccgtgccgnnnnnnnnnntccaccccctccctgaccgtggacgatatgccagcccgatgtctctttgctccaacccatcaccccaggcccgtgccgcgccggggcagctcctgggcctgctgcacgtctccctggaccccggcatggaccccgccgtccgccaggtggcggccatcgcctttaagaacagcgtgaaggaggggtggggcggcgaggacgaggagcgccccgccctggtcggcccagaggagaagggcgctgtgcgcgacgcgatgtttgccggcctggtggccgccccaggtgcggtgaagaggcagctgcgggagagcgccaggaccatggtctacgccgactaccccgccgcctggccaggcctactcaactccatcggcgagggcctggtgtcccaggcaaggccctcaggctggaggcatgtgcaccggggagggggggcggtggggccatgggaacggcagcatggggcggcaggaggcttgcggggccgacgggtcgcactgtggcatggcctcgcgctcccctggcccgctgcatcctgcgacagctcgcccagccgacgtcacccccccccccccccccccccccccccnnnnnnnnnnnnnnnnnnnnnnnnnnnnnnnnnnnnnnnnnnttctcttgcaggaccaggcgaggctggatggtgcgctgagcatgctgcgcctcatcgccaggaagtacgagttcaaggacgatgtggaccgcctgccgctggtccagatggtgcaagccaccttccccctgctcctccccatcttccaggtgccagggggattgcgttgcagggcgtggggtgggggttgcgatgcgtcgacatgcggctgcccaggcccctcaactctcgcccatcaccacatggggtcctcaccgcaccgaggcaaacaggatcccccttacccacccacccccttccccacatacaaccacctcgcagtctctgcnnnnnnnnnncccccctttcccacccacccccctcccccacatacaaccacctcgcagtctctgctctccagcgacagcgcgtccctggagctggcggagctgctcaagctcatatgcaaggtgtactggtcctccacgtacatggagatcccggagctcatgacacaccctgacgctatcagggcgtggatgtcctgcttccagaccctcatcatgcggcccctccccctggtgcgttgtgcgtcggtgtggtggggaggacggacttggcatgtcagaccctgggccggacctgtacgatgaggcacacagcgctcctctttcttcttgggacggtggaccacgctgctcctgctccagactgcgagcgacannnnnnnnnnggcgctcctcttcttcttgggacggtggaccgcgctgctcctgctccagactgcgagcgacagtgcatgtgtttgacggagacagggaagtctggacggtacccctcccgccaccaaccatgtcccaggaccaaatgccgagcgaccccgactctcgggacgcatggcagtggtggaagacgaagaagtgggccctgcacattgcctaccgcatgttcaacaggtatgagggcgctgggtgtgtggtgctgggaggccgcttcgcggcaggatgtggctcggggagtgtccaactcgagggtcgcgcagcaacgagcacctgagccgcggcaggatnnnnnnnnnnccggtgatgggaggccgcttcgcggcaggacgtggcgtggggagtgtccaactcaagggtcgctcagcaacgagcacctgagccgcggcaggatgctcattccaatgcgtctctcaacactctcgggcgctcaaacctctctttttctggctgccgccctgcctcccctgtgtcatatccgtgctgcagtatatcaccctcccccttcacccccccgcccccccacaaaaacccgataggtatggaacccccgacatgtgcacagaggcgggcgacgtggcgttcgccaccgtgttccgccgcgactgggcgctgcccctcctccgcgcctgcctgcacgaactcagcggcgtggcagcggggcaatacatcgcgggccgcgtgtgcaacatggttctgcagtacctgacccaggccctggccttctcccacacctggaaggagctgaaggtcaccctgcccagcctgctccccaggtgcggcatgggtggaagggggtaccaggcgggcggagtcagcggttgctgcagcccgcactgtctgggttacaggcatgctcaaccctcctcaactatgcatgtgaggtcctttcataaccgttcacagcatttctcggcccatcaatgaatccctctgcactctcactgcagcgtgatcnnnnnnnnnnccagcactcctcggcccatcaatggatccctctgcactctcactgcagcgtgatcttccccatgctgtgtttctccgagtcggatgccgagctctggcaggagaacccccacgagtacatccgcaaggtatattctggttggcagtcgggtggggagcccgatgcgcagtcagttggcagcgtctgcctccgaggcaatagcctgccatgagagcgcaggctgccagagaggcttgccggaacctgagttttggaagggaggctggcgccctgccctactacgccgcctctgtccgccaaaaacatcctcgcactgtatccccgcccgccgcggtgtcgcaggggtacgatatcatcgaggacctgcactccaccaagactgcggccatgaacttcctgctggagctctgcaagtcccggccaaagggcaacctggatgccctcgtccaggttggtggagctggagggaggggtgtgttggaatggaacgccgctgcaaggcctggccagggagtccgggccgggggtggagccggcgagggcagctgggtcgccagccagagatcactcgctgtgcctgggagtgccaggcctcaccccaccccacccctctccattgcatccacccaccccacccccggtcacctatcccccctcacccctcccactcnnnnnnnnnnatcgctgcaaggcctggccagggagtccggggcgggggtggagccagcgagggcagctgggtcgccggccagagatcactcgctgtgcctgggagtgccaggcctcgccccaccccaccccctttccattgcatccacccaccccacccccagtcacctatcccccctcacccctcccactcaaaccgcagcacatggtgggcatcctgggggagttccgcgccgccggccccggcgccgacctggcgctggcccggcgcgccgacggcgcctgcctcgccatcggcacgctgagcgaggtgctgaagcagaaggcgcggtacgccgcctcgctggagcccatgctgctgcagcacgtcgtccccctgtttgactcgccgcatggccacctgcgcgccaaggcctgctggctggccggcgcctttgctgacatcagcttccaggatggccagggtgcgatttgttttctggggggggggggaaagggggaagggcctggttgtggggcaagggagagggggagcctgggtcgcgcaggcgtcgtgtggcctgggggctgccgagggcactcagggccttgaatctggtccaccatgccaacaagggaagggtgnnnnnnnnnntggcgtcgtgtggcctggggactgccgaaggcactcgggaacctggtccaccatgccaacaagggaagggtgggttgaggaatgtgccacttccttcttccgcctgcctgcctggggccccggggtctccctcggcgttccccaacatcggctctccccacccgtctgcggcgggcgccnnnnnnnnnntatgtgccacttccttctcccgcccgcctgcctgggcccccggggtctccctcggcgttccccgacatcggcgctccccacccgtctgcggcggccgctaggcacgccgacgggagcctgaacccccccccccccctttaacccaaccgccccnnnnnnnnnnnnnnnnnnnnnnnnnnnnnnnnnnnnnnnntgtgaggagcatcgcggacccggagcttcccgtgcgcatcgacgcatcggtggcggtccgcgnnnnnnnnnncgtcaggagcatcgcggacccggagctccccgtgcgcatcgacgcctcggtggcggtccgcgccttcctcgaggctgtggaaatggaggacctgcccctgttcaaggacctggttcccagtctcctcacccagttcctgcagctgtcccaggaggtgcgcgggtatcgagaggaggagaggaaggggagtgtgggagggggggggaaagggggggtgggtagagggggaacgctcagaggcgctcgtnnnnnnnnnnggggtgtcgagaggaggagagggaggggagtgtgggagggggggggaggtagagggggaacgctcagaggcgctcgttcctgcgtggaagctagacccgatggtagtcccccagggtgatgcggccgccacggatggtcttttccggagcgttccctcttccctcgaatggttgcgccccacctgcgcctgaccctctgaccttccctcttctggctttcaatgcgatttccaccgccccaaccaccacacccacagatcgacaacgaggacctgaccttctcgctggagacggtggtggagcggttcagcgacgagatggcgccctacgcgctgggcctgaccacccacctcacccagcagttctggcgcatcgtgtcggaggaggacgccgcgggggccggggaggaggaggacgacgagggcgcactggcggcctacggcgtgctgcgcacgctgtccaccatcctggactccgtgtccagcgtgccagagctgtacccgcagctggaggagctggtgttccccatcctgcaccgctacacctccaccgacggccaggacgtgtttgaggagatcatgcaggtgggatggtggtttggggtagtgtacttgtggggttggggaaaatacatgggagactggtaggggggttaaagggatgagggagtaagaggtagtgcatgccacttcttacaagaagggggannnnnnnnnngagggatgagggagtaaggggcagtgcatgccacttcttacaagaagggggagaatggcgggtcaatcgcagtgcctcgaccgccccttgcctggatacctatgatgtttgtcccacaaggcggcccccacctggacttgctcccctggcccaccccccaactgcccccatccccccttacctcgccagatcatcacctacctcaccttctacggcaaggccatcagcccgcgcatgtggagcctgtacccaagaatgctcgaggtgaggcggggggagtagcgctgagggagttgggagttcaccaggacgaagtgacgctgcagcggtctggtagtcgaatgggggtaagagcatcgatgagaatcggcactcacaagtcccctgatgcccgccggtcatgtccgacgctccacccctacacacaccagaccgaactgatccccccccccctccaacctcccccccctccgcccagtgcctgaacgagtgggcaatagactattttgaggaggtgctgatgccgctggacaactatatctcccaggacaccgagaccttcctgaacacgcgcgaccccgacctgctggccctgactaaccaggttaatggcttgggtggggtcctttcctggtggcggggatgcgctgggcagctcgggtcacggaagcagccatgcctcctttccacacgtgcatacccaggacctgccatgattcctcatcagaatggcaacaattcaggtcccctttgttcccctctcttttcccccccctttctccccttctcacatcccaccgccccctcacccacccatccatcagacgctggaaaaggtgctggccggggatgggtaccccgtgnnnnnnnnnngggtagcgctgaggcagttgggagttcactgggacgaagtgatgccgcagcggtctgctagtcgaatgggggtaagagtatcgatgagaatcgtcactcacaagtcccctgatgcccgccggtcatgtctgacgctccacctctacacaccccagaccgaactgattccccacccccaacccccctccaaactcaccccccccgcccagtgcctgaacgaatgggcaatagactattttgaggaggtgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccccccctttcttccccttctcacatcccaccgtcccctcacccacccacgcatcagacgctggagaaggtgctggccggggatgggtaccccgtggaccaggtggtctgcgccccgcggctcatgggcgtggtgctgcagacgtgccgcgggcgggtggacgcctgcgttgcgccctacctgggcctgatcctgcgtcgcctggcgcgtggcgacgctgacgaggacttgcactccgggcttctggtggccgccgccgatgcgctgtactactcgccggcgctcgcgctgcgcgcgctggcggcccagcccggcgccctggccgcactgttcggcgcactgggcaaggcggtggcggccacgcgcgccggcgggcgcatggcggccttcccctcgcgccgcgacaagaagctgctggccctgggcctgaccgcggtgctgtccacgcccgaggccgacacgccgccggagattgcgtcggccgtcgggcagctggccgccgcggtggtgcgcctgctgctggccgtcaagcggcaggaggaggaggcggcgggaggggggggcgcgcgggagcgggagggcgaggacgccggcgcggcgcgcgcctcgggcgacgaggccgacagcgagggcgccgacggcgacgaggcgaacatcgacagcgacgacgaccgcgtcgggtgaggctgtgctctggtatcttctgttgagggggaaggggatcgggaaggaggacctgtccaagtgagggtggggaccctcagcgcgggccgtccagttgcccagagcgagtctgccaggcaccgacttgctgtggcgctcagcttcccagggcagtccccaaaccaccctcctcctgatggcccgtcttcgcttcctaaaccctggcccccttccaactctccaggcggtatggcgcgacgcggggcgactccgacgtgtcagactccgaggaggattggtggagcgacggggaggcggaggtgtccagccccgtggacgccgtggaccccttcatctactttggggaggtgctgggcgcgctgggcaccagccagccgcagcgcgtnnnnnnnnnnccccagggcagtccccaacccccccccctgatggcccatcttcgcttcctaaaccctggcccccttccnnnnnnnnnncgcggccatccaggccaccatggacgagggcacgcgcgccgcgatccagggcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaaaggaggggcgcaggggtcaatcacagagattctacggatgctcgtcagtttggcagcaccagcacagctccccgtccccgccaccgcagccccaggacacgtgnnnnnnnnnnagcggccatccaggccaccatggatgagggcacgcgcgccgcgatccagggcatgacggcctatgcggcccagctgcagcaggagaagctagaggctgcggctgctgcggctgctgcggctgcagcacattgagccatgcggcaccctaaccctctcgtcattgcttcaacatggtgcaccgagtgtaagtcgaccaagttacagcagcaagaaacacgtaggagcgggaaagtggaaaggatgcagagcgggggcaaaaggaagggtgggagtctggtcacttgccgcggtacacgctcttctcggagggtaggtacatgaagaaggagaacacgcctgggagagggcaaaggaggggcgcaggggtcaatcacacacggatgcttgtcagtttggcagcaccagcacagcttcctgtccccgccaccgcagccccaggacacgtggtcttaccagagaagatcatgatgaagaagatgaagccgatgatgagagggtgtgtcttcagctgcttccggacgttctgtttgtgggaccagaaggagcaaaggggggagggtcgggacaggccagcatcgagcgctgcggcgcaagcttctgaccagtccaggacgatgcatttcctcccactgcagcgagatctcgtttcgtacctgccagaagccgaggggcttcttgccaccgcgcagggaagtgcggatgaactcctggctcttagcgttggtcacgcgcttggaggtcacctgcgacgtcgatcgtgcgtgggtattctactggaggttcccatatgcaggtgtgtgatccagcagatgccggtgaaagtattccccactgaacgaggcataccatggtgccttcggttagctccggagggggtagtaccgcgtggaggtctacagctggttcggcgagaggtcaggcccttgaaataacgtggattatcgttagatactcccgagcgtgttgcctcgccttacgcgtcgtggagtggtcaggagggatccgctcctcggctgaccgtttaggtgggcaaggtaccgctgcgatggtactgggacagtattgctgctcccccctcctttgctctcaccccgggcgttcgcggtggcctcacagcacaannnnnnnnnncggagtggtcaggagggatccgctccacggctgaccgtttaggtgggcaagggtaccgctgcgatggtactgggaaagtattgctgctcccccctcctctgctctcacaccgggcgttcgcggtggcctcacagcacaagcagatttcaagctgtcagttggtcaatggggagcgaggaaagacaaagggtgaggtcgttctgccacagcgtgtccaccggtctcctacgggcgcgctgcctctgccgcgccaccctcgtcctgcttgccgagggggggagctgcggcctgccacacactcgtcccccctggagacccggaccaggcggcagagaaggtggcctccctcctctgcctcgccggcgtcgcctcgccgccctggcccggcgcnnnnnnnnnntactgcctctgccgcgccaccctcgccctccttgccgagggggggagctgcggcctgccannnnnnnnnncgccatggagccccgggggctgcccagggtccatacgtgcccgccgtccccgtcagggagcggcgggcttgggtggctctgacgcccgccgctgccctccgccccatcctccgnnnnnnnnnntgccatggagccccggggactgcccaaggtccaaacgtgcccgccgtccccgtcaggtagcggcgggctcgggtggctctgatgcccgccgctgccctccgccccatcctccgacccgttgacatggcggccgccacgcacggtgagcgcaaggtcccgccgctcggccaccgtcgcctcgtcctcgaattcgctcgggtcggagggcagcgggccgaagcgtggcggcaccggggtccagaacacctccttgatgttgcgccaggcccccacattgtaggggttgctggagtctgcaggtgttggggtcggtgcctcgatgtgcggaaagaaagcttcggtggtgggcacggcaaggcagggcctgcatgcatgcggcaagaggaccttgtcagtcctcccgagaccccttcgtcctcccctgcagtccccagccacacccggacacaaccaggagcaggcagtccccatctctnnnnnnnnnngggaccttgtcagtcctcccgagaccccttggtcctcccccgcagtccccagccacacccgggcacaaccaggagcaggcagtccccatctctcactcgtttcccggtgccggaagtgctcgtaggtagtctggtttgtgacgaccaggtaggtgtggaaggtggtcaggccgcccacaaacctttggatgtgttcaaggggtaggtaacggatgctcttgggcagtgaggcggcctcttcatcttctgcccacaccaagccgtgcgcatgctccgc

SEQ ID NO: 42505 - DNA, 67 bp, Chlorella protothecoides
cccacccaggccctggccgggacctgggcggcagccgcggcgtcgggccgcctgcactccaccctgt

SEQ ID NO: 42506 - DNA, 61 bp, Chlorella protothecoides
ctccagctcgcgccggctctgcaccgccacgccgcgcacgtcgtccagcgtcacgttgaac

SEQ ID NO: 42507 - DNA, 69 bp, Chlorella protothecoides
aggacgaggggtccctagctgggcgtgagccccacgagaaggtccagcagtagcctcctggacagcata

SEQ ID NO: 42508 - DNA, 136 bp, Chlorella protothecoides
ggcgccgaccccttgccagggcgtccaggggatggactggatgcgtagccctgggccccactccacctctcatcaaaaccaccagtgaccacccccgcttatggtctcacaatctttgctccccaccctatcgcag

SEQ ID NO: 42509 - DNA, 2841 bp, Chlorella protothecoides
  modified_base (273)..(282): a, c, t, g, unknown or other
  modified_base (538)..(547): a, c, t, g, unknown or other
  modified_base (1044)..(1053): a, c, t, g, unknown or other
  modified_base (1520)..(1529): a, c, t, g, unknown or other
ggctgcccgcgcggcgcagggccgatgccggcgcaggcgccgaggaggacgcggcgctggggtgcggcatggcgtcgccggcgtcgccggcctcctcggaggccacgctctctggcggcggcgccgagcggatggcacgcatgaaggagtcgtccccggcgtagctggctcccgagggggccacggcgttcggacccctcgcgccgccgccgccgccgccgccgccggacgaagaagagatgggcgcgaagacgttgaccgcgtccacgcgcnnnnnnnnnnacgccgccgccgctgccggacgaagaagagatcggcgcgaagacgttgaccgcgtccacgcgccccttcacaaagatgggggccagctcgcggaaggcgacgcgcatgcgcgcctggacgtacgtggggcggtccaccagcacctcgcccaggccgtcgcgtgcgcggcacatgagccgcgccgacaggttgatggagtcgccgaagagggtgtactccgcgcggcgctggctgcccaccagcgtggagaagagcnnnnnnnnnncgcgcggcacatgagccgcgccgacaggtttatggagtcgccgaagagggtgtactccgagcgccgctggctgcccaccagcgtggagaagagctggccggaggtgacgccgatgtgcgtggccaagccgtggcggcgcagccccgccgcgatggaaagcgcggcctgcacgccccgcaccgcacggtcctcgtgcgagttgcccggcaggccaaaggcgcagatggccaggaagcccttctcgtcgcaccgcatctgcagcaggcagccgtcgtactggcgcatgcgccgctggaccacctccagggtgcgctgcacgcacgcgatctcctcctcctcgctcaggggggggggcgtggccacgcgggaggcggccgcggcggggcacctcgatgctgcgccgacgtctgcaggcctgtcgtttgtgccgcccgagccgcctgcgctggcactgccgctggcggtcgtggccgacgcgtctccaccggccgacgcgnnnnnnnnnncgctgcgccggcgtctgcagccctgtcgtttgcggcgccagggccgcctgcgctggcactgccgctggcggtggtggccgacgcgtctccaccggccgacgcgtctccaccggccgatgcgtcgccgccggccgacgcgcccctctcgccgccctcccgctggagggcctccgatgcgctgccgctgccgccgtccccgccccgcgcgtcgctgcgtgtgctggggttgtcctcggggtcgtacggcgctgtttccgcgccgcggctgctcgggcgcggcgcggcgccgtttggctgcatgtctaccgacgccgccaggtggccggccgacggcgaggagccctgctccatggagctccccggcgcccttcctcccaacccctgcccctgcgccagctccggcgagcgtgccaacgacaccggcaacggcttggataggcccgggaagccgaggaagagcacggtgnnnnnnnnnngccgacgacgccgggtggccggccgacggcgaggacccctgctccatggagctccccggcgccctttctcccgacccctgcccctgcgccagccccggcgagcgtgccaacgacaccggcagcggcttggacaggcccgggaagccgaggaagagcacggtgcagagccgcgtctcgttgatgtagtcgatgtgccccgcctccacccgctgccgcacgttctggggggacgtgcatgcgcatgatctgcaaggggtgggggtggggtatgtggcaggcaatccaggatgtacgggtcggggtgctggacgtacggaccccgggcctgttctgcgacgagtcgtccaggacctgggccctgcagagcacatcaatcccaggggcgcagcacattcgcactgtgcccatgcagctgagagccgcccctccctcctgcacagtgcagcccagcccctgtggtatcctgatggtggcaccccctccctctgcatcacaccgcccgcccacctgcagcgcccgaatgcgctgcatggggggcaggtatgccagcgcggcggcgtccgcgctgggcgtggactgcaccggcgcgtagcaggccgtgggctcgccctcgtcgtccaggggcatgaccgggtcggaccccggcgccaccagccggtgcgtgccctcgtccagccgctccaacgagcatttcgtgcgcagcaggagggccgcctcgtccgacagcacggtctcgcctggtggtgcgtcaggtttgtgtcggtgtcgagcaggagggagcaggtcgtcgacggagcgaccaccagaccagcggaatgcacagccggtacgtccccccgttcgcttccccaaaggaacaaaggggccacggtctgcgcgcctgtgctccatggccccgcgccgcacaggagcatctggtcctcgggacccccaccctcgcccccccgtctgtccaacctcccgatggatcccgggatcactccgatttcaacccccccccctccctcacacacccgacgcggcgtgcttctcgatctcggccagctgggcgatgggctggcgcgtgcgccgcgaggccgcgtgcggcgcgtcgcccatgaagaagtcccagcgcggcgcgcccacgccgtcctcctcccccggctccagcccgccgccgacgtggaagaggcagacggtgccggcggagatgagcatcttcatgctgagcaggaccttgtcgctgggcggcgcgtgcgcggaggacgcgccggccaccgcgcggccctcgggcgcggcgccgggacccccgacctccgccggcctcggcccc

SEQ ID NO: 42510 - DNA, 83 bp, Chlorella protothecoides
ccaaagccagtatccacattcatatctttaatcagatggagaaggatgaggattacatacggtgcacggtacgcctgggagcg

SEQ ID NO: 42511 - DNA, 7789 bp, Chlorella protothecoides
  modified_base (1236)..(1245): a, c, t, g, unknown or other
  modified_base (1450)..(1459): a, c, t, g, unknown or other
  modified_base (2239)..(2248): a, c, t, g, unknown or other
  modified_base (3055)..(3064): a, c, t, g, unknown or other
  modified_base (3206)..(3240): a, c, t, g, unknown or other
  modified_base (3789)..(3798): a, c, t, g, unknown or other
  modified_base (4344)..(4415): a, c, t, g, unknown or other
  modified_base (4527)..(4536): a, c, t, g, unknown or other
  modified_base (4648)..(4657): a, c, t, g, unknown or other
  modified_base (4897)..(4984): a, c, t, g, unknown or other
  modified_base (5751)..(5760): a, c, t, g, unknown or other
  modified_base (6475)..(6484): a, c, t, g, unknown or other
  modified_base (6937)..(6946): a, c, t, g, unknown or other
  modified_base (7463)..(7674): a, c, t, g, unknown or other
gtgatgcggcgggggggcgggcggcatgggatgtggtgctgacgggggtgggccccacgcccggtgagcgcgccgtagccacgctgcagcccccttccccgttcgattccccggtgcgcaccggaacttggcgcagggtgccccaggcacggaccctgtggcagcctctcgccgccccattcccacccccccaccccaccccccaaaactagggcatggacgtgtacagcaacatcctgtatgtcaaggaggaaagcgcagcgctgagccacctggcacacagcacggcgctgaacgacaagtaccgcaccgagacctgctgcatcatcggcaactaccactcgctcaagggccagcacgagcgcgcggcgcagtacttccgccgcgcgctgaagctgaaccccaactgcctgtccgcctggacgctgatggggcacgaatatgtggagctgaagaacccgcccgctgccatcggtgggtggaggtgctgttggtcgccatggctggggggggaaggagtgtttgggcacccatgggcttgctccggggacagatgccaggtgctgtttgcggaggtgatgggggaacccctgcaggaacaaaccctgtgcacctgacgcagcggtgcagggggtggacggaggatgcatcggggcgcccatccccacacacctccctcacactctggcttctccctgaaaatccacagaggcgtaccggcgggcggtggatgtcaacccacgtgactaccgggcctggtacggcctgggacagacgtacgagcttgtggacatgccctaccatgcgctctactacttcaagaggtggggggccggcggcgggagcttgtttcatgggccctgcatgcagaagtgtggccgcacgctgcatgctcggctcatgtaccgattcacacactcccacccaccttgtccactgtcccttcttcacccgtgtcctggccacacattgatttctccccccttccccccccaaccccaccccaccccaacaccagggccgtcttcctgcgaccccgggacgcacgcatgtggaacgccatgggccactgcttccaggcggggggcgaggcagagtacggactggccatccggtgccacatgcgggcactgccccacgataaagaaggcgtgtcgctgcatgagctggtgagtgcgacgggcggggcaaggggcgacggcaaggtctggtgcagggctgatggtgggtcgaggnnnnnnnnnngcgggcggggcaaggggcgacggggacgtctggtgcagggctgatggtgggtcgagggatgcaaccaaccttcatgagccacagggcacaggaggtaagggaccgtctgcatggcccaccagagagtataagccttcgcgacccctcaatcctctgctggaacgggctatctatgccaagaagtgtatgaagcacaccctggccnnnnnnnnnnatgcccgcctgggtcaaagggcccaagccgcgcactaccaccgcctggtgctggaacggatggatgccgaggggctggagggccaggatgcagtggaggccctcacctacctcgccgattgctatgaggtgcgcggggcgcgggtcaatgggggtgtaagtgaggtgttgggccccggctgtgatccctggacaggggtggcgctgccctggggctggatgcccctcgtcgccaggcgatgtgcagtgcagcgggtgcccctgtgaccactccacgcaacccgctcgctgagtacctagaggtcctgctgtgtacaagagcgctccagatggccatgctcgagcagcagtcatacagacatgctcccaccctcccgctcaggccgagggggacaccacggcggcggaggcctgcctcacgcgcctgctggagtacggcgcccacagcaaggagagcgccaggtcagccatggaccagctgcgctgcgcgctgggcagcgcagcgaccccggtgcgccccgacacgcccccctctcgatgacgcccgcccatgcagtgcgcatgcagccatgtgtgtgagacggggaggcactcggaaggggggtactggcggttggcaaactggccggcagggtgggaggccggggagggcagtagaagtggagggcagtagaagtggtaggaagaggggccgggcttgctcctgacgcagggcaatgttgaaagcgactaccagatgttgtgctgggcgacagcgtccaagagctcacgcatgcccgcnnnnnnnnnngagtggtaggaagaggggcagggcttgctcctgacgcagggcaatgttcaaagcgactaccagatgttgtgctgggtgacagcgtccaagagctcacgcatgcccgccagggtggcagccgaggggcgcaggcccagacagatgaggagggggaggtcacacccggcatcggccgcgctctgcgccagctgccgtgcgcacagctccggcatgggattggctcggtctcccagcagggtgtccaccttgaaggtgctgcccctgcccagcacctgctcccgctgcgtcgagaggacagtcccaaagctggccagctgggagatcaccaccagcacgcggtcggtgtagcgcgacacgaaaacatcagcaggctcggactggatgctaatcttcaaggagcggcttcgcacaggaaagctctcgggaccatcacccatcgatgggcgcgtggcgccacaggaccgtgaccggcgtgggaatagagcgactactctggccccaaggtacgcaagattagtcgtctgaaagcctctccaatgccgttccacgatgtcatacgtacaagatctgactgtgtatactaatcagatatctacatgtatcccttcgtgtgataagggctgtgcattccacagctcgggaatgcaactcggcatggggatgctcccagcatcctcagcacgcacccgagcccgaaactcctcggacagctcgacaagtcgtcacactgtcgacgcgttgcgagacttcaaaccaggagctaaaagcttcttggccaacaacgcaacctccagagggagtttcacnnnnnnnnnncgtcgacgcgttgcgagacttgaaaccaggagctaaaagcttcttgggcaacaacgcaacctccagagggagtttcactgtctcctgtgggcctccactaaataccgttggtacggcttctgtcgccatgactgccgcggannnnnnnnnnnnnnnnnnnnnnnnnnnnnnnnnnnaacatatccaccacgcttttcaaactctcggtaagggatggattgcagtgaacaccgcgtgaaagtgaatcacagctcctttcggtggccggccaagatattccgggggggagcaaccagcgccgcgcaccttaaccaccacccacgcagatcgacacccggacctccgcgaggtcctcggaacccaccacacccggggattctcccatttctctggattccgagctgaggggctggctctccgacaccctgagtacgtttacgttctcgcactcctcccggtctgcactgtcggcagctgcccgggcatgcgcccctcgccccggcacgcagactcagtgttcaccccctcgtatcaccacaggcttggctgctactaatcccactgtatacgtcaagctcctcatatccaatggcatcgcgggctccatcatcggcaaggtgggcatggcgacacagaagctggggctttttggcggaggacactctccgaatcacaagacgacgcggctgtctgaccagctccagttcccaggtcctcctgccggnnnnnnnnnnacggaggacactctccgagtcacaacacgacgcggctgtctgtccagctccagttcccaggtcctcctgccggtcaaggccgtaacatggtccctcctcaccccacctgcctcctcccactgcagggtggcaccaacatcaacgacttccaggccaagacctttgctcggatccagttgtccaagagccaggagtactaccccggcacccaggaccgcaccctgctcatctcaggccgcctgaagcaggtggtcgccgccctggccctcatcctggacaagctggtgggggagggggtggccccccttagcccccgctcccggctgcaccaggagcctgacagggcgccgcgcctgctgctcaagatgctggtcccccaacccctctgcggcatcatcatcgggaaggcaggggccaccatccggtccttctccaacgacacccagacaaccattcggtgaggctcactgatttttgtgggggaaagtttggcggagagagctgtcgtgagggccaggcggaaagggagtaacgctggcgccaatnnnnnnnnnnnnnnnnnnnnnnnnnnnnnnnnnnnnnnnnnnnnnnnnnnnnnnnnnnnnnnnnnnnnnnnnatgaggctcgatgtgcgcaacgccctccaagcctaaatgctgtactcggcgcctcattcctcccctgtcctgggtctaaaccagcaccattctaccatgacttcaccccttnnnnnnnnnngtgaggctcgatttgcgcaacgccctccaagcctgaatgctgtactcggcgcctcatccatcccctgacctgggtctcaagcagcaccattctaccatgacttcaccccttnnnnnnnnnntattatcatcggcaaggcaggggccaccatccgctccttctccaacgacacccagaccaccatccggtgaggcttactgatttgtgtggggggaagtttggcggagagagctgtcgtgagggctaggcggaaagggagtaacgctggcgccaatggggtggctgggtggccatgggctgagcgcgggcagctgcccctgcctcgcacggggccaaggctcggcgctcgcagagccgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactcttccccacctgcccccccaccccacacccctccacccgccagggtgacccacggggagggtgcccccctggccctggctcaccgcgtggtgaccctgtctggggagcagtctggggtcctgaaggcggtggccctgcttgtcctgaagcagagcgaggacatccagttccctctctactccgacctgccctccacctacgcctgctcccccgcctcggtcatggcggcgggagcgggtagcatgtatggtgccggcgcgacctccccgccccactaccactctgactcccccccgcaccaccaccaggcgggcctgccgcctcgccagcctccctatccgggcaactggggcggggtgggccagcacgacggcgcagacgggcgcttcgcctaccccgacgcccggcagtacacccgcttcgcgctcaccatccctcaggagcaggccgccgcgctgtcggacggcggctacaccctgctgaaatccatgtcccaggtgggggtgttgaagggggaatggatgactggcgagggggagaagggagcaagggaggccgacgaggggtgtttgtccaccattccaggggcccaggcagggtgaaatggcggccatggggcatggccaggggggccctgcggcgtcggggccatgcgctgagcagagagcaatgccggcccttccccccacaattttgctccgcgccgactctttcccccgcatgtggtccacaccccatgtgacaggagtcgggggccagacnnnnnnnnnnaggggagaagggagcaagggaggctgatgaggggtgtttgtccaccattccaggggtccaggcagggtgaaatggcggccatggggcatggccaggcgcgccctgcggcatcggggccatgcgctgagcacagagcaatgccggccattcaccccacaattttgctctgcgccgactcttccccccgcatgtgctccaaaccccatgtgacaggagtcgggggccagactgaggctggagcatggtttccaccgcctgccgggcatggcggggaggtaccgcgtgctgagcgtgtccggtaccgctctcagcgtgcagcatgcgcacgccctagtctccagccatctggcgggcctgcacgcccatgccatgggctacgcccacccgcaatcccccggcggcggcccggcctgggcgcacaccgtcgccggctgcacctactacgcaccgccggtgccgccgccccatgcctgggcggcggcggcgctgggcgacgccggggtcgcagtgcacccgcccgctgggagctgggtggaggccgagtccaccatcgaggccagcagcagcggggaggtgtcccccgggccccgcgcggccacgccgcccgccgagcaggcgacggcatgagggcgtgggagtgaggacgagcgcgttgcagacaagcgcgtgggagacgagcgtggaaggactcccgcaaacgttcgtgagcgtgaannnnnnnnnngagcgcgtgggagacgagcgcgtgggagacgagcgtgggaggactcccgcaaacgttcgtgagcgtgaaaacggtgcgttcgcgtgcaccacactcggagcactgggtctggagttgggagtgcccatttgacgctcggccagggccccacatccactcccactgttgggcactggagcgcggtttccagtgattacccaccaactgccttttcccaagagacctgcaccgaactttcaggatggaaatcgtctatcattgctgtcgttgtctgagggtgagagcccacctgctgtaacagatgccaactgggacgggaggaaaatcacaaagtgtacatggagagggataggacaggcagctggggcgccgcgtatgacagcgaaagaggggtggcggggagctgtcggcgatgctaggcaacaggaggacgggggactgacagacatgtgnnnnnnnnnncatcacaaagtgtacatggagagataggacaggcggctgggggcgccgtggatgacagcgaaagaggggtggcggggaggtatcgaggatgctgggcgacaggaggacgggggactgacagacatgtgtgtgctgtcgtacggccgtgcggcaaactgccgcacaggttcacgggtcggtcacagctccagggcctggacgaggcggaggaggtcgtcgtgcgtctgccagcgcagcacgcgcgcgcgcaccccttctccccgctcccgctcggcgagcagggcgtccaaggggaagccggcgcgcgccaggacgcagtcctgcgcgcccaggcgcagcgcggggcacaggtcgttgcagccgtccccgacgtagaccaccgggggggcgggcccggcggcgccgtgcgcgcggcgcgcggcgtcgcgctcccccacgaggcgttccagctcccgccccttgcacaggttgggcgggcagcgcgggcagcgtggcggggcggcggaggcacccgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggcccagccgcgcgccgcggcccagcccaggaggcggaccgagggcgcgggcatgtcgcggcccagcgcgcgcagcgcggcagccagctcctcgcgcgtgacgccgcggcgc

SEQ ID NO: 42512 - DNA, 109 bp, Chlorella protothecoides
gtgcaccaacagacggcagccgcacctcttaaacaggcgcgcgacatccggcgcccggccagcctccaccaggcggcgtggcagcgtgcccagcgcggcctgcatcatg

SEQ ID NO: 42513 - DNA, 95 bp, Chlorella protothecoides
ggctgtgacccgacatgtccgtcgcaagtgggcatgtcgcaaaggccgaatgcgaacgtggtctccaggattccctgaactgaggagctggcata

SEQ ID NO: 42514 - DNA, 440 bp, Chlorella protothecoides
  modified_base (165)..(279): a, c, t, g, unknown or other
ggaaccgccgctccggggccgccgccgcacccgccgccgcccggcagcacggcctcggtgcggccccaggcggcggcggcggcgctgctctccgagctcaccatggccatgcacaagaaggaggcgctggtggcgcagctgaacctgatgaacgacgaggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacccgggcttcgtccgcgcctttgcgtcggtgatcgtgcagctcaaggccgtcagcgaccgcatcttcgagaagctgcaggagctgcgcgacgacggaggccccggcggcgccggccccgacgcctacggcccggcgccgcgcggcgacgacggcggcg

SEQ ID NO: 42515 - DNA, 61 bp, Chlorella protothecoides
ggcagggcgtccggcaggggtgcgccggcctggggcgcgccgccgccggggccggccagcg

SEQ ID NO: 42516 - DNA, 61 bp, Chlorella protothecoides
cctggacgtcgcgcggcgcgcgggactgcgcgtcgccgtcgtggcccatgaccccaaggta

SEQ ID NO: 42517 - DNA, 72 bp, Chlorella protothecoides
gaagccctgtccctccggtcagtatggatcttcgctgcttaagcagtgtcgggagtgactaccttgtgggtg

SEQ ID NO: 42518 - DNA, 61 bp, Chlorella protothecoides
gagtgcggacggaaggtgcttccctcgctcacaaacatcccacaccagcgacaggcatggc

SEQ ID NO: 42519 - DNA, 61 bp, Chlorella protothecoides
agctcctcatggctggcttccaggagcggggctgggtatgccaccatgacgacattcagtc

SEQ ID NO: 42520 - DNA, 96 bp, Chlorella protothecoides
gcatgctttacggtggttgcattgtgcagctgtgcacacaaccactcacgacgggcagcccggcccgcctgccctcaccctgatgacatgtgcatg

SEQ ID NO: 42521 - DNA, 5847 bp, Chlorella protothecoides
  modified_base (142)..(151): a, c, t, g, unknown or other
  modified_base (571)..(580): a, c, t, g, unknown or other
  modified_base (738)..(747): a, c, t, g, unknown or other
  modified_base (1089)..(1098): a, c, t, g, unknown or other
  modified_base (2375)..(2384): a, c, t, g, unknown or other
  modified_base (2747)..(2756): a, c, t, g, unknown or other
  modified_base (2978)..(2987): a, c, t, g, unknown or other
  modified_base (3499)..(3508): a, c, t, g, unknown or other
  modified_base (3663)..(3672): a, c, t, g, unknown or other
  modified_base (3726)..(3735): a, c, t, g, unknown or other
  modified_base (4389)..(4398): a, c, t, g, unknown or other
  modified_base (4942)..(4951): a, c, t, g, unknown or other
  modified_base (5216)..(5225): a, c, t, g, unknown or other
ggacgctgacgcgcgtgccctctggcccggcacccgtctccgaggagcgcaccggtgtggatctggcgcgcgccctccgcatggtctaacgccggttcggcgggagggagcggggagagggggccgggacgtagcctgtaannnnnnnnnngggcgcgcccgcctccccgccgcgcgcgctggcggtgctggtgcgccccacccccgtgcacggcgccatctgggtgcagcagacgctgcaggcctcgcagcaccaacccgcgcagtggacgctgacgcgcgtgccctctggcccggtacccgcctccgaggagcgcaccggtgcggagctggcgcgcgccctccgcatggtctgacgccggctcggcggaggagggggggagagggggccgggacgtagcctgtagcggcacccgcagcctccctcgttaccccacccctccgcacggtggaccccccaccccacccatgaagagggagtgcaggccacggcgccgggccccgtccggcgctctccagcacagagaagaagcgtctcacaccgtcatactgtaccgcactggttgattannnnnnnnnnccccccaagcacagagaagaagcatctcataccgtcatactgtaccgcactggttgattactagcatacattgtgttgtactgcaccctctgccgtgttgtcccccgacccacctgcctgcgcagccgagcatgcggggcgttgcccttttactgctnnnnnnnnnnttactccaccctctgccgtgttgtcccccgctcccacctgcctgcgcagctgagcatgcggggcgttgcccttttactgctgcggcacccccaagggcccattacaggccgggggcatcccctggaattttgtcctgcgccgagccctccttggcctcgcccatcggcagtacatgcttgacgctctgagtacaccatctgaacttcctttacctttctgcccccgccccatgtggccacacacatcggtacccaccttgccatgtgtgtgtgtgaatgcatttttacccctccctcctaattcctgccttgcccaggacccttcctttgtcgttttatttnnnnnnnnnntcttggcctcgcccatcggcagtacaacttgacgctctaggtacaccatctgaacttcctttccctttctgcccccgccccatgtggccacacatatcggtacccaccctgccatgtgtgtgtgtgtgaatgcatttttcaccccccctcctaattcctgccccgcccaggacccttcctttgtcgttttatttgcgtatggcatgcttgtggagccgccggcctgcaccctcgcctgggggcacagtgcctggtgctggctgttgtagtagagacttttgagtctgggcatgggtggggctgcaccggcgcagtgcctggagcagcagcgcccggatgtggcacagtaccacgcctgccagcaggaggtttgaggcgtagaggaagttggcgtttgctgtgcccaggcccagccagatctgtggaggtggatgtgacggtctgggcaacgcagagcattgagccagagcattgagcccatgtgctcttctcgcagccctgcactgatcggcaagcactccgtcgtacatggtgggcagcggcattcagacccaggccggccatcagcaccgccagccaccagcccgggttcggtatgcctgccgcgcagctcagggcctgcgcaagtgggggagtgcacgtgaatttaccgcagggcaaagccttcgaacaaggggtcgagtgcgaactgaagcgccaggctcaaggctgcacagctttaagcccctcagactgtctgcctctcttcgcagcgccccaccattgccagggcggcgtggtggggtgcaggcacatctgagaacaggaacatgagccatagctggcacgccagcacatgccacggctgggtgggaaagcgcagcgcgacgctggattgcaggacggagggcagcgcggcaaacacataggcgtacagtgacctgtcggggattcggtggcaggtgaaccgggagcaaatgcaccagagcgctggtgcagccagcaccgcctctcaaccccgcgtgccccgtatcccggtcttcccggaccctcgcccacctgaagcgagggaaggcctcggcagccaggtaccactgcagccccaggttgggccggatctgagcctcagaccctgggccccctctccaccagcctgcgcggcagtgccaggcccaggctgtgcctgcgaggcagagcgtggaggaaagcagggggaagcatgcaggggtgccgcacgcggtggccaccgccacgccctcgcctctgtgggcgacgaggagcagagagcacagcggagnnnnnnnnnnacacgcggtggccatcgccacgccctcgcctctccgggcgacgaggagcagagagcacagcggagactgcgattcatgcgcagggggtggggtgagttgttgtcagctgtcatgaaatgcacaacatcagcccgttacgtctccgagtaccatcgctttgctcctcctccagccccgtcaccgcactcacgagcatggccaaccacgcagggccggcgctggccaggactgccaggaagggcgctgctgagaggagcctgccctgactgcacagggagagtgagatgaccagggctgcgctgtgtatgctgagcctcagggccccagggccctgggctgtccacaggagtggatgcagcaggnnnnnnnnnnagggcggctggagtctcagttctgacgagacgaccaggcccgcagcctgctgtggagcgagggtttgaaaggacgcctcaagacagtgctctgagcacataaaacgggctgcgcgctttcaatctgtatggccaaaaccaatgccagagtcgcctcaccgtgcacgacctggcccccatccggttgctcgcctttctgcaccgccggcgtcgtgcatgcgannnnnnnnnntacatcaaacgggctgcgcgctttcaatctgtgtggccaaaaccaatgccagagtcgtctcaccgtgcacgacctggcccccatccggctgctcgtctttctgcaccgccggcgtcgtgcatgcgaggccccacgccgccgcaaagtccagcagcaccgttgccagcgcagtgagccaggctccccggcccaagcgtgctgtggcatgtaccgggggatcaaagcccaggacgggcatccatcgggagcccagggtggtcaccagggagcctgggccctggaggcagagtgcaatggccaggcgcaggaatagcgctggcaggagggatgccacctgccgtgccatggccccattcgacatctgcaccgttgaacttgaagctttaggggctatatacttccctctcgcctggatgatgctgaggctgtgagcatggggcaggagacgcgctttgtgggccctcagccctaagacaaaatatcgacaggtcagactcacgatcacagcacannnnnnnnnntcatctgcaccgttgaacttgaacctttaggggctgtatacttcctgctcgcctagatgatgctgaggctgtgagcatggggcaggagacgcgcttcgtgggccctcagccccgagacaaaatctcgacaggtcagactcacgatcacagcacannnnnnnnnntatacatagcttctgtattggaatatcctcacggaggactgttctctggttccnnnnnnnnnnttgacggtgcctttttaaataggtaaaagaagatgggtagtggaggactgcgcctttgtgccgtcgctgatctaatgaggtaaacaatcgcgcgcgcacaagggcttcagacctccgctcgacattgacgtggcaccgatgtgggcgttgttgttccatcatcggccagtacataccgagatcaggccatcgcatgtagtacagaggcgtatacatagattgtgaattggattatcctcacggaggactgttctctggttcctgatcggaaggaatacgtctcggtgctcaccacaccaatgcgagtgacatgatcagtcgccctgggagctcccacagcgcggcgatgagatttgatgcgaggctgacgactgcatggacatcggcatgagatccagaggcggggacctccccctagcatggcgctgtcggagagccttgcggcgccaccccaagtgcctcttcgccatcgccctgctcgtcttgctgctgctggacatgtatcacgtcgggttcctgatgccgcacatcacgtatcaccattacaggttggctttggtgtgagggggagtgcgcagggaaacccactcctccggaaattatccgcataccacgcccgtcactgtaaacctccccccccccccccggggggcnnnnnnnnnnagtgcgcagggaaacccacttcccctgaaaatatccgcataccacgcccatcactgtcacccccccccccccaggaggcgctgggttcgccaatactctgcctgggactggaagcacgtggctgctgcccggaccaacctgccccgttaccaagtccccgggaacctcacctttcccatttggtgagggggatgagctgtgcatggcggactggaggcccattcgttgcccgccgtcgctgccagggtgtccatgtcgaccacgaccccaggccccccatccatcatccctccacctgacccagggtcctgtcgctggcgcggtccaccgaacgccgcgatcatgtccgggctgagctggcggcggcgggcgtgcacgactttgagtttgtagacgctctggacggcgacggcgccctgcccgaggcggaggtgggtgctgcctgcgttcatggatggccccgtgtcttctcagagggggcaacagcgcagctcgccagtgccgtgtgtggtcacatggaatgttgcatcttcagaagcgccgnnnnnnnnnntgtggatggccccgtgtcttctcagaaagggcaacagcgcagctcgccggtgccgtgtgtggtgacatggaatgttgcatcttcagaagcgccgcgccccaccttctgttgtcacacacacatatacagacacacacacacacacgcacacatctggaattcatgttgagaatcgacctccaaaagcccgtgcaggtccagacctacttcgcgggcgagcggctggccaagtttcgggcccgcaccccaaacgcgcggtacaagnnnnnnnnnnacgggcgagcgactggccaaattccgggcccgcaccccaaacgcgcggtacaaggtggcctgcgacctcagccacttccgtctcatgcaccgtctgctgggcacgggcctgcccatggccctggtgctggaggacgactttgcggtgccccccgcctcgcgcccgctcctgcccgccctgcgcgcgcgcctgggcgccctgcccgccggctgggacgtgctgcacctgtccctctgcgacgccacgccacaggcctgggcgggccccggcgtgcgcctgttcagccgcggcttctgcacgctaggcacgctgtacacgcggcgggccgcgctgcgcgcgctgcgcgccgccgaggtgggtcttcgcaacgtggacaacctgctgctggacctggcgctgacgggggccttggcctcctacctcgccgaccccccgctggtccagcccctgcccgccgcgcgctggcccagcgagatcgaccgggagccgggggcaaaggatcctttctgaagcttgctggtgtgaaggggtcacctgactggggccatccatggcctatgcttgtcccaggtatcaagtggcagtgctcatcccttcgacctggggtggatggccccccccc

SEQ ID NO: 42522 - DNA, 61 bp, Chlorella protothecoides
tggccccgaggagctgcagcagctccttgcgccggtagcaacccagctggaagccgcaggg

SEQ ID NO: 42523 - DNA, 587 bp, Chlorella protothecoides
  modified_base (86)..(95): a, c, t, g, unknown or other
  modified_base (185)..(292): a, c, t, g, unknown or other
cctgggcgagggtccagggccggaggaggacgggtcggaggcggaggacgagtcggaggcggaggacgaatcgggggcggacgacnnnnnnnnnnggcgacgaggagggcagggttgaggaggagcgggggagagcggacgagcagggggctggcctgggcgagggtccagggccggaggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggccgcgatcctgctcccccgccgcgcggacctgcccgcgctggctcctcgccccggtgcggagctgatgcgcacggtgctgctgcagcccgcgctgcacgcgccgctcgtgcgtgggcccgtggaaggcctggagacgacgccacggaccctcagccccggcgacccagacacgctggtggcgccctggctgctgcgcgcgctacgcttgcacgctgcggcctgcgccgcgacaagcgccgccggcccgcccgcaggcgccgcgcacgctgcctctccgcccacagccgtcg

SEQ ID NO: 42524 - DNA, 61 bp, Chlorella protothecoides
aattcctgtagactctgtgccctgcggtctccaccgttctgagaagatgatgcttcttgtg

SEQ ID NO: 42525 - DNA, 77 bp, Chlorella protothecoides
gccaacgccagccatgccgcagcccaccttacatcatctcccccccacacacacaccgcgactcctgcccacctcca

SEQ ID NO: 42526 - DNA, 61 bp, Chlorella protothecoides
cggtcagaaaagcctttttggggggggggggcggggggcgacgtcgcgcacagggcaaggt

SEQ ID NO: 42527 - DNA, 9283 bp, Chlorella protothecoides
  modified_base (679)..(688): a, c, t, g, unknown or other
  modified_base (1298)..(1307): a, c, t, g, unknown or other
  modified_base (1525)..(1534): a, c, t, g, unknown or other
  modified_base (2274)..(2283): a, c, t, g, unknown or other
  modified_base (2632)..(2641): a, c, t, g, unknown or other
  modified_base (3359)..(3368): a, c, t, g, unknown or other
  modified_base (3437)..(3446): a, c, t, g, unknown or other
  modified_base (4329)..(4338): a, c, t, g, unknown or other
  modified_base (5148)..(5157): a, c, t, g, unknown or other
  modified_base (6581)..(6590): a, c, t, g, unknown or other
  modified_base (6900)..(7107): a, c, t, g, unknown or other
  modified_base (7203)..(7212): a, c, t, g, unknown or other
  modified_base (7901)..(8025): a, c, t, g, unknown or other
  modified_base (8345)..(8354): a, c, t, g, unknown or other
cccggcgtcacacctagtgtacgcccctccccacccctccaatctcccctcaacccctcctgccttcaggtacaccccctcccaggcctgggagcacttcctcatgtttgggtatcgggaggggcgcgcccaccgcttcatctgctgagcctgaggaagctcccaagcgcggcagggggcaatgtcgccctcgcatgcgttgggccccagcgcggggccatgccgtgcagccgcgcaggggcatgctgtgcacggcagactgtcagacgtgttacaaaaggagagggggttcacgggggatgagcgcacggcgcaggggcccatggctggtggcaggccaggccccgcttgcaaggccagtgaggggagggagggaccctcgagggcggtctcaaaacatgccatacattctcgcggcgtcctggggctcaaatctccggcccctctgctcccgcaccgctctcgccaccttgcgcttcagcgccttcaatctgcggagggatggggggttgggcaggtcaggccggagtcggcgggcgtttactgggatccagggaggccattttctcgatgcttggcagaaagtgccgtgcaatgcttccagccaaaatgctcgcacacaccccttcccacgtcgcgcaccgaatgtttgaccgccacatgaggatcagcgccccannnnnnnnnncccagccgaactgcccgctcacaccctttcccacgtcgcgtaccgaatatttgaccgccacatgaggatcagcgccccaaaaccgacagccacgagtacgtagaagaccagcagctgcggggtgcagtgactgaggattgcagggcagggaccgggagcaaaagcggctggggagggcaactcctgtgtggatgccctgtttgatttcgggatctcaggcaccccgcttgccatgcctggccacagccgcaggcgcgaggttggctgcctcagaccctgcaagcatcgttcgacagagtgcatcaacgcgccagcccacctcttgcagtattttgttggtggcgtgcgcgctctggctgtcgccatagaagatgctggtgaaccactccaagatgaaggcgccaccccctttgctcagctgtgccgcctcctcatctagccccatgctccccgatcacaggaccagagatctcgcctcgccagtccctggcgcgcccctggtgaggaagttggggtagcttttcggggtgctgcagcctgtgtcacttcgggccgcataaacagagcgcatcggacaggttcccgcgccccgggaacttggtggatcgannnnnnnnnncgaggaagttggggtagctttcggggtgctgcagcctgtgtcactccgggccgcatagacagagcgcatcggacagattcccgcgccccgggaacttggtggatcgaagtggaaaagctccatctcccgtacctccgcacggctgtcgggacggtgagcgcaacagcggagcccagcactcctttgatatcgatggcgcacggttgagctcgcctccnnnnnnnnnnaacggtgtgcgcaacagcggagtccagcactccttcggtatcgatggcgcacggttgagctcgcctccctcctctaggctgtgtctgagtggatccgagagctacacacagaattcgaacgtgattcctgcttaacccagacttcttcaccaccttcttgtccgtcgcgctcgcgaatggccacgtatcaaaatcttggtcgtgcccgcgctgcccccgattctcattctcgaggtctcaaactccgacatcgggatgtgcagcttccagtgggaagtcgagtgccctagatctcgccaccatatccctatttcgtgtagcagtctaagtttgtgatgtgttgacaacccggcagttgccctcatagcccccggccctacccgcctaggatgaatactcacagtcaggcccatgcggccatgcctgcccatgtcaagcccgtcgctgggccccatgtggacgcacgccggcctccaatgagagggcaggtgcgcccacaagccgtggctgcacctccgctccgcacacgagacgtcggccgctccaccaatgttcgctggcaccaggccacggtgcaacgcgccgacaaggagcgcatgctgtgccaacggggatgtgtgctttggttcacaggtgagaggagagcagtggcgggggttggggtccacaggaagccctgatctttttccggtgcatctggggtggctttaggagatggtttgatctcccccctcccacgnnnnnnnnnncgggtccacatgaagccctgatcttttttccggtgcatctggggtggcttcaggagatggtttgatctcccccctcccacggctcccagggctcagcgcaagtggcaagagcacggtggccgccactctcgagtccatcctgcaccaaaatggtcactacacgatgctactggatggcgataacgtgcggcatggactcaactccaaccttggatttaggtgaggagtgggtgtttcttcagggtggctggatcttcgggaatccaaacaacaagggtgttttgggggaatggtgggatcatatgtcgtgcccccagtggcctgttgtccatgccaactgtggctaggnnnnnnnnnntcatggactcaactccaaccttggattcaggtgaggagtgggtgttcctgcagggtggctggattttcgggaatccaaacaacaagggtgttgtgggggaatggtgggatcatatgtcgtggccccagtggcctgttggccatgccaactgtggctaggtgtgtctcagacctcaggactgtgagggctgcagcaatgtgagggtgccgagggtccatcagggaaggacaaaggcaaccctaaagcggagctgggattggttacgaggcgccatcgatcttgtttttatcatcatcatgtgcaattgattaggtatgggaacactatggcaccagcgtcgcgcccttcatccttcccacagtgccgaggatcgggctgagaacattcggcgagtcggagaggtggccaagcttgctgccgagtctggcatcctgaccatcacctcgttcatctccccctaccgagctgatcgagatgctgtgagagcacgcatggctcctggtgagaggaagatctgtgggatcgtcgagtgcagtgacgatgggagggtcggtactcatgagagcctgcgcatgctcctgccagaggtgcgaatgcctttgtggttgctttgcgagataagagtacccacatcccgatctgatgcagtcatgcttccttcctacaggtgatttcctggagatctacctccgggtcccgctggcgttgtgtgagcagnnnnnnnnnntgaggtggtggtgagaacttgcggttagcaggcacccactggctgcagcctgagtggccatgtcccagnnnnnnnnnnggcatgcgcctgctagaggtgcgaatgcctttttggttgctttgcgacacaagagtacccacatcccaatctgatgcagtcatgcttccatcctacaggtgatttcctggagatctatctccgggtcccgctggcgttgtgtgagcagcgagatcccaagggcctctataagaaggcgcgagcggggaagatctccaacttcacgggtgagttatcatgccgagggggtggtgagaacttgcggttcgcaggcacctgctggctgcagcctgagtggccatgtcccagcagggaccgatgcattgcctacatacataccaacacccaaggctgctgagatcccaggttgataagtggcatgtgcacggacaaagggaccattctgacaatagcatgctgacctccaaatgcagggatcaatgacccttacgaggaacccaccggggcagaaatcgtcctagatccctacgatgaaggtagggcctgtgactttattaggtactgcaagatgtccatggcagttggttcccattggatcacaattactgctcaatgttcaatcccagaccattcgtttcactcacgcccacttgcggccccccctctccccgcagagcatcgcatgtactctcccgaggagctggcactccgcatttttgaccacctgaccatccagcagtacctccttcccgtcccgtcgacggcgagcttctgaggcccccgtccccgcctgcactcgtcattgacagaccccgtgaagacggcacgacgttgcccccttgtgttctcctcccatcccactctgtgctgagagttttgacaccacattcctcatccccacctccctcttcccgcgcaccgcccggccagactgtaccatgannnnnnnnnnacattgacagaccccgtgaagacggcacgacattgcccccttgtgttctcctcccttcccaccctgtgctgagagttttgacaccacgttcctcatccccacctccctcttcacgcgcaccgcccggccagactgtaccatgacaaatccctgcacccctcggccggtggccaggccccgctccgctcagaagccatgttaaaaccctgtcagcatggccagaggctggcatacacgatgctgaatgtacagttggttggatgagcaatggctcaagggtacacagagggcgctttatgaacatcatgaaacgcaggtcaccagtcatccgccgaatcaaatatccctcggggtgtgggctggcgcgtgggggtttcccggggctgctgctgctgccgctcctcccacgacggggtgtcagcattgacgtcctgcttgccatagtaccattcgccagggctgtaatacccctctccttggcttccaacctcctgctgcgcctctggctcatcgccgtacctacggggggtctcgccctcccagaatggcctggacggctccgggggtggcagccgagcaaggggcaccgcctgccttggaccagcattcctccggtcatacatgtcgctcatctccgccgcctcctgccatgataacaagaagtgttggttgatgcacatctgacacagcgcgttgaatggctgctgtgcctcgttcccctatgaagacaattcaagggccaagagcaatgcacatgccgacacagcccctgctcaagctccccgcacctctttctcatacacagcagannnnnnnnnnaaatgactgctgtgcctcgttcccctatgaacacaattcaagggccaagagcactgcacatgccgacacagcccctgctcaagttccccgcacctctttctcatacacagcagagcgcagtcgcagggcctccacgccgaaactcaacgcagccccggtcgtcatgagctgtccgaagaggaggagggggtccaatcgccagccctgggggtgggggggtcagggtgtgcggtgggatgatggcaagaaggtggagcacggcaggccgattccacaggggcctgcctctgcgaccagtgcggctcacactctgaggcctcccggtctcttgttagacaaaaagaccccattcaatcgcacgtctcacctggaagatcaggatacccccgaccaggagtgccacacacgagatgacgacatcatagtccttgctgatccaaggcttggcctgcctgatctgccacagtgtgagtccgctgcctatcaggcctactcccaaaatgacggcagggcttacgtcaacgttcaccatggcgagcgtgagaggctggatggaagagcttggtccagccctcgtccgagacgggcgaggtcgctgcagcagggatcgcgccaccccacatcgcgcctgtgacactctgtggagttcatatgaaaggacactctgatgtagcgtacgtggtggggtggagccggacccgaaggcacctgcgacaactttcgagtgggtgaccatgtcgactagctcttcagggagtcttggggatttcttgctgaaccagcaaattacaagatgctcaagagcttcatatcattcttgtgtttgcgctggctggtgtgtcgcctcggcaaggatgtgaagatccatcatttgtcgcgcccagccacggagagggaagcccgtgcccccgccttcggacgcagggacgcagcaagatatctggctcggtagcgatgctgtagtaatcgcccatagatgagatattgactaattacaactcaagctaggggagggagtggattacatttggacgccggtgggaccggctggtggccgcgcagaatggcgctgcgagcactggcccaggaggcctggaccgtcggtagcgccctactcaggaggtccatccacagcagcgccacaacttcgtgcctgcacgcggcgcggcaggtgccagcgctccagagctgcgcggggttgtccaccagcagcggtcgcagcttgccaggcctgaccagggggttcgctgctcaggcatcctattctgatgaagaaattcgggaaatagaggcacgcatattcggttctcatatcggtgagcatgtggtgtgggttttaggggctgacgaggctatataggtcatgcagaggagacctgagctgttttgttcttgcatacagtcctgagtgaattgttactctnnnnnnnnnntgaggctctataggccatgcaagggagacctgactagttttgttcctgcatacagtcctgagtgaattgttactctcaagctgaataccattacactcttcctggtcaccgcagggaatggtctaccctcaggccgcaagattctgaaacagaagctggtgggcgagaagctggcatcctactaccctgagaatgtcctccgggccgacccgtacatgctgaacatccaggcagagaggtgagagtcgtgggaggaggcaccaaaattttcagtttcccggcattcatattacatgttaatgctgagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggggtggcaaggagtgagaaaggaaggagtccctgttagcaggcctcgcagttttcatgtcagtacttgcttgtgcaatgaatttcacctcgnnnnnnnnnngagggcaccaaacttttcagtttctaggcattcatattacatgttaatgctgagggttgtctctgacgtgtgttcttctgcggcaatatttaagcatcaattttggtgcattaccactcctagcgcgcccctctccacagggcgaagctcaagctggatcgcctacgaaggcggggcaaggcacctcctaagaagggcgctggcaagcgttcatcaaagaggcaagtgttgggtggcaaggattgagaaaggaaggagtccctgttggcaggcctcgcagttttcatgctggtacttgcttgtgcaatgaatttcacctcgagacatgctcaggaattgatcttgattcaacgctgcaggaagtgacaggatgtagatctcgggcgattgaggcagcgccatcttgggagcaggtgacgcgggctgcacgcagaaggcatctgaagactgtcctggctctgctatgcccatatggcaatgcgaatgcatcgatgtgaaggactgctcattgcatgcgcaaacacatccttgagtgtatccagaggggatcagtgacagcttgaatatttgctgtctgccaagaccttgtcgatgctagtcaaacgtgagaagcgctgacaggggcgggcattggttttcgagcagttccaaatctcgcgccctctcttacacacctttgccccttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatctggagaagcccctgtcgagtcagtggtctgagccttcggctcgcacagacccgatcctggccacagcctcgcgatttccggcactgtcgcaccatgaccgtatttgcggtgagcaaggagctccctgaggcactgcagggcctgcagcctgcccccctgtggcgcttcttcggggagctctcctccatcccgcgtcccagctacaaggagcaaaagtgcgctgatcaatgggagcacccccgcggactgagtcccaattcctctgtcacgcatgcctacttttttctgtgtatgtgcatctcacattaccgctgnnnnnnnnnnactgcggactgactcccaattcctctatcacgcatgcctattttatctgtgtatgtgcatctcacattaccgctgtcccacccctcctcggaccctgccaaattgccccagggtgctggactggctcaagctctttgccgaggagcgcggcctcgcctggtcccaggacgcggcgggcaacctggtcgtgcgccggccgggcggcggcggcggcgaggcggcgcccactgtcatcatccagggccacatcgacatggtcacagagaagaacgcggacgtgcagcatgatttcgaggccgacggcatccgcctcgtccgccgcgacggctgggtcacggccgacggcacgaccctgggcgccgacaacggtgagggaaggagggggaaaggggcgcgggtgcttgacccctgctgaggcaccctggggctgcccccgagcgcgatgcaggggctgactttgaagagcggggggtccccattcaagcttcctccacatccatccattcatcacccccctcctcctcctccccccgccgcgccctcgcaggcatcggcgtgtgcgccgcgctggcggtgctggactccccgccctccacgccgctgccccccttggaggccctgttcaccgtggacgaggaggtgggcatgacgggcgcgctgcgcctggaccccggtctgctgacggggcgcgtcatgctcaacctggacaccgaggactggggcgacatcttcatcggctgtgcgggcgggggcgacagcgccctgaccctggacctccccctggagccgctggcgggcgccgcgggcggctggggcgcgcgcggcttccgcctgggtggcatgctgggcgggcactcaggcctggagatcggcgaggaccgggccaacgcgctgcgcctggccgcgcgcgccgctgcggcggggctggc

SEQ ID NO: 42528 - DNA, 77 bp, Chlorella protothecoides
cctgccacagcaggacgcgcatctcgtaaggcagcgcgttgcgcagtaggagcggcggcttgacgcacagcgtgatc

SEQ ID NO: 42529 - DNA, 5530 bp, Chlorella protothecoides
  modified_base (1110)..(1119): a, c, t, g, unknown or other
  modified_base (1355)..(1364): a, c, t, g, unknown or other
  modified_base (2344)..(2353): a, c, t, g, unknown or other
  modified_base (2536)..(2545): a, c, t, g, unknown or other
  modified_base (3249)..(3258): a, c, t, g, unknown or other
  modified_base (3976)..(3985): a, c, t, g, unknown or other
  modified_base (4676)..(4685): a, c, t, g, unknown or other
  modified_base (4869)..(4878): a, c, t, g, unknown or other
  modified_base (5296)..(5419): a, c, t, g, unknown or other
cgcgcctcggcgtgccgcgcgtcgacgcgcagcgccgcgccatacccatcctccagtgcggagcacagcgcgcgcagcgtggcagggccgtcggcgtccgcctccgccgccgccacgaaggcgtcgcccagcgcgcacagcggggcggggtcggcgcggtcgaagctcgcgctctccctcaggcgctgcaccgcctcctccagcgtggccagttttgttgcagagtcctgctggtatgtggaaggttggagaatatgcacgggggatcccaacgtgagtgggaagcctggtacaggatgctcaagctcttgtgcgccctggcacagactggcatcctggcacacccgcgcgcacctcacacgcaccattcacacccccatcagcgcccacctgcatcagccccgccagggccacaagccccgtgccccagttggccagcaggcccggcaagtcgtcaccgttgtcggtggaggacagctggcaggcggtggcgtacgcggcgcgcgcgcgctcagcgcacgcttccgccgccgccccgtcgccgtcgccggcagccgccaccgccgttgccacctccgcgtcggccaggttgccccaggtaagggcgtccggctcgctggaaagcgcggcgcggtacaggtgcagcgcctgggcgaggagctggcggggtccctcctgcccctccacggcagcctccgcccagctggccagagtgttggcgcagttgaccgccacgtcggcgcggggcgcggccgaggtggaaggcgcggcgcagggagtcgcagcggccgaggtggagggctggtcgcaggggacggcggcgccgtaggcgtggacagcgcggcggaacagggcgcatgccctggtctgcgcctcggcctccacctcgcaagtcagcacgtcgtcaggaagggtggaagcggccgacagtgtcgtctcgccccagttctgcaggcattcgccctgggtcggttacatgcatggtgttgggcatcaggtttagcagaaagggcaattatagtgagcagtcattgcggcagcaccaaaccctgacagacgccttttgaggaacgaaacgccatgactacatcctccgactcctctgccccnnnnnnnnnnacagcaccaaaccctgacagacgccttttgcggaacgaaatggcatgactacatcctccgactcctctgccccaccagatatatgctggcttctatggcagcaagattgggcgggtggggagccagcttgagggctgcctcaaactggccctgcgacatggaggaggagggaagggcgggtttaataatgcagaccttgaatccgatcattgggatacgagaatgaatcgccatannnnnnnnnngccttcgacatggaggaggagggaaggccgggtttaataatgcagaccttgaatcctatcattgggatacgagaatgaatcgccataccacagtgccatgctcagcgagggaccatcccgaccatgctggtctctcctgtgtctcaccactgccttctcatataccggcaatgcctccaagccgcgcttcctctccgctcgctgttgtgatacttcggccgctacggtatgtaattgggaattaggaagtatgagggtccacccacccaacctgaggccccttgaagaaatgttacctgcacatgctgcgcacacgcacctgcaacagcagccaggaaggggtcagccgtgggcccaatcttggatctccccatgttctgaatataacaaaacaattatttgtttgcgatgtgctgccttgggatcgttgggaggccgcttctccgtcttcagaaaccccagccaggcgccagcgcccgggagatcaaaaaaatccacgtggtggacggaccccgcgtcccttgacatgtctccgacagagctgcagcatgctgaaaaacacgatattcaacaggatcgggaatggctaggaggacggagggggaggaggcggagagctcacggctgctggctgctgactggggctcggaccctcacaccgcggcgttcgggcccggatctgcccaggatggcagggatccctcccacaagacctccccgccgctctggacatggttactcctcattgcctcggtgagtttcgtgctgtggtcgtgatgacgtcaatgtgccgcggggctggcctgaaaccctaatctacctcggaaggtgggatgctcgaaacacatgaccatgagcctaggccgcccggcacgccctctcacgccacacacatgcccgtgtgcctcccatccatatgttcaactggcgatcccccccctcctccaccaaaaaagcccaggtgctggccttctcctccnnnnnnnnnncccatatgttcaactggcaatcccccccccctccccaaaaaaagcccaggtgctggccttctcctcctcgggcattgtcttcagcatgatgcccgaggtgccggccatgaccctggcggcctggcgtctgcagatgaccaccgctatcatgatccccgcggctgtgttcgaggtagtggcccnnnnnnnnnntgcctggcgcctgcagatgaccaccgccatcatggtccccgcggctgtgttcgaggtagtggcccagatggacaccaacacgcgctggcgcctagcgcgggccgtctggacgctgctgctcaatggctcgctcctggcgctccactttgggctgtgggtgctgtcgctgaagaccacctcactcccgcacgccatgctcttcgtctgcatggcgccggtcattgtggcgctgagcatgtggatcatgcgccagcccatctcctggggtaaggggaatttagggttgccgggtaggtcgcgcagggggacgagtggtgattcgacttgctgctgcgttgtgcatcacattaagagtatgtccaacagcctgctcaacccgaggctccaacctccaaatcgtgcttgcccacccgctcctgcccgaatgctcggcagtgctgactaacccaccagcacctccctcccaaactctcggcaggtgagctgggcgggacggcgctggggacggcgggcgccgcgttgctcgcgctttcctcagcccacggcggcgctgcggggcctggcgccgcctcctggcgcggcgacctggcggccctcgccgccgccgcgctgttcgtggcctacctgagcatcggccgccgcctacgcgcctggatgcccatctttacctactccactctagtgacgggggcgggcgcggcggnnnnnnnnnngcgccgcctacgcgcctggatgcccatcttcacctactccaccctagtgacggaggcgggcgcggcggtgctgaccctggcggcggcgtgcatcgaggggtccaccccccgccatgacccccgctccgcccactacggcctcttccagtgggcctcctccgcgagctactttcctaaaatcgcctacctggcggtggtgcccggcatcctgggccacaccggcttcaacgccctggtcaagtacatggaccccctcatcctcaccctggtcggcaccatggagccgctggtgggctcctttgtgggccacgcgatggggctggtggagctgccgcaccccctcacctacatcggcggcgcggtggtcctggcctccaccgtgatcgtctccgtcgcgggccaccaccggtaagaaggggtgctgggaggagggggggggtgtttgtgtgcaggaagggagagggtgaggaggtgtgaggtatgttgagcattgcgagggtatacaggagaggatcaggctcatgtgatccctgcagaaccatgcagaacgactttgaatagtttccagcatgcattcacaccgaatttcccttggcccctgcagtcaaaaggcagagcagaaggagtctgagaggctcatcaggtccaaatcgcatcgtgagcaaggggccactctggcttgggttgagtggatgaatggactgagggggtatcatgnnnnnnnnnngcatcaggtccaaatcgcaccgtgagcaaggggccactctggcttggatttagtggatgaatggactgagggggtatcatgctgctggtgtcgtaaagcgctggccgcaggcctgtgcgcctctgcgagggtatgcgccgaccctcgccccgccgtcacaggttcataaggaagacgagcaatgatcaacatgttcttttttccatgctcttacacagtgacgaccgccagcgtccagttgacctgaggcatgatgcctggtctctctggacaccaaatctgtgcacgggcgcagtcacctgagaggaccagcacagcattacgggcaattgtaacgcggaagaaacagccatctgccaaggcgtcgatgcaggcgcagggggagatccaccctatacctcgggtatcactgctcttcatcccgtccgggttctcagcgcccgagaatgcatcaaactccccctcctgtttctttctcaatgggttaaaacactggctgcccaaaagcgcccaaaggatccttgcacatgcacagcgtgctgctgtgcatcccacaccacgcctttagttctccctgcagcccaggggtctgcacgcccccgacacctccttttgttacatttgaatgtgtacatgtcatgagagttttgccctgaagtctgccagcagagggagggcaggcagtggcggnnnnnnnnnncatgcaggcgcaggaggagatccaccctgtaccttgggtatcactgctcttcatccccgtccgggtcctcagcgcccaagaatgcatcaaactccccctcctgtttctttgtcaatgggttaaatcactggctgccacaaagcggccacagggtccttgcacatgcacagcgtgctgctgtgcnnnnnnnnnncggcgccaggcgtcccctccttcacgaagccatgggtgcgcaggagccggatctgggccaggaggaagaccgcgcggcagagccgggcgtaatcggtgcccatcgaggccaggaggacctcgcaggcggcggagaccgtcaccgcagggcccaacacccggaccagcgaggaggccatgggttggcgcgccagggtcgccgccagggacccctgcgtggcctgtgcatgtgtgtgggaaggaggaagaacatggggtacagcagctcaagcgacgtggcatgcgtctgcttgcacacagtgcggggcaaggagcctgtcgctccccagcgcctactgacccccgctttccccgcagggtatcggcctgtcacctgccttcaaagctcacacaggggcccctgtgtcgtctgctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcccgtgccagcctggcggcctgggcgcccgacagcatggccgccccgcccacccaggcggcgagctgggtcagagcgccgccggccagcgccacgggcgccgccgcg

SEQ ID NO: 42530 - DNA, 63 bp, Chlorella protothecoides
gctgacggacgtgctgcgcggcgcggcgcggtcccccgcccgcgccgcgcagctggactggtc

SEQ ID NO: 42531 - DNA, 116 bp, Chlorella protothecoides
ccgcacatttggtgctgggaagccgcgcctttggtggggcaagcgatacactctgagaacggtacggaggctgtcgcacagtgggcccctgcccgccaaccgtcccccctgccctt

SEQ ID NO: 42532 - DNA, 15836 bp, Chlorella protothecoides
  modified_base (110)..(119): a, c, t, g, unknown or other
  modified_base (965)..(974): a, c, t, g, unknown or other
  modified_base (1452)..(1461): a, c, t, g, unknown or other
  modified_base (1709)..(1718): a, c, t, g, unknown or other
  modified_base (3210)..(3219): a, c, t, g, unknown or other
  modified_base (3306)..(3486): a, c, t, g, unknown or other
  modified_base (3576)..(3699): a, c, t, g, unknown or other
  modified_base (4223)..(4232): a, c, t, g, unknown or other
  modified_base (4649)..(4658): a, c, t, g, unknown or other
  modified_base (4909)..(4918): a, c, t, g, unknown or other
  modified_base (5745)..(5754): a, c, t, g, unknown or other
  modified_base (6010)..(6019): a, c, t, g, unknown or other
  modified_base (6854)..(6863): a, c, t, g, unknown or other
  modified_base (7492)..(7501): a, c, t, g, unknown or other
  modified_base (7914)..(8153): a, c, t, g, unknown or other
  modified_base (8237)..(8246): a, c, t, g, unknown or other
  modified_base (8349)..(8358): a, c, t, g, unknown or other
  modified_base (8479)..(8488): a, c, t, g, unknown or other
  modified_base (8661)..(8670): a, c, t, g, unknown or other
  modified_base (9192)..(9201): a, c, t, g, unknown or other
  modified_base (9293)..(9302): a, c, t, g, unknown or other
  modified_base (9965)..(9974): a, c, t, g, unknown or other
  modified_base (10320)..(10329): a, c, t, g, unknown or other
  modified_base (12062)..(12071): a, c, t, g, unknown or other
  modified_base (13067)..(13076): a, c, t, g, unknown or other
  modified_base (14184)..(14193): a, c, t, g, unknown or other
  modified_base (15078)..(15087): a, c, t, g, unknown or other
  modified_base (15289)..(15298): a, c, t, g, unknown or other
  modified_base (15611)..(15620): a, c, t, g, unknown or other
ggggtgggtgggagggtaaaagcgaggcagtgccggacaggacggctgctggcatcataacgaggcactcgtacaccctgccgcagctcctggggggatgtcctggttgnnnnnnnnnnagcgaggcagtgctggacaggacggctgttggcatcataacgagccactcatacaccccgccgcagctcctggggggatgtcctggttgagggctcgagcaatgtgctggagtctgccgggaagtgttgtgccgcgtgtgccgcctacaagcccaccgccgagcaggacatgctcggctgcaatggtggggcgcgagtggggcgcgagagggacgctcagggagtgtgcctgggttggcggatgtgcggcgagggcgggccaccgccgtccaccacttggaatgcatcgctggcctcagaactctggtgtcccttcgggggagcacaggcacaccccacccgaatctccccttgcccgctcgaaaaccctgttcacggctccaccttctctgccctcacagtctgggtgtactgcgaggatgctggactgtgtggcaaggaccacaaggcctgctggctcaagcacctggtgagcgtcgccaagagcccagcgcccgtgcacgccatggcacgtccgtgcctgcccgctgagcatcccaacacggttcccccctccctcgccccaggcacaccccactgcagtggagccgtccaagaagggacccaacgtgggctggacgtcgggcttcatcacccggcctcgtcagaccagagcggctcaggtgaggcggccggcgtatgattggtgaaagggcggagggtgagggcggcgcggtgggcatgggcgagcatgtgtgtcaggcaggctgtgcagggggtcctgctggacgcgcgccgcccccccatcatcgagggtttttttccggtcaccccaagccccctctgccgccgccgcaggtccctgcnnnnnnnnnntggcaggctgtgcaggggggtctgctgggcgcgcgccgcccccccatcatcgaggaacttttttgtcggttacctcacgccccctctgccgccgccgcaggtccctgccgacgacgaccgcaggtaccacacggtcatcaccgcccaggggtctgcggtgcactggcagtcgcgcgtgggctactactggttcctcaagaccaagcgcgactgccaggcagccggcaagtgcgacgtgagtgcgtgaagggggggggggagggttgctggggttgggaaagtgggggcgctcttgtaacacggcagcaggcgggtgttgggggtgagcgagggaggggtcattgtgccgtgcatgccgccagaggtgagagcacaagggcctggacgaggagtggcggcgctggcggcggcctcaggtcgccccccgccacccaggcaggggcccgctgggggggccaggcgcctcgggccgaggcgnnnnnnnnnntattgtgccgagcatgccgccagagatgagagcacgagggcctggacgaggaatggcagcgctggcggcggcctcaggtcgtcccccgccacccaggcaggggcccgcttgggggggccaggcgcctcgggccgaggcgcgggggccaatgaagaacgccatgtggtcccgcagcgcgccacgcccgcccaccaattcccccccgcagatgggggggttcacccggctgctgcactccgggaaggagnnnnnnnnnnctccccccgccgcagatggggggcttcacccggctgctgcactccgggaaggaggacgacctcatggccgagatccccacctgggtcgcccagcccctgccgcccgagcaccccgaccatgggtgagcatgccatccagcctgggagggggtgaggggggactctggcctttccactccggctgggtcactgcagcccgcgctgattaccacggggcagggcacctgacatcccccacccctcctcgcccctccccacccaacccaggtatgtggtcctgaaccggccctacgccctgctccagtggatcaagggcgccgtgatcccggagaagtatgtgctcatgagcgagcccgaccatgtctggctcaagcccatgcccaacctgatgacggggacgacgtgagtcggagggggtggggggctgagtgctgctgagctgcccggggggcagctctgaccaggagggggtattcccatgccgagggctcgggccgcacgccgtccggtcccgggagcccgcccggcctgatgcctggctgcagcatggctgcagcgcctcttgcatggcggtgaatgagactgcgccggggtgcgttgccccggggcatcgcggcgctcgcctctcaaacacaccccacgctcctgggcatgcctgctcaggcccgcggccttccccttcttctacatcgagccctcgaagaaggagttcctgcccatcgtccagaagttcgtgggccccatcagccgcgtggaggcggaggagatcgcgcccattggtgagtggcaggcacggcgacaggcggcgcgggcacctctttctggggtcctggggggggcggtgcggggcagcgcatgccgccacagagcctgggggcgggtgtctcggggggcggcctggggtcgggtgtgtccggggggcggcctggggtcgggtgtgtcggggggcggcccaggggcgcccccccaccccgctctgtcagatgctgccgccggcccagccctgccgcccagcccgccccctggccccggcgcgatccgcagggaacgcaccgaccttcatgtcggtggcggacatgaagaacgtcatgcccatatggttcaacatctccatcgccgtgcacaacgacgaggcggccagcaaggtgcggggctcgggccgtgcgcgccggtgcacgtctgacaggcggggccggcccgcgagcaggcctcccgggtcagccccgggcgcgggcggggccgcggtgggatggtgggggacacccgcccagcccctccccgctgccgggcccagacccacacacctcgccccaccgccccgcaccggctcaggcatggggctgggtgcaggagatgtatgcgttcaccctctcttgctacaaggccggcatccgtgacatctcactcttcctcaaggcaagggggccgtgtggagtggtgggggtcgctgcgcgagggtgggcgcaggcacgatgcaccgcgcgactcggtnnnnnnnnnngccccctcccgctctgtcagatgctcccgccggcccagccctgccgcccagcccggcccctggccccggcgcgatccgcagggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggccgtgcgcgccggtgcgcgtctgacaggcggcgctggcccgcgagcaggcctcttgggtcagccccgggcgcgggcggggccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctacaaggccggcatccgcgacatctccctcttcctcaaggcaagcgggccgtgtggagtggtgggggtcgccgcgcgaggggtaagcgcaggcacgatgcaccgcgcgactcggtctctgagcatcaagcccccgcccctctgcacaccccgccccatcgagccagccggccagtgggagccgaggtggcagctccagactcgacccctgcacgctcccacgcgcagatgacgtcccagccgccgtgggactccagcatggatccctactacatcctgcactacacctacgggatggactacaccaaggagggggtgttcacgccgggtgagcaccctcgcgtgaggagcaaggggggaaagatgggggggcgaactcctcaaagggtgcacgcactggccggctcccgggccgggagggctgcggctgtacaggtcgggaacggtgtgcgagggggcaaggcagccggcgcggctcggtctccactcaagcgccagcagcgcagcccctggcaacctgnnnnnnnnnnaggctgcgaatgtacaggtcgggaacgatgtgcgagggggcaagggagccgacgcggctcggtctccactcgagcgccagcagcgcagcccctggcaacctgtccgcccgatgccgcgcactctgccctcccatgcttgcaggcaagatcggggagtggcgcttcgataaacgggcgtacagcttgagacccccgccgcgcaacctgggcgagccgccagagggcatgaagaatgacctggtgggtgggatggtcgggcgtgaagcactggacgcttggccatgctcgtgcatgcagggccgcaggcctgggtgcccactgctacgccacacacacacacacacactcagcaccccattccaacccccaacctccactcaatgcccaggtgcggcacctcatccacgccatcaatgnnnnnnnnnnaccccatcccaacccccaacctccactcaatgcctaggtgcggcacctcatccacgccatcaatgaggcgtccagcatcattccggactgggacgattactcagccaccggggttgccaaacaattctgggatgggaaaacatttgcgactgcctgagagtgtgggtgcacatgctgagctggacgctggtgtgagacccgaccgcgggccccagggtcccgatgagtgggggtgagaaagggcaactgcnnnnnnnnnntgtgggtgcacatgctgagctggcagacgctggtgtgagacccgaccgcggcccccagggtctcgatgagtgggggtgagaaagggcaactgccagccgcgcaactgccgcgcaggccgggggctccaccacacgtagttgagccacgacgcctcgcgcatgcatgcattgcgatggatctagggatgcatgacggtcccagcaacccagaaggtcggtgcggctgatcgacagcccatgcccaagcccaagggctcctgcaccatgctcggacgcgccctcctcaccctggtgctgatgtcgtgcgtgacgctcatactggcgactgcacgggtgcatggcagcatacacgtactacaaacaagtcgacagcttgcgggcagcgacgcgggtgcgtgcgtgtggctggaccgcgagtcaggcactgctggggtggatgtgccggccctgctcagcccccgcacccgggcttcatccgtgatcacgacttcccgcaggcgcagacggcgcaggagtgcccttgctggtcgatgccacggctgacgcatcgcctgccgcacagggaggggctgcctctcctccacccgctgaggctggcgccgcagggggttcccctcccccgcctgccctcccaccgcccgaggtggtgcctcctcccccactccctccccctccaactgtccagcctgacgcttctgctcctcctccaccctccgctccctccgtccccaaagttttgggggctgccaccccaggaaatgagcgcaaggccaaggctgggcgggccaagaagcgtgtccccatagacactgcgtaccacctggagnnnnnnnnnnatccctccgtccccaaagtcttgggggctgccaccccaggaaacgagcgcaaggccaaggctgggcgggcaaagaagcgcgtccccatagacactgcgtaccacctggaggcagatgggctgcatggtcagatgtacatggaaggcacatgctgggctcgtcgcaacacgaggtaaggctcgtcaattccgcggcagcggtggggtcgtgtggaaaagctaggcaatggaccccaccctcaagaccagccacaagnnnnnnnnnnacgcaacacgaggtaaggctcgtcgattccgcggcagtggtagggtcgtgtggaagagctaggccatggaccccaccctcaagaccagccacaaggtttgccatgtcgacgatggcatcgggagatgttgtgctggccatcagcatctgcatctgccagaatgagttggggcctcacagcagactcattgcaatggaacttgtcggccctcgtgagatccgcaggcggtatggcgagatgctgctggcggggagcgggcacctggtcaacactacagcagactgttgctcagcatgcctgcagtaccagcccagtggggaccaccaggaggccgtgtgcaatggtgagggggaggaggggcgtggcggcatgagatcgggcgggccagccccatcctggaggtgcactgtccaacggttgctgccctggctgtcatgccctcgccctccctgcgcccatggcagcctgggtgtactgcgacggcacccatcccaactgcacgcctcgggagtgcacgctcttctatcaggtagcttgtggtgtgtgggggcagggtgcatacaggctcccattgctgctgctatgcggcggctgaggtcgctgcgaagtgcggcagcctgcgccatgcgaggacaatcattatcagagaccgcagcctgccgagccacctcggaatcagacaaacagcaactctgctctcctctgtgactatctcatcccccacccctccacaccccttggcaaagcctcgaccctgggacatgcccgtgaattcagggccagacgttgggacgatttcggggctgacggtcggacctcctgaggccccagccgnnnnnnnnnntccctccacaccccttcgcaaagccccgaccctgggacatgcccgtgaactcagggcctgacgttgggacgatttcggggttgacggtcggacctcctgaggccccagccgacgaccctgtgagtcagggtactgtggtacccccgatccccgacagcgttgttgcgtgcgctgcgtcctgggtcctgggtgaagtgtccattctccactccaacacccccccccccccccccccccccccgggggcacctggcaggcgctcgctggcgtggaccggagctaccatgttgtggtttccgcgcaaggccaatccgtgcactggcagatgcgcatcaattactaccactacaagaaggcaaagcgggcgtgtgccaagctgcccatatgccacgtgagacagacgggaggtagcgtcatgcacattgccccccgctgaaggagaagggatccgggtggccatgcaacccccctttccttcctctcaagagggtttctaagtggcatggctttgccaagcccactgccgatcccacttgcggggccccggacctggcccgatgggtgagaacaagttgccagtcacgccattgtatattgcttccactgctcttaccccccacctcctcctnnnnnnnnnnatgctgaaggagaaaggatccaggtggccatggaacccccctttcctttctctcgagagggtttctaggtggcatggctttgccaagcccactgccgatcccacttgcggggccccggacccggcccgacgggtgagaacaagtagccagccgtggcattgtatattgattccactgctcttaccccccacctcctcctctcttctgccagatgggcggctacacacggctgctgcactctgggaagccggacgacctcatgtacgagatccccacctatgtggtggacaagctgcccgagggcctggaggaccccacctacctggccctgaaccggccctatgccttcatgcagtggagcaagcaggccgtcatcccggagaagtatgtgctcatgatggagccggaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgtcaagagcccggcaaacctacccacctgcatgtcctctaccaggcccacggggtggcccttttggtatatggagccgtcnnnnnnnnnnaaacatcatgatcaacaacaggtggggcggcgtgggatgcgggaggaaacggaggagcctgcgcgcacggcgcactcattttgctctcatcgatccgggaggnnnnnnnnnntacattgatgggagtctggtatgagggccatatttcatatctcatgaacgccgcccaccctcttcaccactgtgtatggagtgcagtcatcatgtcctcacttgatggtccatgcacaagnnnnnnnnnncacattgatgggaatctggtatgagggtcatatttcatatctcacgaacgccgcccaccctcttcaccaccgtgtatggagtgcagtcagcatgtcctcacttgatggtccatgcacaagatggatgccactgcatgctgcagactccctctgtacatctggcctcagccacnnnnnnnnnnaaattggctccccgctgcatgggccgagggtggtcgtacacacaggtattctgcagaatattgcaatcatttgttggcccccgcaccaacacccatgcctcacaacttgtacacggtccaggcccatcggctaccctttcttctacatggagccagccacaagcgggatgctgaaggtcatgcaaaagttcctagggccgttgagccgctcggaaatcgagcagaaggtggccccattgggtgagcggatggagggtggatgggctgagtcagggcatgtggcagcatgccctccttgcccggagagggtgcctgctgtgcatggcacttgcgccatctgtcttcaagccaccccgagctgtctccctacctgcagggagctcgcccatgctcatcacaatgggcgacctccaaaaggtggcccccctctggctggcctatggcaccatcatccacaaggatgtcgaggccaacaaggtggggctgctcgagtgccgctgggtgggggggggggggggtttnnnnnnnnnnagcctatggcaccatcatccacaaggatgccgaggccaacaaggtggggctgctcaagtgccgctgggtgggcggggggggggggggtgggnnnnnnnnnntatgtcgtcccgtccatctgctggcgccatccacccagcatgtgcgctgaactgcagggtgttccaccgttgagcggttgcaacctgtttgcccttcactcgcaggcgtttggttttgtgaaagagatgtacgccttcatcattgggctgtaccatgctgggatcctggacactgatctctccccagaggtgatgggttgttttcctgtggaagggagagggatgaggacggtccgcctttgggctctttcacacgtgcgctgtcacggctggccgcatgcccctttggcagggatccacaccatgccatccgcatcactccctgcccacaccttcactcgacagatgatggcccagcctccatatgacaacctctacatgggcgcatactatatcatgcactacacctatgcctttgagtacagggaggatggtacgcagggagtgagagggaagagagggaagctggggctttagcttggcttgccagagtgcttgcttgtcgtcccaagtgcctctctcacttccctgtgtcaatcccgtgtccatcgtccccacaccacaggaagccactggggatgtgagttgcagcttggcaaagggagggccggcatcgtttgctctgcctagctctgccttcgtggatcccccgcaatgcacctnnnnnnnnnnagcatcgtttgctatgccaagccctgccttcgtggatcccccgcaatgcacctggcttgcattatttcctcgcgactaacatgcagcactgaagggcctgcctctccacccccaaaccctcgtcgcagcgtatgacgctccttaccgttacgacaagcgcaagtatgctcacgtcattcagccgaggaacctgacgatgccgcccgccggagtgcagaacgatcaggtcgggaaggaagcagagcaggttttggtagcctggcaacaggccaggcgtggttctgtggtctcctcgtcaggggtccgcaaagcccgatgcaaatggcgacttcccctcccattccgnnnnnnnnnntgtgtgaagagcccggcaaacctacccacctgcatatcctctatcaggcccatggggtggcccttttggtatatggagccgtccatgagctaccagctgaagaccgtacgcaagtacgtggggcctttgacacgggaggagatagagaagaaggtggcacccacaggtgggatggatggctgattgtgggagtcaggccagagacagggagcagagtgcctgccgtcaagccaggctgtggctgcgccaggcccagcacccagcccttgacccgacgcaagggttcccacggtccgttcgcgccggctcacgatgcgagcacgctgctccacgatctgagcacgccggcgcacggtgcaagcagcttggcacccgccgcctgggccggccatgcacccctccgccctgcaccgcgcagggtcctcccccatgttcatgaccatggctgacctgaggaaggttgccccgctgtggctggcgtacggcaccctcatccacgccgacaaggatgccgtcgaggtgaggaggtggccgtccctcgatctgcggctgggctgctggaaaggaaacggctgctgggcctcgggggcggcgcctggctcggaccggggtctgggctcgagggcgtcatgcactcgtgatccccaaccctcctctggaaccgcggccctgctcctttgaccttctcaaatcagcacttgagggggatacctccatgcacacagcggcctgctctgcacctcgctgcatttgaactccgctgggctccgtggcgctgcactttcactgcagtgcaccagagtctcgggatccacatgcagtcactcattcacagcgaggttcaaccatgccctcacaggtgtggggcttcgtgcacgagatgtatgccttcatcatcggcatgtaccacgcaggcatccacgatgtggatctggacatgaaggtgggaggggcggggcggggatgcacgggcgctgtgccgtcgccgatgctcaggatgaccccgtggcggagggcccgccaaccaggcagccgccaccgtatgctccccgtgcgcagataatgagccaacccccctacggccccgtccacctcgagcctttctacctgctgcactacacctatgcctgggagtatgatgcccaaggtgcggcaccactcctgggggccatgtgggagccagaaggctctgcctcctacccaaggcatgcacctcagactgaacacataggccccagctcccatctaccctgaccactgcaggcaaccacgacccaagtgggtggtaaagggagcgggggagggtggcacatggacgccacgggacttgtgacagccaggggtggtgctgcgagggagctgactggcagtgccatgtgatcaaaggtctgccggaccacttgtgcccaagtgggatgcacctgtgctcttgcagtcaggtcccgctgccacgcaatgcaggggacgactcattctatcgctatgacaagcggaactactacgagtccatccagcccaggaagctggcacccccaccctacaacatcaagaacgagcaggtgtctgggaccgcgcgcttgctgccatggggctggtttgggcacgctcagccgtctgtatctgaagaagcggggagttgtgtggagtcaagactggaatttgcgtcgctcgtaattgacaacccagacttgactgtatggcgcgctgattgcaggtgtggttcctgtacgatnnnnnnnnnnaacaacatcaagaatgagcaggtgtctgagactgcgcgcttgctgccatggggctgttttgagcacgctcagctgtctgtatctgaagaagcggggagctgtgtggagtcaagactggaatttgcgccgctcgtaaccaacaacccagcctggactgtatggcacgctgattgcaggtgtggttcctgtacgatgccttcgtggaggcgatgaatgccctgccggcgtgggacagctatgaggaggccaaggccgcaagccagctgtggaacggggtcttggccacctccgccgcaacctagccgctgcaggcagggaagcctagggaacccaagacgtttggactgcggcagcagttttaaacccatgggatagtagcggtcctgtgtagtgtcgtgtcagcctatcaagggttcaggaagagctctgtccagcgccatgaatgcctcgagagcttggcactgcaagcatcctctgttcagcaagcccgcaggacagtcttaatgatttactcttggtgggtagtatgtgctgagtgcttgcacaccatgcagtgacaataaatctgtggcacattgacaccaagatttcagccaggctccccaacgaggagccttaggcttgtacagcttcagtctggttacaagactggcaaggtgtcggcgaggcagccaatcttccgctaaactggggaaacatggccacgtatcctggcaggtgcatgttcttggcagtccctgaggaggttccagagaggcaaacctcactgcccctcccttaacgcaacaggaactcactggtatacgaacttaggcgcaagtgtgagatctaagaacgtaccattgccagaactgcctccggaagatttatagacctcttgggatctgatctgtgcacacttggatctcactcgattgatacagctgtactctctgcaaaagccttcaggcacacatgcactgcagatatgttgcatactgtatcatcctacatatnnnnnnnnnnactcttgagatctgatttgtgcacacttggatctcactcgatgatacagctgtactctctgaaaaagccttcaggcacacatgcactgcacatatgttgcatactgtatcatcctacatatgctaggatgatacacacttcggtatagagcctagtcatgggcgggactgtcacggttgcctgatccagccttggaggactctccaactatgagaagaaagagtcccccagtccgaggagcggacgggcaaggcatagtgccctcgaccagatttaataaacgggagattgctttgtaatgatgattcgtccttgaattctggactcgaggtccagtaggagtgtagactctcccccggagcatgccacctcgccgggcaggcagacgtccaaccaacctattcttcatgggtctcctctcgtttctttccctgactcttctcctcactgcagtgcggatctccgttgccacctcctccccgggccttcaggccctgcggctgaatgagcgggctgtcctgggtatgaatactgtgggggccaggtcgggttccgatcgtgtcggatgcttgtggagtgtgggagagggcccccgcttgattctcatagtagtataatgtgctcgactccctaattttgcaggcgaggcttctgacgggctgggaacccaggccgccctggaccctggcagcgtgccgtccggcacagctgtcaaccagacctcagccacagcagtggatgcggcccgcaaagccaccagaaccgtgcccacccagccagcgacccaaatgaagactactattaaattggaggatgatgggttctatgggcggaagtaccagctgggacagtgctggattcgtgagcattcagagtgagttgttggagggtctgcctgctcaatggcaaggcttatctgttggcctgcaactgcctttcttcgaccaccatgaaagctccgtaagcaagaagagcttacccagtgcctgtatgattgcacgtttccagcatccctcgaagcatcaagatggcttccatggggggcgctcactgtcatccctggttcccctgtccaacagtcggtcgggagagtatctggtgaacggcnnnnnnnnnnatgtccatggggggcggtcactgccatccctggttccctgtccaatagtcggtcgggagagtatctggtgaacggctgggacctcaaactcaacacaacagcagagtgctgccaggcctgtgctgactacaagcctgtcaaggaaaagagctttgctccgtgcaatggtgagccacctcctccacgcagcgcccctcaattgttgtggtatcaatgattgagcacgcagccgggcattgtctgaggtgttgatgcccagccgacttttagttttcactagaggctgttgtgcattgttgtgtgaaggtttttgttattgcctcccttgcaaccgtgctggattgctcaaccccgaatgggtcaaggacttgccaaccattccaaggcagcactgcaagagccacccactcgtgcagattgactccctctcacactgttccacctcccctccatgcagtgtggaattactgcgatggctccaactccaattgcactgcaggccactgctggctcaagtaccaggcgagtcagggggcttggaaagagtagattgtgcctgtgcccttgtcaatgtgcctccagcaagcgggctgcggatattgagctggccgagccatggatgcaagactgcagtcaaaagcagtagttccctcagccgcctagttacccccacctctgcactcttccccttgcacagccccgcccttggggcatgcacattatttcgcatccaagtcaagggggcatgtctggaaccatcatccctccaccagaacttccagtcagcactgtggtaagggccggcagtgtgaggtgggtggggcagggctgcactccagtttctccccccctgcgccatctccagcgcctgctggcacatgggannnnnnnnnnactggcagtgtgaggtgggtagggcagggctgcactccagttcctcccccctgtgccatctccagcgcctgctggcacatgggatgttgtcagggatctgctccgtctggatcgtcagagcaggctgccaggtcgcacactttgcgtcaggcatcttcgcccagagtatataccccgctctccatcgtctcacacccttttnnnnnnnnnnatcgcacactttgcgtcaggcatctccgcccagggtataaaccccgctctccatcgtctcacacccttttccgcagaaacctggcgatgaccggagctatcatattgtggtctccgcccagggcgaagcggtgcactggcagatgcgcatcaactactaccactacaagaaggtcaagaagcagtgccaggctcagcccaagtgcgaggtagggcgccgggctgcgcagagcagtgtatgtatctgatgcacaggctcgactgcaagggcggcaaaggggcgtaaggatcttgcgtatgaacaagactcgatnnnnnnnnnntgcccaagtgcgaggtagggcgccgggcgatgcagagcggtgtatgtatctgatgcacgggctcgactgcaagggcggcaaaggtgcataaggatcttgcgtatgaacaagactcgatgaccaagagattggcatggcaatggatgccactcagcagcctgtagaggagctgctgacttccctgtgagaccgcgccccgccccccccccccacccc

SEQ ID NO: 42533 - DNA, 26198 bp, Chlorella protothecoides
  modified_base (903)..(912): a, c, t, g, unknown or other
  modified_base (5718)..(5727): a, c, t, g, unknown or other
  modified_base (7100)..(7109): a, c, t, g, unknown or other
  modified_base (8144)..(8153): a, c, t, g, unknown or other
  modified_base (8594)..(8603): a, c, t, g, unknown or other
  modified_base (9028)..(9037): a, c, t, g, unknown or other
  modified_base (10232)..(10241): a, c, t, g, unknown or other
  modified_base (10524)..(10533): a, c, t, g, unknown or other
  modified_base (11109)..(11118): a, c, t, g, unknown or other
  modified_base (11295)..(11304): a, c, t, g, unknown or other
  modified_base (11368)..(11377): a, c, t, g, unknown or other
  modified_base (12848)..(12857): a, c, t, g, unknown or other
  modified_base (13251)..(13260): a, c, t, g, unknown or other
  modified_base (15576)..(15585): a, c, t, g, unknown or other
  modified_base (16209)..(16218): a, c, t, g, unknown or other
  modified_base (17420)..(17429): a, c, t, g, unknown or other
  modified_base (18420)..(18429): a, c, t, g, unknown or other
  modified_base (18830)..(18839): a, c, t, g, unknown or other
  modified_base (19335)..(19344): a, c, t, g, unknown or other
  modified_base (19720)..(19781): a, c, t, g, unknown or other
  modified_base (20297)..(20306): a, c, t, g, unknown or other
  modified_base (20468)..(20477): a, c, t, g, unknown or other
  modified_base (20961)..(21025): a, c, t, g, unknown or other
  modified_base (21231)..(21240): a, c, t, g, unknown or other
  modified_base (21366)..(21375): a, c, t, g, unknown or other
  modified_base (21499)..(21625): a, c, t, g, unknown or other
  modified_base (22651)..(22660): a, c, t, g, unknown or other
  modified_base (23384)..(23393): a, c, t, g, unknown or other
  modified_base (23875)..(23884): a, c, t, g, unknown or other
  modified_base (24085)..(24094): a, c, t, g, unknown or other
  modified_base (25553)..(25562): a, c, t, g, unknown or other
cccccccacacaccacacacacacgcacacaggccctcccccgcctcacctcccagggtgacgttctggaggatggacacgttggccccgatcacagcggtggcgccgatgacgacccctgtgccgtggtccagtagcacccccgccccgatgcgcgcggcggggtggatgtccacggcgaacacctcgttgctgcggctctgcagcgcgctggccatcatacgccggccctggtgccagagcacgtgcgcgatgcgctgcacctgcagcgcgtggaagcccttgtagtagagcagggcctgggagaggccggagcaggcggggtcacgttcgcgcaccgccgccaggtcggccagcgcggcggccacgatgctcgggtgggaggccagcgcggcgcggaaaatctccgacagctcggaggggagcagcgtggcgtctgccagccgcgcggccaggatgaaggccagggcgcgagggaaggagtcgtgggccaggatgctggcgtgcaggaagctggaaagcagggcctcggagtcggagtcgcgctgcgcctcctccctgtcgtgaaggggatcgggtgaggtggggtggatgtgaacctgggagagctgcgggggccgatcgcgggctgtcaaatgacaagtgggggtattggggtggagtcgggactggcgtacgtgccgtgcagaccggcccctgcaggggtggccaacatggaggcacatgcgcgcagcacgaggggcaggggctcgagtcggggacctgggaggcatgcatgcctcgtgggccaggcacgcaagcagagcagtgtgtgagcatgcagagccaccccagggtatcccccacccatcaccccccctaccgaatggtctgccagatgcggtcccccgcgggacagctcannnnnnnnnntccagggtatgccccatccatcaccccccctaccgaatggtccgccagatgcggtcccccgcgggacagctcacgggcggctccgctttgtggttgagagggtcaccatgcgcggacagggtggcacccccggccccggtcggggtgctcgctgcgccggagttgaggagggagcagaggtggggttccgggcacgcccgtgcgactgaatctcaggggcatacaggccaggccaccactgatccatctcacctcgggtcatgtgtcgagctgtggggcggcctcgcgggctccgtgaatgacggcgggcgcacacagtgcgggttggctggggggtggtctgggcagcgtgcaaggcagtggtctggctggccatgcggagtgccgacgggccctcagtggcgccctgagatgcgattggcactgctcgatatgtgggatgcgacggtatgagcggcccgggcgccttagggcaggtcccgaaaggaatctaggtgtccctccgaaggatttccaggtcgggggcgcgaattctggtctggctacggatgggagcgatcctcatgcgcaatagtacgccgcacactggcatcagagcatactttcatatacaccaacgttcagcgaaatgaggaatgtgcctggcgcagtgtcaaagggctatgtcgctccgccggggggccaaagcccagtccgtatcctgaacaggactccaaagatctctcaggccgtacagaagtcgctgagggagcgtcagagggtgagtgggatgccgcgacccggatggcgctcggcatggtgctcagtgttggagtgaccttgcaccttgccccactgcaggctgtcatggaggccaggaaggcagagcacctgcgagagtgtgcagagtgggaggcccagatcgctcaggaggaggccatgcacaaggtgagtcgcagcttttatgacagtgtaacgggttaaagagtgggccagcctgttttgtcaagctccaggaggagtcatgcagctgccatgggaatgcacgcgtccgccatgagtggtcattcgtcaacatcttcacaacccgctccctgcatcgtgcaggtgcccgcgccaggcagaccgcgcgtacccagctcccagccgcagcaggtcgaagccacgctgcatcgagtgcaggaagaggagcggacgcagcgcgatcgcctagttgcccagcaggaagagttcagggccagggttttggcgcgtcaacgagaatcacaaggttggctcgccaggtctggcccggtcctgcaggaggcctctcgcttcagtcagcttgtgtcggcgctgggctcccagaggggtggacaaccgatggaacggtatgacagtcaccaaagctgggagacgcgaggttggcagggcagcagccctgcgtcctccgtgcggcctgggcgtgaggagcgcagtcatcggacctatgagcagcccagggagaacagggcgcagcgtgacccccctcgcgcaagtccagcagggcagggcgggaccagctggtctgggcacccggctgcggaaacagatgactggtgattcctgtggcccccttgcgcgagagtggaatgagcaattagtgtcgctcgataatcagagggattgtagaaattttcagatggcgtgcgtgagggtgcattgccgtctgtgatctctacaaccatggaatctcctagaaaacatccaatccatccgctgaaacagtaacaccatgcacaatgtgcagctcccctctgtgtgctcctacttcacaccgcagtcatggaccccacctcaagggaagcccagatccacgtggatggggagttggaggtttctgtcgtggaccgcggggctgatgggttggtgaatatgatgttgtccatgaacctttcatttgctggcttgccatgtcccatcgcctttggtgggaccccgcccctgcttccctcacatccccccccgtcattcccttaccggtaagcctttgtggcaaccgcctgcgccagtaccatcatgggaatgtcctgagcagccggtgcaagcccgacagagagacatctcgtgttgcctgatgcaggatgcccgcccacgtgggtcttcggcgccggacacattcgaccttcatgaaccaggtcacttcatgcccgagatatcgccgagaaaataaaatccatgccttgtatatttagcctgcgtttccatgcgagcatggggatgcatcgctccagcttgcggtgcaaatctcagatcggcgatctagggtttttgaatcccagcaatctccaagcgtacgccgagcaacctctgcacgcgccagatacagcacgccatgcgataagaccttcttccatggtttgggttgtgaggccttggattcccgtctggagtcttttgagagggtaaatttgtgctattggcctaccttcaccgcgtgcggtccgagtgtcctgggcgccgaaccctgcgcacggcacacggggtgtctatacacccggtcgggttggtactcgcccgtcccagctcaccgagggcgcggcacaactcatctgaacaacagcgggagtcccccgaaccgccacagcacgagccaccatgacgtatttcagtctggccgcgctcttcattatgttccgtgagaccctggaggcggccatcattgttgccgtcctcctgcagctcatggagcggctgaagatgccggagttgaaacgatggggtaagcccaggggtgggatggcaatgccgaacctcgcgcccgcaccgaatcgcatgacgtacgccttcccaccggcaagtatgctgcagtccgcatccccaccacctcgcctgctttaccagaagggatgcaaggctcgttggcaaagtagtcgcatgccctgtgtaatttccccaaaattgggcacgatgacaggcataccacccaatcatcatggagacggccttgtcctcctgtcagccctcccactcctcctcgtcgacacagtttggataggagcagcagcaggggtgggcgtggccctcatcgtgggcgtggtcttcatcgtcctgttctatgtggcaaacaactctatcttcacggggaacgcggagaacctcttcaagggtttcattttctacatcgcggtcctcctcatcgtgtacgtgtccttccacatgctcaagttctacaacctggagaagaagtggagatataagctggagcaggccttcaaggagcgggaggtgggggcaggggccgggttggaggggggttgcatgcatgctgggtgtctcgtggtcggcgccaaccccaccacgcaccgagtcgtccatccctgtctgcgcgcccgccatcacgcagggcatgaagaagagctacaggtacaccgtcgccttcctcgctttctcggctacggtgcgtgaaggcattgagtcggtgctcttcctcaccggcgtgtccggcgggcagggcatcacctcggtcatcatccctgggatcgtcggagccatcctggggctgatcgcaggctgcatcatcttctacacgtgagatgccggggggggccttgggtcccggatcggcggggtgcctctccaccgaggctggcggtggacgctcgctggcgtgggcggccgctcgttgcacagcgggggctgggcgcgggggctgggcatgccgcatgctgcggccggcagagggcgtcggcgcaggcatcatcccccccttcctcccggctggagcgtgccgggcacagagcacgaggtcacccccccctccaccacctgtgcagggggcggagcatccgcagcatgaagtggttcttcatcatcatgaccgtgctcctcctcttcatcgccgccggtgagtgggtggggacgcgccagtggggatcatgtcccatggtgccaccctccccgtggacagcctctacgctgtagccctctttatttgagggtttgacagctgggacggcgctcactggcccccctcctgggcgctctcttgttccacttgacatgtatggccctccgtagtcccccccacctccactcccctcccccccccaaaggcctccattttcaacacactccctccaccccctttgttcacacaggcatgctcatgaacggtaccgccgccttccaggccgctggctggttcggcgcgacctacccctacgagtgggtcccctggtccaataagatcctgtggaacaccatgggctgctgcaaccccgacaccaatgagttctggtccctaatccgcgcgttgttcggctaccaggccatgcccaccaacatccagctcctctattactgcctcttctggttcgtggtcctctccgccatggcctaccgcgcctggctgggcgtgctgaccgacgagcaccgcttcgcggccgaggacgaggaggggcgccccgcctccttcaaccccacctatgacggcgagggcaagctggccaagggcgtggagggggcctccggctctgacagctccccgcgccagcacagcagcgaacgcgcgtcgggggacaagtttgaggacgcggcggtggcggagccgtccagtgccgcggtgcccgccccgcccgtcgcggtgaaggccgagtgagccacgctcgtgctttcagtgtatgctgccctttcctgtacacccccggcttgcgtgcaggctccgcccggtgcgccgacgggcctgcatgttcgccccccttttcgctccctctccttgctttctcgccgtggtgagccggcgtggcgcgcctgcctgtcggcatgcttggcccctgcccctgcacagggtctgggtcctttggcgtnnnnnnnnnngcgtggcgcgcctggctgtcggcatgcttggcacctacccctgcacagggtctgggtcctttggcgtaagtttgttgctacagcgaaatctatcggggtgggatgttcatgcaccaatctccgaaggcgatttatccatgagattgtgtctccctcaaaattgagcgcgcgctccaacgtcagctgggcgatgccacacccaaaagacctctgccccgaaaggggaaaccgtcgggctgcacctccccacatgcactcgtacatatttgaaagcttgtgttgcccgaaacagcagagtttctggcgcccctcacatcccgtctgacgctccgtcgtgaacgttcgaactgttgcctggcccatggccccgcggctcaggcgcatcgcgcggcatgctgcagcctaaacctattgcatggcatggcaggggaagcagggcctcgttgattgccaagaagggcagcacctggccccgggcagtggcggtgagttgcccaacggtgtgccggtgctgatcactcgatctggtacgtctgcagtgctcagctggaggtagaattctgcaatgtgtttccatgtccatgtgcagggagccccgcgaccggcgggccgacgcctgcgcaatctcggcgcgccgtgcgcccagtccccggaccacgtcgagtacccggcggtgtaccgggcggaggagtacgcgctcgagaccttcgacagcgatgactacaggcacgcccccctctacgacccggacgactacgacacccagctgtgccccctggtgccgccaaggagcccgcctgcacggacggcactgccgcgggccctggccgcacaggcctggggccggtggagggcggctgcggcacggccgcggggcgcctcccgtcccgaggctgcccagagtgacaggaataatctttgggaggcgtcgccctcgccctcgcccagccacttccccgacgcaaagcagccagcgccgccccgcctgcgggtgcccactcccggctccctcctgcgcctccttcagcgcttgaacatcgcgctgagcgccacgctgggcgcgctgggggtgctgctgcaggagggcgccgcgcgggccggcgaggctctgcgcgccgtccgcgctgcggcgctgcgccgctatgctggcagccgcgtgcagctggcgctgcagtcctggcgcgagagctgggcggaggccgcgcaggaggtgccggaggtgaggtgactcgctgtggtgtctccctgcgcagaggcggcgtgggtacgggcgttcttgagtgacatcaggggagttgatgaaagggtaccaaggggttggtttgcgggtctggcctggcagttgccagtcccttggaccctcgccgcccctnnnnnnnnnnagcgttcttgagtgacatcatgggagttgatgaaagggtacctaggggttgctttgcgggtctggcctggcatttgccagtcccttggaccctcgccgcccctgaccccccgtgtgctcctcccaccatacctcacgtatacacacaccaacacacaccaagttaagtccaacgcacacaaaccaatttctcaggacgtgtggggcaaggcagtgtgggcctgggagcggccctggctgcgcaagctgcgcctgacggtgggcatggccaacctgagctaccgcctgccggcgttgctggcgctggtggccacgcaggtcacgctgctggccagccaggtgtcgctacccatgctggcgccgctgctgctgggcacgggcatgctcctgcgctccctccgcgccaacgccagcttcatcttcccccgcatcggcctcatggtggtcctgctctgggccctctggttcttccagggcgtggtccagaacaccgtggcctaccttcgcaaacaggtgtgtgttggtatgtgtgtggggcctgtttgagtaaaggaatgggggtcttctctgttgtcggggtcggaaacggagggtttggatgggaagggagggtggcaagggtgccaacaaggttgttctggaatggccaaggcgctcaaggagcgggcaataatgcaaaggaggcccgacctgatgcccgactcagcacctttccttggcgccccgccacttcgacagggcgcgctggaccagcgactggcgggcggcatcatcaccaccagcgagatcagcggcctgctggcggcggtggtcatcctgctgagcatgctgggcatcaacgtgtcggccctgctcctccccgccggcgtcgcgctggcggtggcggcccaggacctcacccgcaacttcctggccggtttcttcctgttcgtggtgcagcccttccgcctgggggacaaggtggcggtcggcgtggcgggcgggggcccaccggggtccaccggccctgcagggccctggttcgagggcgtgtgcnnnnnnnnnntggggggccaccgggggccaccggtcctgcagggccctggttcgagggcgtgtgcgagaaggtggacctgcgctacacctgtatccgctcggggcggcgccgcctcatggtgcccaactccatcttcatggcgcgcgagttcttcgtgatggacgacgtgcccgccgccggaggtgccgcggacaacccaagcatgcgcgggcccggcgcgcccggatacgcggggccgcagcagcccctgccggggctgggcccgcactatgcgggccacgtatggcagctggtccagggcccgcccgtgcacgctgaggtggcggccgcggcggctgcagagggcagcgtggagggggcggcggtggacggcgaggagggggggccgggcgcggaagcctcgccctcccggccgactccgaggggcctgcggccccgggggccaagccnnnnnnnnnncccaggcgctgaagcctcgcccgcccggccgactacgaggggcctgcggccccgggggccaagccagccgccggcctacacgacctacccctttgccccgggggtgccgccgtggggaccctacgggccatttcccccgccctacacggggacgcactgacggcagacgcgacggcccccttcccttccacacaccttctccaccagcatgctagcgctgcgctaccccgaacgaaaaccgacacatgccctcgttgtacccagaaatccctgaccctgtaataatctctctgcctgcatgcgtggacgacagtgggaaacctaggatgatggctttcttcacgctctccattccagagatgctgctgtggttgggtgcccggatactcataaacgagaaaagtgattgcgagactgcctgaaannnnnnnnnncataccccgaacgaaaaccgatacatgccctcgttgtacccagacatccctgaccctgtaacaatctctctacctgcatctgtggatgacagtgggaaaacctagtatggtgggtgtcttcacgctctccattccagagatgctgctatggttaggtgccaggatactcaaaaccgagaaaagtgattgcgagactgcctgaaacccagacccttgggggcgcaccacctcgacacatcgcccgatctggaaacctcaaggtcccccgacatgggcccgcccgtgcgagttgccttgctcggcggtgggacattcgctcggtcggcgtacctgcccctgctcacaccggggcagacggatcgcaccctgatcggcatctggagccggacacgggagtcggcggagtcggcggctggtgaagcaggaggggtgccttcctggcatggggaggagggcctgcaagaggtgctggcccggccagatgtggacgcggtcatcgtggtcgtggctgcccaggccacactccaggtggggcctgtgcggcgagagccaaggggagtgcgatcctggtttgcttgtcaggacagccactggcgctgagaaacaccatggagcggaggccaagatagagctcccgggcaccccttcattcctgccatccccgagcctgccattccagcggaccccccagatatctcgtcccactacacaaatccacagatcgtgcggcaggcgctggcggcgggcaaggtggtgctgtcggagaagccggcgggccccaccgtggcggccgtgaaggaggtgctggattggatgcaggcctctggcatccccgcagcacgctggtcggtccaggaaaactaccgcggcgagtcgggcctcgtcatggccgctgagctggcgagatctggcgcgctggggcgcctggtcaaggccgacctcgtggccgagctgcccatgaaccccggcagcaggtactacgccagcgcctggcgccgccagctgcccggcagcttcctgctggagggcggcgtgcactttgtggccgcgctgcgcctggtgtgcgccgcggcgggggcaggggaggcgggtcgggtgtcggccctcctcacccgcggcagcgaaggcgtgcctgagcctgataccttggtcggctgggcgcgttttgacggcggcgtgccggcgggcgtgagcnnnnnnnnnngggcgtgcctgggcccgataccctggtcggctgggcgcggtttgacggcggcgtgccggcgggcgtgagcatcacccaggcgggcgcaatcccccgcctctgcgtcaccctcgtcggcacccaggtttggatggtcgtgtggattgctcgtggggtgagcccaggtgcacggggttgaccatcgtgcccctgcgccggtttcgccactccagcatgctccacaccccagtcaggacctcctctccgcacggtgcagggcacgatcgaggccaagcggggccannnnnnnnnncggggtgagcccaggtgcacggggtcgagcgtcgtggccctgcgccgctttcgccactccagcacgctccacaccccccgtcaggacctcctctccgcacggcgcagggcacgatcgaggccaagcggggccagtggggggcgtggactgcggcgcctgccaacagctacaccctgcacgcagagtcgagcggcgacgtgcccgcctccgttgaccagcgcgtgctgcctttcgacggcgtgggcacccaggtcggcgcattcgtggcgcacgccgccgccctgcgggacggacgggatgctgagctggacgccagcctcagcgtgcaggaagctgcgcgggacctggccctcatggaggcgctgctgaggtcgggggagcggcaaggcgaggcggtggatgtcgaaaggcttgcctgaggggggggcgcttgcttatagaagggtagcgacgtgccctggcagtgctgccatgaatggcggcaggctcagcggatcggaatctcgatatggaaacgacccccacgactatacgactgtagaaagacgacaccaagcaaccactggactctgatcnnnnnnnnnncgtcgaaaggctagcctgaggggggggctgcttgcttgtagaagggtagcgacgtgccctggctgtgctgccatgaatggcggcaggctcagcgaatcggaatctcggcatggaaacgacccccacgtctatacgactgtagaaaaacgacaccaagcaaccactggactctgatcnnnnnnnnnnaatggcactcacggacctgggtacggcttgcaatgaaaccagggcaccgttccctcgcgccaannnnnnnnnntatgacactcacagacctgggtacggcttgcgttgaaaccagggcaccgttccctcgcgccaagcctcttggattgcaggtcaaccaagcaacatcaagccagcccaacatcgcatcgcaccactctcagtcacagtcccagaaatccgcatcaggcagcagccttcttcttcaccgcacggatcatgccgtactggaccaggccatccacgaatgcacggtggaagcgctccagggtcaccccgtcccgagcgcacttgtaccacaggtgcggctgccaggattgggggacagggtggcttttgtgaggttggacctcggttgtggaatgtgatgcatgacccaggccttgacgctccttcacataccatgggcgcgtgcactgagcctgcctttcgctccaacatgtgacactccgcctcacacttccccctgcctccccccattcccgccttcctcctgcccaccttgctgaccacaatccaggggtcgtaaaccccgacccagatggagtggcgccaggacgggagcgtgtacttggcccagtcctccaggtgagccgcctccatcacgccggtccccttggtgagatggaaaaggggaaggggaggctcaggtgacacatgaggtgctgggcgccacacagtaagcgggatgcatggagtgggccccaggcacagcgcctgcatacccccggcgcgcctcagcccctcctccctccccagatcggagcaggccgtctcacctgcaccaggcggccgtactcctccttgctgatgaagtaggggtgcgcccattcgtcgtacaggaactgcaggcgctccttgtcgctggcggtgaaggggttggccggcgtctcctcccgctggcaccaggtggcgatgacgagggtgcccccgggcttcagcacccgcaccatctcacgcacgtaggcccccttgtcgggcatgtgctccccggactcgcaagcccacaccacatcgaaggagttgtcggggtagtccatcttcagcgcatccatcacctgcggatgcggggcggggggagaacaggcatgagctagcatcacaagcatgtcaggagcttgagaaggtgaagatctccaggatatggggaactcggggacagcaaacaacggactggggccatgtcaacctgtgcgcggcttcccccatcctctcctcttccgccgcgccttgaattcgcagtttgcgagccccttctcggcggccagggctgtaccccgggcgacttggtttggcgacagcgtgatgcctttgatgcggagggggaggtgggggagcgtagcattgggggtgagggcaacggcgcaaggcgactcacagccacagggttgatggtgggaagagatgccaggctgagctgactgccaactcacaggctgaacctccgtgctcagggcacagcccaggtaaacctgaatccccaccaagtcgtgctcacagccccnnnnnnnnnntctgagcctccgtgctcggggcacagcccgggtaaaccggaatccccaccaagtcgtgctcacagccccaaagtcagcgcaccagcgaccttggcaccgggaaagcgggaagccagcatccgcgtggtgccgccaatgccgcagcccacatccaggatgctgccggggttggacacccccgcgaattggatcatgcggtccacaaagtcgtgcttggcctggatgaagtccttcttcttgtaccccgctgcttgctcctgtccgggtggaggggtgagggactggtttgcatgatgcatgtgattgtgattccaagtggcaacttccctagtgttgatctttccctaaccccatgcgtgccggatggatgctctgggcatggcaggaggacttnnnnnnnnnnagctgcttgctcctgtcggggtggaggggtgagggactggcgtgcatgatgcatgtgattgtgattccaagtggcaacttccccagtgttgatccttcccttaccccatgcgtgccgcatggatgctctgggcatggcaggaggacttccgcaggtagtcctacgcacccttcttccctcatcaccccaatggcctacctcctcggtgtagtaccccaggtggatgtgctcgccccagtagtgctccaggatgccctccctggtccatgcatcgtactccttgcccacgttctggccatcgtaggttcgagacggggtgtcgaacaccttttttatggcccgaaggcccagagcagctcccccaagggccacagcggccaccaggggagtggggacctcagtgccaagcaggacaggccccgccctggcagtgggcgtcaccgcggcaaagggcacccgatcactattcctcttgctcgatctctccatgtgtgacacgctatgctgctctgaccccgtgactcgacatgttaccgcgctggcccgccggggggcggtgctccattgggaggtcacggcacgggcactcggcgtcgtgtgtgccactggaagcgcctgcatgcttgttgcgccaaattcacgcgatcatgggccggcagtgatcgacgtttgatgtgccagatcgaagcagtactggggagtctagctgggtggctctttcatgaggaggggacgaccgaatcgcgcaggttatcgagtttacggggtggctgggaactccccgtcccctctacaacacccactggttcccacccccccgctgagacgtgtgccgcccgcatgcggcgcatcggtactcgtacatgtgttgcatacatttgcatggtacaggctgcgcatgcacggcggccccggggggaggggagggagatggacgtgtggcagacggggcacttgcccttgggtcactcctctaactcctcgggccccctccctcactgcttgggcggcgtgctgggcggctccggcttgtcgtagctgaaccccggcgggtgcagggagggcaggcgcgggctccaccgcgcgccggctgcctccccctcgcccgcacccgcgcccgcatccgccggcggagcctcatcggcccctgctccacgtgtcctcgacacgctgccgtagatggacagggcctgggccaccatggccgcggggtcgttggccgaggtggggaggagcatggtggtccccttcttggcgatggacccaaaggcctccaggtactgctccgccacgcgcaggctgaccgcgttccggccgccgggcgcctcgatggccgcggccaggcgctggatgccctccgccgtggcggccgcgcggcgcaggatggcctccgcctctccctccgcgcggttgatctggtcctcgcgggaggcctcggacgccaggatcacctccgacttctgggcctccgccacgttgatcttggactggcggttcccctccgactccaggatctgatgtttggggaggagggaagagaagggaggggggcggggttgagattctgagcgtgtgagcacgaggccggatcatgctggctcccggcgccgatcatggcctgcccagggcaggaaactcgtgtgccagggttgggtcatgctggtgtgcgcatgtccagcatcgaactgtcaagactcagaggtccaggctccccaatgatacgatttgagatcatgcccgcattgggggccccgtgatccagtcctcacccttcactgcagggcaatttacgccgtgcgccagtcggtgcaaatcccccccccgttccatccccccgtcctcccgcgcacctgcgcgcgcttgcgccgctcggcctcggcctgcaactccatggccccgcgcacggaggccgggggcatgatgtcgcggatctcgtagcgcaggacctgaagcccccactggctggcggcgggctggatggaggccacgatggcggagttgagcatgtcgcgctccgcaaacaccgagtccagcgtgatcttgcccagctcgctgcgcatcgtggtctgcgccagctgcgtcaccgcgtacagcgcgttctccacgccgtagctggcggcgtaggggtcggtgaccttggtgtacagcacgccgtcgatggtcagggagacgttgtccttggtgatggccatctggttgggcaccgggatggtggtctcctgtggttgttgtcacgagcaaagtgagagggtgaggggggaaagggggttggttgtggtatggagtacgaggatggggcaggggctgggagccggnnnnnnnnnnattgttgtcacgaacaaagtgagagggtgaggggggaagggggggtggttgtggtgtggaatacgaggatggggcaggggctgggagccgggagcgtttctgagaaggaggcctcagcacccgagagcagtgggcccgccgggcgccttgcgtggcggtctgcctgggcacgctgaaggagggacgccacgccaccagctcctctcacgcatgcacgcaccttgagggaatgggcgtaggcgatgcgatccacctgcagagggtggcacgagggaggggacgcattttacccagtgccagcttcccagtcactcctgactcactgcccggaacaggcacaataccagggggcgcctcgcgcattcccagatgccaataacccacccttaaaaccgcaccacggggatcaggatgtggaggcccgggctgagcgtgcggctgtacttgccaaacctctccaccacaaaggccatctgctggggcacgatccgcaggacagtgttggcgggggtggacttggtcgcaaagggtgtcatctcgaagggatcccgggccagcgtcagaatgctggagtggaatcccctggcacaggccccggcgggaccctccgccaggagcccggcnnnnnnnnnntgtcagggtgctggagtggaatcccctggcacaggacccggcgggaccctccgccaggagcccggcgccgcgggcctgcagcaggcgcgcgagcaccagtgatcgccgcatggtgtcgtgaaaataatttctgaacaatctaatgtgtacaggatcagagtatgtatgccgcagcacagcacgacacggtcaggagacccgatggatacatcaccatcatttgcgcccgaactgtatcccgcgtttttcaacatcagcaagagtgctcaccggaacccgcaggcccccaagatcgtgtaattttcacggatctgcgatttaaccagagggagagctccttcatcccccacttgactgcctcgcacaggtgttcgttggaggtctcccccgcaccgtccggcctgcccttcctgcccggaagatggctctccgggccgtatttgtcgtggcttgcctgtgcttgagtttaactgcgcgcggcgccaagcactccttcaccgcgggggacaaggtcacgctctgggccaacaaaggtggggccgggctccgtgaaggttggtgtcccgaggtggcccggctttgaaagatccccaccccttcccccgctcccgacgcccctcgcagtgggacccttctcctcgcccagtgaaacctaccagtactacgacctgcccttctgccagcctgagaacaaggacaacaagctgctcaccctgggggaggtgcgacagttgggagcccagcccgcagattcccagatggcggcattgctgctggaagcaccctggccctgcgcagtatgatcactctgccagccctcagagtccaccaggctgccgaacaagcactccacccccttcctcgcaggttgtggatgggaaccgcatggtcgccactccctacgacctctccttccgcgttgacaaggacaaagccacactgtgctctcgccacctaggcgcggaggacatcaaggccttccgcacggtgagtcgttgggtgttggcactcgcggactgtagcaccttggtgttccatgtcgaggccagcggaatggtcgccttggcctgggttaccgggatttgaatgcctctgccgctgatcgcctggctgtgccttcagtgaccaaccgctctccccctcccatccttcccccaaggccctggccaaagactactacttccagttcttctatgacgacnnnnnnnnnngccaaccgctctccccctcccatccttcccctaaggccctagccaaggactactacttccagttcttctatgacgacctgcccatctggggctatgtcggcaaggtggagaccatcaagggtgcgtgcttgctggagtcctctggggtatcgtttcaagggagtggctttggggggaggggatggagggactttgctagccttgtttgcaagctcaagacaggtggcctccattccgtaaggactgtgtcccagcggccgggagacaccaagaccggtgttttgtgctgcctggtttgttcgatcactctcatccatgccaaactcctcataggtgcttatgctcacaattccccattccatgcccccactgccttgtcgcgccagatgctgacagcaaggacaccaagaaactgttcctcttcacacacatccactttgacatcgcctacaatgaggaccgcatcatcgagattaacgtgagccagggttgcagggcgaaagagtgctggtactgtatgggggaaggggatggggaggtggtcttaagtccctttccaggaggcacccatgtcccttcacaattcgtaaacgttgctgtcactcacatcgcatcaacccctttccctcggccccccaggtctccaccgacccgacccaggtggcagatctgtccgagggcggcgccgaggagcaagacgtcaccttcacttactcggtgacctggaagtcgtccctgctttcttttgacaagcgcatggacaagtacaggaagtaccagttcctgaagcagcacctggaggtgtgtggctggtgggctttggtgatgggactgagatgcggatgtggcggcgtgggatggagagcaattgtattggccctggggcagcgtgcttgagcatgaggggtgaagggtccctggggagcatcttgcccctttttgtttccgtagaggggtacccctgtgcctgtctttgggttcttcagggctnnnnnnnnnncgtattgacactggggcagcgtgcttgagcatgaggggtggagggtccctggggagcatcttgccccttcttgttaccgtagaggggtactcctgtgcctgtctttgggttcttcagggctcgctgcgccgacgccgggctccacctttcaaatcgcgcctcctccctggctgtgccccggcctgcagatccactggttctccatcatcaactcctgcgtcaccgtgctgctcctcaccggcttcctggccaccatcctcatgcgcgtcctgaagaacgactttgtcaagtactcgcgcgacgacgaggtgggctgggcgggtgtagcgtggagtgcccatgtcggagcgacgggctgggggttccgggatgggcgccgtcactctggggtcctgcggcgnnnnnnnnnnagcgggtgtagcttggagtgcccatggcggagcaatgggctgggggttctggggtgggcgccgtcactctggggtcctgcggcgcgtctgtgcagggctcttgctgcctggccgacctcggcttgcccctggccacgagcctgagtcgatccctccccaacctcctgcccccctgaaccccgaacaatcgacatccggccaggaccccgacgacgccgaggagtctggctggaagtttgtgcacggcgacgtcttccgcttcccgcccgcccgctccctcttctgcgccctggtgggcaccggcacccagctcctcgtcctgtctttctgcgtgtttggcctggccctggtgggcgcattctacccctacaaccgcggcgccatgttcaccgccctcatcatcctctacgccctgacggcgggtgtgtgtgtgtgtgtgtttttgcaccagcatgctttgtggtggggggggtggccacccagccttgccagtgcnnnnnnnnnntgccctgacggcgggtgtgtgtgtgtgttttgcaccagcatgctttgtggttgggggggtggccacccagccttgccagtgccgacagcgcgtgggtgcggatgatgggaatggctgggagaagctcacgggctccacatgggggcaatgggcccctccgacaccatgaggatgtaccacccacccaccctcacccccatccctttgtctcaccacaggcatctcggggtacacctctgcgagctactaccgccagatggagggcaccaaatgggtgggcaacctgctcctcacctcctccatcttctgcggccccctgtttgccatcttctgcgtcaacaacaccgtcgccatcgcctacggggtgtgtgtgtgnnnnnnnnnnnnnnnnnnnnnnnnnnnnnnnnnnnnnnnnnnnnnnnnnnnnnnnnnnnnnncgcctggggtccggcgggatcctgccatcgggctggagtgggccggcgccatacctgctgccgccgcactcagcacgctgctcagccctctgagcctgcccaacgcctctttgctcgcaagcccactgcccaaggcccccccccctgctcccgctgcagtccacggccgccctgcccttcggcaccatcgtcatcatcctcctgctctgggcgctggtcaccgtccccctgaccatcgtgggcggcgtgctgggcaagaacacacgcaccgagttcgcggcgccctgccgcaccaacaagtaccccaggtgggcacgccggggccgcagggtgtccggggtttgcagaatgaggttggagttgtggagagccgacggcgtgcctgtctggcgcccagttactcggctgcacccgcgtcccaacagcccccttgccagtgttgcctgtcgtgccgaggcccatgtcctggtggcgctggcctgcagtcgccatgatcttgcgtgtcttgccataccnnnnnnnnnntcttgccagtgttgcagcttgtcgtgccgaggcccatgtcatggtggcgctggcccgcaatcgccatgatcttgcgtgtcttgccataccagccccctctcgctgttcggtagacctatcagaggatgtactgcctcgcactgattacctccctcccccccnnnnnnnnnnaagacttctcagaggatgtattgcctcgcactgattacctccctccccccccaaaacaaccatgcacagggagatccctgagctgccctggtaccgcagtgtgatgccccagatggtgatggccggcttcctgcccttctccgccatctacatcgagctgtactacatcttcgcctctgtctgggggcacaaggtttacaccatctactccatcctcttcatcgtcttctgcatcctctgcgtggtcaccgccttcatcaccgtggccctcacctatttccagctggcggcggaggaccatcgctggtggtggcgcagcttcctggcgggcggctccacgggcatcttcgtgtacgcctactgcttctactactacttggcgcgcagcgacatgaacgggctcatgcaggccaccttctactttggctacaacctcatggtctgcctcggcttcttcctcctcctgggctacatcggctggtgnnnnnnnnnnnnnnnnnnnnnnnnnnnnnnnnnnnnnnnnnnnnnnnnnnnnnnnnnnnnnnnnnctgtgaccacaccacctactcccgcatgaccaccccatgtgacccactgtacaacccaattcccattcctcttccatcacaggcggtcgtccctgctctttgtgcgccgcatctaccgtgccatcaagtgcgagtaggagcatcgtcgctcctgtgacagacaggacagggccctccgcccccctgtgtctcccaaaagaactgannnnnnnnnngggtgcatgcagggagggggttgggtggggggaagggcctgctgcagaacacctccttgcctgactcaaatggccgacgctgcaggacccaatgcggggtggagtggggtcgcgctgcgtgagctnnnnnnnnnnagtgcacacagggaggggttgggtgggaggaagggcctgctgcagaacacctccctgcctgactcaaacggccgacgctgcaggacccgatgtggggtggagtggggtcgcgctgcgtgagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcgccatcaagtgcgagtaggagcatcgccgctcctgtgacagacaggacagggccccccgcccccctgtgtctcccaaaagaactgagatggagagggctcgtcggcggcgcgcatgccacccaagagaaggggcaaaccctggcggcctgcaccccctcgttgcgtggccgctccggcccctccttcccctcgtgctccctttgtaatgttctgcctcctcaagaccagtccatgcggcgcaggggtgacgctgggtggcacgccaaatccccgtccctgccaatggaagtttgagagtttccgcttggaaacgtcaaactcgggccgagaaacctctctgcgcgtaacgcatctgctcgaggtccttcccccagatcccagagcagcaaagctgctctactattatattttcattcactccggagccatgccgggggaacgcttcaatgtcaggctggcgcccgaggagggtggatcgcccgagcccgtggtggtagaggtgggcctggagggcctgaacctcctggcccccggatctggacgggcgctccgcaagtatccattgcaccacatcagccgctggtccatgcggggcagcagcctgatcctgtttgccaagagcccggtaggttccggggaagcgaggggtctcggcgcagcctggcccagctggccgcgcggggcctgcatccctcactgtgtgacggagcacatgaccctgaggtttcctccatatacctgcaggtggacgtggaggacaggacggtggtcctgtcgggggacgagtacaccattcggtctgtgctggacacccttacctccagctgcatgcagtgagtcttcgggctggctcggccgcgtgccggggaccatggtgcctgattgttgtttggaagatcctgcaggccgtgggatgtgggctgtacaaggagcctgccccttgcaggtgcccgtggccatccttggtcgcagtgcgatcgatccccccctctccacccctcgacaatgccaaaggatggcnnnnnnnnnnagagcctggcccttgcaggtgcccgtggcaatccttggtcgcagtgcgatcggctcccccccctccacccctcgacaatgccaaaggatggcggagttgctgcagagcggccgcaccgtccccggcacctcggacggcgccctggccgcctcctccctctccagcctgctgaaaaaggcaaaaaaaccggcgctgctcaccgccgatcaggtggagttctggcacgacccggagaaggcgggctggatgcactcccagggcgaggtcatccgtacctggcggaagcgctggttcgtcctgaagcagggcttcctgttccgcttctccgggccggacgtcaccgccgccagccgcgcgcgcggcgtggtggacctctccaccatcaccgacgtctgcgacggcggcccagccacgggccgccccaactccatccgcctgtccacggccaccggcaagatctgctacctggccgacagcgagaccgcgcaggtggagtggctgtcggcgctggagggctctgttgcggccatcctccgggtgctgagcgggtgggaggaggaggcagaggaggcgccggccagggcaccgcgcggcggccgcgggcgcgccgtctcctcttccgacccgggcaaggcgctggaggagacgctgcagcgcagcttcgctgcggagtctgctgccgcgaaggggccggtgggaggcagtgggcggcgggccgccgctnnnnnnnnnnctccgacccgggaaaggcgctggaggagacgctacagcgcagcttcgctgcggagtctgccgccgcgaaggggccagtgggaggcagtgggcggcgggccgccgctccgggcatgatcagcgtggtcaactatgctgggctcagcggcggcagcagcaggtcggagcctgagccccagtacatcaacgtcgactatggggctggcattgcaggtgtgatgtgtggtgcctggagaggtggtattgttgtgagggaagaatgttggtggggatgtggagaggggattgagaggcaggattcttgctttgctgtttgggggagtcctgcaacgacaccctgtgcatgaggggtctggagcgcctcccacttcgggatcaggactgcaggctacactgtagcttgcatcccacagcttgcatctcctcaaaccttggctatgcgggtcagaatccatgatcacaattgctcaggaaccctcgacnnnnnnnnnntaccttggctacacgggtcagaaaacatgatcacaattgctcaggaaccctcgaccctcttgcatcccctgacccaggtgccagccagcttccttcgagcggggccagatatggcgcacagccgtacggaggcggggcctcggcaggatacggtggccaccaggcctacgctacgtcccagggctacggggagggccccgnnnnnnnnnnatcgagcggggccaggtatggcgcacagccgtacggagcggggccctcgggaggatacggtggccaccaggcctacactacgtcccagggctacggggagggccccgggcagcattgcgccccagcccgtcacggcgccccgccgcagtacgctcccgcgccgcacgggggcgtcctgcagcacgcggggccccagcagtacgaggcgcagcagcagcggtatgagccccagcagcaggttcggtacgacgtgcagcagaccacgctgtttgacgccgccactgcgccacaggtgaggagctttctagaatgaccttgcagggtatgtgctgcttcatgcttgctggctcacggcatgtgggtgctgttccacaggtctacttggtgctcgcacactgcattgcgcagcttttctcgtgatgaagcagcgatgatcaggaccctcccaaccccggttgcaggctgcccccaacccagcaccatcgggaccttggcaaactcaccacacggcggagggcagaccctacttttacaatgtggtcacaggcatcacgcagtgggagacaccggtggcgtaaaggacgggacggcagctccatgagaacatccgaggcatggcgttggtgaccccagctcctgccgcatgctgcgctccaaagcgtgcgcccccccgatacaaatcgaggatgttgccaggtgccatacgcagtgctctctgccctgcaaaacagttgctgtcatcgacttgtatagcatcccgtacgtaatcgacattgaacgaggttcgatcccgcggccggccgcccaggggctgtgggggatggtggttccgtagtcgagtcgcccagatcacacgcgatccgggacaccatgagcatcgtgcgggagctgcgccaggcagtggtagactgcaatgcgcgcggcctgatggagtcctcccgctgggcagcgcagcagctggctgggttgccagaggaggagacgggcactggggaggcgagcctggagcctgtgcaaccggtctggagcagggaggacgacagacacgccctggctcgctgtcactttgatgtcaaggtgctttgtttggtcttgtgcctgcagcgatgggcgctgcttgcggatattgaaggggagtccctttccagaatgagcctcccctcctgcgtgccacactcgattccaccacacctccccccactgcaggaatacaggagtgcggcacacgtcctctcagactgcacatcccccaaatccaccttcctgaggctctactccctttacctagccggcgaaaagagaaaagagtaggtttgtctgtctagaagggggagggggaaggggggaagggggggtgggccgagccggtctttggggccagtcgggcaagggtttgccacacacatctcttgggtggctggcatctcatgtggctgacagtagtacccgcagcgccgannnnnnnnnnatttgccacacaaatctcttgggtggctggcatctggtgtggctgacagtagtacccgcagcgccgacccgtgcccagccggcatccctgttccaggctccccacatctccccacctccagggaggagcgggcggaggctgccgggggccgacccccacgtgtcagcccccagaacgccgagctggagggcctggaggcggagctgtcccgcctgtgtgcgggccccgccgacggcttcctgctctacctcctgggcctggtccgcctggacggggccagcctggacggtgcgcgccaggccctggtggccgcggtccgggcctaccccgccaactggtgcgcgtggaaggcgctgcagcgcgcctgccccgacctgcccgccgcgctggcgctgggcttgccggagcatcccgctcgcgccttcttcctggcctccctggctgtggacctgcacgacagcggcgaggcgctgggctggctggaggagctggcgccgcgcttccccgcatccgatgtcctggtccagctggcggcggaggcgcactacaacctccagaactttgacgaggcccaggccctgtttgaggacctgctggcccgggatccgcatcgcctggaggtgggggggggagggg

SEQ ID NO: 42534 - DNA, 135 bp, Chlorella protothecoides
ctcccgcagccgccggcggtgctggagtggttgcgtgggcagtgcgagcgcgccgccgcctccgacgcccccctccccgacggcctgagccgaggggactgggccgcggcgcgagaggccgcgtacccaccctgc

SEQ ID NO: 42535 - DNA, 80 bp, Chlorella protothecoides
ccgcggggaggagtgcggtgggcggagtgcgcggcgcgggcgccggcgatgcctccgacgacgcctctcgagacgcctcc

SEQ ID NO: 42536 - DNA, 75 bp, Chlorella protothecoides
tgacaacataacatccagctggagccagattggtcagggtgcagctgcgtcaaaaagcaataaattcacggggtg

SEQ ID NO: 42537 - DNA, 61 bp, Chlorella protothecoides
tccttcaagctgggctccctggggttcctcacctgccacgaccaccgcgactaccgccgac

SEQ ID NO: 42538 - DNA, 61 bp, Chlorella protothecoides
cccgtcatcgtcttcagcttcagccgcaggggcggcgctcctggtgggaaatgcgcggcaa

SEQ ID NO: 42539 - DNA, 35218 bp, Chlorella protothecoides
  modified_base (95)..(104): a, c, t, g, unknown or other
  modified_base (3927)..(3936): a, c, t, g, unknown or other
  modified_base (4669)..(4678): a, c, t, g, unknown or other
  modified_base (6581)..(6590): a, c, t, g, unknown or other
  modified_base (6766)..(6775): a, c, t, g, unknown or other
  modified_base (6941)..(6950): a, c, t, g, unknown or other
  modified_base (7011)..(7020): a, c, t, g, unknown or other
  modified_base (7388)..(7397): a, c, t, g, unknown or other
  modified_base (8446)..(8455): a, c, t, g, unknown or other
  modified_base (9925)..(9992): a, c, t, g, unknown or other
  modified_base (10251)..(10260): a, c, t, g, unknown or other
  modified_base (11136)..(11145): a, c, t, g, unknown or other
  modified_base (11940)..(11949): a, c, t, g, unknown or other
  modified_base (12098)..(12179): a, c, t, g, unknown or other
  modified_base (14127)..(14136): a, c, t, g, unknown or other
  modified_base (14315)..(14324): a, c, t, g, unknown or other
  modified_base (19506)..(19557): a, c, t, g, unknown or other
  modified_base (21805)..(21814): a, c, t, g, unknown or other
  modified_base (24149)..(24158): a, c, t, g, unknown or other
  modified_base (25324)..(25333): a, c, t, g, unknown or other
  modified_base (26043)..(26052): a, c, t, g, unknown or other
  modified_base (26908)..(26917): a, c, t, g, unknown or other
  modified_base (27767)..(27776): a, c, t, g, unknown or other
  modified_base (30954)..(30963): a, c, t, g, unknown or other
  modified_base (31269)..(31278): a, c, t, g, unknown or other
  modified_base (32834)..(32904): a, c, t, g, unknown or other
  modified_base (33215)..(33224): a, c, t, g, unknown or other
gggctcgcaggtcccggcgcgcaccgcgtcggcgcccactgaggagaatggggcggaggttggagtgcctgctgacacagacacgccggtcgccnnnnnnnnnntcggtgctgcgcgcgtcgttggcgccggggtccagggcagccgcggcgcccagccgcccgcgtcgcgcgccgcgcagcaggcggaaggcggggccgtactccaagcccgcggccgccaggcgcgcatacgcgtccgccacgtccacgggctcgcaggtcccggcgcgcaccgcgtctgcgcccacggaggagaatggcgcggaggttggcgtgcctgctgacacagacacgccggtcgccagcttgatcagggacgcggtgaggtggggctgggacgcgccgcccgcgccccccttcctctcgcccgggtcgagcgagggcatggccagcgcccccgtccggccgtccagctcgacgagcagctgcacgctcctgcgcgcggagcccgccgccggcaggagcaggggcgaggcgatggcgccgtgcaccaccgccaggccctgaccggtccggctcctgcccagcgtggcccctgcggcaacggccgcctccaggtaggccgcgccggggagcaccgccgcgccgcccacgcgatggtcccacaggaaggcgaggcgcggcgcagccaggggcacgctgaactgcagccgctgcttggcggccgtggccaggtgcaggagcgggtggcagggcaccagcgcttcggtccagcaggcagtgctcctgctccagggctgggcggccagtggcgaggcgcctcgcccctccgcggccggcaacagaatggcgtgcgcgttcacgccgctcatgccaaaggagctggtgcctgccgcgggtattgcagagggcctggactgcatggggatgctgtgtggcacaggtaggccggccagggagttgcccacatacggattcaggctcctgttttttattgggggggggggtggaggtatgtaacgaggggagtttggcaaggtgttgaaatagggaggcagagtctgctgccatccaatgatcacacacagctgccatgacagctgttgggccgccagacatgcactcgtggcctccacgaaaacccaaggaacccaccctgtcagctcacctgtagcgcaggccgtgggccaggctgctatccatggccacctgggccaggagcagccccgccaggccggcggcgccctccaggtgccccgccagcactttcaccgcgcccagtgtcaaggagtgaccgtccagctgggccggggtcgcgccgcggcgggtgaccgccttgcgcagcccgccggactcgatggggtcgcccagcggtgtgcccgtgccgtgggtggacacgtagtccagcacatccagcctcgccgcggccatggcggctgacaccagcgcctgctggctggggccgtgcggcgcggtgagcccgctggaccgcccgtcctggttgacggcgctgccgcccagcactgcagacagggtcgacgcgaacgtcggagcgtcgccgtcttcccctccagccccaccagccagctccaggaccaccgacacgtagccctcgccgcggccgtagccgtcggcctccgcgccaaaggccttgcagcggccgtcgggggacagcgcgtgcacctgggtcatggccgccgaggcggcgcccggcaggagcatggagttgaccccggcggccgtggccagcgtgcagtctcgcgcggtcaggccggcggccgccagatgcagggccacgagggaggaggagcaggcggtgttggtgggcacggaggggcccaccaggcccagcgcgtaggacacgcggccggtcatgaaggccaggccgttgccggtgaccatgtaggcccccgccgggttgcccgcggcggtggccaggtcgccgtactccagccagatgcagccgacgtagacaccggtgggggagccgaccagggtggcagtcgcatgccccgcgctcgcaaatgcgtccacggtggtctccagcaggatgcgctgctgggggtccatgagcgccgcctcggtcaggctgaggccaaaggcctcggggtcgaaggcaaaggtgtcatgcacgaaggaggcgaagcgcgtggacacacggcccacgccgccgccggcggagaacagggcgtccgcgtcccagcgcggcgccggatcggtggcgatgagctcccggtcggccaccagggccgcgcggaaggcggccaggtcgtcgatgccgccgcccaggcgcagcgccacgcccgtcagccccaccaccgacccgtgctggctgggcacaggggtggcgggcgcggcgcggagggcctcctggccggccacctcctcctcgccgccgcccatggactccaccacaaactcggcgatggcggagacggaggggtagtcgaaggtgagggtggcgggcaggtccaggccgaagcgcttggacaggccgttccgcagctcaaccgcgcccagcgagtccagccccgcctccatgagcgaggcggtgacgcccacgggcgcgcccagcacccctgccacggtgtccaacactgcctcggccaccgcctcgcgcgccagcccggcggccgggcgcgcggcggcgctcgaagttttcgtcgcagttgcggcagtggatgcttccgccgcggccgcgcccgcccagtccgagaacaggggcaggtggcgcgcggcctcggcgccgcccaggcgcgcgacgaagcgcggccagttgaaggggttggcagagcggacggcgatggatggcgcggcgccggccagcaggccttccagggcggccagcccggggccgggctccaccatgcccatgcccatgcgctggacgcgggcctcggtctcgcgtgaggccatgccgccgccggcccaggcgccccactgcacgctgacgctcggcaggccggtggccgcgcgggcggtggcggccgcgtccagcgccgcgttggcggccgcatagttggtctgccccggggcgccgagcaaagacgccaccgaggagaagaggacgtgcagcggtgtgggcgcccgcgcccgctccgaaccccgcacgctggcggtcttgggcgcaaacacggcgcgcaggccgcgcacgctttggttgcccagcgtggcgtccgccagcacgcccgcggcgtgcaagaccgcgccgtaggcgcccagcaggcccagcgccgtggcgtcctcgcccgcggcggtgtcggccttgaagacggtgaccgcgcaccgcgcggcgatcaggcccggctccaagtcgccgcgccccgatcggctgaccaggacggcggcgcgcacgccgcggcgctgcgtccagccggccaccaggcggcccagcgtgcccaggccgccggtgaccagcaccggcgcgtcggcccgcggcgcctcgacgccctggggcagccgcaccacgatcttgcccacgtgccgagcctgcgacatctggcgcagcgcggccgtcaccgcgcccatgccgtgggagatgtggggcaggggggccagcgtgccggcggccgcctggctcgccacacggctcagtgcagcgtgcagcgcatcctccgacatgaagtccacggccacgaggccgtaggagacgtcggtgcgctctgtaaaaagagccaaggcagggagtgttgagaggggggaaggggtttgggagctttgtggaaggggagtgggagtcgatcagaaactgacagaaggctcgtcaggaatgggctgctgatgctacaataatgaatgctgtgtccagccaagtgaaaaaattgactgggaaaccaggtccttaactcagtccgcacatggggagcattctcaacaccccatgctaccacagcacccctacacacaagacaccaagcccaccttgtgccacccgccccgcgctccnnnnnnnnnntgttgggaatgggctgctgatgctgagagaatgaatgctgtcccgccacgtgaagaaactgactgggaaaccagttccttgactcagtccgcacatagggagcattctcagcaccccatgctaccaccgcacccctacacacaaaacaccaagcccacgcccaccttgtgccacccgccccgcgctccagatgtcgcgcttgctgatctccacgaagcgcccacccaggcgcagcacggccagggatgccgccaccatgccgggcgaggtcagggtgttgagcaccaccgacaggcccatggggtccagctccggcgcctcctgggcaaagagagcatctcgcgaacccagcacgtcccgcacgcccaggctgcgcagcagcgcccgcttgaccgggccacccgccgtggccaccgggaaggcgcccgcccgcgcgatgacctggagcgccgccaggcccacgccgccggcagcggcgtgcaccagcaccctctcgccgggggcgatgcgcgccgcctgatccagcgccgcgtccgtggtgacgaagacggtgggcatggtggccgcggcctcgaaggaaagcagcgccgcggggagcggcaccactgtcttggaggaggccaccacgctgctgcccaggcagccgctggccaggccaaacacgggcgtgcccacggccagggccgggtagccgggcgcggcggggccgcaggccgccaccactcccgcgcannnnnnnnnnagccagggccgggtagccgggcggggtggggccgcaggccgccaccactcccgcgcagtccccgccgggggggccggggtctcccgggtacatgcccaggacgttcagcacgtccctgtcgagtggtaggtggcagcaagaggggtttgtatgtgagtgtgctcggggagtgggctaccagacgggggggtgtgggaggcaagaggggtgtatttcaagctcccttagtccttcccagacatcccattccctgccagcctcagtcggtcataccctacctgaagttgaggcccacggccttgacctccagggccacctgccccggcttgagcgcatccaggccagagacagccacgggcttgagggacccgaagctgccgcgaggcaaggggagcagctggaaggcgggcagcgtgctgtgcgccgtcgtgctggcgcccaggcgaggctcgtgaaggaccgaggcccgcaccgcctggccgtagccgtcaaagggtgcctgggcgcccgtcgtgccgccgatctgcagggcggatcgacaccccgcgcacccggcggcaaagccgtcggcgtccgcgccgctcactccgatggcggggagctcctgcgcggccgcacgcaccaggccccagacggcggccccgggcagggtgtcgacacccggccgagggccgctgctctgcgcggcggggtgcgtgcccgcggtggcgaggtgcagtgcgtcggcgcctccgcccgtcgctgcagcttgcacggctgccagcgccgctgagatggcgagccccgcgcctctgtcgctggcacgcacggtcaaggctccgttcctcgcaggtgtctcttccgaagaggctgcgacgctgcgcgccgccagccaggagatgtcgtagagcatgtcctgcacctccaccgacggcggggcgctgccagccccgccggcgtcgccgatggcgcgggacacgaggccgtcgagggtgcagacgagcgcgccctggctgccgaccagcagcacgtcgcgggacatggccgccgccgagtcggcgtgctgcgggttgcgcgcggcccgcgctgcgacgggcttgaccccgggcgcggggaccaccagcgcccccagcccggcgggcaggaagacggcgccctgcacggcggcctggttggccagcatgccccccagctgcagcccgttgtccagcgccgcgggtccgagcaggaactccggggccccggaacagtgcccctccggcgccagcgcggcggcgacgccgcgctcgccgcgcttgacgccgcgcagcaggcggaaggcgcggccgtactgcaggccggcggccgccaggcgctcgtaggtgtacacggtgtccacgggctcgggcgtgccggccagcaggccctctgtggcggaggcaccgccgtccatggcaccgtttgcgccgacactcgccacgcgcgacagggacaggcgcacgtgcaccgtgccgccgtcggtgctggacagcgtggcgtccccggatgccaggtccacggcgccctccagcaccagggtcgcgccgggcgcgcccaggatgagcggcgccgagatggcggcggccgtcagcgccaggcccgccggcgccgccgacggcgcagcgagggtgcggcccatggccgccgccatctccaggtagcccgcgccggggaacaccgcgcgcccgttcacgcgatggtcccagaagaaagcgtgggcggggtgtgctgtgtccatggcaaaggccacgcgcatcgccgtaggggccaccacggtcgagccgatctgcgggtgggccggcggcagcacactgaggtgctgccgggcccaggcgatgggcgcgatcgtcctttcccccgtgccctccaggctgcccagcagcgcgtgcgcgttggtgccctggannnnnnnnnntccgcccaggctgccctcgatgtaagggttgatctgcatgagttgggttgagcattgcacgtcagacaagggtgcgcaggtgagcgagcgcgagtgataggtcaactcggcgtagtcacatgtccctcgactgtgagagacatcatgcgcaactgtgtggcaccagacgggcttgnnnnnnnnnncgtgacggtgctggcacgggggtcgcccgcgccggcgcggggcatgctgaacctcgccgccccgcccaggctgccctcgatgtaagggtttatctacgtgagttgaattgagcattgcgcgtcagacaagggtgtgcaggtgagcgagcgcgagtgataggtcaannnnnnnnnnctcgccctgacccccccgtgatcatgccacgctccaacccccaagcactcccgcttcctcnnnnnnnnnngttgcccttacccccggtgatcatgccatgctccaacccccaagcactcccgcttcctcgtttccccttccctacccacgagcacctcacctttgtcaggtgcagcacaggctgcacgacacgctgactcagcgcccgctgggcgtgcgccaggcccaccacaccggccgccggctcggtgtggcccatggagctcttccccgcacacagggtgagggtggcgccgccaaagacggcggccagggcccccgtctcgatggggtcgcccaggggcgtgccggtgccgtgcatctgcacgccgcccagggccggaggggtcagggcggcggcgtgcagtgcggcgcgcagcgcgccctgctgcgcggggnnnnnnnnnnagccgggggggccagggcggcggcgtgcagagcggcgcgcagcgcgccctgctgcgcggggccattgggggcggtgagcgtggaggacttgccgtcctggttcaccgccgagccgaggagcagggcgcggggtgccggggcttctgcgctcgcgtcgccgtcgcacacgaagcgcgcatgcagggccaccgccgcctcgccacggacgtagccgtcggcggcggcgtccagcgtcttgcaccgcccgtcggcggtcagcatgccggcgcggttgaacattgcgctggtgcccggggtgaggatgagcttcacgcccgccaccagcgcctcctcgcagttgcccgcggccatgcccaggcgcgcggcgtgcgcgcccaccagggaggaggagcaggcggtgtcgatggccagcgccgggcccgtgaagccccagaggtagctgacgcgccccgccgccacgctggtagccgaccccgtggccgagtaggccgagatgtcggagtgggcgcgcgccaggtcggcgtagtcgggcgtggagatgccgacgaagacgcccacggcgcgggagccggcgtcagcggagcgcagcgcctcgcccgtaagctccagcagtgcacgctgctggggatccatgagcaccgcctcggtggcggtggtggcgaaggccgccgcgtcccaggcgtagggctcctccacccagccgccgaagcgggcgggcaggtccagcgtcagctgcacctccccgtcccagcgcgatagcggcacgtgggagatcacgtccgccagtgtgccggtggacagcacgtcccgcggcgagcgcgaggcgaccgacgtgatgacgatggccgaggacgtgatgggggcaagatctgccgggccggccgacggcggagcagcagcagcaaagcgcgccgcggatgctgcaattcctgcgggccccacaccatggacagcagctgcagcagcagcctgggcgctcagagtctcctccacgtacgccgagatggcgtctacggttgggtagtcgaagaccagggtgcccggcagcnnnnnnnnnntgcccagactggtctggaggccgttgcgcagctccaccgcgcccagcgagtccaggcccgccgccatgagcgggtcgccgcgagcgacctccccgccaatgatggagcgggcagcagactccaccgcggcggcgatgaaggcagcgcgctccgcgcgctccatcccagcagccgcagaggccggcgctgctcctgtctgagcaacaccgcccgccacccccgcttctgccactgcggccggcttcaggtgcgcaaactcggcgaagagctccggcacagggccggcggccaacaatgtgggccagtggatgggcgtcatggccaggcaggccggtgggctgggcgcgacgcccagcacccccgccagcgcggccaggcccgacacgggggtcaacgcccccatgcccgaggcgcgcatcttctccgcgctggcggcggccatgcccgcgccggcccacgcgccgaagcgcacggagtgcacgccgcggccggccacctgcgctgcggccgcggcagcgtccagcgccgcgttggcggcggcgtagttgctctgccccggggaccccagcgcagcggccagggaggagaagagcgtcagcgcggcgacagggagcgcggagatcccagcgccccgtgccagcgcgtccagcgcgccgagcttgggcgcgaacacgccgcgcacgctctgtgcgctctggttggcgaaggccgcgtcggcgagcacgccgccggcgtgcaggacgccggccagtggcgccagggtcaggccgaggtcggcgagatcgcccgccgcgcccgcgtcgcaggccgccagcgacaccgcgcagcgctgcgccaggagggcacccaagttctgaccccggccgccgcggctggccagggtcaggcccgtcacgccctggcccaggagccagcgggagagcacggcgcccagcgcgcccgtgccgccagtgacgaggtagcgccccagcgcgtcggcgcgcggcgcgcccagcgcgccgcgcgcgcgcaccaccaccttgcccacatggcgggcggtggacatctggcgcagcgcgcccgccgcggcgcccagatcgtgggtgatggtgggcagcggcgccaggtggcccagcgccaggccggcgctgatgcgcaggagcgctgcatgcatggcgggctgggacatgaagtccacggccagcaggctgtaccgcacgtcgggacgctctgtggggagggaaggagggaaggggggatgggttcatgaggatgacagggttgggtggaatacgccacaagggtacggcactgggtcgggtgaagggccaaggggcgacatgcacagggatcaacgcatgcctgcgcaccagccacgccaccccacacccaccctgcgcaaagcgccccgcgctccagatgtcgcgcttgctgatctcgatgaagctgccgcccccgctcaggccggccagggaggccgccaccatgccnnnnnnnnnnnnnnnnnnnnnnnnnnnnnnnnnnnnnnnnnnnnnnnnnnnnnnnnnnnnnnnnnnnngtgccgcttagcatcgcgacctcgtcggcaaagaccaggtcgcgcgagccgatgacgtgcgccacgcccaggctgcgcagcagcgcgcgcttggcggggccgcccgccgtggtcacgggcgtcgcgcccgcgcggcggatgacctgcagcgcggccaggcccacgccgcctgcggcggcgtgcaccagcacccgcgtgccgcgcccgatgccggccagcctgtccagcgccgcgtccacggtgatgaacacggtgggcnnnnnnnnnncacctgcgcgcccagcgtgcccatgccgccggtgatgccgagcgcgggcgcggccccggcggggcgcgtttccagtgccggcgcgcgcaccacgatcttgcccacgtgccgcgcctgcgacatctggcgcagcgcggcctgcaccgcgcccaggccgtggctcacggtcggcaggggtgccagcatgccagcggccacgcccgcggatacgcgggtcaagcccgcgtgcagcgcggcctccgacatgaagtccacggccaccaggctgtaggaggcgtcggggcgctcctgcacgacgcgccccgcgctccagatgtcgcgcttgctgatctccacgaagcgcccgccagtattcaaggtcgccagggacccggccaccatgccggaggaggtgaggctgttgagcaccacgttcaccccccccagctcggcggcctccgagacaaagtcggtgtcccgcgacccaagcacgtcccgcacgcccaggctgcgcaggagggcgcgcttggccggcccacccgcggtggccagcggcgtcgcgcccgccgcgcggatgacctgcatcgcagccaggcccacgccgccggcggcggcgtgcaccagcacgacgtctgcggggcagatgcccgccagctgcaccagcgcggtgtccacggtgacgaagacggtgggcatggaggccgcggcctcgaagcccaggccggccggcatctgcaccagggtgtgcggcgagacgcacaccgccgtgcccaggctgccggcggccaggccaaagaccctcgtgccgggggccaggaccgcggaaccgggcgaggtcacgacgccggcaaagtcgccgcccggcgcgccggggtcgccggggtacatgcccagcannnnnnnnnncccggggtcgcctgggtacatgcccagcacattgagcacgtccctgttgtcatgagtacagagaatggaagggggggcggtagtggaggaccaggggcctagctgtaaggttacgacatgcagcactttcagtcgggaacctggaaaaaggcactggtgagcgtcaacaatccgttgcaagctgtgacacccaaaccactcgttcctccgatgtcaccatcccctccgacctgtccccctccggaaacacaacaacaaccccttgcctgaagttgaggcccaccgccttgactgccacgacgatgtcctgccccgccagcttccgctccgggtcaaagggcacgggggcaagggaacccaggctgccgcgcggcatgggcatgaggtggtgcggcggcagctcctccctcacgcgctcagcgtgcaggagcagcggcgccatggcgctgccgccccgcaccgcagaccccagcgccgacgtcagcgggtgcagcgccggcagcgccgatgcgtctaccaagcgcaggccggcggctgcgggcgcggatcgatccgcagggtcagtcagtctcgcggtccagcccacgcccggcacctcctggcccagcgtgcggatgaggccggagaggcccagcacgccagtcgatggcggggcggtggacgctgcgctgggcgcgacggcgccaaacccggcgccggcgggggcctcaaacacaatagtccggttgcgggcgtcgggcgcggcgacggcgcgctgcagcgcagccagcgcggcgctgacgccctccacggccnnnnnnnnnncggggcctcgaacacaacagtccggttgcgggcgtcgggcgcagcgacggcgcgctgcagcgcggccagcgcggcgctgacgccctccacggccgaggcgtgcgcatcgcgccagagcaggctgccggcaggctcggcatgtccgtcgnnnnnnnnnnnnnnnnnnnnnnnnnnnnnnnnnnnnnnnnnnnnnnnnnnnnnnnnnnnnnnnnnnnnnnnnnnnnnnnnnnagtacaggcaggcgacacgctccacggtcctctgcgcggcgccgccgccggccatgcgcttggccagcagggccgacacgctggccagggggccgccggcgcccttggacccaggcagcagcgcgtagtcgcttcgcgcctcgccgacaggggcgggcaggggcaggcacgccgcccagctggcctcgtggctgcgcggcaggcccgctgcccctgggtcgatggccagcgcgcccaggcccgccggcacgtacaggtcggcgggggcggcaccgaacacctgccccagctgcagcgcacagtccaggggggcggggtcaagccagaggcccgaccggcccgtgtcggagcgcaggcccgccgtcgccgcgggcgcggcagaggcgggcaggtgctctgcgagcgagagcatcgctctgacagggagcagcgcagaggccctcgcagggcctgtcgcgaggcgctggccgtcgttgctcgccgtccctgccgcctcggcgctggccagcacgtggctggtcgtgccggcgatcgacacgctggcgatgaccagcgcgccgtcggcgccgtccacggtcacccgcaggaccacgccgtcgccgccacgctgaccgaggccgggcaggacacagggcgcggggatggccgctccggtcaccagggcaccggctggcgcgcgcgagacggcgcgcacggcggcgcccgccgcctcaaagtatcctgccccggggaagagggcccggtccaggacctggtggtcccagaggaaagcgtggcgcggcgcggtcagatccgtctccaggatgacgcggccgcggacggcgctcgtcaccacctgcaggagcgcgtgcgcctgtggcagcacgctctgcctgccgccccgccagggcagcggcgccttggggtcagcgcgcgtcgcgccatcttcggcgccggaaacaacgggggccagcagcgcgtgcgcgttggtgccctggaaggcgaacgccgacacgcccgccaccgaacggcccccagtccccgccagcggcaggttctggcgcggcagcgccacgcagcccggccgcgtctcgtccagcgctgcggagacgtaggggttgatggcgcgcaggtgcatgatggcgggcgcgagggcgcgccccgccgccgccgcgccgaacagcgcgccgaccaggcccgcggctggctcagcgtggcccagccaggacttggaggcgccaaaggcgacgggggatcgccgcgcggcgtcgatgagcactgccgtggccgcgcccatctcgatggggtcgcccagcggggtgcccgtgccgtgcatggacagggcgttgacctctgcgggatcgaccccggcaaaggccagggcgctgcgcatgacctcctgctgcgccgggccgttgggcgccgtcaggctggaggagcgtccgtcctggttcaccgccgagcccagcatggccaggggccggtcggcgcccgacacgctggcgtagttggcgcccagcttcgcggcggccgccaggaccagcgtcagcacggcctcgccgcggacgtagccgtctgcggcggcgtccagggccatgcagcgccccgacacgcccagcatggaggcgctccagacgtaggcggtgctggtgcccgtggcctgaacgtgggcgccggccgcgtaggccagcgccgactcgccggcagccaggccgcgcgcggcgaggtgagcggccaccagggaggccgagcaggcggtgtcgatggacagcgccgggccgcggaagccaaaggtgaaggacaggcgcccgcaggccacggacagggcgttggctgtcgcgtggaaggcgcccttctccactgcggccgacaccaggctcccgtaatcggagctcgcgatgccttagttgtttttggggggggaggggggaggttggggagggaggcgttgacgacatgttgaggtggnnnnnnnnnncgctcccgtaatcggagctcgcgatgccttaattgttttttgggggggaggggggaggttggcgagggaggcgttgacgacatgttgaggtgggaagggtgagagaggtaaagtgcatgagggtgtgacagcatgcatcaccatcaccgacacagaacggcatccacaacactgtatannnnnnnnnngagtgcatgagggtgtgacagcatgcatccccgacagagacacagaacggcatccacaacactgtataccatgcttcacaacccccatcaccacttgcacctcctccacctccccgcgcctccccctcgtatgaatccaactcaccaacataggtgccctgcaggctggcggggatgccggtggcccccgcgacggcgacagaggcctcgcccacgacctccagcagcaggcgctgctgcgggtctagcaggggcgcctcggcgctgggcacgccgaaggcggcggcgtcaaaggtcatggggtggcgcagggccgccaggaacctggccgccaccgggttctccccgtccacatcccacctctcgtagggtaccacccccacgacgtccagcgggcatgcggcggagatggcgagcacgtcgcgcggactgcgctggacgccacccagcaccaggacgggcgaggcgggcggagcgcggattgattgcgccagcggggcatccacagcagggccagtccaagctgccgacacagccatcggcgcggcagtcacttccccctccctgtccctggccattttctggcccaggaactcggccagggccgacacggtggggtagtcgaagaccagggtggccggcaggcgcatgcccgcgctggcctcgagcgcagaacgcagctccaccgcgcccagcgagtccaggcccgccgccatgagcgggtcggcggggtccacgctagcgcccagtacgcccgccaccgcctcctggaccagggcctgcgcaccggtgaggtccacgacggccgccgggccccgtgcgggcgtcggcgcggcggccaggcccgcgaagaatgcgtcgcgcgccgggaagcgcgcccactggacgggcaccgcggcgtggacagggggcggcgcggcggcgacggcgacggaggaggcgcgcaggagcgcgcccagcaccgccaggccgcgctccgccggcagcagggccaggccgctcctcgccagccggccctctgtggccctgtccccggccgccatgcccgcgcccgcccatgcgccccactggatgctggaggcggggcagccctgtgcgagggggtgggggaggggaggagagtttggggaactatgctgcggatactaagtgttttgaattgatgccctgaggcacagaacggcaaaggcggttgctggagggtggtctgcattccggtatgcactggcccgcagaacaaattacgcatcagcatgtcccccatgacccacgtcccctcgcacctggtcggccaggtcggcggccgcagcgtccagcacggcgttggccgccgcgtagttggcctggccgggcgagcccagcagggaggccaccgaggagaaggccacgcaggcctggacacgggcggcgcccaggagcgaggcttgcagagctgcctgggcggcgcccttgggcgcggccactcgccgtagggagcctgcgttcagcccagccagcaggccgtcggccagcacgccacccgcgtgcatgagcgacacggcgcccgccgcgccagccagcgccgcgacgtcggcggcggccgacgcgtcgcaggtgcagctggagagcgtggcgggtggggcgccggtcgtcgagttcgcgctggccgctgccctgctggcacgcagcagctcgactggcacggcgccggagcggctgagcaggaccaccgaggtcaccgccggctggtggagcagccaggcggcgaccgtaccacccagcacgccgctgccgccggtcacgtagaccgtgccgctcaggctcatgactcgtgcatcgtcaggcgcgtcgccctccggtgcgcgcaggaggcgcggcgcccaggcgacgcgtgccgagacagcaccgccgtgcacgccgaccagtgaggcagagtccgcggctgcttgtgctgccaggctccagccggcagctgcatggctcgcggacggctcggtccacagcatggacagcacaggcccagcagcatcctcggcagccagggcctttagcatgccctgcagggccacgccgggcagccgcgaggcgcgtgatcgggccggcgcggcgacagccacgtcagccgctcccgtgcccgcgatgcccggcatggaagctgaccccgccaggccctgcagcgcctgcagcgccgcagcggctgaggttggtgcccggaagttgggcgcgttgcgagaagctgtcgccgcgcgccgcacctcggctgcctgccaggacgtggtatacaccagcttcttgctctcctcatccgctgtgtctgcactcgaggtagcgtgagcaggcccagcgctggaagccgaaaccgcgagccgctccagcggcagcgcgtccagctcccaggctgccaggaggccggtgccgagggcgatggtgagttcgcctggtgctgctgcggcgtgggctgcagcatctccagcacccacactcgtggttgaccaaagagcgccggcagaagtggggaggtcccctgcctcgcgcagcgcagccgcagcatccaccgccaggccctgcagcgcaagaccgcatggcagggccgagtctgcagtggcgtccagcacggccacggccttgccggcgctcgactggctgtccagcgcgggccaccacagcgttttcgtcctggggttccctgcgctgcctcgggacacggacttgggctcggcgctcgccgccacaaggccggcgctggcgacgtgcgccgcgccggcctccttcgtgaccaggtgcaccgaggcctggcccccatccagggtcacatgcaggctggctccagcggaaagagcggccggctgcgtggtgaggcggcgcaggccggcgcggccggcgccgagcagcgctgccgcgtcggcgatggcctgcgaggccaggcccagcgcgagcaggggcacggcgcggaggcacagcgtgcgcagcgcggcgagccgcggctgcgccaggtcggccacgaatgcggcgcgcttggctttcacgccgaccaggccgaagaggtcgctgggccgcggcgcgacccaggccctctgccgctgccagggcagcgcaagggtgtcgacgctgtcctctgcggccgctgcgccatctaggctgcccagcagcgtgtgggcgttggtgccctggaaggcaaaggagctcacgccggcggtgcaggcctggcctggggccgcgctcgcaccaggaccaaggatgcggttggccgcgaagcggccgaccggcatggaaggcgcgacgtagtcgttgacactggtcaggtggagcagcggcagcgcggcctgctgcgtcagagacaggctggcgtgcgccagccccatcacgcccgccgccggctcggtgtgcccgatcagcgacttgcccgcggtcagcaccagggggtggcgggtggagcctgggtcggctcggtccagcagtgcagccagggcgcccacctcgatggggtcgcccagccccgtgccggtgccgtgcatctgcaggtactgcaggctgcccggcgtcaggcctgtgtgaggaatgcaggatgttggatcaggggttgaggggtggggtaagtgagaggatagggtgggctgttgcatactcatctaccatcaggctgccaagacttgaagatggtacgtctgatggtgcctctgtagaaccctcatagaatagttgtgaccgactcctaccacacagaaacccaccagcagaggcgagggcgctgcggacgacgccctgctgcgccgggccgttgggcgcggtcaggctggaggagcggccgtcctggttcaccgccgagccgagcacggcgatggccgcgtcgccccgcggcgcctggccgccttgcaacagcaggccgcccagcccctccgagcgcacgtacccgtcggccgccgcgtccagggtcttgcagcgtccgtcggccgccagcatgcccgacttggcgaaggcagcaggggtctccggggccagcatgacattgaccccggcgttgatcgctgcagcacactgggccagggtcagcgcggccagtgcggcgtgcagggagacgagggaggaggagcaggcggtgtccaccgtcatcgccggaccacgcaggccaaaggtgtaggccaggcggccggaggccacagacagcgtgctgccggtggcggtgtaggccgtgacccccgccgtgtgacgcgccaccaggcgcgcatagtcggtggaggaaaggccgacgaaggcgccgacgcgcgcacggtccagggcaccgccggcgcgggccagcagttggcccgcgcactccaggagcaggcgctgctgggggtccatcagcaccgcctcgctgccggccaccgagaaggcggccgggtcaaactcgtcgatgcggtccagggtggccccgaagcgcacggggatgccgccaaacaggtctgtgggtgattgggagtggcgggaggtgatgtggaggaggggttgaactgtgtaacgggaggggagcagggtggtggccaaacaacttcgatggcggccatggtacattggcatacggaacaaagcacaattcaggacaagcaacagtataagaccctctccccttggcaggagctcgacttgcacgtgccccagtctccaattcccaagaactcacaaaggcccagcccaccttccccggtgtcaatgtcccagcgggacaggggcagcagggccacggcgtccacgggctgcagccccgcaaaggcggagcgcggcggctgggtgaccgactcgcccacccagatgctgggacgctgggcgaccacggtgctgcccgccggcacagcgaccaggggccctgccaggctagacacagtagcctcgccggtgccaaacatgtcgtcagcatcggtgggctcgccgaggacggcccctccagcatcagctgactcgccggccgtcgccccgcccacgcgctcggccaggaatgccgaaatgcctgcgatggtggggtagtcgaagaccagggtggtgggcaggtcggcgcccaccttggcctccaggctgttgcggaactcaacgctggacagggagtccaggcccgccgccatgaggggcgcctcggggtcgaccccgggccccagcacggccgtcaccgcttcggtgaccagcgccgtcagtgctgcggcagacactgccgccgcaccggcggccgccnnnnnnnnnnnnnnnnnnnnnnnnnnnnnnnnnnnnnnnnnnnnnnnnnnnnggaggttgttgcaggtcgggtcgcggccacgctcgtgtcgtcacggacggcctcgaccgcgacctcgcccgcaaactcgtcaaacatggcgaggccagggcgggcggctatggcctgcaggtaccgcggccacgagatgggcacggccgcgagaaccgggccggccgccgcggcggcgagcacaccgcgcagcgcggccagcccggccaagctcggcagcatgccgacacccgtgcgctccgcgcgcgcgcgtgtctgcgcgtctgcgccggccatgcccgcgcccgcccatgctccccactgcacgctcagcatggccgcgccgcggtgctgcgccagctcagcggccacgtccagcgccgcgttggcgccagcgtagttgctctgccccggggagcccaggagcgcggcgatggaggagaagaggacaccaaaggcggcgggcgcctctgccagccctgcgcgcgccagcgccgccagcgcgccggacttgggtgcgagcacggcgcgcacgccgcgcgcgccctggttggcgatcgtggcgtcggacagcacgcccgcggcgtggagcaggccgaccagaggcacgccagtggcgcgctgggtcagcgccgtggcgtcggcggccacgccgccgtcgcccgaccccaccgccagctcgccggcgtggccacggcggaggaggtccagcaggggtcccgaagctgcgccggcacgcccgctgcggcccacaacgtgcacgccaagccggcagtcgcgtgccagccaggcggcggtcagcgagcccagcgagcccagcccgccagtcaccagcacacggccgacccgggcgctgggaggcaggtcggtggcggggttggtcaccaccaccttgcccacgtggcgcgccgccgacatggcgcgcagcgcggccgtggcatcgctcaggccgtgcgtcacgcagggcagcgggaggagcgtacccgtcgccagccggccagccaggcgatccagtgccgcggtgatggcggcgtcggacaaaaagtccaccgccactagcgtgtagtgcacatcggggcgctctaatagtgtggtgggtggaggagggatgggagtaagtgatgagcggtggctggagtgtcccagaccgatattcatattacatcacgcacccgtgccaccccagaacccagacgtaacacccaagaacgaccctcaccctgtgcgaatcgtccagcactccagatgtcgcgcttgctgatctccacgaagcgcccgccagcattcaaggcggccagagaccctgccaccatgccggaggaggtgaggctgttgagcaccacgtccacgccccccagctccgcaatctcggacacaaagtgagtgtcgcgcgagttgaggaccgagggcacgccccgcatcctgcgtagttggaatggaatggcggcagtgagcacgccatgcaggcccttgccagtggtattgtgtgcatagaggccatctgacatccacatcagtgtgcgccctttcctgctcgcctttacacgcaaccctaccacccacacacaaatcacgaaaacaccacccacctgacgatgctcctcttctgggagctgccggcggtagcgaccaccctggcgcccagggcattggcgagctggatggccgccagcccaacgccgcccgccgctgcggggaccagcacggtcttgcccggcttgaccccggcggcggccacaaaggccatctccaccgtcatgcagacggtgggcgtggtggccgccgcctcaaaggacaggccggcgggcatgcgcgccaggcgcgccgcggggcaggccacgtgtgagcccagggaccccgcggccaggccgaagacggcgtcgccggggacaaagcggctcacgcctgcgcccaccgcctgcaccaccgcggcgcagtcggcgccgggggggccggggtccccggggtacatgcccagcacgttcagcacgtccctgaagttgacgcccacagcacgcacgctgagggtcacctcacccggggctggcgcagcaacgtccaccgcgcggcggcgcaggttctgcagcgcgccgcgcggcgcagggaagaggccaaagggcacggaggacggcgcggcgggcgcggtgcggcgcagccgcgcgtcgtgccgcgccttgccactctccgccgtgccgtaagcgccgttgctgaaggcggatccctgctcgggctcgcgcagagccagctccaggcaggcggcgcgcgctgnnnnnnnnnncaaaggcggacccctgctcgggctcgcgcggagccagctccaggcaggcggcgcgcgctgcggtcgcgttctgcgcgtccagtgccgaggccgcgagcgccacgcggccgcgcgtctccatggcggcggcgcgcagcagcccactgagcgccaggcccttgctttcagaccgggccgaggcgccgcgcaggccgacgaaaccaacgccactcgcggaggccgccaggccgccctgcagcacctccagcgcggaggtcgcggcgcgctcgtcgccgcgaggcagctggaagcgcggcgcaaaggtggtagtcggtccttgcacctcaacaggcacggcagcgggccacgccacgttgtacagcagttctgcgatgctcgtcggcgcgtcggcggcctgcgccgtcgccttggccccggtccccgccagggacttgagggtcatgccgctcaggctcatgcccgtgccgctcccgcccgccaggccgtagtcgagccgggaggtcgcggagtcggccgacagctccctgctgaaggcccacagcatggcgtctgccagctttgtgccgctcaccagcaccgcgtcggcgccggcaggcaccttcaggccggcttcctggcccgtcgcggctgcggcggattgcaggcagcagtccagggtggcggggtgggcgaggaaggccaggtcggcggcgcccgtgttgtccaggcccgccagggggccgggcgtagcaggttgttgcgcgggagtggtcccgcccgccagcgcctggatggccgttgagtggagtgtgggccgtgcggaggcacttccattcctgctctccactgccccggcctgggctgtcaggtgggcgtgcttgaaggcggccggggaggaggccactgccacggcccccgacgccagcgccaggctgacgcggatggtgaggccgcggtcgccgccctcgggcaggatgagggggttgggcacctccaggccctgcagcgcccggctgatgtctccaggaacagccgtgacgagccccacccccgccagctccatgaaggccgcgccgggcacgaccgcgcgcccgctcaccctgtggtcccagaggaaggcgagggcaggcgtggcgcccagagcgcactccagcaccatcgcccgtgcattgatcgcggcgcgatgcaggccggcgtgcgggctgggggccacccagtggcgcccgcgctgccagacgggctggacgctcacgttcttgctcgtctccgcatccactgagggcgacgtaggcgccctgatcagcgtatgcgcgttggttccctggaaggcaaaggccgacacgcccgccaggcacgacgccgcgtccgccgcctcctgtggccggccaaaggtggcgcgcggcagcgcccagcgcgccggcgccacgccgggggtggggcgcatggaggtgcccacgtactggttgacgtcctgcaggtgcaggatgcccggcagcgccgcgtgcgtcagcgtcagcgcggcctgcgccacgccggccaggcccgcggccggctcggcgtggccgacccaggacttggaggcgctgagcgccagcggctggcgcccggcgggggcgcactccatgaacaccgcggcggcggcccccacctcgatggggtcgcccagcggggtgcccgtgccatgcatgtgcagcacggccacttgggccgcggccacgctgccgtcggcgagcgcgttgcgcaggacgtcctgctggctggggccgttgggcgcggtgagcgtggacgacctgccaccctgattcacggcggtgccgacgatcaagatcgcccaggacgggccatcgtccagtgcaggcccgcctgccttcggcccatgcaggagcagggcggaggcggactcgccgcggacgtagccgtcggcgccggcgtccagggtccggcagcgcccggcaggggacagcatgcccgcccgctggaacatggccggggtgtcgggccccagcgccaggttgaccccggcggccagggccagggaggactgctgggacaggagcgagttgaaggcaaagtgggtggccaccagggacgacgagcaggccgtgtccacgctggccgcagggcccttgagccggaaggtgtaggacagccgcccggaaaccacgctcagcgcggtgctggtggcgctgtaggcggtgacgccgcgggtgtggcgcgccgccacgcgcgcgtagtcgttggacgacacgccctggaggtggttggaaacagaggattgagggtagggagaaaggaaagctggtttacagtacagcaaggtggggcctgtgggattgccagagtgcggccagtctgnnnnnnnnnnaccctgaagattgttggaaagagaggaattgagggtagggaggaaggaaaactggtttacagtacagcaaggtggggtctgtgggattgccagagtgcggccagtctggcaccctagagctcatgccctgtgctctccagcactgcagggttgtccatcattccaccacgtcgtacgatagaaaggctgcatagacatccaagagcagtgtccccgccgcatcatccctcctccaaagaataatataaaggaaaacacagatcctcctttctcaccacaaacacgccccagtcggcgcgcaggccctcgtccgccaacagatccacgtgaccgagcaatgcctgggccgaggcctccatcaggacgcgctgctgtgggtccagctgcgcggcctcggtggcgctcaccgccagcgcctgcgcgtcaaacaagtcgacgtcgtccagccaggcgccgtactgcacgggcaggccgcccgccagcccggccgcagcgtccacctcccagcgggacaacgggacgcggctcggtgcgtccaccggcaccagcgtcgccagcgcgtcggcaggcgaccgcagcacgatctcactcacgccgatgacacgagcggggggagggaggcgggaggcgagcgacgccgcaccgcgcggcgaccagaatgccccatcatcgacatcactgtcagaaagcgcggcggcggcgggctcctctccgtcctcgaccgccccgccctgcgccgccgctacgcggccggcgatgaagccggtcaaagcggccacggtggggtagtcaaacaccagggtgccgggcagctccacgcccgcgcgccgttctagcgcattcctgagttccacagagcccagcgagtccagacccgcggccatgagcgcatcctcggggcccacgctggtgcctagcacgcccgccaccgagtcctgcacagcggcctgcacggccgcccgcgcctcggcgctgggctcggcagagccctgcgccggtgtcttctttgctggtttggggccagagctgacggtccccgggtgggaggacagggtgcgacggcgacgggtgaaggacggcggcggagcgccgggtccgggagaaagctccccagccggtccctgctcggcgtcgccgccgccgtcaccgccatccaccgccaccgnnnnnnnnnnacggcggagcgccgggtccgggggagagctccccagccggtccctgctcggcggcgtcgccgccgtcaccgccatccaccgccaccgcctcgtcctcgaactcggcaaaggccaggggcagggcaccggcgccgcgcatgcggccgacaaaacggccccacatgaagggcacggccgcggtggtggggcgcgcggcggcgccggccagcagcaggcccgccacggcgcccaggcccagctcggggtcgatcatggccaggcccatgcgctccacggccttggcggtgccgacgtgcgcggcggccatgccgccctcggcccaggcgccccactgcacgctggcaaagcccgccaggccctgcgcctgccaggtctgggccgcagcgtccagtgtcgcgttggccgccgcgtagttggcctgaccgggggagcccagcagggccgccacggaggagaaggcgaggtgcagggtggccggggacgaccccagcgcgccctgccacagctggaccgcatcggccttgggggcgaaggaggtgcggatgccggccacgctctggttggccagggtcgcgtcggccagcaccccgccggaatgcaccacaccctgcatttgtggtgtatgtataagaggagtgagaactggcatgaacaagacctgggagccagggggttgctgtactaatctctcacagatgttgggaggttcnnnnnnnnnnatcggccagcaccccgccggagtgcaccacaccctgtgtttgtggtgtatgtataagaggagtgagaaatggcatgaacaagatctgggagccagggggttgctttactaatctctcacagatgttgggaggttcctgagggagccaaagagcaaaccccatctcccaagccacagcatcccaaccaaatatctcacctgcaggtgggatgcggtgcccaggctggctgcggcggcggccacctcggccgcgctgcccgcgtcgcagcgccgcatggtgacggggacgcagctgccggctacggcaagtgccacggcgccctctgcggaggcgccacgcccggagcgtcccaggagcaggatccccccgatggactgcctggccagccagccggccagcagggagccaatcatgccaaagccgccggtaatggcaacggtgccgcgcgcgacgtctgcgtggcgctgctgcagcgtccccgtcctcaccacgatcttgcccacgtggcgcgcgagcgacatctggcgcagcgcattgcgcacgttggtcaggtcgtgaacgacgttgggcagggggcgcaggccgccctgcccgatgtagtaggccaggcgggataggcagtactgcaccgcctcgtccgacaggaagtccaccgccaccaggttgaagctgatgtcggggcgttctgaggggcaaggaagcaggaagagagggtgaggattcaagagttggggacaggggtctgcaatgtggtgagtgatgtgcaccactccaagggacaaggggtacagcgcatggccaaatatatgagtatatacaggcacacatgattgttccagcctataccaactctcannnnnnnnnncgacgtcggggcgttctgaggggcaaggaaggaggaagagagggtgaggattcaagaggtggggtcaggggtctgcaatatggtgagtgatgtgcatcactccaagggacaaggggtacagcgcatggccaaacgtacgagtatatacaggcacacatcattgttccagcctataccaactctcacccccccctcgctcaccctgcgccacgcgggcgccactccagatgtcgcgcttgctgatctccacaaacttgcctccgaccttgagggcggccagggacccggccaccatgccggaggaggtgaggctgttgagcacggcgtccaccccccccagctcggcggcctcggagacgaagcccgtgtcgcgggagcccagcacctcccgcacgcccaggctgcgtaccagggcgcgcttgggggcgccgccggcggtggccaccacctggcagccctgcagggcggcctgctggatggcggccaggcccacgccgccggctgcggcgtgcaccaggacccgctggccgggggcgcaggccgatgcctggcgcagcgcgcagtccacggtaatgaacaccgtgggcatggtgctggcggcctcgaaggacaggttgtccggcatgggtgtgagcgtgagcgcgctggcatgcacgtgggagcccaggcagccgccggccaggccgaagacggcgttgcctgcggagtgggtgcatcgggggcgatgagctctcatgcgtgttggggagtctagaaacatgggtctggctgcaaagaaggcgaggagaaggatgcgatgccctcagacaaccatcagcgtggccatgttccctctaccaacaacagagtnnnnnnnnnnacgtcggggcgatgagcttgcatgcgtgttggggagtctagaaacacgggtctggctgcaaggaaggcgaggaggaggatgcgatgccctcagacgtccatcagcatggccatgttccctctaccaacaacagagtggcatcagcgctcacccatctgcaggttggtgactccggtgcccataccgaccaccactccggcgcagtccccaccggggggaccggggtctccagggtacatgcccagaacattcagcacatccctaggggtgttggcattggaggaaggcgattttcggcggggcgtgagaggaatgtgttgtaggcacatttgcatgacatatgatgatggaccgataccgtcacgatgccctccagggattgacacctggttctccaatcacacagcagcatcgacttctgcgtggccacagtccaagcgctgtaggcatccaaccaacctctccgccctccccccgaaaagatactcgtaacaaaccgcccacctgaagttgatgcccacggctttcacggccaccagcacctggccaggtgccacgctctcctccacaggcagcggccccagattctgcagggccccgcgcggctgggggaagaggtggaagggtcccggcgcgggcgccagggggctgcgccgcagctgcagggccccccacactcccgctgagagtgaggtgccgtacgcgctgccgggcgccagcgtcggggcctggctggagagcgccgcgcgagggcgcgccagcgcccccggcccgacgacgtccagcgccgaggtctgcagggacggggcctccagggccagcgtcctcgccaggccccagatacccgcggtcgtcaccgcgccgcgcgcggccggggtcaaaccgcgtgccgtctcctcgcccagcgccgcgccggcggtggtgagcgccagcgaggccgcgccggaggtcgccgcctcctgcgccagcgcgatggccgtggtggcgagggcggcgggccccagggcctgcttcaggaccagggccagggatggaatgggagcaccagcaccagccgctgggcctcctacagtctggaccttggcccaggccaggtcgtacatccagcgctcgggcttggcatagacgccgtcggcggccgcggcccgcttcttcttcagtgcgcgcacgcggcgcgcgtccgagctgccggagccgccggtggggcgcgcctccaggccgctgacggaggcggagggcgccgcggccgcatcgctgcgcagcaggtagtcggtccaggtgggctcgccggtggacagcgcaccgggcgagtcctcctgcgggcaggcggcggcgaaggccggcaggcgcgcgagggagggccccgcggcggcgacctcaaacgcgtcgacgccggcggggatgcgcagcgccgctccggcctccaggctggcggccgcgccgagctgcagcgtgcagtccagcgcggcaggagacatgcggtagcctgaggtaccgtgcgtgggctgcgccacagaggccgtggagggtgcgatgcccaccagcggcaccaggcgcagcaggagtgcggtgccgcgagcggggcgcttggccttgaccccggaggtggccccggacacgaccgcgccggccttggcgctgcgcgtcgcgggcgcggtcgcgacggtcgccgccaggtgcaccggggcgcggcggccggccccgctctgcaggctcaccgtgccgcggtccgcgctgaccacggcggtgagctcggcaaaggggtaggtgtccgcgcgccgcgcctcgctggggatggccagccgcagcggggaggggatggtggcgtctgccagcagggacgccaggcccgggcccagcaggcaggcaaccgccgcggcccccgcctcgaagaagccagcgccggggaagagggccatgccgttgaccacgtggtcgaggaggaaggaggacgcgggggcggagagcagggtggagaagacggcgcgcgggttgcgcttggccgtccccgcaaaggtctccagcagactgtgcaccggggggtgcacccagacgcgctcgcgctcccagggctggcgggcgggccccgcccagccgcgcagctcgcggccgggtgccgcgccgatcagcgcgtgcgcgttggtgccctggaaggcaaaggcgctgacgccgagggaccgccgcccgctcgcggccgaggcgtcggcgccccagggcgcgtcgccgcgcggaacggcccagtgccccgcagtcttggacatggcaccctccaggtaggggttcagggcgcgcaggtgcaggatgggcagctgggtggacgccaacagcgcggcgtgcgcgtgcgcgatgcccaccacccccgccgccggctcgccgtgcccgatccaggacttggaggccagcagggtgaggggcgggtcgccgcgctgcgcggcgcccagcagcaccgccgacagggcgcccacctcgatggggtcccccagcgccgtgcctgagggagggaggataggggagaggaggggtggagtgggttggaggagggaggggcgtgaagagcacgcgcatcgcggtctgtaccttgattttcttcccctcgccctgggaacccccatgccccttcaacaccctccccctccatccagccaggagcacgacgacgcacctgtgccatgcatggacacgccggagacgtcggaggcgtggaggccagccaccgccagcgcgctggcaaccacgctttgctgggcggggccgttgggcgcggtcaggcttgaggagcggccgtcctggttcaccgccgagccctggaccagggccagcgccggcccgtcctcatcagcgcgcgccagctcgtcggcgccggtcagcgccagcagcatggcgcagcaggcctcggcgcggacgtagccgtcggcgccggcgtctagggacttgcagcgcccgtcggcggtcagcatgcccgccttctgtgcgctgtagtgcgtctccgggtgcagcgccaggttgaccccggcggccaccccccaggcgcactggcgcatgagcagcgcggtggccgccacgtgggtggcaaccagggatgacgagcaggcggtgtccaccgacagcgcaggcccgcgcaggccaaaggtgtaggacacgcggccagacaccacggaccccgccgcgccagtggccnnnnnnnnnnaccaaaggtgtaggacacgcggccggacaccacggaccccgccgcgccagtggccgagtaggtggtggtgccagcatggtccaccgccacgcgtgcgtagtccgcccaggagcagcccacgaagatgccgcaggaggcgacgtccagggacgggcgacccacgatcacctcggcgccggcctccagcaccaggcgctgctgggggtccaccagctccgcctcggcgcccgacaggccaaagacggcgcggtcaaagcggtccacatcctacattgggttggagggagagggatttggggacagttnnnnnnnnnnggacaggccaaagacggcgcggtcgaagcggtccacatcctgcatttggttggagggagagggatttggggacagttggggagtgggaggatgttcaaggcagtagggaagaggtgcggacactcagtcagtgctagagagagaagggggcttggagattcgggtgtcgacagcggtgcgggagcaatgaaggactccactgtcactgctagccttccagataccaggccttggcaatacacccgccagcctgccctgtggcaacccctttgcaccccgcccctccaacttgggccccccacccaaaaaacgaaacccagctcacgtccagcaggctcgcgaatctgttgggcaggggcccgccgcgtgccgtctgcgcctcgacatcccaccggtccaggccgatgacgcggacggcgtcccgcgcgccgtcccctgcccggccctgggtgaaggggcggtggtcggtggtggcgcgcaagctgaccaccgcgtcccccaggccgaagccggcaccaccgccgcgcagcgcctgggtgagctgggcggggatggtggagggatggtcggccgcgccccaggagtcgtactcggcctcgccttcgtcagcgccgtggtcgccaccgggggcgaccaccacggtggcaaggaagccggagatggcgcgggcggaggggtagtcgaagaccagcgtggaggggagctccacgcccacatcccgctccagcacgttcctgaactccacggagctcagggagtccagaccggctgcggagagcgggtcgtcagcgccgatctgggtgcccagcagctggctggcagctgctgacaccagtgaaaggaaggcgtcggggtccacaggcgctggcgccgagcggggccggacctgggacccgggcgccgcggctgacgccgccggggcagtggcagtcgccaggaaggcagagatggcggcggccgatgggtagtcgaacaccagcgtcgaaggcagctcggtgccgacctccctttccagcacatttctgaattccacggagctcagggagtccaggccggcggcagagagcgggtcgtctgcgccgatgtcggtccccagcagctggctggcagctgccaggatcatgggtaggaaggctgtcgggtcgactgaaggcgtgacgccagctggggccgtggcagccacagtggaaccggcagcaggctgcagggaggccgccacaaacccggcgatggcctcggctgaggggtagtcgaagaccagggtggtgggcagctccatggcgagctgcccctccaggacgttccggaattcgacagagctgaggctgtccaagccagcggccatgaggggctcggccgggtcgacggcacggcccagcacccccgccgcggctgccaggaccttctccaagatgccctggaggaccgctgccggcggggcggcgggggtcgtcggtgcctcggcccgcccgccagagggcgggcgcggcggcagccggcgcgcggcgggccgacccacaggagcagccacagcggcgggcttcacggcgggcgcnnnnnnnnnnnnnnnnnnnnnnnnnnnnnnnnnnnnnnnnnnnnnnnnnnnnnnnnnnnnnnnnnnnnnnngccaaacatgggcggaacgcctgccaggcgcggcatgaacctgtcccacaggaagggcacggcggccagcaccggagcggcgcctgccaggacgccggcgagcgcatgcaggccgcccacgggctccaccatgcccatgcccatgcgctcgacgcgcagggcggtggacttatcctgggccgccatgccgctgcctgcccatgcgccccactgcacgctggtggagggcaggccccgggcctgcgccagcgcggcggctgcgtccagcgccgcgttcgccccggcgtagttggtctgccccgccgaccccnnnnnnnnnnagcctgcgccagcgcggcggccgcgtccagcgccgcgttggcgccggcgtagttggtctgccccgccgaccccagcagcgaggcgacggaggagaagagggcggctgcggtcacgggctggcacctgacggggcccgcccaggcctccacgacggcggtcttggcaccgaaggacgcccgcacgctgcgcacgctctggttggccagcgtggcgtccgccagcacgccgccggagtgcaccacggcggccagggggtagtcgcggggcccgaacacggtgcggctgtcggcggcgaccgaggcgtcggccatgaccaggctgaccggcgccaggcaggtgcgcaggaggtgcgccaggtcggcggagcgcgcgtcggcgacgcggccgacgcggcccaccagctccagcgccgcggtggcgctgtccgtcgcgcccagccacccggcgatcagcgtgcccaaagaccccgtgccgccggtgatgacggtgcgggactggacagcggacggggtgggcagcggcgccgcgcgccggcggcccggcagtagcgtcgcttgcagcgagatgcccgagcggtgcgccgcgccgtaggccctttcacttgcgccgtcggcggcgccggccccactcagagagagcgatgtctgttcgctggagccatacgccagcgcgtcttcgtccacggcggacacactcgcgccagccacctccaggcccaccgagcgcagcacgccccacagcagcgcgggcgcctgcgtggcagaggaaagcgcggggcccagcgcgggcgcaggcgccgccagggcgccatgcagcacggtgggcgtgcgcaggccgagggagaagggtgcccggccggcggccgccagccgcgtggcgatggcggcgatgccgtccagccccacgcgcgcggggccgcgccccggcggcgcgatggccagcgacagggcggcatctgcggagatgtgcgttgctgtctcagcacgtgcagcctgccacgccgtaccgtacaccagctgggagcggttcggtacatcgccggtcgccgacacggcggcgccggcggcgggcatgggcggcaaggcgcccagggggcgggagttcaggccggtgatcgtggcggtgcccggcaggacgccgtagtcgttcatgtcccccgcgggggagctgaggcggcaggctgcgactgcggcgaggccctcgggcgcacgtgcccaggccggcagcgccagcatctccacagcggcggggaccttgagcgccaccgggccggaggcaccgcggccgggaaccgccgccaggtgcagcgtggcgtccagggcggcgggcgagagggacacgtcccgcgcccgttcggcggacgcagagatgccggcaaagtgcgctgcgatgcccggggcgagggcgagcggcatggaccccgccaccgcgtccagcgccggcccgcgagccagcgcctgcaggttggtgggacggcgggtcaggccctgccccgtgcgccggcgccgcggcgcgtcggcgtcgttggcagcggccacgccgcagcgcaggtgcgtctggcgccgcgcgccgctggacacgacctccaccgcgccggtctgggtggtcacgcggcagagcagcgccgcggccgccaggcccgggcccggggattgcagaggcaggggggcggggacggcggcgttcaccagcaggggagggggggcgtcgcccccgccgctgagcaggcaggccgtcgccgatgccagctcgaagaagccggcgcctgggaagagggggcggccgcccaccgcgtggtcccacaggtactccatgtgcaggccggcgaggcggcactccagccccacggagccggggccgaggcgcagcgcccggcccagcatggcgtgagcgcgggggaccacccagcaccgctgctccaccagctgcttctgtggcttggcaatgccggtgggctgcgggccgggcgccagcagcgcgtgcgcgttggtgc

SEQ ID NO: 42540 - DNA, 129 bp, Chlorella protothecoides
gggagaggggggcaggggagattttgggggcagggggggtgtctctgggggcatccatctcaacaaacgctcagaattccagcagggcgccgaatgaggaggccctctcacatcaggcatgccagtggc

SEQ ID NO: 42541 - DNA, 68 bp, Chlorella protothecoides
ggccgcctgtggcaaggagtaagaagggaagttaggtactgggagagggttgcactgcaggggttgac

SEQ ID NO: 42542 - DNA, 65 bp, Chlorella protothecoides
cctgcccctgccagtcacatccactcatgtacccatgcgcccccccccccccccccccccccccc

SEQ ID NO: 42543 - DNA, 61 bp, Chlorella protothecoides
gagcaggccagagtcatggaaggcgaagcagatgatctgcgccacgcggcctatgatgtca

SEQ ID NO: 42544 - DNA, 122 bp, Chlorella protothecoides
tcaagggcgtgggcctctccaggcggggtgtgaggggcttgcgcctcaagaaatcagtgccactctcattccgccgcccgcgtgccaccgtttcaggggcgtgcggcacgacttgaacctgc

SEQ ID NO: 42545 - DNA, 61 bp, Chlorella protothecoides
ctggtccttggccagcagccgcttctcgtactcggaggtcaggttgctgagcacgctctcc

SEQ ID NO: 42546 - DNA, 61 bp, Chlorella protothecoides
ctctgagagggtgactcctccgggctaggggtgggcgcctgttgtgggctgggactgggag

SEQ ID NO: 42547 - DNA, 190 bp, Chlorella protothecoides
ggaggcggtgcgcgccgcgcgcggcgcgctaaaggagcgcctgcgccgcgacctgcgcgcgctgcccttccccagcctgtccgccgcgcaggcggcggtggagcggcgcaacacgcggtaccgcgcgctgtccacgctggcctccaccgacgccgaccccgagggcgcgggcgacgccaccacgctggcg

SEQ ID NO: 42548 - DNA, 5340 bp, Chlorella protothecoides
  modified_base (123)..(163): a, c, t, g, unknown or other
  modified_base (1380)..(1471): a, c, t, g, unknown or other
ggcggggcgacgcgccagcacgcctccagcgacgacgcggtgtccctgccgggccccggcctcgacctgctgggggacctggtgggggaggacgccccggcccccatgccccagccggccgcnnnnnnnnnnnnnnnnnnnnnnnnnnnnnnnnnnnnnnnnngaccccttcgacccctttgcgccggcggggcttgcggacgaggacgccggcccgccccgggacgcatgggacgccttcgcccctggccccacgcccccaggccccaccccactggcggctgcgtcgaacgcccgcgccccgctccccgaggacgccttctcctccctgtcgctgggcagccccggcgccgggccgccggccctcggtgctgtgccgtcgggcctgggtgccctgccgcccgtcgcccctctcgtcccgacccagaaacctgcgccccaggcggcctccagcttcgggagcatgctcagtgcggggggctacgggctgtccacccccgacacccgctcctccaagcccgacccctttgccgacctgctgggctgaggtgtcgtgtctgggcccttaccttttggtcacgcgcacaggcttgtcagtttgcgtgaagggacggaggatcaggcaggcatgggtgatgggcaggtgggagggctgtgcatcccagtcgatacgatccaggggggcaggggcgagggcaccgcccgcgcctgccgcgcaggcgcaccacggcgtcacgcccggcccggggccgagcggcgcggcgcgaacaggcgcaccccgcgcggcacgcaggccagcagcgcgacctgcgcgccgcccttctcccggggctggtcgccgccccacgcggcgagcggcccgagctcgccccccactgcgcctctgctcagcgtggcccccgtgcggcagcagtgcaggctgagcgcggcggagccggcgctgctggccgtcagcaagtcggtccccggcaggaagcagggctggtagattccgggcaggcggcgccggcccgcgccctcgtccaggcagtgcaccggctcccgcggggcgcgcaggtcgtggatcagcagctccggcgcctgggacgtggaggccagcaggcggccctcccggcccgggtgccagcgcaccgatgcgacgccggccggggacctggcatccagggtcagcgcggggctgacgcgcgggtcttcccgcgcatcgacgcacaccacccgaccgtcgtcgccgccggtggcgaacagcgcgggcgcggcgtcgcccggcggcgcccagcgcacggacttcaccacgcggccggcgtggggcgcggcgtagcgctgcagcgccgtcagcgcgccggcggggtgcagggcgcagaccgccacgctgccgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacccccgccccggagtggaggtcgggtggggcggcggccaggcgccgcggcgacgcgctttggacctcgctcccacgctcccaccctcccgcctgggtctggcccaggtcccagaggcacaccgcgccgtcgtttccagcgctgacgagccaggggacgggggcagcatgcatgtccctcccgggggggtcccagaactggacgtccgccacccagccgcggtgcagcgacgcctggaggagggcagggacggcctcgacccggcaggcgtccctggagcgcaggccccagagggcaacaacgccgccctttccacccgcaaccaccagcccgggccggcagtcgatgctgtggtgggagggtgcgcggatgtgtgcagtgggaaggtaggatgagtgtgattggtggacctcacgccaccccggctccctggcatggtgtgtcatgctcgatctggaagctgcttcgcacagcagcagctgccctgcttggatcgggtcatcgcattctgacctcctttgcacagccgcgtggggcccggccggcagatccaaccaagcggtcagctcgcccgacacatgcgtccctacaacacacccgcctgtttcctgcaacccatgcccacctgtaggctcgggccagggtgcgcgcctccaagaagcagggcaggtcggagaaccccgtggcgtccacgaagctgtcggccctcgacccctcacgctgcgccccgccaccagcaggcggcgcggacgcggaggcctcctggcaggtttcggccaccaggtagtgccgcagggccgagtcctcccagacgggggcgggctcctcagcaggttcaagccacccccctacactgttgccggcctgtgcctgtgcgtcatcctgggctgatggaccccccgccagcatctggacgcgggaggatctcctacgcggctctgtgggtgcctccagggccaccttcctccgctttggctgtggctggcgctgtgggcgctgtggctcggcctgggccaagcccagctccctgaacttggcctcacgtgccaggatcctctgggaggggaatgcggtgcagatggtcaacagggtgctgcactccatgccccaccggcagcgacccgtaggcccactctgtcacgaccaccctacccacgatcattcattcatcagcgcaacctaacctacacactctcaagtactcaccgccatccgctcctcttcatatgtgggctggcgcaggccgtcagacttgcttgaggctgcctctggcgggccggtcgcatgtaaggcagactctggggcgcagggctctccgcgggtggcctgatgttggacatgatgtcgtgagtgtgtcaactccatggcggcatcggggccagtccggatgtcctcgaggggcgggagacccacagggagcgcggcttcatatggcgacattgacaatgcgcatattgaggcacaaaccggtggtaattcccccttccgctctgcctctggctctgcacgctggggatcgactcgcgaggcaacaccttcctggctgcccgcgaagaacgaagtgattgtgcgctgcatggtcgccgagacccgcggcgtacagtgaacgtcttacatcctgagcacacttccgcactgttcaggcatgtcatcgtccttgggttgtgaacagcaccgtcgacgggcagcaagcagaggtgcatctggcactttacggcttgaattccgcggaagtggaaagaatgtcgctggtccaagagcgctcgatcgtcctcgaagctccggttccactacatggactgcaactctgtcggcacagccactctcgagatgcttggcacgccttcttcgtcaccttgagcatcggtctggtggtctacgcggcagggccccgtccccttgcgaaccccactcgcacccggaggactgcatggactctcgacgggacagcatgtcctcattcgagcatgtcgaacttgcccaggcggctgagacctcccacgatgacacgcccatcgcgggcaacccggcgttcaacgcgcccgcgcgcgccacatccctccccccacccgtacccagtgcgagggtgagcccggggcccggctcggggttcccacccgccccgcgctcccctggccaggaccccctgaaagagatcgaggaggtggcggagcgcgtcatggggacggcggtgcacgctgccaaggacgtgacccagctggccagcgaggctgcccgggaggctgcccgggaggcgcggcagggcctgagctccctagcctctggcttctcctcctggtggtccaccctggacgtccccaccgaggatcagggcagcggtggcaacagtgcagacgaggtcagccctggggtgtgatccaggggaatcgctgaatgcattggtatgtggactgcgagaaggtgtttcatgttaccatacggaccaagaacgcaatgaacctcctgagattgcgccatttgggggccccctcattccccaggatccactggcctctttctcaaagcccctcacacacatccctgcaacccttggtccccctgcagcgcgatgcggtggccctggcggtctccctgggcctggagccaggcgaggcggtgctggagtccttcccctgccacctgctgcagacctaccgctccgtcaatggtctgacccccgaccgcgaagtccccttccccggtacccttcacctcaccagcctaaacgcggtcttcgtcgccgggcagggggcagggctgccggacccggtccgcctccccctcgccgccgtgcgcgcctcccacgtcaccggggccgcggtggcgaggcccccgcgcggctcagcatctgccgggcagcggctggtgctctccgccaccatcgcagagggggacatcgccttcgcagggttccgggagggcggccccgagtcggcgctggccctgctggagcacctgtcctccagcgactgacggcgggcgactcaggtctggtgatggcacctggaccgcccgctctgcaggcgtgcatgcccggtggtcaccaagcccaccgtgtcaacatccctgaggcccccggctcgtgcgggcagcccgccaccctccgcctgcgtcgaccatgctgccgccgggggcagcctgtacaacacaccacttctcccccgtgctcccccgagaatgcttcccggccgccacgttgcgcactgcacttgctgcccggtctgttgtccccctttctaccagcctggttggcctcgacatgaggctgccaagtctcttgacaaacctacccatctgtggatggtctggaacgccgcagtttccatctcccgagacacccctgacctgtgccattgccacccctcctgccggcacccatcaagaggcccgtactaagagtctgtactgtagcaatcacgtctggaacccagccgtgtcaaggagcgtcatcatggcgtgcatccggcgaacgtttgcgccacttcatgcaggcttgcgtgtcgagcggggtgtcattgcaggggtcatgggcgtcgccacgcacgtcaggggcatgctccattcgccccggggatcagagcatcgagaatgcaagagggccgtcccgggaccccctcacccccgcaccagctccctcaggcgctccagcagcgcctgccaggcggtgcccggcgctgcctcgccctccagcagggccatgacgacggccgacttcctggcggcctccgccagctgcccccccggcgcgtccagcagcgtgagcagggcgcggcacagcgcctcgcccaggtcctcgtcggcgcccagcacgcgcaggccgccgagggtgaggcgcagcgccgccggccccgcggcacgcgcgcgcgc

SEQ ID NO: 42549 - DNA, 61 bp, Chlorella protothecoides
cggtggtggtgctgataaaccagaggctggggaaggagatgccaaacccgatgaggccgct

SEQ ID NO: 42550 - DNA, 158 bp, Chlorella protothecoides
gagggttggggggtggatggggaggggggggttgagtgaataatgtggcgtgtgcagcgcagcatgcccatcccatgggacactccctttgccgccccagtcgacccccctccagtccctgcccgcgccgaccccaccatacccaccttggagggcat

SEQ ID NO: 42551 - DNA, 155 bp, Chlorella protothecoides
gctgagcgcggcggagtcgctgctgctcggcggcgaggaggtggatagcgcggagtgcgggctgcaggcgctgccggagagggcggaggcggcggcggtgatcgggccgagtgccgtgcaaggacgggagccacggcaggaggatctcgagcgcg

SEQ ID NO: 42552 - DNA, 71 bp, Chlorella protothecoides
ccctcggtggcacctctgccgagcgtccccgcccccccccccatcacgatcacaatcccgcagtgtggcac

SEQ ID NO: 42553 - DNA, 61 bp, Chlorella protothecoides
cgccggtcgtcgatgggtggggccgccttcgcctcctcatgctcttctggggcagtgtcct

SEQ ID NO: 42554 - DNA, 67 bp, Chlorella protothecoides
cagagtgcgtgctgcgtcgtgtgcgggcgcttggaggggggcttgttcagggtgttctggtggaggg

SEQ ID NO: 42555 - DNA, 78 bp, Chlorella protothecoides
ggcggaacccctcggcaggccggccagcgcagaagcaagcacggcggtctggctggggccgtgcggcgcggtcaggct

SEQ ID NO: 42556 - DNA, 61 bp, Chlorella protothecoides
tggcactgtgccaggccgatcttgtccctggcccgccgctccctcatttggagcgtcgtgc

SEQ ID NO: 42557 - DNA, 61 bp, Chlorella protothecoides
catcgcacacactcctcaagtgcacagggggcaggaggcgagctgctgcgaggcagactga

SEQ ID NO: 42558 - DNA, 73 bp, Chlorella protothecoides
ggcccttgagtgttccaccctagagaccagtctgaggctcttcaggccggctgcagcctagacctatcatggc

SEQ ID NO: 42559 - DNA, 96 bp, Chlorella protothecoides
tcggtggggtgtgagttggggaactggatcgacaaggttccaagcaggagtgctgtgggggtgcaacgtcagggtgtcacaagtacctccccgcag

SEQ ID NO: 42560 - DNA, 101 bp, Chlorella protothecoides
ccgcgtgttccaggacgcggtcaagtccggcggcgcggcggcactggccgcctcggcccgcatcatcttcttgggcgtcaagccgcagggcctgcccgagg

SEQ ID NO: 42561 - DNA, 129 bp, Chlorella protothecoides
acccccatgccccaagcaccaggtcagtttcttgggggcggaaggggagacccctggtgtttgccagggttggacttggatcagggcgatccgcgttgagtctcgacggccttgagtccccagatggcc

SEQ ID NO: 42562 - DNA, 61 bp, Chlorella protothecoides
caggccacccacagcccatcctccgcctccacccccccccccaccccttgaccacattccc

SEQ ID NO: 42563 - DNA, 61 bp, Chlorella protothecoides
ctgaaggctatgaggtcaacgcccaccccccccctgtgctcccagcctgccccaatgagga

SEQ ID NO: 42564 - DNA, 61 bp, Chlorella protothecoides
gtaggccgcagagtagaacacagaggctgggttgatgcagaaaaagagcacggcagcgtct

SEQ ID NO: 42565 - DNA, 72 bp, Chlorella protothecoides
ggcaccagctgccgaggtggatgccgcccttgcccatcccccccaccactaaatcgcacccaagccccctgt

SEQ ID NO: 42566 - DNA, 61 bp, Chlorella protothecoides
gggcaccctccgtgataggcttgcgtcggggcgacaccttgggactggtgtgttacattga

SEQ ID NO: 42567 - DNA, 67 bp, Chlorella protothecoides
ggccagcaccgcgcgcgcgccgggcgacggtgacgctgccgtgccggggcgctccagcgtctggcgc

SEQ ID NO: 42568 - DNA, 69 bp, Chlorella protothecoides
ctccctgctggcggggaagcggcggccgctgcggcgcggcggcgaatgaattttaaatcgggggggggg

SEQ ID NO: 42569 - DNA, 96 bp, Chlorella protothecoides
gggctcagagtcttcgtgagacgtttgagggtagagatgctttcagtgcctctcgaaatgatctgtttgatggaggtctgacgatctttgcctggg

SEQ ID NO: 42570 - DNA, 61 bp, Chlorella protothecoides
ggcggggatctcgcccaccgcccgcgcctgccccgcaaacttggtgtagggccgcaccgcc

SEQ ID NO: 42571 - DNA, 110 bp, Chlorella protothecoides
agcacctccttgaccacgccgcgcagccagacttgttgcccagccatgtcagaaggtggtggatgagttggtattggggtgggagatccctctggggcgcgtacggaagt

SEQ ID NO: 42572 - DNA, 70 bp, Chlorella protothecoides
ctcgcccatgccgcgcgggttgtcgtcgggcatatgggccacccagtgccagacctcgggcgccaggccc

SEQ ID NO: 42573 - DNA, 88 bp, Chlorella protothecoides
cagccctcaccgccgacccacgcgtatttaaagccccctccctttcacccccctcaatcatctgctttgcagggttttgaggcggcca

SEQ ID NO: 42574 - DNA, 65 bp, Chlorella protothecoides
gggggtcacagcaaggcgtcttggtgtgtgtgtgggggggggggagcaggggaggtgcagcacac

SEQ ID NO: 42575 - DNA, 63 bp, Chlorella protothecoides
ggcccgccccctcatggccgccctcctgggcggcgacggccgcatcctccgcgagcgtgagct

SEQ ID NO: 42576 - DNA, 78 bp, Chlorella protothecoides
cagctcgcggtccctcaccctggcgaagaatttgaaggccacaggcttgccggtctcgcagtcctccccaaacctggg

SEQ ID NO: 42577 - DNA, 69 bp, Chlorella protothecoides
gtccagctggcctcagggctgtgcctggtgtggggggccatccgcgcggcccgcaccctgcaggtgtgg

SEQ ID NO: 42578 - DNA, 61 bp, Chlorella protothecoides
ctttcctctgctcaaagctcatcggcttgggcatccgtgcgattcatgtgcggcaaacgcc

SEQ ID NO: 42579 - DNA, 7122 bp, Chlorella protothecoides
  modified_base (262)..(271): a, c, t, g, unknown or other
  modified_base (597)..(606): a, c, t, g, unknown or other
  modified_base (1283)..(1292): a, c, t, g, unknown or other
  modified_base (2423)..(2432): a, c, t, g, unknown or other
  modified_base (4585)..(4683): a, c, t, g, unknown or other
  modified_base (4969)..(4978): a, c, t, g, unknown or other
  modified_base (5897)..(5906): a, c, t, g, unknown or other
  modified_base (6001)..(6010): a, c, t, g, unknown or other
  modified_base (6420)..(6429): a, c, t, g, unknown or other
  modified_base (6721)..(6730): a, c, t, g, unknown or other
gggggggggtgaggacaagctgtacttcttctcctgctgtcagacaacaagtcaataatagtccgatcagcacaccccattccctcggccacaggagcgcacacttgtttgtgattcacctctgcatccagctttgctccttccccaggcagcaggttccctttgcaccgtctatctaacccccctcaatgcccctttcccaccatcccaaacacacaaaaaacaacgaccaccaccaaaccccagcgcaccttgaagccgnnnnnnnnnnccgcggcgcgtgccgccgccgcctcgccctgccgctgcaggcacaggccgctggggcagccggggctgggcttgatgtccagcgtggggaagaagtcggtgagggaggagtagcccaggtagcgcgtcacgctcccaaactccagcaggtacttgagcgagttctggaccagcagccccgccacgatgcctacggaggtggtgggggtggtgtggtcatggaagcagtcagcatgcggaggtcccggtggggggcgcgcccagccctcgcacggttccgaaccgaggatcccagtgggatcagggtcagagctgcggtgcccaagnnnnnnnnnngggtggtgggggtggtgtggtcgtggaagcagtcagcatgcgggggtcccggtgggggcatgcccagcccccgcacggttctgaaccgaggatcccagcgggatcagggtcagagctgcggtgcccaagggcgtgatgcccggccccagccgccctcgcgccggtggctgacacacagccacgccgtgacacccagccgggcctgtccccctttccacccacacacacccatggtggtgggcagggaggccgcgcacacgccctcccgcttcagcgtgcgctcgtcgatgcccgaggccaccaccagcgggggcacgcaggcgaagcaggccgtggttcccggcaggatggtctggatgtggccggagacggcgtcctccgatacccccgactccatccaggcctggctgagctccaggcagacctgtgtgagtcggggtggagtggagaacggggtgggagtcggcgccatgtgatccgggtggaaagctgccgtgtcgtgaggcgcagagccgggctgtatgcccatcacagtgatgattgggtggggcccaacgcctggctgcatcgaaaaggtgccaacaagtgtcagcccaggtgatccccctgttgctcccctcacagcagcacaacttgtgcactcgcgagccacctggttgatggtcatgcgggcctcnnnnnnnnnngtcacagcgatgactgggtggggcccaacgcccagctgcatcgaaaaggtgccaacaagcgtcagcccaggcaatccccctgttgctcccctcacagcagcaccgacttgtgcactcgctagccacctggttgatggtcatgcgggcctcgtagttgtccacgcagctgagcaccaggtccacgcgcgatcgaccagccccgtcgctcaggctgcgcttgaaggcctcgaagccagccagggtggtgatgttcatggtgaaggcctccagggccacgtccgggttgatcccggtcagcgtggccgcggcggcgtcggtcttggtcatgccagcctggtcggggcggaagaagagtcggttcatgttggccagctccaccgtgtcgtagtctggcacaggtacgaggggggggtgagaggtgtttatgtgtggagggatggggatgagcagatgggtgtgggaaggcaagctggacccacacggtgtggttctcagcaatgcaatgccccatgcgcgaggatagacgcaggcttctcctggggacagcacagaggaatgcaggccagggcgctgggggggccaggaggctttcaattggcggggtggctgcaggacaagcattggcaaacggagaccatgcaatgggaatcgcaaggtctccacccatcagcaccaggcactcggcagcaccttggcaccccaaggcagtgcatcatcttaccccaacccaactcaccgtacatgagcagcctgccgaccccgcagcgagtcagcatctctgcagccactgagcccacgccgcccatccccacgacggcgaccgtcttctggcggatagcctggtagttggtcacgatgcccatccgctgcagcgccatgagccggctgtatggattgctgtctaccacctcgtcgctcatcgtggctatggatgggcgggcggggggggcgggtgcaccaccggggggcgggccaggtgaggtgttgccgctcctgcccagcagggcactcatgcgcgcctgcagcgcctgaagctgctcctgtaactgcagcagggagaatgttggtgttagaatgaaatttacctctgaatgaccgtgtgctgtctgatcgcccgaccctgatgcctcnnnnnnnnnnggaatgaagtttgcttctgaatgaccgtatgctgtctgatcgcccgaccctgatgcctcgaggggaacccacgtctgttgccgctgccttgagctccgcatccttcagaccctccaccgatgcctgagaacatggacgagattagctgatgtcaatcaaattcctatgcaccatactgtatgcagcaaggatgattgattgcgtgcctgcaacgcttggagcttgctggagacgctgtccgaggatgtcatggtcaagagagtgatccctcgatcaggcgcggcacgcagcagacggtaggattagattcatcgaggcacaatccagcgatgaaggccgtcgtgacaggatagcgtacgggcctctttcggcctgagctggtaaccttgatttcgagggtgggaagatttgcgcgcccgcgcattctgggacgtcatctaaatctgggcatgcacggggaaggcaaggacgcttcagagtccagcattgcacagagagcatacagaacaacacttatctgagtatcgtggtttgtcgagcaacccctttggtccgcacacacacgaacagcacagggacacggtccttgggtgatcctcggtgcgcgctatgtttgccgcgatccgcatgaccagcgccgtccgcttatccagcctacgtctcagtacaaccagcgcacatcgggtatgtgggtccccccttgcgtggtcggcgcagcaccggctgtgtggtgtgtctggctgcaagcacacgaggatgcacgagaggcttccgtacatctttgactcctgcgcggtgtcaaggaaggccattcggatcggaatctcatgccccataacatggatcccacttgcaggcatttttcacggctgtgcgccctcagccagccagactgtcgtgctctccgacccctggctccgccctacgcgcccagccccacgcaatccgtcgatccagacggcccttctccgtcgctgctgtcgccaccccgctcaatgcacgtggggtgtgtgtgtgtgagttcacctgcaagagcacgtagtgtgatgcttgctgcttaccttaaatctcctcctctgcgcaccgttcccacctcaggaaaccgcacccgcctcccatccggcggtgaatgcgcccaaggaggcgcatggcttcaccctggtggagcagcagtatctggcagagtatgactcgaccgccctcctgtacagacacaagaagactggtacggtgattttgggtttggctggggatctgagccggaatggaattcatgcctgagtccttttttttgccagggccctttccacgccacttcctgtccccgagccctgggtgcttcccttggtctataccatttgatccacaaagccatgtgctgcatacaaagggaccccaagccgtggaggcattccgtgacctgcccacttcagcacccacccacactctccacattgccgccctccccaggcgcgcagctgatgtctgtgatcaacaaggacgagaacaagacctttggcgcgaccttccgcacccccgtggatgactccaagggcacgccccacattctggagcactccgtgctgtgcgggtcggacaagtaccccatcaaggagccgtttgtggagctgatgaaggggtccctgaacactttcctcaatgccttcacctaccctgaccgcacctgctaccctgtggcctccgccaacctgcgcgacttctacaacctggtggacgtctacctggactcggtgctgcaccccaactgcgtgagcgacccccaaatcttcgcgcaagagggctggcactacgagctggagggcgaggccgagcccttgacgctcaagggcgtggtgttcaacgagatgaagggcgtctactcctccccggactcggtgaatgcccgcgtcacccaggccgcccttcaccccgacagcacctacgccaaggactcgggcggcgaccccgaggccatccccaccctcacctttgacggcttcaaggtgcgctggggtttggtggttgtcgttgtttttgtgtgtttgggagggtgggaaggggcgttgaggggggcaagatagacggtgcaaagggatcctgctgcctggggaaggagcaaagttggatgcagaggtgaatcacaaacaagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcacttacgcaggacttttacgcgcggtattaccacccgtccaacgcgcgcttctggttctacggcgacgatgagcccgaggagcggctgcgcctgttggctgcggccctggacggcttcgaggcgcggcaggtggacagcgtcgtgcgcccgcagccgctgcttgcgcagccgcgcgtggtgactgagcgctatgcggcgggcgccgtggaggagggcggcgagcctaagactttcgtctccctcaactggctgctggcggaggaccagctggacctggagannnnnnnnnngggaggagggcgtcgagcccaagactttcgtctccctcaactggttgctggcggaggaccagctggacctggagacggagctggcgctgggcttcctgaactccatgctgctgggcacgccggcggcgccgctgcgcaaggcgctgaacgacagcgggctgggggagagcctgatcgggggcgggatggaggacgagatgcggcagcccgccttctccgtgggcctcaagggcgtggccgcgggcgacgtggaggccgtggaggcgctcatcctggagacgctggaggggctggagcgcgagggcttcagcgccacctccatcgaggcttcgctgaacaccatcgagttcgcgctgcgcgaaaacaacacgggccgcttcccgcgcggcctctccctcatgctgcgcagcatggccacctggatctacgaccgcgaccccttccagcccctcaagtgggaggacgacctggccaagttcaaggcccgcatcgcggaaggcagcgacgtctttggtggggcattggtgtgggtggttggtgtggggcgaggtggatgggggggtcaggagtgcattgggtggctggctgacaggggtcccagctcgtcgtgctgcgcaggccagggggagcccctgccgccctcgtcccctgggggtgcggcccagccccaagtcaggccttgccggctggacagccgtcgctcatgcccacctgctgcatgccgcgctcataacaactcgaacgaacacgtattttctgcttccctccacccccgcccaggccccctgatccggaagtacctgttggacaacccgcaccgcgtgtcggtgcgcctggtgccggacgagaagctgggcgaggaaagggaggcgcgggagcgtgaggccctggccgccaagcgcgccggcatgagcaaggnnnnnnnnnnccccagctcgtcgtgctgcgcaggtcagggggagccccagccgccctcgtctcctgggggtgcagcccagccccaagtcaggccttgccggctgnnnnnnnnnntgaggaaagggaggcacgggaacgtgaggccttggccgccaagcgcgccggcatgagcaaggaggaggtggaggccaccatccaggccacgcgggagctgaaggagcgtcaggagacgccagacacgcccgagtcgctggcctgcgttcccctgctccacctgtcgggtgggtggctgttgtgcagtggatgatgtgacgggagttgtacgtggggtgagggggtgaggatggagatggggatgcgatgacaggaacggtctcacctgcatcatcgtctcaaacctggctcacatcatgaaagctttaccccttgtctccccccccccaactccagacatcccgaagaccatcacgaccacgcctacgaccgtgagcatccacgccagcggcgccacgcagctcacccannnnnnnnnntccttgtctcctccccaccccccccccaccaacttcagacatcccgaagaccattacgaccacgcctacgaccgtgagcacccacgccagcggcgccacgcagctcacccatgacctcttcaccaacaacatcctgtacctggatgtggcactagacctgacgcgtctgggtccagagctcctgcccctggtgcccctgttctgcaggtgggtgtgagtgcgcttgtactcctgggaggggagagaaacaaggggtccacagcgcgcatgtggaggggactggcatcaccannnnnnnnnngaggggagaggaacaaggggtcgacggcgcgcatgtggaggggactggcatcaccaaaagcaagctggctctcgccacgtcgtctcgatccccccacccctccaccaccaggtgcctgaccaacatggggacggaggaggaggatttcatcacgctcacggagcgcatcgggcgcaagacggggggcgtgtcggtgtcgccctttgtgacctctgtcaagggtagccccctgcccaagggctacctcatggtgcgcggcaaggccaccgcagacaaggcaggggacctgctccaggtcttccacgacatcctgctcactgcgcggctggacgacgccgcgcgcttcaagcaggtacctgttctttttgggggggggggggattttttttttt

SEQ ID NO: 42580 - DNA, 70 bp, Chlorella protothecoides
gttgaaggagagggagggtggagatgggtttggagggaaatggggcaatgggacgagctgatgctaagac

SEQ ID NO: 42581 - DNA, 61 bp, Chlorella protothecoides
agtgctgaacacagatgaatggggcactgcccggtctgggccccaggctgggctgtgctgc

SEQ ID NO: 42582 - DNA, 61 bp, Chlorella protothecoides
ccagggctgctgcgtcgtcatgtgaagcgcgcgccgtgtgaagcgcgcgctgcggccggcg

SEQ ID NO: 42583 - DNA, 61 bp, Chlorella protothecoides
gtgggagggtgaggaaattggctgggcaggggaggtggagggcaggtgctggaggggaggg

SEQ ID NO: 42584 - DNA, 61 bp, Chlorella protothecoides
ggccgcgccgtggcggcggccacgggcagggtcgatccggcctcgaccgcggagtggcacc

SEQ ID NO: 42585 - DNA, 68 bp, Chlorella protothecoides
agatgcggcccgcgccggggtcgggcgaggcgatggaggtgccgtggtccgctgatcccgggagctgc

SEQ ID NO: 42586 - DNA, 73 bp, Chlorella protothecoides
catcgctgggtttctccaaaggagcgggccgaccacgactccctcacgacgtgccgcaggattacgtcaagtg

SEQ ID NO: 42587 - DNA, 61 bp, Chlorella protothecoides
aataactaactaataaactaactattaaagcaaataagtaaataagtaagtaactaataaa

SEQ ID NO: 42588 - DNA, 67 bp, Chlorella protothecoides
tgcgcccccgctccatgccggctggctcctgaaggcctctgatgcaggctcattccgcaagtggcgg

SEQ ID NO: 42589 - DNA, 79 bp, Chlorella protothecoides
ggcgcgccctgtcacaggaggaccacccagcgcccaggaccagaaaccctccacaccgcccaatcccttctcccttctc

SEQ ID NO: 42590 - DNA, 61 bp, Chlorella protothecoides
tggaaaccgggaacgtccatgtgcggcggggggaggaataggagctgccagggagcctgca

SEQ ID NO: 42591 - DNA, 76 bp, Chlorella protothecoides
gcgcggcgacttccgcgaccccggggccccgctccggggggcagccgtgcagcgcgacgacgacagaggcggcgtg

SEQ ID NO: 42592 - DNA, 61 bp, Chlorella protothecoides
cccgcccgcgctggtggccgagtacatggcgggggggagcctgaagggcgcgctggcgcgg

SEQ ID NO: 42593 - DNA, 91 bp, Chlorella protothecoides
gcgggtgtgaaccaaccctaccttgttctgaacattttgggtcatctgaccaacgtgtgcgccagcctctccagcgcctcaagcctggaca

SEQ ID NO: 42594 - DNA, 111 bp, Chlorella protothecoides
agtgtgagttgcgaggcccagccggtaccaaagcaggcggggccgcggacaaaaacgggggggggcctgcctgtgaacagtaggccgccagggaaaggcaagggaggaggg

SEQ ID NO: 42595 - DNA, 61 bp, Chlorella protothecoides
tacgggtactcgaggatctcaccgcggatgggcggtgcgggagcgcagacttctgtgcgac

SEQ ID NO: 42596 - DNA, 65 bp, Chlorella protothecoides
ggctgcaaaagtatcatggtcacagaggatgccggcacgtgcaaactgacagcaggaatcacttc

SEQ ID NO: 42597 - DNA, 61 bp, Chlorella protothecoides
cgcgcgcgcgggggaggccaggcactccgcaaaggaccagcgcctggatcaatagaaaggg

SEQ ID NO: 42598 - DNA, 61 bp, Chlorella protothecoides
agggcggcgcggactcagccgatggcgagcacgagcggcgccagctggcgcgggacctgct

SEQ ID NO: 42599 - DNA, 73 bp, Chlorella protothecoides
cgcagcagctgccactggcgacgcagcagccgctgatgtgaatgcagaagccacggagcccgaccggcggaga

SEQ ID NO: 42600 - DNA, 61 bp, Chlorella protothecoides
ttgggctgggacatcaaatgtcttgcacaccgtttactcctcatactttgccacgccaagc

SEQ ID NO: 42601 - DNA, 10128 bp, Chlorella protothecoides
  modified_base (94)..(320): a, c, t, g, unknown or other
  modified_base (402)..(577): a, c, t, g, unknown or other
  modified_base (660)..(669): a, c, t, g, unknown or other
  modified_base (1417)..(1426): a, c, t, g, unknown or other
  modified_base (1645)..(1654): a, c, t, g, unknown or other
  modified_base (2030)..(2039): a, c, t, g, unknown or other
  modified_base (2226)..(2235): a, c, t, g, unknown or other
  modified_base (2518)..(2527): a, c, t, g, unknown or other
  modified_base (2713)..(2792): a, c, t, g, unknown or other
  modified_base (3827)..(3836): a, c, t, g, unknown or other
  modified_base (4596)..(4605): a, c, t, g, unknown or other
  modified_base (5854)..(5863): a, c, t, g, unknown or other
  modified_base (6469)..(6478): a, c, t, g, unknown or other
  modified_base (7089)..(7098): a, c, t, g, unknown or other
  modified_base (7326)..(7335): a, c, t, g, unknown or other
  modified_base (9348)..(9357): a, c, t, g, unknown or other
  modified_base (9817)..(9826): a, c, t, g, unknown or other
  modified_base (10010)..(10056): a, c, t, g, unknown or other
ggggcaggtggtggcgcatgaggtgcaggaacacctcgctctccaggtccggggcagatagggagggcgggcaggggacgcggagctggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaatttaaattgggggaaggggggaaactatgagaagggatgggtggaggggaggggggggcgatcgggcgtggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccccccaaaaaacaagagaaatcaccatgcaggacttcgtgcaggtcatccagctcggcgtcgctggcgagttccaggnnnnnnnnnngcagggcctggtggtagctgggcaggccgccgcgcagcgtgcacagcgcgtcgccggccaggaagcgcaggtgcgcgtcgatgcgcgcgatgcggcgtcggcgggtgggcgggggtggggcgtcggcgtgggggcgcaccgccagcgtcttgagcacggggctcagcaggctgggcgctgttcgattaaaatttatttgggggaaaggggggaaacggtgagaagggatgggtgggggggaggggggggcgatcgggcgtggaagggggagtgtgatggagactgagtaaatcatagtgagcgccgcccggcagagcaccatcattacaggatggatggaatcgcccatcgtctcccacttcacttgcccccccccaaaaacaagagaaatcaccatgcaggacgtcgtgcaggtcgtccagctcggcgtcgctggcgaggtccaggacggcaaagaggtcggggtccatgtagtgttcatgagagggcctgctgggggaggacggtgcggctcggagggcagatcgagatctgaccgtgggaggctggatgttgacgggggccaccctttgcgccgaccatgctctcgctgggaccgggactggcgcccgcagagacatcataatcgaggaacgaaaggcggatgtgttgtggatgtgtgcccagcaaaactcgtcggagccctgtggcacctagattgattttcaaagggcctaaagcgaaatgcaatcagggcgggcaaacaacnnnnnnnnnntaaaggcggatgtgttgtggatgtgtgaccagcaaaactcgtcggagccctgtagcacctagattgattttcaaagggcccagagcgaaatgcaatcagggcgggcaaacaacaaaaagccccccgccatgtcgctgcggtattcctgtggcttaaatggcgatcggtaacttattgctgagatgaacttgttgagctgatggtccgagcagcaagaannnnnnnnnnaaagtggcaatcactaacttattgctgagaagagattgttgagctgatggtccgagcagcaagaatcaccttcagctatggagttgtgcgcctacccgtggagcatcgaatccgatcacatggatctgggagtcgcccagttttgttgggctggcgcttccaagagacgcgacacagggtgggaatcgtcgtctgctcattgaagactttgaaaagctgaagaggggacaatgaagggctcactgcgaatcaatgagtgccaagcaatttttgaagaaacctatcttgtctacaggcaagtggtgcgaacagtctattcccatatcacagaattcttcgtgcacactcctgcccctcaaacacacattgtgccagnnnnnnnnnnccttgcctacaggcaagtggtgcgaacagtccattcccatatcacaaaattcttcgtgcaccctcctgcccctcaaacacacattgtgccagggggtgcacatctccaagcttctcatcgagggctcccacaggccgcgctgagactctgctcactacggttgcagctgacaatccctgccgtctcnnnnnnnnnnagtgcacatctccaagcttctcatcgaggactcccacaggccgtgctgagactctgctcacaacggttgcagctgacaatccctgccgtctcgctccgatcccaatcccgtaagaccagcatgccataaactataaaggcaaggctgggcttgaggcccagtgcccctgctccaacccacttcaaacacacagccgtagcctaaagcattctttccgcttacatcgcgccgtccgacactagtttggtccaccccgagcaggtgaccagaggtggtgcattcnnnnnnnnnnaatcccaatcccgtgagaccagcatgccataaactatcaaggcaaagctgggcctgaggcccagtgaccctgctccaacccatttcaaacactcagccgtagcctagagcattccttccgcttacatcgtgccgtccgacactagttgggtccatcccgagcaggtgaccagaggtggtgcattcnnnnnnnnnnnnnnnnnnnnnnnnnnnnnnnnnnnnnnnnnnnnnnnnnnnnnnnnnnnnnnnnnnnnnnnnnnnnnnnntggagcatgtctcacttggccatggggttggcagagatgtaggacacggcctcggcgacagatgtgatcttgtccgcctcttggtccgggatctcaatggcaaactcctcctccaacgccatcaccagctccacactgtccagggagtccaggccaagatcgctggcaaacgctgcggattctgtcacctgtacaggtcatgcaggaggcaatgggtgaggatgggggcaagcaaggcgtggaaccacacccatgcatgtggggggttggggaccagtgggggccagcgtcgagcctctgcgcgctgcaccctgcatgctcgcatctctagagcgaacataagcatcgattgccatccatgagaagatgtgcccggagctcattgctacgtcttcacaggtatcatatgcattccgtaactgcgtcatccctcccgcacgcaccttgctgccgtccacgcggtcaaagttcttgatgacatccgtcacccgcttgaccacctcatccttatccaagtatgacgcggcagcaaacccgcgcaggctggtgagggagggggttgcgttcaggttgaggcgggccaccacgccctgtcgcacagcggccacggtgcgctgcaagaaagccatgactccagctactcccgatccggcgtctcgtgcaagggttggggtagaccaggcgaggagggccggcattgggacgccctgtttatgtggagcaagtgcgtgactcactttccacccgaaccctgcccgccctcgtcgccacatgcagggggtggagggcatgcgaatccgaagcctgttcctcgcctgcacctggcatgcatgcagcgccgagcatgtgtgatctgtctgcacactggtttgtccagcaaagttcgtagattcaataccctccaagtttccatgatgacggcattacagaagtcaagtgcagtgcagacgctgcaggactcgagcaccgactcatgcgcccagggcactcgcggcaaagcccccgcccctccaccctcgtgacgtgttcctgccnnnnnnnnnncagttcgtagattcaatattctccaagtttccatgatgatggcattacagaagttaagtgcagtgccgacactgcaggactcgagcaccgactcatgctcccagggcactcgcggcaaagccccggcccctccaccctcgtgacgtgttcctgcccaattggatgcctcgtcgacccatggcctcggccggcaggatcttgtcaaagaacgagggcaggtcgccgggcctgtgtgtggcttcctgggccgcagcggagggggtgtccaggggactatttgagggcaggcgcggtcgggaccgcgtgtaccccggcttgggcaggatgctgccggaggccaggcccccacacagctgccggacctgcaggatggcgggggtttggagagagatgttgctgctcggaatcgtgctgggatgttctggcccccaaagcaggcaggatgtggggctgctctgcgcgattgcacccccgacaatggccctcaagcacatcgctcaattcccaagcctggaatagagctcacccgctcgccctggtctgtgtaccgccaccgcactcgcacgggggcgtgcgtctgggggtccaccagggcaacgttgctatagtggatggggccctctaggctcaggctgcccgccggtgtctctttggtggccttgatgtgccgcttgacctggggatgtggagtagtagtggtaagggtgggccacgcaagtgctgcacagggataccatggtcctgcctcttggccagggcnnnnnnnnnngggagtggtaaggatgggccgcgcaagtgctgcacagtgataccatggtcctgcctcttggccagggcgtcaatacgatgggcggcaggccgcgcccagctttacccgctccctgccatgcaccgctcccgctcatagagaccctgcacgtaccatgttggcgccctccacgaccacacggggccactgccgatcgcgcaagacttccttcacggtgccgatgcggcccttgtcccgaccggcggtgatttgcaccttgtcacccttcacgattttccatgtgttggactcaaacatgggcttgaaagccctcctgtacctgcccatcctgagcgccgctgtgcaggagggaggcgactcctatgcgtacggaaggctggggtgtatctgataagcaatgagtcagagggaagctcaggccctcgcgcaatatctcttcaatttaaagtttggtttccaaagcatcctgcgactgctggggcattgtctccgggaggtttgggcactttgggagcggggagccaaagcacggcacagcatgcaacagcacccgacctcatgaaagcgcatgtgtggatcggcgagctcatcgggttcccaactccatgcacgtcaattcttgcggaacataatctcctccaagtacatccagcccgttgtcgcagtgccatgcgtgcgatcacggcgtgtgccgcatctcacagcctggcccaacccaccagcctgaggcccccccatgccagcctaccagcagtgactctggcccccggccccaagccggggtccatacatcgccttcacctcctgcgcttcgccctccttgcccccatgctgtctccacctgctgtcccaggcctgccaggcctgccggtccttcaggctggggcggccgccctggcagaccccgtgggcgcccacctgccaggggagcgccctctcaccgccgtcctgctgcagacgctgcgggagtgccaggtggccataggggtgtaccccccgtttgcctacgatgcgagtgggggcatggggcggggcaccgtgcgaccccggcccgacggactcttggacctggattttgatccacgcaggtgtgctgtggtggtgccagtgccgttgccttgtgaatgggagttgggatggagctggattacctgtacctgctctgacctcgtcggtgagcaccagttcaacccccccatccccccaacaccctgcagcctcgtcatccccagcatcgactcccacacgnnnnnnnnnncatgggagttgagatggagctggagtacctgtacctgatctgaccccgtcggtgagaaccacttcaacccctctaccaccccaacaccctgcagtctcgtcatccccagcatcgactcccacacgacgagtgtactgggggtgcccctccccccgcccctgtccatcgccatccagcccctgtccctgagcggcacgctggaccccgccacgggcagcatggagttgaccctggacgcggacttcctgttcaccgcaggacccctctacaaggcgccgcccctgcacgtgcacagtctgctgagcacgaaagatggaaagggcgaggcgctgaaggccaacgggagcgcgcgcctggccgggaccgccaccgtgccccgcacccccgatggggcgctgaacgccttcctggacctgcccacggaggccctggcggtgctctctacccacctcacctttgtctgaggggtgggcaggggttgtgggctcatacagggttcacttcaccgctggcgcctgggctgtctcgtcctgagtctgcctgtgctggacccatccccttggaagtatcctgtcaagctcacacagccaactggtgctccttggnnnnnnnnnncacccacctcacctttgtctgaggggtgggcgggggttgtggggctcatggagggctcacttcaccgctggcgcctgggctgtctcgtcctgagcctgcatgtgctggacgcatccccctggaagtatcctgtgaagctcacacagccaactggtgctccttggatgtgcttgctggcaccaccgcagcactgatgtgcccacatgctcacctgggcagcaatgccctgcagtgccctcagagtgcggcgagaggaagagtacaggctttgcactgtacggaaagcagccttgccttggcgtgccaagcacacataaaactactgggcctgcgccctgggggccaccaggtatcggtggtccttggctgcattcttcttcctccgcttctccatgtacttctccagccggccgctggccttgagctcctcaaacttggccaccagctccagtcgcttctgctccgacttcttgaggtggaagggcgtcttgcccgcctgtactgccgcccgctccttgctctgtcgcatcaatggggtgggaggaagggtgcattggtggcagcacggaatgcagcagcgctcgcagcgatgccagagcgggctgcctgcnnnnnnnnnnccaatggggtgggaggaagggtggattggtggcggcacggaatgcagtagcactcgcagcgatgccagagcgggctgcctgctccctgatctggccatggcaactctgacgctagaagaggtcaacgcacggcttccctcccctcaccgccgataagggcggccgtgtcccacggccacagtcccgcccgctgactttctccccccccccccccccaaaaaaacacannnnnnnnnnagttggaagaggtcaccgcatggcttccctcccctcaccgccgacgagagcggccgtgttccacggccaaagtcccgcccgctgggtttctttcccccccgatacaacaacacagcgccacccccttttaccaggcccccatcacaaaccttcagcttggccttgaagtcgagcttccaccgccgagcattctcctcccgcagcgcttgctccacccgggtcagacgcgcctgcaggtcggcccgcgcctccgcgcccttggctttcttcagcgcggcgcgcaggcccttgcgctcctccggcagcttctcgtcgtacaggaaagcgtactggctcttgaagcggcgctcgtcaaaggcgcccccggccagggactcaaagcgtgggtccttgccctgggcgcgggggccctggatgctctcccgcagcaccggcacggggcgcttgctgctggcctccgagggccggtgcttgttctcccggggctggcgccccgcgcgcagcgtagcgcgcgcccgggcccgcatggcggagcggtcggtgctgccatccgccagctgggcggcgcgctgcccaagcggcacctcgtcgtcctcctcctccgcctggaaggagtggaggtaacagggcatgttcagcgactagaatgcaggctccggtggctgcagggccgcgtggagatcaggtacagccatttgcaacattcagccccggagcacctgggagtcctcctcgagactggacgcggcgctgtcatcgtcgctgtctgacgctgtctcatattccggctcccgggctcgcttccctctttgcatgccagatacctcctctgggccagacatgccatcgctgctggtgtcgctggcgttctccgggggctcgcgcacatgctggggcacggcacgtttcaccctcatcttgttactctctgaaatacggaacgcgatgaagcttaatatacgtacgcagtgtggaagggccaatctcgtttcccggttctctcatgtgccaatgctaccggagagcaacccagagcgcgcgcgctcccgctctcgcatacgacatcgcctgcgctgataaccagctcggaagacagggctgcattgcccaatgcgaccttggcgcactgggcgttataattaggcaccaatgacgtcgcaccatgatatggtggaagtagggcgtgccccgccctcccggtgatcacacgcgggcccagctggcaccatgggcacgagcggggccaccacccggctggacaagctcctcaacctcttaaactgtgagtaggaggtgtggtggagctcagcatcggttgtacgcgctgatcgctcctgcaacccctgtccctgtcccaatgggttgttacctatcccacctccccaccaccaccctcgcaggcgggacatgcccggagacccgtcaggaggccggcaaccagatcgtgggcatcctgcgcagccaccccgagcagctgcccggggtgctgggcgcggtgagcgccctcctgcgcagccccaactgggacacccggctcgcagcagccaggtgcctgggctccgccgcgatgcactttgtgcacgccacccccgcggacattgccgccgcctcgggcctggatgccgtggccctggaggctgagctggaccgtgaagagccgatccctgacggcacagtgaaggcggagcaagatggggacgagggccccttgaccctggagaacctggacatccaggagatcgtggacaactgccctccactcctggcctccgggggagaggtgaggggggagaggtggggcgggggcggcggccatgccaggtgccgcacgtgtgggtgcctgactgggacgttcgccgccgggtctggcgagcttggcctggcgcgccggcttctcacctgcccacagactcgagtacgcccttcgttgcatgttgccccctcccctctcgacacccctcgcccattctcccgggccctgcgcgcaggagtacgcggcgcaggcggccgagnnnnnnnnnnaggtctggcgagcttggcctgccgggccggcttctcgcctgcccacagacttgagtacgcccttcgttgcctgttgccccctccccttctgacgcccctcgcccattctcccgggccctgtgcgcaggagtacgcggcgcaggcggccgagggcgtggcggcccagcgctcggcgctgcgcaagcgactgggcctgggcggcgcggccggcggcttcatggacgacgcggagctgttcaaggacgaggacctgctggcgggggcccgcgaaccggagcccagcgccgcccagcccgagcctgcgcccatccaggcgtgcgaggggtcggcgcgcttgcgcctcgcctcctcgcgccgcctgaagggcctgaagcgggcgcagggcagcgccaccggcggcggcctgctccccccgcgcaagtccgccaagctggacgccggcggcggcggcggcgaccannnnnnnnnngcgcaagtccgccaagctggacgctggcggcggcgaccagccactgacaggcgcgccgagcatcgaccccgcctgcccccccgccgccgccgcgctgcgctcctcagaggcggcctgggctgcggtgctggcgggggagtggccgctgcagcgtgtggcggagggcctgatcccgggcctgctnnnnnnnnnnnnnnnnnnnnnnnnnnnnnnnnnnnnnnnnnnnnnnnccgcggagtgggagacgcggcacggcgcggccgccgcgcttcgcgaggtgctgcgccacgcgccgcgcgccg

SEQ ID NO: 42602 - DNA, 61 bp, Chlorella protothecoides
cggccgtctggccatgtttgccaactttggcttcttcgtccaggccatcgtcaccggcaag

SEQ ID NO: 42603 - DNA, 147 bp, Chlorella protothecoides
tccagcccagaacctgtatgtgggggggggcggggcaagcatctatgtgggaacggtacccatgttcatgcccaagcctggtcatgaaaacggcgctgggtgcacacagggcaggcgcggctctgtcacggaccagtatgcaggacc

SEQ ID NO: 42604 - DNA, 78 bp, Chlorella protothecoides
cgcggagaaggtgggtactttggagaggggcatgggatggggggggggtatgacagcaggggcatcatcgtgggcgtg

SEQ ID NO: 42605 - DNA, 140 bp, Chlorella protothecoides
agcattcgggtgtgcaccgggcaggacgactttgtcgtcctgcgtatatgggtgtcatcatgtgtgcagcaacatccactggatggttcaaaccaccagtcgtctctgcacagcccgccagcgttgcaatgatggaaaca

SEQ ID NO: 42606 - DNA, 71 bp, Chlorella protothecoides
ggaactccgctccacactctccattgcttttgcccctcagacccacacccactctccccaaccactgcacc

SEQ ID NO: 42607 - DNA, 313 bp, Chlorella protothecoides
gggctggggctggggctggggctggggctgtgagatgggctgggcgggggtggtggcgggctgggcgggctgcagtctggtgccgtcgttcccacgacgtttcctgcagagcctgtcagcccaacgactcccgttccacaggcaaatcctgcttcagagttggcggagccaggtgccgtagaattgatggctcccaacacctgtgacagattggaaataaccacattaattaactcactccttggtatcagatatccctcctaatcccaatcaaagaccctctactcaccacccctcctgcagatgtctgggt

SEQ ID NO: 42608 - DNA, 79 bp, Chlorella protothecoides
gcagggtgcaccagagtgtacgccctcgtttcgttcgtgcgtggcccacgctccttcgctggcacgccccgcccgcaag

SEQ ID NO: 42609 - DNA, 133 bp, Chlorella protothecoides
gaggaggcgctgctgggggtccatcagctcagcctcggggcggagcaggccaaacagtcccgcatcaaagtgtgcaacaggctcatgcaaaaacccgccaaaccggggggcactcatggcccagctgcttgta

SEQ ID NO: 42610 - DNA, 10189 bp, Chlorella protothecoides
  modified_base (91)..(100): a, c, t, g, unknown or other
  modified_base (322)..(331): a, c, t, g, unknown or other
  modified_base (440)..(449): a, c, t, g, unknown or other
  modified_base (779)..(788): a, c, t, g, unknown or other
  modified_base (1676)..(1685): a, c, t, g, unknown or other
  modified_base (1839)..(1848): a, c, t, g, unknown or other
  modified_base (2953)..(2962): a, c, t, g, unknown or other
  modified_base (4269)..(4313): a, c, t, g, unknown or other
  modified_base (6188)..(6197): a, c, t, g, unknown or other
  modified_base (6281)..(6290): a, c, t, g, unknown or other
  modified_base (6370)..(6379): a, c, t, g, unknown or other
  modified_base (6556)..(6617): a, c, t, g, unknown or other
  modified_base (9273)..(9333): a, c, t, g, unknown or other
  modified_base (9950)..(10053): a, c, t, g, unknown or other
gcagggctccaccagggaggcccgccgcctccagcagggcgcggagggggcttgcgtcgtggtgtccggcctgtggggaagggatgggccnnnnnnnnnncagcggggggacgcgcggccgcttcagggcgccgggcgtcccggtgcgcggcgcctccgccggcgaggccgtggccccagcgacctcgaggcccagccagttcatggctgccagcatgcattccgcatccgccacctccgacggcaggcacgcgacgcacacggctggggcggcggcctcgatgtccacgggcagggctccaccagggaggcccgccgcctnnnnnnnnnncaagagtgtgcacatgcgtgaatgcggaccctgtccccaccacacccgccaacacaacaccgccggcgcagctcaccgatggcgccctggccaggctgctggacggcannnnnnnnnntcagcagggcgcggagggggctcacgtcgcggtgtccggcctgtggggaagggatgggcccgggcagtcgtggctgccggggcaccggctgtcgccttggcctggttgccattgcccaggccagcggtgagagtgcgcacattcgtgaatgcggaccttgtcccctccacacccaccaacacaacaccgccagcgcagctcacccatggcgccctggccaggctgctggacggcacggagaggaagtgcacgccaaagggggagcacgcctgaggacgcaaggttgcggatggggttggagggtgaggtcaagggcagcatgcgcgcccnnnnnnnnnnccgcaaggttacagatggggttgaagggtgaggtcaagggcagcatgcgcgcccaaggcgcaaccgcagactcaggcggcacccccagctgtgattctgaaaatagagcagtcgttgcccaggcgcaccttgtctggcggggcgaggaccagggaggcaaggaccaagccgggctcatccagattggacgaggcaaggataccccccctcaggatggacagcaggtccttgaggctggcgatgggggcgagggcggcctgccctggcttccccaggggtcgctgggcggcgaggaggtctgtcagagagcctgacctggcactgacgatgcggcagccgagctgccagggatttgtgcctccttcaggcccgctgcaggcgtccagcaggtgcacggctgccctcaggaggaagccggccgagtccacagagcttgggacacctgaggattggaggtggggcaaagccaggatggcatgggggagggagaggggaaggggggccggcacggcgaggacttgttgcatgctgcatcgcctcgatccatgtccggcactccgatgacctctggataaccggcaccctgtccctggccgcctcccaacacgatgcactgcaaatgcagacaactcagcacctgcaaagcccatgacggcgtcggtggcgccgtcggcgccgttcaggcccaggaggagggcgctggtgcgagtctggtacacgctttccaccaggtcggaacagcaggcctcgtacatgtggtggcaggaggccgagcgctcaaacacacgggtgaaggtgtggcgcgctccgctgggtgtcgccagccctgcagtttcggctgtggccccggcctccccgaggaggctgtagtgggggctggccggcagnnnnnnnnnntgctccactgggtgtcgccaaccctgcagttgcggctgtggccccgacctcccggaggaggctgtagtgggggctggccggcagcctggtgcatgcgtggagcgagggtgcagtgcagtgacgagcaggtgatcgcaggcgaggcatcagtacnnnnnnnnnngcgtggagccagggttcagtgcagtgacaagcaggtgatcgcaggcgaggcatcagtacagagccctgacctcaaactctggcctcagaaggagcctggcatctctcagggcctgctcactgccagggccctgtcagagcgcagggaccaaaatcccccgccctgctgcggagaaccaccctgcatgcagccacccacctgacaaaggcgcttgtcgcctgagatggggcaggcacgcttgatggggcagcctcagcatgggaaccttgctcggggatgggtaggggcgccgcctccgtctcgctgcggcagggagcatcgagtgggaggggtgtttgaatccagaaactttcctctgctcaaagctcatcggcttggacatccgtgcgattcatgtgcggcaaacgcccgcacagcttctgctggtcacccaggtccagcagctgacctcgtgtctggaaccctggtctgcgacgctccgctggacagagcgggcgcaaacgaggatgccgaccagcaagccaggtcgtcctgtgagcgtgggatgtaaaaccatggggggcagtgccgcgatgatggcggagccattgggcctggcccctgctgacccacccacctgggataccgagatctgggagggttggttcgggagtgcattctcgttgtgatgaggctggcggtcgatcccagatcggatttggaaggagtgcttcctgctgtgaaagctgggggcctttgatagcagcgatcgcgggcgtgccttcgagtcgagtggccctgtgccagactgggcaacggtaagctcggcctcgacctcggagcctgagctccggctgcacccaagcatcagcggcgatgttccagtgtggcctcccatcccgatttgatgagtcccgggagatcagtgattggaggccccgtgagatggccgttgccagcaggccagccttgaagatcttcaccactcaacgggccagagctgatcgtccagaccttgagtagctcccaggagcgaatgcaatgaatatttttttattataattgctgttcaagaggcaaggagaatgctttggattccctgctatgaatcactttccgggcttgnnnnnnnnnntagcctagaagatcttcaccactctacgggccagagctgatcgtccagaacttgagtagctcccaggagcgaatgcaatgaatatttttgattataattgctgttcaagaggcaatgagaatgccttggtttccctgctatgaatcactttccgggcttgcagctgttttttcgggggtacgagggagctgaggtggagcaggtggggttgacgtcaccacgtcgcgctcatgttcaaagctcagagtcatctgccgcggatacccgccctgccatgcttttgtgtatactgtgatcatatcattttagagacttgaactcgtccaacaggcattggagggcctgacgcggtgaccttcttcaggttgggtgagccgctgccaccgggccagcccgcagcaacccagaccccacgaaggaacagccagcatgaccacctccctggaccttaacgcggtgcgttgaaccgatgcctcgtccaccacttgctggaggcgctgtgtgcggggtccagctgagccgagtggctgcacttttgcgggggcgctggacccccgcaggcaatgccagacgcagggccatgccgtgcctctggtattctcatcatatccttcgctctttactaccttctcggaatgtgaatgaacttctgcctttctctgcgcaggctctggcccgaccgggtctgctcaacgccgtgctcgcggcccccaaccccctgcaatgggtcctgggcatcttcgtagctgtcgccaccctgatctactgggagcagttccggttcagggcggcaaggtgggaatagagggacggtggggaggtcgtgcattggcccctggttgggtgacctggatcctctctgcagggccagctcctgcagtcagacgagtggcaagagctctttgagaccgtgcgcgtctcctcccataggcagttgtgtcatactggcacctctttcctcactgcactgccttcccatgacgccaccctttcctcctgcaccccgaagggccacctcgagcggcaagctcatcccggggccggagcgccccttccccctcgtcggcggcatcgtggagatggtgatgaaccccttcgccttctgggagaagcagcgcgtctactccgaccccggcatgtcgtacaactccctggtgggcaagttcatcctcttcatcaccgacgccgagaaatgtcgcgaagtgatgtcggtgcgtggtgctgagcgggaaatctgagaggaggcagtgcgtgttgaggcctgtctgggcaatgccacccctctcgccggggggggggggggggannnnnnnnnnnnnnnnnnnnnnnnnnnnnnnnnnnnnnnnnnnnnctcaatgctgcgcaaggaattggcaaggcctggccttggccggccctcctgattggacatgccctgtcgacatctgtctcattcagtcagccctgaagttgaccgtcccaagctcacgcatgcctctcccgcccttccccctttcctcccatccctcagatcaatgaccccgccagcatgctgatgtcgctgcacccttctgccaagaacatcctgggcccaaacaacctggccttcatgcacggcccagagcacaagaacatcaggtcggtgctgtgttgtgtgcatgtttgggggagggagcatcagcatgggtatgaatttttcgccccttcacctccccaggcgcaggcctggcccatgctggcccaggagtgctcctcaccatcgcaacacacccccatattcagatgcccccccatccacacgtcaactcttgcaggaagtccttcctctccctcttcacgcgcaaggccctgggcctgtatgtcgagatccaggacgccatcatccgccgccatctgacctcctggctggccatcccgggagagcgcgaggtccgcgacgcttgccgcgacatgaaccagatgaccagccaggaggtgttcgtggggccctacctggatgacccggaggtcaccgccaagttcagcaaggcctaccgcgtcatgaccgaggccttcctggtgggggcgctggagggtgtggtgtacattgattctggagatgagggtgggctgcatgtggcgacaaggcagcgggcagggctcgcagtgcaatgaatacatggccttttccacatcgatgtgttggcaatgaccatgggatgatgtctacgccacaccccctgggacgcggacgtgccggtgcagggctgctctcccaatcacatgtcccaactcccccgccccgccgctgccgctttgctgccgccctgaaatggcctgcctcttcgtgacatgctcagtgatgttgcaccccctccgccgtccccaccaagcttgtcccgcgtgcatctcctccagcttcccctcttctccccccaaatcacatcgcaggccttccccgtgtgcctgcccggcaccgctgtgtggaagggcaagcaggggcggctgtacatcctcaaggtgctggccacctgcgcccgtcgctcggtggcgtacgtgcgcgcggggggcgagccgcgctgcctcatggacttctggtccgtcaagtgcctgcaggagatcgaggaggcggcggcggagggcgtgccgcccccgccccacaccaccgagcaccgcatggcggacgccatgctggacttcctgtttgccagccaggacgccagcaccgcctcgctcacctggtgcctgaccctgctggaggagcggccggaggtgctggcgcgcgtgcgcgcggagcaggcggccctgcgccccgacctggccaccaccatcacgggcgaggtgctggcgcagatgacctacacgcgccaggtggtgaaggaggtgctgcgcttccggcccccggcgcccatggtcccctccatggtctacgccgactaccggctgacggaggactacgtggtgccgcgcggcaccatggttgtcccctccatcgtttcggccaacatgcagggcttcccggacccccacaccttcgacccggacaggtttggcccggagcgcaaggaggacatcgtgcacgcgcgcaacttcctcacctttggccacgggccccactactgcgtcggtgaggggctggaggaggggcttgttgatgctgtggcagtggagggaggaggggacgttgatgcagggggcgggcaagaggggtcattgccatgcacaggccaggggcgccgctggagagcactctgaatggtgttcacgnnnnnnnnnncgaatcctcgtcggctgcccctccccatggttcacacgcaatgccccaggaaagaaagaaaagccacccccccctccccactcnnnnnnnnnntgaaccctcatcggctgtccctccccatggttcatacgcaatgccccaggaaagaaaagccacccccccctccccactcnnnnnnnnnnccttgatgctgtggcagtggggggaggaggggccgttgatgcagggggcgggcaaggagggtcattgccatgcacaggcctggggcgacgctggagagcactctgaatggtgttcacgccgacctgttcctcgagtcagacagccgccgcgcttcttaccctccagcgcatcggccnnnnnnnnnnnnnnnnnnnnnnnnnnnnnnnnnnnnnnnnnnnnnnnnnnnnnnnnnnnnnnccacctgccccgcgcaggcaaggagtacgcgatcaaccagctcacctgcttcctggccatcctgtccatggccaccgactggtcgcgcaggaggaccgaaaagtcctccgagtgggtctacctgcccaccatctaccccgcggacgcgctcatcaccttctcgccccgcgcctaggtgtgccagcgggcgcgccgcgaccccgctcgttgctttcccaggttaggtagcgggcgtgcgcgagccgagtgcaggcagtgtgctccccccctctcacgacgctttccgaccagcatcagacccccgccgcgccaggcgcctttgtaactgtccaccatgcactggcagacgaacgtgagccaggagttgtacaggagagaggagaaggaaatagcgcacggcagcaagcaatggggccggccccacggaggagcagcagcgcggtgcaaggggtacaggggagcgaaaaggactggtgtgggggtccggtgcgtcagcccttggtgctgaagcccagggccacaagggccacccaaaagacgacgctgactgcgatgccgccggcgttgctgggcgggctgtagatgttggacctacgaggaggtgggggtggggaggggcgcatgggttgggggccatgcgaggatcgggtggccgcgcatcaccatcccgcacacgccctcgtggcccgctcccagcgcccccatgaaactcaccagtactccccggacatccagacgcggaaagagtcgatgtcattgaaggcggggaagcagcccacgttgccgccctccgactcggcctcggccgtcagcgccatcagccggcgcaggttggtgtcgtacacgctgggcgccgaccaggccacggagcgcgaggcgttatacaccgagggctccgcgagagccgccgcctccgcagacgcctccgcggtcgtctgtgtggcgggggttggtggtagcgaagggcgtcaggacgggtagcagcaaggattgcttccgggcaatacctggcccagagacctaggacacagccgggtacgtggctgcatgtccgcccactgcacatctccagggcgcggcgtgaccgagggcgatgcacaggggcgggcagcacatcaattttgcgggttgctggacaactggcacatcggcaacccacaagcaatccaaaaacactcacgtcttggagggagaagaggccgcacagggtcgcgtactgtgcccatgtcgccgggaagcgctgcagggagcgggttcgtttggacatgtcatgcatctgtgtggccacatgcgcacaaaagcgagagccgttacttgggacccttgacgggcctggctgggcaactccccacaccgggaaccggccgagcgggacgacagggtgccaccgaaatgtcaaggcatgtaacctacattgaagcagtagacgagctggctctgctcagggcagtcctgatggtacgtggcgtagatgccgtcgagcaccacctggtggcactccttcaggcaggtggtgttgcagccccccgcggtgtagggctccacggcgttcgtgtaggatgccatgacctggtccagcagggagagacatgtcgacgacaggattgtgacctcggtggtgatggagtcgtcgcccttgcccagcacgccgggggcgagcacagccagcaggaggaggagagggagcgtcgccttcattgcactccccgatttaagaactctttcaaatggaggtacaaaggcatgcggtgccagtcacccggtttgtggggctgcgagggccgtcacccaaagagcgtgcccaggcggtgcacatctgcaaagggagtgggcctggcgcacgcggatccaaagatctagggtttttgatcgcagcacacgcagcatcccgacacccatgcacgcttatgacgcgggcgtacgctgcctcaattacagcaatggggcaaagtttgtaattaccaaagctgctagcaatgattctacgagataatcgatgaggctgatggggtgccagactccccgcgggctggcactcgccaggatgccagtcttgctggccctgctgctcaccctgctctgcgccacagcgagatcttcgcccctacgcttcttcatagacgcttctgcctttgcggagggtgagactgacttactgttggaggccatcgcggcctccaacggcacggccagcgtggtgggggtctcacgtggcggattcctggcccacaagggctggcacaacacctccatgtgggacatgtactggacggggcgggaggtagggagatcggggtgtgggctgtcgtcgtttgtgggtatcattggtggctcgtggctttccttctcggcgcacagcgctgcgctggcgtcgcggactacagccccatgggcaagaagatcacgatcttttcccccacacacacacaccctttccccaggcctgctaccgcgccttcctgtcccacctggcccccggccagctggtgtcctgcaccccgggcagccaggccatcacgggcaaggccagcctggtggcgaccatgaagcgtgcctacggcacggccgcgtccctcttcgtcccagagtccttcgtcctgcccggcgactacctggcctttgcccgcgccgtggttgcggcgggggccgccccggnnnnnnnnnnnnnnnnnnnnnnnnnnnnnnnnnnnnnnnnnnnnnnnnnnnnnnnnnnnnnacagtcaccgcgggcgcggcatcgcggtgctgccgccggccgccgcgctggccgccgcgaggcagcgtcggctgggtggcggtgcgcagcgctacgtggtggcccagcgcttcgtccccggccagctcctggtgcggcgccgcccgctgtacgtgcgcctgtgggtgctgagcctgggcacgcacccgctgcgcccctacctctttgacggcggcgtggcagtgttcggctcgcgccagggtgctgacgacggcagcgacggggatgacggggacggcgtcgccgacggcggcctcacgggcatctctgctcagggcgccgatgcgtcagggcaccaggccatggtggtcaacctgtggcagcaggaccgcgccgcggcgcgcccctggtccctgcgccagctctgggaccatttggactcccgcttcggcgccggcgcggcgaccggggcctgggcccgcatgtgccttggcgtggccgccgcgctggcggcaggcctgcccgcgcagcgcgaggccggcgcggcgctgcccgggtaccagggcgggaacgcggaggtgctgggcgtggacttcttgctggacggcgcgctgggcgcgcacctggtggaggtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcggcgggggaggcctgccgcgccggcacgcgcgagcccttcgacgcgcagaaggaggccttcctggccgccgcgctgcgcctgctccgcgccagcagcgacgcggcgacgggcaccggcccgggccggccgc

SEQ ID NO: 42611 - DNA, 61 bp, Chlorella protothecoides
acccgtgggcttgcagcccaggcgctgcatatcggcccagatggccagcgcctcgcctgca

SEQ ID NO: 42612 - DNA, 125 bp, Chlorella protothecoides
ctccccgctgcgcctgccgacatgttcctagactgaccctgctgggcggtgcctccctcttcaccgccccctggggcccctgtctctccaccccccagcaatgctgcgccatctgccaccctgaa

SEQ ID NO: 42613 - DNA, 61 bp, Chlorella protothecoides
gtctcggcgttcgtccattggaagcaggagggttcttctgcccctcctcaaccttccctcc

SEQ ID NO: 42614 - DNA, 61 bp, Chlorella protothecoides
ggaactgccggcgatgggaccggctgcatccgtgcttccatggccgttagccatctacgga

SEQ ID NO: 42615 - DNA, 143 bp, Chlorella protothecoides
tgaactccttcgctgactcccgccccccccccccaaacaatggcctcacaggcaccgggcgcctcaacgggaggagcgagcgcctgctgggcaacttcatgcgtgacagcccggaaacccgccctgtgatcgccaccaagctg

SEQ ID NO: 42616 - DNA, 132 bp, Chlorella protothecoides
cctgcgccctcggcacaccgccctcctctcaccgcccctccactcctcccaccccagctcacttccccctcatcgcccgcctccgccctgatacaaagaataccaccctcacagccccgcaccgaggtacag

SEQ ID NO: 42617 - DNA, 74 bp, Chlorella protothecoides
gggcgtggtggcggggctggagggtgtgcggctggaccgcgcctcctgcgccatctgcggccaggccagcgggt

SEQ ID NO: 42618 - DNA, 61 bp, Chlorella protothecoides
tctcttggtccgtcatggcagggctttgggggtttgaatggatgagtgggggcaacggtcc

SEQ ID NO: 42619 - DNA, 82 bp, Chlorella protothecoides
ggtgagccacggcctggcggagctgtccactgccggcggcgtgcttggaaatgagcaggcggcctaccgcgcggtgggcgcg

SEQ ID NO: 42620 - DNA, 864 bp, Chlorella protothecoides
  modified_base (180)..(189): a, c, t, g, unknown or other
  modified_base (551)..(560): a, c, t, g, unknown or other
gcggcggcccgggagtgcatctgcatgaggggcgtggcgcgcggcagccactggaccagagcggcgcgggggcccaggggcagcagaccgtaggccggcgcggcgtcgcgcagcgtgggcgaggccgaggccgccgcgcgccgcgtcaagtccgccaggcgcagcagccaggcgtgcgcnnnnnnnnnngggggacgaggccgaggccgccgcgcgccgcgccaggtccgccaggcgcagcagccaggcgtgcgctgccgcatcctcccgccccttgagcaggaagggccgggccacgccgtcctcccccagcaggtgcaccagcttgggccgggtcttggtctgcagcacatccacggtcccggaggcaaacccagccacgcgcacgtgctcgcaccctggcgggggcgagggagaggggaggggagacggtggtgcgacggcgtggatctggagtcttcggggtgggtggcagagcgatgtgatggggggcgcaaagcggcacggcgcggggggtggaggacctcctccccaccccccagcgattatgnnnnnnnnnncgggtgggtggcagagcgaggtgatggggggcgcaaaccggcacggcgcggggggtgggggacctcctccccaccccccagcgattatgggcgttcccctcccacctcccttcacccccccacacactccctttcccagcctcacaccctcccctcaccccccatccagccaaacccacctggcatgcaaaggaggcccgggggcaggtgcagcaggcccggcgcgacgtcctccaggtccagccggcgcccgggcaggaggctggccgccgcggccatcgcggcgacggccgccttctcagcc

SEQ ID NO: 42621 - DNA, 45381 bp, Chlorella protothecoides
  modified_base (2884)..(2893): a, c, t, g, unknown or other
  modified_base (3130)..(3139): a, c, t, g, unknown or other
  modified_base (3671)..(3697): a, c, t, g, unknown or other
  modified_base (3767)..(3776): a, c, t, g, unknown or other
  modified_base (4415)..(4424): a, c, t, g, unknown or other
  modified_base (5649)..(5658): a, c, t, g, unknown or other
  modified_base (6403)..(6412): a, c, t, g, unknown or other
  modified_base (6932)..(6941): a, c, t, g, unknown or other
  modified_base (8212)..(8221): a, c, t, g, unknown or other
  modified_base (8783)..(8792): a, c, t, g, unknown or other
  modified_base (10539)..(10548): a, c, t, g, unknown or other
  modified_base (10902)..(10911): a, c, t, g, unknown or other
  modified_base (11635)..(11644): a, c, t, g, unknown or other
  modified_base (12675)..(12684): a, c, t, g, unknown or other
  modified_base (13246)..(13255): a, c, t, g, unknown or other
  modified_base (13592)..(13601): a, c, t, g, unknown or other
  modified_base (14747)..(14756): a, c, t, g, unknown or other
  modified_base (15619)..(15628): a, c, t, g, unknown or other
  modified_base (15716)..(15860): a, c, t, g, unknown or other
  modified_base (16054)..(16063): a, c, t, g, unknown or other
  modified_base (16671)..(16680): a, c, t, g, unknown or other
  modified_base (17463)..(17472): a, c, t, g, unknown or other
  modified_base (17975)..(18022): a, c, t, g, unknown or other
  modified_base (18217)..(18226): a, c, t, g, unknown or other
  modified_base (18530)..(18539): a, c, t, g, unknown or other
  modified_base (20522)..(20531): a, c, t, g, unknown or other
  modified_base (20970)..(20979): a, c, t, g, unknown or other
  modified_base (21572)..(21670): a, c, t, g, unknown or other
  modified_base (22118)..(22127): a, c, t, g, unknown or other
  modified_base (22749)..(22758): a, c, t, g, unknown or other
  modified_base (23014)..(23023): a, c, t, g, unknown or other
  modified_base (23691)..(23700): a, c, t, g, unknown or other
  modified_base (24125)..(24232): a, c, t, g, unknown or other
  modified_base (24485)..(24494): a, c, t, g, unknown or other
  modified_base (24844)..(24853): a, c, t, g, unknown or other
  modified_base (25127)..(25136): a, c, t, g, unknown or other
  modified_base (25576)..(25585): a, c, t, g, unknown or other
  modified_base (27354)..(27363): a, c, t, g, unknown or other
  modified_base (28028)..(28037): a, c, t, g, unknown or other
  modified_base (30985)..(30994): a, c, t, g, unknown or other
  modified_base (31281)..(31290): a, c, t, g, unknown or other
  modified_base (32419)..(32428): a, c, t, g, unknown or other
  modified_base (32853)..(32862): a, c, t, g, unknown or other
  modified_base (33275)..(33284): a, c, t, g, unknown or other
  modified_base (34338)..(34347): a, c, t, g, unknown or other
  modified_base (35122)..(35131): a, c, t, g, unknown or other
  modified_base (36843)..(36852): a, c, t, g, unknown or other
  modified_base (37137)..(37146): a, c, t, g, unknown or other
  modified_base (37628)..(37637): a, c, t, g, unknown or other
  modified_base (39087)..(39096): a, c, t, g, unknown or other
  modified_base (39191)..(39200): a, c, t, g, unknown or other
  modified_base (39431)..(39440): a, c, t, g, unknown or other
  modified_base (39544)..(39553): a, c, t, g, unknown or other
  modified_base (39692)..(39701): a, c, t, g, unknown or other
  modified_base (40006)..(40015): a, c, t, g, unknown or other
  modified_base (42821)..(42830): a, c, t, g, unknown or other
  modified_base (43877)..(43886): a, c, t, g, unknown or other
  modified_base (44875)..(44884): a, c, t, g, unknown or other
gccgcatactcgcgccgcgggacgtacctcacgttcccgcccagcaagcgcatgtacagcgcgtggcccgtgggcgcggcgggcgcctcgccgcggacaagcaggtgcgaggccagcgcgccgcgcgtgccggccgccagcgcggccactgccacgaggtgcgcgctctgcgcgccgccgcaggtgaccacgtgccgggcggggccggcccgcagtgcgggccacaccgcgtccagcttcctcagcttgttcccattgacgtaggggtgagccaggtcgtcccgcagcacgtcaaagctgccgcactccgtgatctgggaggtgggctcgtcgtcgttcatgtgtgagggaggggtgggttgcctccaggcaagcacaagccggtaggccatgatgggaagcacagctcaccctccccggacctgggctgctggactgggcaggagccagtcccggtccagcaggcggtcgatgtcggcatggcaggcggagccagatggcgcgtggagtctggcgcaggccctggcagggccgcaggacagcacccgacgccccaccaccgccgcgaggcagcgtggcgtggggatcgccaagacaccaatctcgaaacgttctcacggtcgtttttccaaaaaaatcactcatcgtcagcgtcctgcatgaaagcatgtcgggggagtgatatggtttcgtccagattcgaagcgtgccccgcgtgctatgcagcactttaagccgagactgaacccaccctgccgatagcaatgcttcagcccctgagtaccgggtcaggagtcgagcattgcattgcgaatcagattgaacgttcgaaggctctagatccattctcaacctttacaacttgtctcacccgaacattgtggccatggcggaggtaggggtgggtcatgcatggggtggccccggcactgcaaaactgcatgcgcacggatgtatgatgtatcacttgttgcacggctgcaggaatcagccttcttcaaggagctcaagggctccgcccctttcttcctgatggccgggcccaacgtgatccagtcggaggagcactgccttaagatgtgccgtcagatcaaggccgtgacaggcatgtactttggatggtggttggatcctgtctgtatggtgatcgggtgcagatcgcgccacccctccctcttgccccttccctgagcagacagcctgggcatcaagcttgtcttcaagtcgtcatttgacaaagcgaatcgcaccaacgccgcctccttccgcggtcctggaatggaggagggtctcaggtggggtatcacgtgtatcttgcgcatggttggttggagtccagacaatcctttgtgtgacgaaggggagagcacctttgttgggactcgaatacaacagatggacatggtgtcatgatcgggggcaggtcagctggatttgcatgaggcaaccccatgcacatcatgcagggtgttgaagaaggtcaaggacacctttgatgtgccaatcatcaccgacatccacgagtcctggcaggccgagaaggtggctgaggtggctgacatcatccaggtgggtccctctgtgcttgatatgttgggatgaaggccaagggtgccttgtttgacatcattcccggttgattctttgccttgagaaattcatggcgctgcccctctcatcaatatcctcattcatcacacacacactgactccccgaactctgcccgcccccgcatagatccccgctttcttgtgtcggcagaccgatctgctgatcgccgccgccaagacgggcaaggtcatccagatcaagaaggggcagttctgcgcggcctccgtcatgcgcaattccacggagaagtgcaagcacgccggtgggtggcttgaagggttttgttggggggcatgggattcagtacgagggaacggggctgttatcgggagttcagatttgccatgctccatggccctctgcacctgcgccccggccaccccacccctgttacataaatgtttccccccttccattaccccccccgaaggcaaccccaacgtcctggtctgcgagcgcggcaccatgtttggctactccgacctcatcgtggacccacgcaactttgtgctgatgcgcgacgcgggcgtgccggtgactgcagacgtcacgcacgccctgcagcagccagccggccgggccctggaggttagtaactgaacaggcggggaggaaggcggggaagacaggcaaggggccggcgcacatctgcgctgcggtgcccagcgtgttgccctggatggcagatgccgggagtagacatgggtgcctccctttttggtctggactgggtctcgaggctctgagcccaaccctggcccggccatgtcccgggccggctgcctgcctgcagagcgcccagagattttggttctgtttccctcagtgtacagtgatccttgcctgtgcactgcgcgatggatttcaacctaccacctcctgcgcccaaccccaaacccctgcctccctgaccccagcctccaaccccctcggcagggcggcggcgtcgccagcggcggcctgcgcgaactcatccccgccatcgcgcgcacagccgtggcggtgggcgtgcagggcatcttcatggaagtgcacgacaaccccactacctcccccgtggacgcgccgacgcagtggccgctgcgaaacctgcgcagcctgctggtggagctcattgccatcgctcgggccacgcgggggagagacgacctggacatcgacctgtcccccgtgggcgaggactttgaccccgaggccatgatctgagggggctgggcatgccatgctgtgcgggcaggagatcactcaagaggggttggagagagtacgggnnnnnnnnnntcatgttgtacgggcaggaggtcactcaagaggggttggagagagtacgggagcctgcacatcgaggcccgtgggcggtgtcggatcaggcattccgacaaccaccgactggcttgtgctctaggtgcctgcatgggcatcagctcgctgcgccccgtgagctacatgggaggctatttccgggatctttggtgtggaacgagcctcataacagactggaggtcctgctttgacccnnnnnnnnnnagcccgtggtcggtgtcggatctggcattccgagaaccacatactgatgtgtgctctaggtggctgcatgggcatcaaatcgctgcgccccgtgagatacatggaggctgtttccgggatctttggtgtggaacgagccacataacagactggaggtcctgctttgacccttctcccttgccagggccggacctgccggggatggccctccaaacataccgcctctgttttcctagcaagctcacatggacgagccaggttccagccccaacatcactggaaccactgcggcatggtttccttgtgccgccagccctccggcagctcaaagcggccggcccagatgccgcgcttggcctcctgggctcgcagctctgcgggcacaaagtccttgctgtagcggcggtaggcgacggcgtgcccctcctccaccagccaggcgttcaggtccagcggacgctcgcccgggcggaccacggtgcacaccgccacggagcgccggtacatgtccttggtcttgaccgtgcaggcnnnnnnnnnnnnnnnnnnnnnnnnnnnaatgccgaagaggcgcacgcgggtgccagctacctgattggggggggggggggggggggggggaggaggnnnnnnnnnnggcctggccgcagaggtaggactcgcccctgccgtccaggcaagcctgcttcttctcgggcgcgtcgatgccgaagaggcgcacgcgggtgccagccacctgatttttggggggaacggagttggacagagaggagcttgcaggacagggggaggtctggtgactctggcccggcactcaacatgcaattgaacagcaaccatccacacctccagcgtgtcgccgtctatgacccggggggtgccgatcagcacctccgccgctgagcatgccccggcatggaggtgcatggccatgacgaaggccgccaccggcatgaggcactgcctgagcggggccatggaggcttggagggggtgagctcctgctctgaggcgaaacttccttctcttggagaggcttggggatactaggcatggcccgggtgccttcatgcggccctgcagccggctggggctggcatggcacgaacaccctcccatggacgccgtcatgctgggaaatatgtggggatgcgcggcaatctgctagccattcactcggtcatcagagcacattttccaccgcgatcatagcttccctcgtcgataatggataaagtgggagtgtcggagcctggatggttccgagatttttcgnnnnnnnnnnagtggtgtgacacgaacaccctgccatggacgccgtcatgctgggaattatgtggggatgcgcggcaatctgctagccattcactcgatcatcagagcacatatttcaccgcgatcatagctcctctcgtcgataatggataaagtgggagtttcggagcctggatggttccgagatttttcggttctagcgcccgattctgcgttgcgcaacacttccgaagtacacggtaatttcaggttgatctttgccgggatttcctgctctgggagaagcgggataaaatccgccgcaatagtgtccattatgcagcaggccaaggcccactgaggcttgaatgccagcgaaggctggggccaggtgtacaggtgctgcacgacccagcgatgaacaagatggggtgcagggaataaggaaagcaaagactcccatggtccagaaagatgtgcaggtgagccttgtgaaaccagatcgactcttgataagtcgagtaatacgagatagtagcaccgcatgatgcgcgaggcgccccccttcacgccccaccatacctcacttgatattccagatcctgctcccggccagcctcacctcacggcagcgtgcactgctccacgaagtcgccgaggaatgcggcttggcgcatagcagcaccggcgaaggcagccagcggcggctgatcctcggggacgcagaggtgacgcgagactgcgtcagcgacggggatgggccaattgccgacgatgctctggcagccctgctggagcagcacctgggtgccgctgtccggacggccttccagggaagcgcggcacaggcgaccactgccgggcccgggacacatggcatccaagctcggccaggcaagggcgggaacaaggcgcaggtgtccggccccagctcaggggagcggtccgccaactgcggcgacgtccctggctttgccgctcgaatgcagtccctgctggaccttgagcaggccgcggaagtttccgcggcagaggccgctctggatgggggcgggggccaggggctcgtgctcccaaacctgaggctgacgggggtggaagcggggctgctggggcgcagcctgctcaccctggtccacaacaaggtgtgcggagggacaagagggggtgctgttcttgtggaggacgttgcagtgtgcactggaagcatgagcctggtgagggtgagcggatgggcagagtcgctcttggcaagnnnnnnnnnngcaagagggggtgctgttcttgtggaggacatagctgtgtgcactggaaacatgagcctggtgaggagggagcggatgggcagagtcgctcttggcaagggttccatgactcgcggcgagtcgccagctcggcatgcctggcgtcaccagctttccactgcacctgtgcagggcacgccgccaggccccctgccagtccacaagtttggaccccatgacattgtgcgcctgcgcgccagcaaggccgctgccggcgcccccgtactcgcggagggggtggtgtaccgtctgcgggacgactccatagttatagcgggtgagaggggatgttgtgtcgtttgccaggacgtaatgccgtccagatcccgcccaccgccatcccgcgccgatgctccgctggcccccccatgcacctggggaccctgggcccctccacaacagctgacctgcgtcgccctgcatgccactcccaagcctggcggtgcttacagctcagctgccaagcccacccttttgttccagtggatgacactcctgaggacggactggatgtgcccttgaggctggaaaagctggtcaacaccgtgacccacacgcgtatgaaggccgccttgaatgtgcgactgggttcgggcgtctgacagcgcatgggttgcgtgtcggcctgtgaatttgctcacgagtagcgcagcgaaggcctgaggcgatatccctcctctcttcaggcatttcagccaccagctcnnnnnnnnnnggcgtgtcggtctgtgaatttgctcacgagtagcgcagtgaaggcctgaggcgatatcccgcctctcttcaggcatttcagccaccagctcgctccccacgttcactcctgtcctgatctctacccacagacgctggcctccgcctcggagcacgggagctcccctctcatcgacgtgtgcttcggccggcggccggccgcacccgccacccccctcggccccgtccaatggaccaatgcgagcctggacgagacgcagagggaggccgtgtgcgccgcgctttcctgcccagaccttgccctcatccacggcccgccgggcacgggcaagacaaccgcggtggtcgaggccatcgtccaggtttgcttggaggggaaggggccttgtctcgcggagaggcagctgctctggtcaggctgctgattggtgcctggtgcagcctggcagcgtgcctggccggctccaagcatcccgaaacttgcatcacctggacacaggaggtgggccgtggcagccggnnnnnnnnnnaggaggcagctgctctgatcaggctgctgattggtgcctggtgcagccagggagcgtgcctggccggcttcaaacatctcgaaacttggatcccttggacacaggaggtgggccgtggcagccgggttctggcttgcgccgcctcaaacatagcggtggacaatctagcggagaggctggccgccgccggtgtgccagtcgtgcgtgtcggccaccccgccaggctgctgccccaggcacgtagggcctgggtcgcagtatgtcatgtggcggctcccttgttgcagtgtggcatggggtggtgccctgcgtgcatgttggattgcaccagcataccaaacggacgctgcatcggtacggggcttagaagcgtggatcatgtgtggtccaagcagcaggagttcatgcttcatccccgtccctgtttcaggtgctggatttatcgctggaggccaaggtgctgcggagtgacaactcggccctggccaaggactgcaggaaggagatgaaggcgctgaatgctcagctgctcaagctgcaaggtggcattctgttgggggggtgggggggttaaggggtcacaccaccccttccagcttgccatgtagcttctctcctgccaaagacgcagtggatcaaaggcccgcccatgtcccagacttggatgacgaatcgggtgactgacgccttggtcgcctgctgcagggcggcgggagggcgccgcgcggcgcggcgtgcggagcgagctccgcctcctggccaaggaagagcgcaagcgccaggagcgggcggtggcagaggtgctggccgcgacccgggtcgtctgctgcaccctcgccggtgaggggctggggatgtggggatccttgcctggagagatacgacatctggctgccctggtgcctcctgtccccaacgcgtgccaaatccgaccggcctttggaccacagtggctgccctcccccctcttcaacaccccccacacgcatgaatccgacctgccccaggggtggacgcgcgccagctccgggacctgccggacttcgacctggtggtggtggacgaggcggcgcaggcgctggagcccgcctgctggtccgcgctgctgcgaggaaagcgcggcctgctggcgggggaccacctccagctgccgcccacggtggtcagcgaggcggcggccgccgcgggcctggccgccaccctgttcgagcgcctgcagggcatggcgccaaaggggcctcgcagcgtcatgctgactcagcagtaccgcnnnnnnnnnncttcgagcgactgcagggcatggcgccaaaaggaccacgcagcgtcatgctgactcagcagtaccgcatgcacaccgacatcatggactggtgcagcgtcgcgctgtatggcggccgcctggtcgccgcgccggccgtcgcggcgcacaccctggccgacctgccgggtgagggaggggacgctgtagcagggggaaagattcggatggggaaagagggggcgcttgcggggtgggggctgtgcgtatggtacgattcaggagggcgtcactcccttggggccctgattcaaggtgtcctggcgaccagtcaccgcatcgggggatgaatccctcccatgccccgcgcatgagtctttccttccctccaaagatcataaggccgagacaaccctgctgatccccactcccatggggctggatgccttcttactcatagtgatcccgggcctcaacaccaatgatctgtgaggttctcgcgcgcgcccccccgccccctcccaaactcaacattcctcggcacccacacgagaaccacaggtgtgcatggggatgactccgcnnnnnnnnnncggggctggatgccttcttactccgagtgatcccgggcctcgacaccaatgatctgtgaggttctcgtgcgcccccgccccccccacccaaaaaactcaacattcctcggcacccacacgaaaaccacaggtgtgcatggggatgactccgcgctgcgtgccgccctgctcttcatcgacaccgcgggctgtgactgccccgaggccgtggagcgggagggcgggtccacctacaaccctcgcgaggcggcggcagccatggcccacgtggcgcgcctgctggccgccggggtgcggcccgaggacgtgggcgtgatcacgccctacgccgcgcaggtcgcgcgcctgcgggagctgcggccgccggagctggccgcgcgcctggagatctccaccgtggacgggttccaggggcgggagaaggaggcggtggtcatctcctgcgtgcgcagcagcggcggcgaggcgggcggcgcgggcgtcggcttcctggccgacgcgcggcgcatgaacgtggcggtgacgcgcgcacggcgccactgcgcgctcgtcggcgacggcgacaccctggccggcgacgctttcctcgcggggctggtggaccacgcgtcggcacggggcgagtacgagagcgccgcagacttgctggagggctgacgtggcctggggctgcgactgcgcggttcggaggctgcgtatgtgagccgggaggcccatcctggggggcctgcattacatgcacacggcggacaggcggccgcggcgcagagccgggagccagagcggccggacggggcggtgctggcatggtcaaggaagaaagcatgggtgtgtgctgcccagataccatgggacatgacgactccaaaatcaagcgctcgccggggtggcgacaggcttaggcgtggccgccgaccccgccagcaggtacccaaactgcttggaggacttcttggtggtggaggcgcccaggggcttggtggcgaccacctgggtcttccgcatctgctgcagcatctgcttcatgtgccgcttgctcttcacgccttcgggcttcggggagtgtggtgtggtaccgggggttgaggggcgagcgcaagtttggcacggaagttggcaagccactcacgagcaccatgccgcatccccgtcctgtgcctccccctgagacagagcagctgcgaatacccttcctccggcatgaacgtatagacgtgatattgcaaagcagggcacacatcctggctgccctacctccgtaaggctccacagctcggcagacgtgaggggccgatcggcctggcccagatgcctctgcaggatcttcttcactccctctgcttccaaagctcctgcgcatcacattgggtgcgtgggatcccggccattctgagctccccagtgctcctcccgatattgagaatccgggtggagtggcccaccccttggccggccacccgtcaccaccagcaggctcaccggactcgctggaggtggcaaatgcacgaatggcttgctcggtacgaaaccttagtgcccttgagatccgtgacgcttgcagcatcctgcgcactttctccggaccacgtctccctcctcagaaagtactcgggacgcaacagcccaatcaaagccaatcgcaaagccgagacgccggtgcgagatggctgtgcaatgttcaatcgtttggatgagatgtattgttgatgcgcgaagttatggagcgacctttctcatagtattctcnnnnnnnnnngtctccgggccacgtctccctcctctgaaagtactcgggacgctacagcccaatcaaagccaatcgcaaagccgagacgctggtgcgagatggttgtgaaatgttcaattatttggatgagatgtattattgattcgcgaaattatggagcgacctttctcatagtattctcgcgcgcgtggcgccctcagcactggccatgcgaggtgtgagaaagccgtgcatgcatgtttgcggacccacacccgggcgtccgaatgcacccagaccagttaaagacgcacggcatatttcaaaaacgtaattagcttcaagtcactttctcatcgtgtgtcgatagccgggagtgcctgnnnnnnnnnncaaagacgcacggcatatacaacaaaagtaattagcttcaaatcactttgtcatcgtgtgtcgatagccgggagtgcctgcgttgcataccacacttgcgccctgctggtggacccacgagctcgcctcccagcgtaggatagagccggcaacgagtccgggacggcatgcagcatgacgaggtgaatgcgaggttgtgtggagtgcctcttaagaacccgaagtgagccatctggccctggccacctccccgacggctggtcgcccatcagcgcttccccctccctcactccgcccacaggtcatctggcaggtcatcaaccatggccactgtagtttccgggcaaagacccagacccagaatttctgtaggaacgagtacaacgtaactggcctctgcaaccgcagctcctgccccctggcgaacagccggtatgccactatccgggaggacaacgggcgatgctacctgtacatgaagaccatcgagcgcgcacactctccaaagaacctctggcagcgcatccgactgaagaagaactacagcctggtatgtcgacggggtgggtgggagggagggacagtgatacagggggcagtcatcattggatgggaaaggggtcaaaaggccgcatggatcggcgtgtggcaagtctgcagcctgtccacagaagggtatacactcctgatttctgccaagactgatgcactcgatggtgacacnnnnnnnnnngaaggctgcatggatccgcgggtggcaagtctacagcctgtccacagaagggtatatactcctgattcttgccaagactgatgcactcgatggtgacacagcgcaagcctcccgcgtgcaagcctcctccctaaccctctgtccatacacgagtccctcacgccactgccacccccctcccccttcctccaggcacttgcacaattggacgagcacctcgcctacttcccaaagttcctggtgcacaagaacaagcagcggctgaccaagatcacgcagtacctcatccgcatgcggaagctgacgctgaaggccaggccgaagctcatcacactgccggcgcggaaggagaagcagctgaagcgcaaggaggccaaggcggaaaccgcagcgcagctggacaagtccatcgagaaggagctgctggcgcgcctgcaagccgggacctacggcgacatctacaactttccctccaagcagtacaacaaggtgagggcccttgggctgagctacctggctgcgggatgccaacaccccactatcacacaacacatgtcctcccaagacatatgcgatgcaggttgcagtgggagtgcaattcattgcaagtgctctcttagtctcaatgccttcctgtgctcagcaagatctgagtcacgcccttaaatgaccacctcaggtgctggagggggagactgtttcagacgacgccaaggaaattgaaaaggaaattgaggaggaggaggaactggaggagtatgtggagggagatgaggataccagcgatgaggtatgaggtggcgaagggtgttgtgcaggactggggcaaagggcctgagtttgtgctgcctgctctgatcgttaagcggccaaggtgtatggatattttgctaggtggtatgcgctcgaggtggactgctggccttgtgtttccagtcctgcgcatttaatataaaactcgtccaacatgtcactcatcccctcacaggaggatgacgacgaggaggaggtggaggaggtggagtatctgnnnnnnnnnngatcgtcaagcagctaaggtgtatggatgttttgctaggtgatatgcgctcgaggtggactgctggccttgtgttcacagccctgcgcagtttgtatagaactcgcccaacatgtcactcatcccctcacaggaagatgacgaggaggaggaggaggaggtggaggaggtggagtatctggatgacggcgactttgatgaggaggaggatgacatggaggactgggagggtgtctccggcagcgacgaggacgccgctgctgcggcgcccgcacccaccgcacggcaaaaacggcaggcggctccctcggcgcttgcctcccgggccgcagatggcggtgcgcagaagaggaggaaggggcggcgcggggtggagattgagtacgaggaggagcgggagacggggctgcaggggcggagatcataattacttttagtccccgccctgtacctattcccctgtgtacaccattgaagaggcctctgctttgaaaggggttacttgacagggccgctctgggaattagtaacggtggcagaaggcagctctttggttgagacgnnnnnnnnnngattacttttagtccctgccctgtacttattcccctgtgtacaccagtgaagaggcctctgcttcgaaaggggttacttgacagggccgcactgggaattagtaatcgtggcagaaggcagctctttggttgagacgcgaacatggtgctctgaaaagggctgcaaaagggttcaggtatgcacaggagctgcttcggagcgtaataagagcatgcccggggatgcaaacgaaagtggaagatcaacgtccatggtgaaggaaacgctgtgaataaagctctgtagcagaccaggctgctgggtgattggagtctcctctgcgtaggagcgaatccnnnnnnnnnngaacagcatgcccggggatgcaaacgaaagtgggagatcaacgtccatggtgaaggaaaagccgtgaaaaaagcactgtagcagaccaggccgctgggtgtttggagtctcctctgcgtaggagcgaatccttcttgccactgagcaaaaacaaacactgcatctcatgggcgtgcactgcccgcctgagtctttacggcaacaggacgctgcctcaggtgtttgggcagaccaccgagccggcgggcacgtctgtcatggtcgtgaacttctgcagggcgaggaagaggccccctgccgcggcgccccccgccagcgacgcgacgacggggatccagccgtaggtcaggaactcgctggggcccttgcccgggatgggcagcatccagtgggcgatgcgggggcccaagtcgcgggcggggttgatggcgactcccgtgggccctcccagcaccagcacgatgaggaagatgaaaaaggcgagggtgaacccaaactgcgcatcaaacagccctctggacggctcgtacagctggtttccgcgcgcagcgatcatgttggccatgaccagcagggtgatcgtccccatgaactcgcagaggaagttccagtggggcgcgtagatggcggggcgcgtggcaaagatgcccagcttcgtgttctggtcggcgatcagcagtgcctcgtagcgtagctgcgccggcggccgcggcagctccaggcaccccacgcactcctcgtcctcctcgccggcggtgcaagccagcccctggccgtcgtcgtggcgcggcgcctcaccctcgcgtcccatcaccgactccagggtgtcttccacctgccgcgtgcgctgctcgtgctcgctgagcgtgcgtgagcgctcctccagcaggtctagccgccgctgaatctcctccttgttggtcaccgttgcgcagcggagcgactggggggccggggtgaggtggaccattgattcttgggggaagtggaaagcggggatgatggcgtcgtcgacaggcgggccgcagcagaggcagggtcactggggagtgggtcggtgagagtgtccggacctgtccagggcatccagcatgcgcatgggagattaaactatgcccaggtccacggagcagagcatagtctgcnnnnnnnnnnaagagtgtctggacctgtccagggcatccagcatgcgcacgggagattgaactatacccaggtccacggagcagagcatagtctgcccatccgcacaatgcacccggcccttgccttcaggagctcggcccgctgcgccttgatgttgctgtgcaccagccccagcaccgtcccgatctcccgcatggtcccctggatggcctcgccggggcgcacacggcggtgctggtccttggggtcgttgttatagccccccaccgccaggtcggatggggagaaggtgcggttggcgcccccaccaagcaaagggtcggcgaggaaggggtcggcctcggtgacggagggcggctcggggacgacgttgaagtggggcaggtagatgagccacaggaggatggcgcccaggaaggcgcccgccagctcactgaaggacagcgccaggaactcggtgctgtggcgtgagtgtgctggggcagcgttgggcaggcggtgcgggggaggacactgccgcgcggggctgagtgacagcgggacattggcaacggcaaaaggaactcatagctgcagccgaagacggttggaaagtaacacacagtgcgatcaggcacatggggcagaatggatgaccccgacgacatgcccccctgcattctgttgtgattccaaccaccttcacagactccccctctgaaactcacactgagaggttccccgccacccactggaacagacaggccgctgggttgaggaaagcggagatgtgcccgaacactggcatgaggaaggtggagagcacacatcaggacttgtaatgtggacatcagccaagcacagctgttcaggactgctcatgccagatcatnnnnnnnnnnggctgcagccgaagacggttggaaagtaagacacagtgcgccaggcacatggggccaaatggatgaccccgacgacatgcccccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaaagcggagatgtgcccaaacactggcatgaggaaggttgagagcacacatcaggacttgtaatgtgaacatcagccagacatagctgttcaggactgctcatgccagatcatttcccagcttatccacctgcacctgcttctcgcaagcaacccagtatgcaccccttgtgccagccaatactcactcnnnnnnnnnnacttatccacctgcacctgctcctcgcaagcaccccagtctgcaccccttgtgccagccaatactcactcatggtaggaaatccgaatgctagaccgaaacctatggccaagaatccccagccatatccatttccctgtgattcaaataggctgggaaagtgctcaccaagacaccttcaatccccaaccccaggcagccggggccaccctcaattccgcgaaggcttgctcgcacatgcgcacagcatccctcatcccaccttggtcttggccagcagctcatttgccacagccgcatctcccaggaagagctgcgtggaagggggtgagggatgggtgtcggctcgtatctccagctcgccgcctgggtgtcaactcatccgtacccactgtccagaactaggctcaaactcaccgcgagcatggtgccaatgacctctgccccgcatctcgcccccaaactgtaggaataggggctcagaaacatgcttccaatcatggcgtcgggatggttggggttccggctcgcaggtcgacgagaaccctagccgatggctacaacgaaatcaagtgccgtaggccatctaagacaaattctgattcgccnnnnnnnnnnttcgggatggttggggttccggctcgcaggtaggcgagaaccctagccgatggctactacgaaatcaagtgccataggccatctaagacaaattctgattcgccggatgcattatagagctggtttgcattacaggcttggtacggaaagagatgccgaccgattccatgcctccaattcgaagctcacggtgtggatgatgtaaggcgtgggcgctggagaggcacatgcgggaggacggtatccacccgtcctgccaagtgcgtgcttgattgatttgcgctggacatccgacagtttgattcccattttttccatgatcttctcctcctgcccatctgtacgatgaagaggcagcaggctcttccatggcgtattggaattgacaggctaacatcccacaggcatacaagcaagcaagagtagaatcctcaagacgcaaaatggacgtaaaaaggggggcatggaatggcggtttaggcgatagcttgctgggtcattcccgaaaaaggaatcgtgaggcattcaagcagtgatcttggttggaagcgcattgggtggaaaggggagagattgttggtgaggttggacaggcagaccattcctcattgttttgacaaggagctccgaggttgtgtccagtcagacacccaaaaaccttgtaaaagggcaggcttcgcctgccaatgcattcttggcccaggaggggtgttgcagggtcggtgtgactccagggtgaggttcagacattagggcagaccacggagcccgggggaacgttgnnnnnnnnnnaagaccattcctcattgtttcgacaaggagctccgaggttgtgtccattcagacacccaaaaaccttgtaaaaagggcaggcttcgcctgccaatgcattctcggcccaggagggggggtgcagggtcggtgtgacctggggggaaggttcagacattggggcagaccacggagcccgggggaacgttggtctcccccgtgaacttctggatgaggatgaacaagccgccggccgccgctcccccgcacaggggtgcgacgacggggatccagccgtaggtcaggaactcgctgggccccttgcccgggatgggcagcatccagtgtgcgatgcggggccccaggtcgcgggcggggttgatggcgacccccgtgggcccgccgatcacgagcacaatgaggaagatgaagaagccgaggatgaagccaaagagggccccaaagaggccccgcgccggctcgtacagcaggctcccgcgcgccgcgatcatgttggccatgannnnnnnnnnnnnnnnnnnnnnnnnnnnnnnnnnnnnnnnnnnnnnnnccagcagcgcctcgtaacgcacctcggcgggggtcttgggcagctgcaccccgtccaggccctcctcgtcggcggtgctggggcggctgacggggccgccgaaaccgtccccgctcttgcgcatgccctgctccccgccccggatgactgtgtccagcgtatcctgagcgcgccgtgccctcacctcgtgctcgnnnnnnnnnntatgccctgctccccgccccggatgacggtgtccagcgtgtcttgagcgcgccgtgccctcacctcgtgctcggtcagggtgcgggagcgctcgtccagcacctcgatcttgcgccgaatgtcatccttgttgacgaccgaggcacggcccagggactgtggcgcaggtggaggggtttttgagggggaagagaggggccatggatggggagggggtgagcggggggggtgcattctggatttggaggtggctgaggaggaggggctgcccaacaaccactgagcagggagcaggcgtcccccnnnnnnnnnntgcattctggatctgcaggtggctgaggaggagggtctgcccagcaaccactgagcagggagcaggcgtcccccccaagggcttgacgcctccctgttccccccacaacacacacgtccgccacctcaccttgagcagctcctccttgcgctgcttgatgtcatcatgcacgatccccagcacggccccgatgtcgcgcatggtcccctggatggcctggcccgggttcatgcgcatgtggcggtccagggggtcgttgttgtacccgcccaccgccaggtcggtgggggaaaaggtgcggttggcccctgcgcccagcagcgggtcggcgaagaaggggtcctgttcggtgacggagggcggctcggggacgacgttgaagtggggcaggtagatgagccacaggaggatggcgcccaggaaggcgcctgccagctcactgaaggcgagtgccagaaactcggtgctgagcggggagttggatggggggatgggggtgttctgaaggacactaggaggaaacgtttggcattggggaggagagttacatccctgtcatgcagcaaacagcaggctttacagtgaaggactgtaatgacccatgagcacatcaattctcccatgccgtgtaacgtgaggaaaaacacgtctccttccctgcacccatctgcatacccattgatgttgccgacaacccattggaagaggcaagcagcgggattgaggtaggcagagacatgatcgaacactgcggtgcatgggcaattgggctgagttgcggggcactgagggtccggcatggactgtgcattccataccagtttgacacgtgattgaagcagcaggtctcctaaaccgcaaggcaaccctctcaattggccccatactcactcatagtcgcaaatccaaaggcaaaaccgaagcccatcgagaggaatccccagccgtagccatttccctagggattggcgggaggggcacggtggggaggtgaatgcgccgcgctgggttccatgcgcacagaacctgctaatctcggagcggcgatgagagtccggacagcctcattacacaccgacatacctttgttttggccagcaactcgttcgcgacagcagcgtcgcctaggaaaagctgcggagggcatgaggaggttcagacatgagcctggttgctggatacggtgaccccgcggtgcgcctccgacacaagatttacgttagcctaccgctatcatggtgccgatgatttctgccccgcatctggcaccaaggctatacgaataggggttcatgaacatgctcccgatcatggtgcgagtggagcccgatgggcacgctggttccggaaatatgcaagctcaagggtgcgcgacactttacatccaacacagaacccaatgctaggtcttaatcactcttaaactatcaatactggatgggttccgcctaaagaatgacgatagcgggtctcaatccctgtacatcaagcactgccgcctttcgtaggtgccgcgccagcatggaagctgggagttccgtaattgccagattattcgatctcaggcatgattcgacccagcggggacaggtgagttctcaaggtgagacaatctcttgcacactctgctgcaatacttctaatggacttgcgatctctgtgggccgatcgccaagattttgccacgaacaccggctcgattgcagtgttggcttgcagctgggtgtcaatgatagcagaggagaggagagccacctatttacaaagagggttataatggctttattgcaagctatcagtgtcaatgatgagatgacttcgcgcacaaaccgttgtctggcagagtctggcattgcggggctcttccgaaagctcgaataatttccggcgggcgaatccgatgccattcttgaatggggcttacacttgctcacacgaagaatgtgcaaaccaaccgccttctttggcagacacgatgagtcnnnnnnnnnntggacttacgcttgctcacacgaagaatgtgcaaataaaccgccttctttggcagacacgatgagtcaagacaggaagcttgtactttgcacagtatccaaggtccgtgtattacggcagttgctgtctaaagtattggttgccagtccctgcctaacaatatttgcatcagtgtgccagggacttgcctaatctggacacctcgcaccatgcttgtctgatcttcatctaggcgtgcctctgctatgaatcagtcttcccacacctcgaggaatctgaggtttttagtctggagtgcctggggacatcggacctgcttcaatgcttctgcctcacttatgtgtcccgtcggcctctcactgcttcaaatcgagcttccagtcaacgggaatggagttgtagtaacacctattgtactaatctgaagaagatcgacatnnnnnnnnnnctttagtctggagtgcctggggacatcgggcctgcttcaatgcttctgcctcagttatgtgtcccgtcggcctctcactgcttgaaatcgagcttccagttaacgggaatggagttgtagtaacatctattgtactaatctgaagaagatcgacatgcatctcttagatgtatactgttcaattcagggggagtgctggggagaaaagctgaatacttgcccaaccaagtcagcgccaggacgatgagcacaggactgcactgcaacatcctgagactgaatgcaagacaatccttcatcagcgaccttcacagaccatggagccagccggcacgtcgcttgctgtcgtcagtctctggatgacgacaaagaggccacccgcagccgctcccccgcacaggggtgcgatgacggggatccagccgtaggtcaggaattggctgggccacttgcccgggatgggcaggatccagtgcgcgatgcgcgggcccaggtcgcgggcggggttggtggcgaccccagtggggcccccaagcacaaggacgatgaggaagatgatgaagcccagcatgaagccatacagggctccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggtcacggtggccatgaattcacaggtaaagttccagtggagcgcatagatagcgggctgggtggcaaagatgcccagcttgatattctgtttggcgatgagcaaggcggcgtaacgcacctcagccagtgactcgtgtaattttgcaccgacagccggcgacgcactctctgccgctgcctgctccttccaggtgagcgactgggtggtgggtggcccagcctggccccactccccacactgcaccctggacatcttcttcatctcctccagagtgccttcctcatggcgcacacactgagtcgccgcgccctgccatgggtgggagcccaaagcatggggctgggtctgggatcctggagcaacgcaatgcgcgtgctgtatgtgtggagggctatcgagggtgaggggcggtgaggggccctgtccgctgcaacatgctggcnnnnnnnnnncgggatcctggagcaacgcgatgcgggtgctgtatgtgtggagggccatcgagggtgaggggaggtgaggggcggggaggggccctgtccgctgcaacatgctggctgcggtcgcacaggaccacgtgcgcaaacagggtgaaccggtctcgccaaaggtagattgcacgcagattcacctgcaggatgccagacctgtgatgcggtgggtccctccgcatggttcccaagaccttccgcatggtccccttcagcgcctgcccagggttccgacgcagataccgatccagggggtcgctattgtacccccctactgccaggtgggtgggggtgagggtgtggtaggcaccccctcccaggagtgggtccccatagtaggggtcggcgtcggcgatggagggcgggtccggcatgatgttgaagtgggggaggtagcagagccagacaaggacagcgccaaggaaagcacccgccacctcactgaacgacagcgccaggaactccacactgttgttgtggcggttgggtttggtgctaaagcatgctgggcagtgggggcggatgtagagcataaggggtagggatgagccgacaaagatcgatgcagcatagggatttgttnnnnnnnnnncccagcgacgcactggaagagacacgctgcggggttgagataggctgataccccgccaaaggctgtacaagaggaggaggaatggttgggatctggaggcaacggactccgcaatgagtggccgtccctgcaccctttctggtgctgtatgaccccgggagctgccctggctcctcacattccccacccatggttggaagtccaaaggcgagcccaaaccccagcgccatgtggccatagctgtatccattccccnnnnnnnnnnccgaggtgcacagatgtacaactcgaggcatggccaacctgttcagttacccgcatcaggtgccgtccagaacacaccagcgtacccggataggtttccagcgacgcactggaagaggcacgctgcggggttgagataggctgataacccgccaaacgctgtacaagaggaggaggaatgggtgggagctggatgcaacggactccgcgatgagcggccgtgcctgcaccctttctggtgctgtatgaccccaggagctgctttgactcctcactttcctcacccatggttgggagtccaaaggcgagcccaaaccccagtgccatgtggccatagctgtatccattcccctgaaagaagatttggaatccaatgtatgggccaggctgacagtgcagctgccggccaggggagcagagcaggtcaggttgaaaagacggaaccgcagcacagccctcctacctcctgcacaccttggtcttggcaaggagctcattggcgatagaagagccgcccagatagagctgtgcgatgagatggagcattaaactttgtaggagaggcgaatagtgttgatgtgaccgacccatcatcacaatttatccctagaaggctcaccgccatcatgctgccgatacattcggacccgcatctcgcgccgaggctannnnnnnnnngtcatcacaattcatcccgagaaggctcaccgccatcatgctgccgatgcattcggacccgcatctcgcgccgaggctatacgaataaggaatcgggagatctcctggtaccatgtcgcagggattgtttgaagcctgcgagggccggcgaggaggctacgcctcaagttgggcagtctatccctgactcatgagaatgggctggccacgtcgccattcatgggcacatgatcgaggccaccgcgcggtatcctcttcgacgcatgaatgagacggcttgtttgggtatgttcttttctatcaagccatgcatcattagcaggacgggcgtgcagcctatgggaatgcctgtccctggatacggacatatccgactaggagtaggatctgtgccccgcgaatctcgaggggcgtatctcctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcatcagcgtgaatgtatatctctaggagctgtcgaggtagacccgagggtttgcaggcactggagaggattgggatccactctgagagcattattaattgaggtggaattcttcacctgttttacctgcgtggagtcttactggtgactcaccactgccagagaaccatcttcttccctgccaagccaccacgtccttggcagtccattctaacattcatcgaaaagaaaatcgggggttgatttcagnnnnnnnnnntttaattgaggtggaagtgttcacctggtgtacctgcgggagtcttaccgatgactcaccactgccagagaaccatcctctgccctgccaagccaccaagtccttggccgtccattcttacatttatcgaaaagaaaatcgggggttgatttcagggtttgagaggataccatagtagctggcatgcacacaatgccatgcatgtatcatttggtggaccggtttgcaggaagaactcgatgctgggatggaaaagtgcacggatttgtatgcccccgattcgggttgcggcacaaagcagggcgccggggtttccaggttgggagttggggcgctcggttcaaaacagnnnnnnnnnnagaagaactcgatgctgtgatggaaaagtgcacggatgcatattccccgattcgggttgcggcacaaaggaggggccccgggttcccagattgggagttggggcgctcggttcaaaacagtcccagacgtggctggggttccgtgccaggggagtttgatgcagggggagacaagggcaccctgcgaggcaaaatgcaggtcctcgatggggggggcacagaccgagcggcgtcgcgacgccatggccggcgctcaggagcaggtgacggagcnnnnnnnnnntggagaaaagggcaccctgcgatgcaaaatgtaggtccccaatggggggggggcacagactgagcggcgtcgcgacgccgtggccggcgctcaggagcaggtgacggagccggcgggcacgttgctgtaggcggtcatcttctgcagggcgatgaagaggccgcctgccgcggcgccgccgcagaagggcgccaggatggggatccagccgtaggtgatgaactcgctggggcccttgcctgggatgggcaggatccagtgggcgatgcggggccccaggtcacgggcggggttgagcgccacacccgtgggcccgcccaagttcagcacgatgaggaagatgaagaagccgaggatgaagccgaagagggggctccagagcccacgcgacggctcgtacagctggtttccgcgcgccgcgatcatgttggccatgaccnnnnnnnnnnacgcgacggctcgtacagctggttcccgcgcgccgcgatcatgttggccatgacgagcagggtcacggtggccatgaactcgcagaggaaattccagtggggcgcgtagatggcggggcgggtggagaaaatgcccagcttgatgttctggtcggcgatgagcagcgcctcgtaacgaacctcggcgggggtcttgcgcggcggcgccacgcgcccgccgtcctcgacgtcgatggtggagtgcttggtcatgctcaggctgtcatcacgcgcattggtgcggctggcagtcaccttctccagcgtggcctgagccatgcgggccttcatctcatgctccgacagcgtgcgcgagcgctcacgcaggtgcgccagctgctgctccaccgtctcgcgatccttgagcgaggggcgctgcagagagcgggccagctccgcctggcgcgcctgcaggtcggcctgcaccgtgctcagcagctctccaatgtccctgaccgtgctgtgcagggcctggccggggtgcaggcgcatatactgctccagggggtcgttgttgtagccaccggccgccagctcgccgggggtgaacacgcggttggcgcccgcgcccatcagggggtcctccaggaaggggtcggcgtcggtgacggagggcggctcgggcacgatgttgaagtggggcaggtagatgagccacaggaggatggcgcccaggaaggcgcccgccagctcactgaaggacagggcgaggaactccttcctgtggtgtttggaggtccgtgggaggatgaggggtgggtagcgagggaggggagtgcggtgctgctgcaaggcgggtcctgcattgctctcgcccatcctcgaccctcaggatcgaggctgggcggacggcaggcaagcagacatccacaaggttccagccaaacaacagactccaggcacaagagcttgcccccataccgccacgctcggcaccccctcatgagcatcttacccgttcatattgccgaccacccactggaagaggcaggcagcggggttgaggtaggcagagatgtggctgaacactgtgattgcatggtcgggatgggggggggggggttgaggccctgacttgcatgtgtactggggcaaagattccactatgtaactccacatgcacctggcgcacggttcaatccgctatcccactcactcatggtgacgaagccaaagggcagaccgaaaccaaaggacaagaagccccagccgtagtcattgccctgtgatgccgttgaggggtgaagagagttcagaatggccgcatcgatgaacgtgtactcccaccccgtcacattccgtccgtgaaggttccatcgcagcaacacccaccttcgtcttcgccaggagcatgtttgccacggaagcatcgcccagaaacacctgcatccatggtcgtgcgtggaaagttgtcgagctgcgtactcgcgtgccgagcacggctgcccgatgcacgcatcgccctgcccgtgtcctcccaactcaccgcaatcatcgtgccaatgagctcacagccacagcgggcgcctaggctgtacgtgtagggattctcgaacatgatcccgatcatggtgaaggacttggctcgaagcgaggtgtgccaatgctgtacagaacgaggtagtacggaggcggcgcgccgagcacgagcccgagaccagagccagacaagatactgagccaaacaacaatgaaaaagacaatgggatggaggagattccaccactacnnnnnnnnnnaagaccggatccagacaagatactgagccaaacaataatgaaaaacacaatgggatggaggagattccaccactacttcaagagctcgggtgtgcaaagtttgtccgtgtcagatgtttgtccaatctgttgtgcctgctcccattaataaaccctgatgccgatgcagattccatcaccatcagctttccggccgcgacgggtttgtgggaccggaacttcgcctgtcctcgtattcgccgacgaggacaaacctcacgtgttgcggaccacgcgtttaccacggcaacggagaatctccacaattctgtggatgtttgagctttctgggagtcacagctatctgtagtagtgggttggtatttaccgtgaccggcgtggtcgagatgttgccgattgtgccgtggtgactcggttgatggggagcgctaagggagccctgggtgcctatagctgatgcttcggattagtatcagatatgcccatttgcaatatttttccacaattttatctttccaaacccatggtgccgagcttggctgggaggcctgtccgacctgtgaagtctgttcgatatcgggtacctccggccccgcccgtggtaaaaaactccaggcccaagactagggtttcggtccatgaacagaagcctctatcgactcctnnnnnnnnnnggtatcagatatgcccatttgcattatttttctacaattttatctgtccaaacctatggtgccgagcttggctgggaggcctgtccgacctgtgaaatctgttcgatatcgggtacctcaggccccgaccgtggtgaaaaactccaggcccaagactagggtttcgtccatgaacagaagcctctatcgactcctcactccttagaagcctaacacacgcaaggcttgcgcctgcacgggccacggttaggagcctgccgcccgttatccatccgtctgtcatcgaatgatgagctttcatatgatgatggccctgtcatcgaagccaggatctacaaccaacccttattacaacagggtatctaaacacgacattacattagattcgagcccagtttcagcatgcatcgagtttgtgtgaggcaaggggatccagcatggtggagctaaaggccctgattagggtgctgtaacaaggtcgaaaggtggccgctggacaccggcacggtacattcctggatgactacagcacggcacatcgacaaggtgcacctccagcccgcgacgactcttccttcgaccaggcatcacaggcgcgactgtcctcccctccccttctctgcttgccggtcgttacagtggtttgtcctcctgctggcgggaaaaagccagggcaggggcatcatttcaaaaaacttggggagcagggctcgcatggggtgggtgttcccaagacaaaatcgtgacggcgtgggatcggtgggggcagcggggaaagcggggccaggggtcccccgcagcatcggaacaagacgcgcggcgccggcacgggcgggggtcaatatcactcgcatgcgcaccagcgtcgcgcaatgcacgccggcgtgcatgctcgacacccgtcccccccatcgaacaaccacacgcggtgaatcactctgcctcctcgtcgctctccgccagctcgtccagggccatggcgcgctgcactgccagcttccacttggcgtggcgcttggaggcccactccggcgaggcttggggcgagaagacgacggtgccctcgcctcccttggcctgcgcgaagagcccctcgcgggtccagaacccgacggcgatgcccgcggccagcgcggcgcccagggaggtggtctcttggttggcgggcctcaccacctcgcactgcagcaggtcggcctgcacctgcatgagcaggcggttcttggtcacgccgccgtccacggccaggcggcgcagcctgtgccccgagtccgcctccatggccgccagcacgtccagggtctggaaggcgatggactccagcaccgcgcgcaccacgtgggccttggtggagtactgggtcaggcccacgatgacgccgcgggcgtcggggcgccaccagggcgccagcaagccgccaaaggcggggatgcagtacacgccgccagagtggggcacgctggcagccagcgcctccgactcggcggggctggcgatgaggcccagcgagtcgcagagccaggacacgccctgccccgccacggcgatggcgccctccagcgcgtactcgggcgcggcgtcgcgtcccagctggtaggccagcgtggtcagcaggccatggctggaggccaccgcctccgtccccgtgttcatcagcatgaagcagccggtgccgtaggtgttcttggcctcgcccagcgcgcagcgctggcccagcaccgccgcctgctggtcgcccaggcagcccgccagcgggacgccggccaggggcccgctggccagcacgccgtagcgctccgcgttggacacgatgcgggggaggaggaccttctggaagccaaaggtggccaccgtctcggcgtgccagtcgcaggagcggatgtccatcagactggtgcgcgaggcattagtcacgtcggtgatgtgcacgccgcccttcacgccgcccgtcaggttgtagatcacccagctgtccacggtgccaaacgcgaggcggcccgcctccagcgccgccgccaccgcggggacgtgctccaccatccagcgcagcttgtaggcggagaagtaggtggagacggggaggcccgtgaccgcgcgcaggccgtcctggccgcccaccttgtcgctcatggccttgcacactgcggcggtgcgcgcgtcggaccagacgatggcgggggtcaggggcttacccgtctcgctgtcccaggccaccgtggtctcgcgctggttggtcagcccgatggaaagcacgttgtacttggagccggcagactccatcgtctgccggatggcctccgacacgctcgcgatgatggcctccgcatcctgctccacccacctgaggggaggggaaaggggggtgggatgcgatgagcatgggctgatcagaaaccaacaggccacgccagcatcggacttcgggcccccgaggccctggccacccccacccaggcagcccccaccccgacacgcaaaaccctcacccggcgtggggagtggccgccgcgagggggacctggctcttggcgacgatgttcaggtccttgtcgtacaggaagaacctggtcgactgggtgccctgatcgatggagccgataacgtcttgcaccatctcggcgaaaaggaggcggggtgggagaggggatgcggctgcggggatcgacgccgacgaacgaaaaatcgcgatataatgagtttttgaataaatggcagtgggtgggggggtctcaggtgcgatgcctcgactcctccccggttttgatcatcacgccttgtacaggtcctactcagcacgcacctccagaacccccgctagttcttgctcccagtcagcaacgagaccgggggtccgcaacacactggcacacggcggcacggcgcaaacgtgccctgacaatgtctttcctgcattgtgccggcttcaagctccagagccgacacgagannnnnnnnnngctggcacacggctgcacggcgcaaacgtgccctgacgatgtctttcctgcattgtaccggcttcaagctccagagccgacacgagactcgagttgagattcacgcgaggtttcgcccaacccctgtgtcgaggggaatctggaccgccttcagatcacacggcatctgtacacgctgccaatgcgcagagaccgttacaacgaataatcaagggatacacgggggatgatcgcatgatcttgctacttccttctagacactcgtttgcggagggccaggtcagggnnnnnnnnnnaacgggggatgatggcatgatcttgctacttccctcttgacactcgtttgcggagggccaggtcagggctccattcctgggacatgttgagctgatgcctccagacctggaaaacagcacgctgtatgtgctgctgacattctgggcaatctcggagtggcaaaaggctttacatgcacggagtcagtgtttctggtttctatgtgggagacttggagctgctcaggcagcagccaactgtggcaaggaagcaagccaggctggcctggccagaggagggagacaatgcatggttaaaggggcggaacaatgtacacacaccgctcctggtcccatcggcgcccacggccctgctagagggccaggccggcaggcacattggagtggttcaggtgctcgatggccttgaagagcgcccccgccaccgcgccccccgcgaagcaggccaccagcgggatccagccgtagtagaactcgctggggcccttgcccgggatgggtaggatccagtgggcgacacggggtccaaagtcgcgggcggggttggcggcgatgccggtggggcctcccagtcccaggatgagcacgaagatgaggaagccggcccacattcccactgtttgacaggcagtgggggtagggagcgatggggagggctggaaacagcggggcctggcgtccctcagcaggggtgtcctgacgtaccgcagccgaacgatgcgcatgcctggccctcgggtcactctgaagaggccggccgggggcacagcgcaggcgcacaggctggtgcacctccctacgccgacccaccacttcacgccacgcacagaccgtcaggaggccatgcgcctgtcgatggcgagacgaggcgccctaacaccccaccacacagacccccccccccattatcctcacctgtggtgaggaagagggagcgcacgggctcgtacagcatgttgcctcgctccacgagcagcaggtacaggaggatgagcgtggccgtgcacatgacctcgcacaacgcgttgaatgcctgcgcggggggccggcgcggcgcgggttgtgggctgtgcggcattgctgtcttgtcgcctgcggtaccggctgggcacacccagggctcgcaggnnnnnnnnnngggcattgctgtcttgtcgcctgcgttaccggctgggcacacccagggctcgcaggagacctgtacacacacagcgacggcccatcgcgcgccagacccgcgacagcacccacccccacccaccggcgagaggatggcgggccgggtggcgaagatggacagcttggcgttctggtcggccacgatggctgccttgaacagggcgtcgccacgcgcacgcctcgcctccatcagccgctcggtgggccccgcctcggcctccgcgccgcgcgccgtgcggggcttgctggcctcgggctcgaccctgcccgcccccggcctggcgggggcgcggtacgccttccccggctcggacgtcggcgcgccgtccacaggcgtgcccccgcccagcttatcgtcctcccgctccagcgccgagacgctgnnnnnnnnnngggtacgccttcgccggctcgggcgtcggcgcgccgtccacgggcgtgcccccgcccagtttctcgtcctcccgctccagcgccgagacgctgcgcgcgcgcttgaccgaggcgcggtccacctccagcgccatctcgctggcgtactgggagggcggcagcggctgtcccgcgcccacgttgggcacgcgcagcagtgcctggaagttctgtgcggaggggaacgcagaggggcgggggtggggtgagattggcgaccaggaatggcgagctgcgggggtgcagaggggtccaagaccggactgactggcctcggcgacggggggagtaggcagcgagcaggtactcggtacgaaaccgccccctccctttggggggcccacaggatgaacccacctccaggtccatgtccnnnnnnnnnnaacaaggaatggcgagctgcgggagtgcagaggggtccaaggccggactgcctggcctcggcgacggggggagcaggccgcgagcaggtcctcggtacgaaaccgccccctccctgtggggcccccgcaggatgaacccacctccaggtccatgtccttgatgcggcggtggacatcggcgacctgaacggagcggcggcgcagcgccgcgcgccgcccgtcggatttgtcgtccacgggctccggcgacacggtgtacagcgtggccggcccgccaaaagcctgaggcaggaaagggggaaggggtgtgtgcaggatgctgaagcacagagcggcgcgcagggttgggagcaggggccggcgatctggtgtcacagcgcacgagggcgacggaagtaaacaccgcacacccatccggctcaccactttcagcagctcgtcatggtcctcggggtgcgcgctgtcggcgctgaggaagtagcgcatgtcgtccagcacgctgccgatgcccttgcgcgggccctcgcgccgcgccttgtcttgcccgcgcgtgttgtacgaggcgatggacagggcctcagccgacatcgcgtcgcggctgcgcagcagcaggtcatccacggccttggaggggggctcggggatggtcttgaagtggggcaggaagtgcagccagaccaggcaggcccccaggaaggcgcccaggaactcgctagcggagagggccaggaactccagcctggcgagtgggttgcaaggggaaggaaaggggaatggtcgtgcacgcaaggaggagagggagcttggggcagcaagcctgcacacaaggatgcaggaaggtgatggcgtgatcggacggtttgctggcccatgtctccctcaatcctcatcacccacccattgatcttgccgatgatccacagcgccaggcagctggccgggttgaggtgggcagagatgtagttgaacactgcggtgacagggttgtgtgtcggtgtgaggggctacgaacgcaccgctgaaaagaatggtgctgtgctgggggcatggaacnnnnnnnnnncgtgtcggcgtgaggggccaccaacgcaccgctgagaagaatggtgctgtgctgggggcatggaaccagcgcaggggcctgggcaacctgagggggagcatggactccaaccgctgccaccacaaccacccatgtcaagaagcaacaagccagtcctcaaaacagctctgccagatgctcagcctcacgtgtgatggcgatgccaaacgacatgccaaatccaaaggccacaaaaccccagcccatccgattgccctgcgaggatgcagcgggggcggtgttgcagcggcgtctaccccaaggcgcgctcgtccctttcagagccgcattgaaaccctcgacgaggggccatgcccgccccaccacccaagtcaccttggtcttggccaacaattcatttgcaaggatactctctccgatatagatctgtaaatggggtagacgaggcgtgagctgtgctggggctgttcatggccagtacacgcatcctgctcgcgcacaatggcgctgccctggccgtcacctcaccgtgatgcaggtagcgatgatctcgctcccgcattttgcggccaggctatatggagctatagctggaacgaccaccaaagtcgccatggtgcagcgacgtacaaagcgaccgactcacagtcgcgcagggggccagtgaactggtgatcacctaggccaatccgagatcacctgttagttgcttgatagggccttctactgaaataatgcagggtcatttccaacatgagcatgtgattctggtttnnnnnnnnnntttgacagagccttctactaaaataatgcagggttatttccaacatgagcatgtgattctggtttgtgtggatgtgcgggatgtaatggttccctagggcaggggggtcaaaaccaatgttgcgcgcgctcctggcgagctagaaaaactccgacaacgcttgagagctcacttgtcgagccatgtcctgattggcatacgtggtactaagatatcgctgtttgtgataatacgcctctcgcttacatcgtgggacctgctgcctccgagcacaccgatgtcgcgggcccagttgctccagcggtcctggagcgaggctgcagcagcgtaccaggagcacatggtgccccgcttcgtgccatggacacttgccactctggatgcctttgggtcgacccgcattccggaaggcttggtcgtggtgccggcttgcggaccaggtggggcagggcaaggcaagagcagagtctgccctgctcagattcgtatgtgagacacggtgcaagcctggcagcggtgtccccagctcttatgatcacccctggcgtgaccaggaggtaccacatgaagcacaactcatcgtggaagctgcttgcaactccactccgagctgcaatgcacatgcaggtcaagagctgcctctgcttgcagacctgctgcccaaccatgacatcctcggcgtcgatcttgctgaaggcatggttgccattgcaaggcgagtcatccagcatcaaaacctcaggtatgggttgacagatagagcatgccaagggcctgcagtcagcctgcaaacgaacgtgatgggaacactccccctctgtcctcccgacacccccctccctcacattccacaggcgggtcactgccatggcaggggatgccaagtcgctgacacaactctccggctcccgtcccatcaccggcatatactcctgcttcggtctgcagatcatcccaggacctgcagagaccctcaggtcctgggctgccagcctggcaccaggcggcaccctggcagtcacctactggcccgaaatcgcggagcaggagggaccgtggcgcacactcatctccctgacaccacccgccgacaggccggctgactgggaggtcggcatccccggtgaagccctgaaagagcccggagtggagctcgtagccgacaagggactggactttagcatggagtggcccagtgcaggggccttctttgatgtgaggccatggagcagggtgcaagaggtccctgtgtctggttgaagccttcattggtacccagcagagaatcagagacgtcctgccagcccagggcatttgggccctgagggtctgggatggacagaatctacggcggtcccgacagattctgctctacacacatcctccattgtcccaattaatgaccctcatcctcctctccaacccgtcgtcttcaccagatcctgagcacggcaggcccctggagggctctggccattcttcgtggtcccgccttcatggaggagctgcgcaggaaatttctggccacatgtccggaagcagatgccgagccgctggtccacaccctcactgcgaggatgattgtcttgagaaaggctggtgggcagtccccctccaagatgtgagggggaatttggacttgttcatgggttgggacctgcaaagagagtgcacctcaaaaattatacaacagccttccgcagcttgctgcnnnnnnnnnngttggacttgatcatgggttgggacctgcgaagagagtgcacctcaaagattatacaacagccttccgcagcttgctgcaccaaccagtgataatgtaatgcagtgctttgaactctacatctggtcaaggtgaagctttagtggcactgagggtgcccctttccatttcaggcaatgcatcccttcccaaattcgtgcaattccccctaaccctcctatagcattactaaacctccaggtcaaatcctgtcagcctggctgatccgggactccatctttgagtnnnnnnnnnntcctctaaccctcctatatcgttagtaaacctccaggtcaaatcctgtcaacctggctgatccgggactccatctttgagtcctggacgaacctctgagaaactacgtcgtcgctcgtcaggacgagtgggacttgatgattggaatggtggagttattgattatcatgttgattcacagagcctcttctagaactcacacaaggggttgagcaaatggcacatcgcaagctaatgcctcccgctgggtttgctgcgccactgtcagctgtttacgtacacctccagctcccgccatgtaggtccaagtgttacacctccctgcgcgaccccttcgatcgtaagatcctcgaataacatctgcagataattgacagatatggccgatgagaatgtctgcttgagaatgccacaccaggccagtttctgcccctggattatcttgtgcatggttcctcgcagtgaccgacgtacatgacatgnnnnnnnnnnttacacctccctgtgcgaccccttcgatcgtcagatcctcgattaacatctgcagataattggcagatatggccgatgagaatgtccgcttgcgattgccacaccaggccagtctctgcccctggagtaccttgtgcatgattcctcgcagtgaccgacgtacatgacatgggaagccccatcaccctccagcgttcatcattctgcaaacgagcaggtctggccctggcatccgtcatcctcacatcgacacacccttgtgtcttgggacacgcccgaggggctggacaacataccatgcgggagcggactgtatgtgccgacaacacggccctcgtcgaggagttgcggcgtaagtggtgccatgccgagactgggggctatcattttgcaggcttcccaaagcacattatcaacattgaaccacagggcgaggcgttattcagagcgagaaggtggaacggggcatgatggcggtcgatcgcggcaatttcgccagcatcccgcaggcaagtcctcggtgtcggatcgcccgccgccgaaacatgtgctcgatggcgtcactgacaccttttggccattactggacactcacagatggcatacatggatgcaccgtcccccatcggtcacggcgcaaccatctcggcacctcacatgcatgcatactgtttggaagctctgagcccttggctgactccaggtgccaaggtcggtgctcataaggagcgaccaccctcccagctgctgttctccaaaagccatccgtgggagatcctgccatgtttgagatggaatctccaatgatgtagccttgttttccatgacgatgttttacaccatttctcccgggcaggtgctggatgtcggctcagggagcggatacctggcggctgtcatggccaccctggtacaggacagaggttcaaaggcccctggcctcgtcatcggcgtggagtacattcccaccctggtggaggctgccctccagagtgcggagcgggaccccacctcgcggtctttgctggatgcaggtgcgtctcgggagcgccacgatgactggatgggcacgtgcaggcatgcttgcaagtcctggtgtgtctggcggaggcagggaagacctgcagggtgtgttgctggtcactgccactccctgtggcgcccacaggcatcctgcagctcagggtgggggatgggtggcagggctggcccgagtctgccccatacgacgcaatccatgtgggggcggcagccgccacggtgccacaggccctggtgcgccagctggcaccaggtggcagactggtgttgccggtgggccttgatgggcaggagcaggtgggtggtgatgggggttggtcgtcaatgctgggaataagcagtggaatagagcaggattgtataggattgatggccaccttggatagcacgagtcctcaaaagtctgaannnnnnnnnnttggtcgtcaatgctgggagttagcagtggaatagagcaggactgtataggattgatggccactttggatagcacgagtcctcaaaagtctgaannnnnnnnnngggatgctgggcagggttcgggggtggtagctgcagtgcccgcctgacgggaggagcaagtgacagaatccctacaccccattcgccacataccctgtctacccaggtgctcactgtggtcgacaaggattatacaggccacgtcaagacaaagggcctgttcagtgtgcagtatgtgccgctagtacaccggaatgaggcttgagccctgttgtggtcctggcggcaagnnnnnnnnnnaggatgctgggcagggttcgggggtggtagcagtgcccgcctgacgggagtagcaagtgacaaaatccctaccccccattcgccacataccctgtctacccagnnnnnnnnnnatctgttctcaggagcgcagttccttgtgccaggaggttgcaacattggcaaccttggcgggcgtaaaggtgtttttatacgcagaggttttgaagttgactttgacggcgaaggcatcatgtcctttcatgtatattnnnnnnnnnngtctgttctcaggagcgcggttccttgtgccagcaggttgcaacattggcaatcttggcggacgtagaagtgttttcatacgcagaggttttgaagttgactttgacagcgaaggcatcatgtcctttcatgtatattttgtgcacagatggggccactccctgacagaattactttccccttgaccccaggcaaagcagggtgtatcatgctgaaggttgaaccctgtccccttgcgtcatattgtcatcgagggtgtgaatgtatggttgtcgtgatatgaagaaatcagagccgggcagaannnnnnnnnncaaaccctgtccccttgcgtcatattgtcattgagggtgtgaatgtatgtttgtagtgatatgaagaaatcagagccgggcagaatgcactcccagaggcctggatgatcccggcgcgccggaggatcctcgagataaagcgcgaggggcgagggggctagccgggtgggtcgcgagccctggaagtttccaaagttactgacttcgcgcaggctttgttttattgcataattgcgcatgcagagttataagttggagacgtagcgtgaccagattcccatgcagactcttgcgtgctcgaggtgcagcgttgggtgcagcccaagcaaccaacgattcaacggctccatcaggacaacctccaggacaaaacagtactgctccctgacctccacagcatctaccttcgccgccccctgggcatcccagcatgggccggctcgaccaacacacgcaggcatgccccttgcgtgcggggcgcgatgtttcaactggggtccagtgcttgctgcagggcaccctcggcatcgtaactggcgcattccggcgcgcatgagcgtatcttgagtagctattgacattggctatcaacgttcacggttccgcagggaggacacctctctccgtcgttgccgggaacaaagccacgaccgggccctttgcccccatagtgcgcatcgtcagagacaggctgggaaccaaaaaatttaaccagctccgtggcaaggccatctctctccattcgcaaggtagggtgacctgggaagcatttgggttggattgtgcatgatgtgctgggagcaggtgtgccggcttgcctccttgcctagtgcatcaagcccagcgctgtccacttgggcaggccttacataaagggcattgtgagatggcccgccaagcactgactcatccgtgccttcccaacatcccccattttcacagtcatcaagggtttctgtcaaaagattggagtgagcaattctcaaagtcaaggcctgatccgcctagcaaagaaaaacggagagaagcttggtttcctggcttaatttgggagcatggcgtggggactccagcacggccagatgtgtgcgagctcccgtgtttctgagtgtcagagcatggccagcggtcaaagccagggctgaccccatcgtggtactgcttttcgatcatcaatgtttcagtatacatccagagcagtgtctcaagcttgtaaatcctttaccaacgggaggcaccatcaacacatgaggtattgcatcagatgggtgcaggggccagtttagggctgtggggcaaagccgttctgcactgacatgcaagggctttttgtatcccaggctggtcttggcggggagcaatcactcttgggcaatgctgctcaaggtttcttgtaggaatgtctgcttgtccatcggtatggcagaggcaggtgtatcatctgtgcccggcggccatttctcgctcggaggctgctgcagcttccatttgacgtccttgtcggacacggcatttgatatgaatcggttcactgcggctacatccatctccaaggttcgcctggaggttgccagctcatgcgtccgcaccgctttcctcactttctccacatactggtccaatcgtgcctggtggattaatgggtctgagcaggtgttggaccgatggacccacgatgtcagggaggaccgcaccagggcccaaagctgagtgtgaacaatggtagggaagcagtgtgcagcactgctaaacttgcagaatcttttactgcaccattcactatagcctgggagcagggagtggtcccatcaccctgtcctgtgaccccgacatgcctgctctttatatagctgaacgtgtgagtccgggtccctcccatgcagctgtgaatggctacgaagcagggggttcgcccccatggctagcgccaggagggcttgggcctggtcgcgggaggcaagggcggagccggcgatgtccttgagggagagggagcccagtccctccatccccgtgctcagctgatccaatgacgcctgcggtggacatatagacgtcattcatcttatataagatggtgcaaacgtatcgcaaaaatcttttgcgcacctccaagcgactgagctgtgcctcgacgtccttgggtacctcgacatccatggcgctgccagctccttcgatgaggtgcacaagacgagcagttcagtaatctcgtagaacgcgcgtggataaggcgctgcaagacttctgtctcctgtgttttgctgccgtagagcatccaccctgcatcagggtgtccctctaccgggatgtgggcgcgcgcgatgtccatccccgaaacaaccccgacaggtgctccaggtcccagcccctcgcaccaggcttatgcacatggcatgctgcttattgaagttacggatctctacatcaagggtttaatgctcccccagtgaagctacaggtgcgcccacgagttgagtacactcccgagcgtggccggcctcggggaggaggagggcatggaggtctccaccgaggacaaggtgatgagtgattgataattttgcttctttaaatgggtggcagactgttaggaggcgtgagcgcgctatcctctcctccagacacatgttgtttccttgctacgccctactgatgatcactccacgccactgggccggagaggaatgtggccgatacccgcactaggacccattaccccgctgcttggagaagagtaattgagtggtgtgtcatcggccccttccatcccttttttctcccaggtgatgctgtcaccggcccnnnnnnnnnnctgtgtcatcggcccctcacatcccccttttctcccaggtgatgctgtcaccggcccccagtaccccccgatccccccatgcggaccagtccgatgtcctctccgccgaggaggtcgtggcccgccggtcgggggacgtgctcctgcgccacaccatcctcaagggagaccacttccccggtgggtagcaggcctaggttggggtgctggggggtggggccgagggcgcaccgcgtgatgaggggtgcctcggcgggctggggtgttgggacgggcagctgtgttgcctcgagtttatgaggtccattcaaaactcacagcctggtctcctgccctcaccccctttcgcacctgatcttccccccgtgtcttcccccccctcctctgcaccaccccaggctgccagaacatgaagctgcggccgctggtggatggcgcgcccaacttccgccaggtcccggggctccccgtgtacggcgtggccatccccaccgtgcagggcctgcgccgggtgctggacctgctgggcgcggccaagggcaggcgccgcgtgctctggcacagcatgcgcgaggagccggtgctgtatgtcaacggcgcgccctttgtcgtccgcgaggccgacaagccctttgccaacctggagtacacggggattgaccgcgagcgcgtggaggccatggaagccaggctgaagctggacgtgctgcaggagtcggcgcggtacggggcccagatcctggtggccgaggaggacgaccagttccaggtggtgcaggcctggcagcccgtcagcgaggccgacgtgcagacccccgcggaggtgtaccgcgaactcatcggtgggtggggcggatggggaaagctggaagcgatacattgttctgtgggtgtgaggggggaggattatgtagggggcatgcggggttcgcagggagtgtggcgctgtgatgcaacaacccatggcgcacagggggatgcccggcgcggtgcatggagcgccgactctgtgcgtatgaggaggggtgctcggcggacgtgtaccgnnnnnnnnnngtatgtagggcgcgtgcggggttcccagggagtgtggcgctgtgatgcaacaaccagtggggcacagggggatgcccggcgcggttcatggagcgccgactctgtgcgtgtgaggaggggtgctcggcggacgtgtaccggacagtatctccagcgacacgtgactgcctccgccccaaacagaggacgggtacgacatcgactacctgagggtccccgtaacggatgaaaaggcgcccaagggccgggattttgacgccctgatcaaggtgatgcctgggagtggagggggcgcaagaggtgtcctgaggggatctgacagcgcatctgggcagttgtgggggtgttccataggcggcatggacccgtttgagcgtcagaggcacgctcatccttcacacacacacaccctccaaaaaaaacatatagaggtgctggaagccacccaagggcgctgcgctggtgttcaactgccagatggggcgggggaggaccaccacaggcatggtgatcgggacgctgctggccctgcgtgcgggccttgccgcccgggcgggcgaggaaaggacgtctggggccggggcgaaggtcgagccaggcgccaggccctccatcccccggtccttctgggacgggccgccgcagcaggcgctgggcgcccccttccccgactggtttgcggccgcgccgggcggcgctgacgaggatgccagccccgccgcctcccccgacgtgggcgaggcggagctccaggccggcaactggggcgcggtgcgctcgctcctgcgcgtcctggagggcggcgccgccagcaaggtggatggggagggtggagaaggaggggagtcggtgattttgatggaatggtgatggcagcgcccagtcaccggccctccctggttcctccccatgctaccttatgcaatagatgactcacccccatgactaacccccccccaaacccacctccaggccgtgctggacatggnnnnnnnnnnggggtggagagggagggagtcggtgtttcgatggaatggtgatggcagcgcccagtcacaggccggccagggccctccctggttcctccccaagctaccttatgcaatagatgactcaaccccatgactaaccccctcccaaaacccacctccaggccgtgctggacatggcgctggacgcgtgcgcgggcatgcagaacctgcgcaccgccatcctggcctaccgcgaccgcatggcctacgagcgcaacgacgcgcggcgcggcgcgctgctcaccgtctgcttggagtacctggagcggtactacagcctcatcgcctttgcctcctacgtgggcgcgccggggtacgaccccggcgacgacccgggctacgcgcgctggtcggcgcagcggcgcgagctggcctccatcctggagcgcctgctgcgcatgaacccgctggccgccctggcgctggacgacggcggcggcggcggcgcgcggcgccgccccgcc

SEQ ID NO: 42622 - DNA, 61 bp, Chlorella protothecoides
tcttgcaccccagactggtgcctgtggctggtgcacccactgtgaggaaaatcccgggttt

SEQ ID NO: 42623 - DNA, 131 bp, Chlorella protothecoides
gggggggcgaagggcggggttgggtgggtgtgggagcaagctgggcacagtcacagagggaagtggcccgcattgagcaatactcagaaagtaccaaggacactctggagtcacgctcccgctgactcctc

SEQ ID NO: 42624 - DNA, 66 bp, Chlorella protothecoides
cgcccctaccatctcatgctctcccccccccccctttcctcaccaacgacaggttttgtcagggtg

SEQ ID NO: 42625 - DNA, 80 bp, Chlorella protothecoides
gatgatagtgcgctccagcctgaatttcggcgacactgctcatgacctgatgtttgtcaccctgattctctcatgcgcag

SEQ ID NO: 42626 - DNA, 61 bp, Chlorella protothecoides
cggtggcgatgccccaggcggagaggagggggatcgtggccagagcgagcttgggtccggc

SEQ ID NO: 42627 - DNA, 64 bp, Chlorella protothecoides
catccatgagatcctccctgccctgcacaccctcgtctccgcccagcacccccgttttccccct

SEQ ID NO: 42628 - DNA, 18068 bp, Chlorella protothecoides
  modified_base (109)..(118): a, c, t, g, unknown or other
  modified_base (1285)..(1313): a, c, t, g, unknown or other
  modified_base (1591)..(1600): a, c, t, g, unknown or other
  modified_base (2282)..(2341): a, c, t, g, unknown or other
  modified_base (3096)..(3105): a, c, t, g, unknown or other
  modified_base (3282)..(3291): a, c, t, g, unknown or other
  modified_base (4176)..(4185): a, c, t, g, unknown or other
  modified_base (6485)..(6494): a, c, t, g, unknown or other
  modified_base (6546)..(6555): a, c, t, g, unknown or other
  modified_base (7367)..(7376): a, c, t, g, unknown or other
  modified_base (9711)..(9720): a, c, t, g, unknown or other
  modified_base (10428)..(10437): a, c, t, g, unknown or other
  modified_base (10586)..(10595): a, c, t, g, unknown or other
  modified_base (12004)..(12013): a, c, t, g, unknown or other
  modified_base (12102)..(12111): a, c, t, g, unknown or other
  modified_base (12178)..(12187): a, c, t, g, unknown or other
  modified_base (12243)..(12252): a, c, t, g, unknown or other
  modified_base (12510)..(12610): a, c, t, g, unknown or other
  modified_base (14324)..(14333): a, c, t, g, unknown or other
  modified_base (15629)..(15638): a, c, t, g, unknown or other
gcggagtgaagtacctgggcagggttgcaggaggggaaagggtgggaaggcgaaatgtaggaggacgagatatccctgctgatgggacgcatcggtgggcagggcatgnnnnnnnnnnacctctctatgcagtacatgcctgccagcgtgcccacagcattcacgccagcagggaagagggagagcaggagcaccgtctgcttgttccgcacccctgccgcctccaggatcagcggagtgaagtacctgggcagggttgcagaggggaaaagggtggaaaggcgaaatgtaggaggacgagatatcctcactgatgggacgcatcggtgggcagggcatgcagtgcgtcgagtggctgggggagcggccaccacatgagccctcctcgatcccaacaaggactgcgcccccgaacgccccatccctcacatgacggtgttgatgccgcacagctgctgcagggcctgcagacccagacctgcaaggaagcaggatgagagggagatctgaattaacgttcgcatgcgcccgaagtcccgtgtacttcgcaaaccaagccgtgtcgcctcgcattcaatggcccgctcgggattacagccccctccccctgccgccgacccgcccagttccgccctttccacccgcccgctgccctcaccgacgtgcagctggcgcaggacggcgggccgcgccagctggccccagtgcgtccccccgctgcgctttctcgatggcggggcgggcaccatggccagccccgccagctgcactagcgggggcagcgccgctacccccagcatccagcgccagctgcccggtaggtgtgcggcgccccagttgacgacgtacgccgcaaactggccgccagtgatggcgaggacgttgagggagaccaggcgcgcccgcagcggcggcggcgccagctcggcgatcaacaccgggacggtgacggatgcgacgcccacccccagccccaccagcacccgacctgcggggggtggggaggggggagagagagtgaggaagaaaagagagggggttgcggtcggttctgggatgagggacggggtggtcgtgggcaagtgccaggtctgtttgggcagggttttgcacccaacccaggcaatgcccccggccccagcctctcacccaggatgaggacacgcaggccctgcgccgcagccatggccagggcccccacgcagaagagcccgtctgcgagggccagggtgccgcggcggccccagtggtcggagaggcggccgcccgccgccgcgcccgcccnnnnnnnnnnnnnnnnnnnnnnnnnnnnnaccaccgccgaggccacaatggtctcctgcacgcgagccaggcgggcggggtggccggccaggggggccaggagggagtcgcggatgtagggcagggcgccggagatgacgccggtgtcatacccaaacaggaacccgccgatggcggcgatgcacgtgatcaggagcaggtgcctggggctgcggggagtagaagggtgggcatgtgtgccgtgtggacctgggaaggacctgagagtagggagtacccacgacctggcggcggcagggggttagcnnnnnnnnnnaggggagtagaagggtgggcatgtgtgctgtgtggacctgggaaggacctgagaatagggagtccccacgacctggcggcggcagggggttagcctgcccaaagcacctggccatgtgcatgggtgcctcaccggggactgggtggaggttcagggccctgggccggatcatggcgcggcgaggttgcgagcaggggatccgtgtcattcaagacctcgagcacagtctcccggggctgcatctccaccccgatctgacccgatgcggggcgcgcaggcattcacacggggctggaccacctaccagccccgctgaccgcgagggctgcccatgtgctcttccacatgatccgtccgatgcacgagccaattctgttgagtctctgccgctgatcttgcacagggagactggcttggatgcctggccagctgtcgacaccagtcgtgagatcgagccgcgagatcaagcgccttgccaatacagaattggtttcgtgcaatcgtgggctccctcccatctccgccctctttacaggctttgggcaacgcacacgcctcacacacgattactgtccacgcatcacggctttgccaagtgtgagcgcggcacctcttcaagggccatggacttgagcaggaagaggcggtcggcgcgctgcgccaggctcccaccccccttcannnnnnnnnnnnnnnnnnnnnnnnnnnnnnnnnnnnnnnnnnnnnnnnnnnnnnnnnnnncgtttcaagcgatccagccccagagcctgcagctccgtggcagaggcaaaggcacccaggtcgagggcgggctcctcctcagcaggggcttctgtggggggcacagccctggcagcgtgctcgggagcgctgcctgccaacgcagcaccgtcactgcctcgcgccccaccgccgtcgccattcgccatctgctcgcgcccctcctctcctgcctgctccctcgcatccgcaccagcggcggcaggcctcgacccaggctcagggccgtcgaccgcggtgcgaggagaggcagagcgcccctcccccgccggctgcccctcctcatcctccgagtcgctgccatcggacagggctgtcagggggtctatcctcccgcgctttccgggctgcgcgccgcccgtcgacccaacgcgcttcccggccgccagcgctgccgcgacgcccgccgacacgtttaggaggctctgccgcaggtcctggcgcacagtggccacgtccacctccgccttctggctcgccttctcctccttggccagctgcttgagatggcggagggcgatcacctccagctcccgctccccggcctgcgcctgccactcctccagcttcttggctgcggtctgctgcctggagtgattgaacgagggggagaggggaaagcttaaagatccaggggagatgaaacatagcaggctgggcggggttcgcccagtcgagacctctgctcggggttgcgcccgcgggtatgggagcannnnnnnnnnggggggaagcttaaagatccagggaagatgaaacacagcaggctgggcggggttcgcccagtcaagaactctcctcggggttgcgcccgcgggtatgggagcaggcagacaatgcagcgggtgtccctgtcggtgtgaagaacccagaccatgccaggtccagtggcaccccatctnnnnnnnnnntggcgtccctgtcggtgtgaagaacctggaccatgccaggtccagtggcaccccatctccacgtgccgtgaagtggcaactgggcctcccacagccagcctcgacccgcggaccctctcctcccttgacactcttcacctgatgcggcggccctgcagatctcggcaagcgtcgtagttgtcggtcatcttagcctttcccgctgcacgcagattggacccgaagccacccttgccgccccgcagccggccaacaatgtgcagggaggatccatgcgagatgcccaggctgcatagtgggagctctccaggctccaccgtccggctgcagtgcagcaggctcacgtccggagcgccctcgagacaggccctcgtgtaaagctcatccgatgtgctgctggagggcagggtcagcacggtagtgcgccctgaaggtgagaagcgagagccacggggtcaggaacctgagatggcctagggaagcaggatgactgaaatacaacagaacaacaagattcatcgactgtgatccataccttcgagacacctcaagaagagctgcatgtcgatgtgccgggattcgagcgttgttgcgtttcgacgacagacccacagccttccggtgcaaggtatctatcgctgagagatgacggggccgtgctgttggaacaaactatgaggtgagaatccagaagctccagacaccccagtgcgagccctagaagaacttgcagaagaagtccaagtgaatgggaaggcgaggcgggaactcttgctgcgcgcccccaattcgggagtgggggtgaagtctcatttacggcatgaagcagcgacgccagatgggaattcatccacgaccttgcatactgcgactaggagtaagcannnnnnnnnnagggtggagtctcatttatggcatgaagcagcgacgtcagatgggaattcatccaagaccttgcatactgcgactaggagtaagcactcgagacggtagtcgcgcgaccgcccgcagcatgtcgtccaagagcaaagcggctgccccagtggcggacgctggggagcccagcacgagcgagaggaatgagcctggacgtattgtgtacatagggtaaggaaattttaatattccatatggcatacaggtgtgccatgcgggctgacccaagaagggggggggggttggcatttgaccaaagtcacccccccttgacaccacgttctctgcctttccctccgcacagtcacctgccccatgggttctacgaaaaggaaatgaagggtgagggggtgctgatatcgcgatgatggagaagatgggagttgcagtttgcctctctgtgcagggctttgagggagcgaagccatgcgcggtgcctcccctcaactcccacccgaccctccctctggacagcctacttctcccaattcggccgtgtgaccaaggtgcgtctgtcgcgcagcaagaagacggggcggagcaagcactacgcgttcatcgagttctactctgcggaggttgcgcgcatcgccgccgaggccatggatggctacatgttcttcgggcagaagctgcaggtgggtgtggggatcgaagcatcactgtgcctggctcccgagcaagtgctgagccctcacggcagccttgttgggtgcagaggcaaggtgtctttcatgtcgaaaccaaacgatgccgcgccactgtcactctgcccccgcgcgcaggccaagctgctgctccccagccaagtgcacaaggacctgatgaagggctccaaccgcgtcttcaagaaggtgggctgctaggccgggcgggagggggggaacagggagatcgtggcgcccgctcagcacccggcggtcagtcggcagccgcccagagcacccgacccggcccacgatcgcaaccccatgctcgcaggtgccctggaagaagatagagatggagcggcacaatgtcgagcggggcgaggctgcccaggccacgctcctgaagcgggcgctgaggaaggacaggctgcggcagcagaggatcaaggaggtgggccggggtcctgttttggggaccgagccgggggtggatatgcggctgggaggagcatcgtgcagggggcgatcgaggggctgagccctaggccgccaggcgctcctttcttctggattggtgctggagtgagtgcctcttcgtgccgcgggcgagcagctgtgaaccagcatttcacccttcccctgtgcaggccggcatcgactacgagtaccaggggctggagagccggttgccgcgcgccgccgtgaagaccacattcgaggactgaaaccgccaggcgcggcataccccatccccgtcaccgtgcggggcaccgcccctcgcacttctttcagacccttccaccaaccacttctaccctgcacgctacgagctcgttgtacagcaacagcaattcctcataaaaattatccgacggccagggtggggcaggacgagtgcacgggtggcatgcctccgccggggccatgcccgccagtggccgtcaaagaagaaggcccgcaagcagtttgcacaggaaactgtgtcaaaattggataatagcttggtgtgcgggggggttgaaggggggtccaggacgctcagtgggaggcccaaagcgatgagcagtggggaaggcgtgtcagcccaagggatgcgtgtgcaaaggtgcgacgcgcgcagaaagaatagacagggtgccgctgcagcctgctggcagcagtgtctcgggcctgacggtctgtccaactggcacaataagtagggaacaatggcagccacgccctcactcctggagggccccaagtgtgggtgtggggctcccgcagatggagaagccccggaagggatgtgcgcactcgcagggtaggccacacaatcgagagcatggggcaggtggagctgtgggatgcatgggacaaggccctcagtcctcggccctgatctgccgggcgtgggccttgggtccggttcccagcgtgcccagcatggcgttgatggagtcagctgccgactggtggtccatggtgaggcccagccggctgggaccctccagcggcgccaggcggcagcgcttcagggctgcgacggcgagggtgtgggggtcggttgcggggtgtcaatgagagggctgggggctcaggggcgcaggagaacgatcgagactctgnnnnnnnnnnggggatgcataggacagggctctcagtcctcggccctgatctgccgggcgtnnnnnnnnnngcggcgagggtgtgggggtcggttggggggggttcgatgagagggctgggggcacaggggcgcaggagaacgatcgagactctgcacagggactcacccctgtcgctgctgaagatggtctcggaggaggcggcactcgggggtgtggcaggtcggtcgtgggcttcagcctcggcgccacgcttcaccggcttgcaccctgcaagcgggagggacatgtagctctgctccttcctgtgggcagtggcagaggagcgggaggtttactggggcgcctgggatctgagtgagaggatgaggccaagcgcagggcagcatgggaacgattaaaatcgcaggaaacggaaacaccaacccaacagacgtccctgctcctcattgtgttcccaaacctgcagatccgcatcctcccaacataccacaccaatgtcttacgtgatgggactggctgcgggtgtgaagagcagggcaacctcgtcgtcagcctcatcgtcttcatcagagtctgccgagggaatagagtgtcgagcagccatgaggatacaaatgggaagctctggcgccaagcagctcatcattatgccgtttgaagttccatccaggtgacggaccaccaggtacctttgacgctgcgttccagctccaggacgccctggtggctggcagtgagaatggcctccagatcaaaggcgtctccctcaaccccctcccagcacaggggaaggtcgtcggtgtccggggcccagggcgccgacactgtgtgatgttgtgggaataaattgagagtcaaggggtgccgcgcatgggggttnnnnnnnnnnatggggtgttgtgggaataaatagagagtcaaggggtgccgcgcatgggggttggcgagagtttcacgcggtcggggccctccgatgccaaacaatggtcgctcgcaccttgcgccggcatgccacacccgcgcatgctctcccactccatgctcagacgaagctgttgggagggggtggggtctccgtaaacgtagtgccgggggtccagactgatggacgcctccgagcccgaggctccccggcgaggcctgactccacccccattaggagaccgcattgcggggtacaacccaagcgagtcggcagcagtctgcgtagaattgggttgggagggtgaggtgaggctttcccggcaacaggcgatggtaatgaggctcgggcgaccgagtctgcatgggcaaactgtctccccccgggggcaaatgcagtgaggggcccgacgcaccggtgtcggacggatcgtcgagaggtgcgctaattatgatgtgatctgatccacccctttgagcggcgcattggcccggtcatggtgttgaggccgtcgcccgcatcacgccgacgcaggtgtcgggagggcgtttcgccggggacgaatgcgtgggtgtactgccaatttgccccacgtggtacttcctcgcccggtcaacagtccgagccagcttggacagcgtacccgagctgctggccagcctcaagcagccagccctgatccgacggtgccacataatataagttctgactgagagccgagacagttgtgtttgcctttgctgcctccctcctgcccatctgattcgcttgcttttcttgcatgggtcagaaagacttgacagagcgagttttctgagggagcttgataaaattagagagtttacctcacgaactgacaatcagttggagattctccgaggcaacactgtctcagggagcgcccaggccccctctccttcgttgaaaggcgggggcctcgaccatgaaatggtctgtcagcagacggtgcatcgtcttgtggcatgtgtactgtactatggggtcgtgaaatgttggctggggatcaggagatgcggaagggcaggggagaggaaaatcagagagagattagaagaaaagggctggaggaaaaagaaggggaagtacagcaaccggaccacggacggggtcttcttattgtatacatccaattaccgtgcagcgccggacaaagcccagccgcatttcccccctcatgggacgggcccctgcaggcacatcgagctggcagtgcagcgatgtggtgagctgccggaaggggcctcagagggtctcaggcgtgcccaaaaaacgcctaaaagcagtgtttggcctgaagtgaggagagaaagggagagagaaagggagaaagcagcggggtaaccgctgatgtggttggaaaaaagggtgtagaaaaggaggcatgagtataaggtgggaggcagacggtcgccttcactccctgtatcttaacgctcaagtgggaggaactttggtgattcatacggagccgggagacagcgcccgtttcactgcaggtgggcaggaggttgggaggacggaggctgagcgatgggggcagtctggcataccggcaactgcacacgccgtgccgagacggtgtgcgcaggctcatgcatgccgagtgggtagttgaggttccccaaggcaagggggaggtcctcacaatgggccagcaacaacaccaccctgtacgcatgtcggaaccggcaagtctgcatcaacactttgcaccgtctaagccactgcgtcccttcctaacacccatgacgccacccaccagcaccctccctaacccagccagtggcagctcacccgtcaggaacttggtcccgactgccctgccgttcagggcctgaattacgacatccgtgacgctggtgtccacaaactcacaaaaggcatatccctgcagcatgcgcgggggggggggggaggggtgggcgcacaccattgtggctggtcgggacatgtgggagccggcaccaaggtctcttcatccatgcgacaagggctgaagtcctcatcaagtcccggtttggcccatggggaaaattgacggggctccagcaaaccgacatgacggaccttgctgttcccggtcgcgcggtccttgacaaggttgaaagccaggaggcgcccaaatggcaacaacaactcttggacctgattccccggtggaggggggggcagcgtgtttaacgactgagggaggagcaggggcggccaggggtacacaagcccatctaaggcgcaccatcttcggctgcgcagcatcccagcaccaggcccacctgttccnnnnnnnnnngttccccgggggagggggggacagcgtgtttaacgactgagggaggagcgggggcggccaggcctacacaagcccatctgaggcgcaccatcttcggctgccccagcatcccagcaccaggcccacctgttcctcaaaccactcgcagggcagcccgccgatgaagatcttgttcggcgtgtcctgtgcggggcgaggaggcattgccgagggggtggttggaggcaggccgcaggtgaggctctggaccatgactccagtcctcgtccctgcacagccacttccccctccctgccgtgccccacaccccttcaacccccgcgcctcggagaggcggtccaccccatgcaaggcatgcgctgacgagcccacccacgcccctcgcacacctgcaccatggtgcggatgatgcccatgcgcggcaggtccatgcacgggttgggatccacgggtcccagcatgatggccagcccagggtcgtagttgtttgggcggcggatctggcggcgcgggggcggggggagggcgtgagtgacggggcaggggcaggtgccgcagcgccggggcgggcgccgcagggccgtggcgggcgcccctccgccagcacaggcagccggccgacggcacgcggcgggcatccaccgcatcatcagccggttcccagattggggggaggggggggatcccaggctgcacggtgacgcgcgnnnnnnnnnncacatcaggtcctgggcggcacagccacctcgcagcagccagggagacctcggcgccggggacgcgaccagacacccgatgccggaggctccccgcctccccacccacgcaccagcctccctgacctcaccgggaacagcttgcaggannnnnnnnnngagccagtccactctcacacaccccgtgagccccaccttgagggggttggcatggaagatgaccccgtcaagggccatgaggttggaggcctcctctatgctgcgcagctccaggaaggcgtacgtcctgtcggcgttgttctgggccatgtgaaggcctgtgagcccgccctcggaggcgccggggtgcatctgcgggtgccgtgggtggaggtccggggggcacatcaggtcctgggcggcacagctacctcgcagcatccaaggagacctcggcgccagggactcgaccagacacccggtgccaggggctccccgcctcaccacccacccaccagcacccctgacctcaccgggaacagcttgcaggagatgatggggtagcccggacccgcacaccccttcacttgactgatgaggttgttgatgaagtgtcggagctcggcttcgtgggtggtcgccggcctgcggggggagggggccgggtgcgcgcgcgtgggtgatgcgtgacacatcacggcgcccacgcgcggtgtgcagccacccgcgggcagacggccccccatcccaccgccccatcccctcccctggtctcagaccccaggcctcacaggttgccgatgtagatgcgtttggccgggcgtgcggcatcggggttcaccagctggtaacgcgccaacaactgatccatccagttccggtagtgggcgatcgtgcctgcgttggaggagcgggcggtgggggagggtcacaggagccacaccaggagagctgcaggtgggagacactctgccgtggggccaccccacctgccaggtagtcgatgtgctgtcgcagttctacctcgctgccaggtaccccctcctgggggaagccagcgggcccaggcttcctgacgccctcgaggtcggcagacatcggtccgtcgccgctctcgcccgggcccggaagaaggttcccacccagcctgtccaggtttcttgtgtggtaaagtagtaaaggaacatgggagaaggggtgggagaaggagctgtcgccctccgccaccccccccgtcaggtcaccaccgccctccattcgacccgttggcctgtgcactctccagggtgcagggccgctccacctggccaccaactaagcgacgaaagttcaaagtgtaaaaaacaagtaatagaatcggtgtcacactggttgagtggagtgcatgaacccccagcggtttgcactgaggtgcatcttcggggtccatgccccggtgcccagggtctctcactgccgcccgggagtgactgtgcagcgggcctgagactactcccctcgcttcgtcatctttcaattcgttcttagatccgttgcggcggtccaatggacaccggcattcagccacacccgaccgatagtacggattnnnnnnnnnntttcgtcatccttcaattcgttcttagatccgtcgcggcggtccaatggacaccggcgttcagccacacccgaccgatagtacggattnnnnnnnnnntgctttgaaggatatcagcatcctccatgggtctaccctagtgcacaggcggtgaggagggccccannnnnnnnnnccttcgacctcgaaccaatttttcctacctcgagacacgatcactctcacgacctnnnnnnnnnntcttcgacctcgaaccaatttttcttacctcgagacacgatcactctcacgacctcgtctcctagtttccggctacggtaatgcaacaattgctgtgcatctcagggagtttcgatgaccgtctgtccgtgcatgctttgggtagtcctcgacacttacaagtgggtggccccagtcaggccggagaagtttcttacgtgtccccatcattccagacctcgcgggtgctcacggacgccccgcactcattcggaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccactcatccatgccaggggagaagacctcttggatgaccgtcagcggctgcccagcgtgccagaagatgtagtaccggccccagaagggacctggacggccgaattccctgcagtgaaggatgtggcagggcatcgagttgctctgcacgggggtctggaggatggaaactgacagcaggaagggatgcacagcacagcagacggattagacactcacctctccagctcctcattgtgaccacactcgacggtcaatatctcgcgatacagctccgtcttgcgttcgctcagagatgtccagatgggctgggctttgtccctgtagcaggcagggtgccggcgtgtcggctgtcatgcgtccggcgccggcaacaataagtgattggtacgccaggctgacggactggtggtgtcgtctcaggcggggggtcctgacacaggctcatgctgcccataccaatggcctccccaccccacacctctatcccctcccacgtgagatagccgtccacgctgtctgccctccaccacgagcgggcatacaccagcgcctgtcgtcgccgagtccgcaagaacacctgcacttgggtccggaccaagaggtgttgggtgcgccagaggcagacctcacacagacagcccatgccttgcgactggctcactgatccctgtcgcctggcatgccccaggacgcaccctgcatggggtgcttaagagttgcatgcccgtcggcctacctgtcgcaggaggagcccctcgcccatgacctctgcctcctcaggcaaagggtcagcgtcgctgtgtaggtccatgcccacgcagtcgacgttcacctcgctctgggtcagcagcgagaggtggcgcgtcaccgagccatcgctcagcagcaggagtctccagggtggcgccaaggactgggggtccgatccaagagcaagcgcctcggtttcgctgccctgcggcagcatggattcggggaggggaggaatgcagggagcgtggcatggctggctgggcccaggtccctcctttggaagtcacaccagggcagcaagcaatcggtctgcacctgccagaggagggggctgtccaagactcgtccacgatgggcaccggattctgctgaggcatctgatggcctgagcagggtgttgcgcgagaggacgcgaccacgagaactcgatcgctccttcatggcatgagggcggaaggccctgctccagcggacctctgaacccggttgtgggttcccagcgacagctggaggtcgcgcggttgacatggaccggcacataattccttgccctacaattcagagttgtgagtggaagaaacgttgatgctctcgagcagcaaggtgttgtcactgcatggcgtcgacgacggtacaggttcccacagccgatacgccgctgtcgcgagcaagaaataacaactacgtgcgccctggaataatttgtcttgctcagcggtatgtaatgattcgtggtcatagcccaaagggggtaaccagcggcgacatgaccctgcatgctccctgtcgtatttctggcgccccaaggatctccgggagctccccggcttccgggaagtgcaatccaggggtgttatatcgcacggaggagtttatcccggccctgaaaacaattaaactatttcgatccagcccacccagattgcaatcgaaatggagttcgtggatggcttgtcnnnnnnnnnntggaggacttcatcccggcctgaaaacaagtaaactacttcgatccagcccacccagattgtaatcgaaatggagttcgtggatggcttgtccagtgtgtttggggcccgaggccccagaaccttcgactccctgctgaagttcaccgacctgagccccagcacgcagcggcacatgcagaaggcgcgtctcttgccagctgatgtggtagaagcctgtcgatctgtccggccccagccttcgggccacacacgtatgaggcccggcaccgccctgacccctccctccccttccccctgcgcaggtgtatgccaccctcgccatgaccctgctgttcgcagcagcgggatgctacatcaacatgctcaccgggattggagggattctgggcgtgctgggcttcatggcctgcaccatctggctgggcttcacccccgccctcccgtccacgctgcgcaagcgtgagggcctcctcatgggcgccgccctctgcctgggcacctccctcggacccctggtcaacctcacgtacaccctgcacccagggtgcgacggggaagggggaagggatcgtgcatggcctgacgcatcgtgttgtggacattgccatctgcgctgatcaggctcaccattctttgcatgccgaccacgccaatgctgcacacgatgccatcgaccccctcacctggcccttccgctcctcgccacgcagtgtcctcctgacggcgttcctgggcacggcggccatcttcctctgcttcagcggcgccgcgctcctcgcccgtcgccgatcctacctcttcctgggcggcatgctgtcctccgtcctggctgtgtttgccacgatgcgcctggtcacgtggttcacgggcgggggcgccgcactgttcgaggccgagctctacctgggcctgctggtcttcctgggctatgtcctgtacgacacccagcttgcggtggagaaggcggaggcgggggacagggacacagtccgtgccgcccaggacctcttcatcgacttcatggccgtcttcgtcaggctgctggtcatcctcctgcgcaacgcggggaagcgggacgaggaggagggtagggaccgaaggaggtcgcgaggggcccggcggcgcaccgagctttaggctgctccatgggccgtgctgcgaatgtgtgagagcgggtgcacagtacggcgtctgcggcgtgtgaaacccacctcccggtggatgtgatgtatgtgtgcccttgttcttccacctcttgaggttttattcatgtacagaagcggatcatcctagnnnnnnnnnngccggcggcgcaccgagctttaggatgctccatgggccgtgctgcgacgtgtgagagcgggtgcgaagtgcggcgtctgcggcgtgtgaaaaccacctcccggtcgatgtgatgtatgtgtgcccttgttctttcacctcttgaggtattattcatgtacagaagcggatcatcctaggaggaaggttttggactccgtgtagtcaagcacatgtcaatgtgctggatcacactatgtgcagactgaggcgttcacgggtgcaggcagggagtttggacacaacttcagtcgtttaagtacaccaaccctgtctgagcagttgccatcgagaagagctatgggagaggcccaaaggagtaaacctggagctcgtctgacacagccgcgggcagcgcagcctcgaccctggcccccgaggatgggcaagccggccgtggccgacatcacacaaaggagaaggggggggctaccgtataccattatctcccgttgcccggggaaagggcaagggctacgtgcgatgacaaattaaccagcatctgcctcattcgcacttgcatcgggaggcaatgctgtgcacattcaccaccccccggccggcaccccaccccctcctcgagcccttgcggggacgctgcccatgtcctcaagccttcaccttgtaccctaggaaccttgttacatcgagatcttattctttgcggcgatgctctcgtcaggccgccctatcctcggccgccgaagccggctcgagagcagcccaccccgaggccccgcccgccatacatttcgacaagcatgagctcgtgcttgaggttggggatcgaaaggtgtgtggtctagtgagaggcttcgtgttgcatgcttgtggccccgtggtgtgcggcttgggtctgcgcctggtgggccgacagcaccgacaagtccccaccccctcggtgttccagatcacgctcgagaccggggagatcgggaggcaggcgtccggcgcggtcatggcccgggacggggacaccatgatctacaccaccgcgtgctgcgatgccgcacctgaggagggcgcgcccggtgccaggcacggcagtcccctccaggtgcactatgccgagcgcttcagcgccgcggggcggacctccggcgggtacgtcaagcgcgacggccgcgccaaggagcacgagatcctgatctcgcgcctggtggaccgcccgctgcgcccgctgctgccggccgactggcgccgccccacccaggtcctgtcctgggtgctcagcttcgacggtgcgcgcggcactgaggcactggcggtgaccgctgccggcgcggccctggcgctgtccgccgtccccatccgcgccgcggtggcggcggtgcgggtgggcctgatcccgggcaggggcctggtgctggacccggactcggaggaggtggaggcaagcgtgctcgacctcctagtggccgggtcggcggagggcctgctcatggtggaggcgggggccgagttcgtgaccgaggcagacatgctggaggtgaggggctctggtatactgtgtagcttggacgggggggagccttcgtgatcgcatttcgacgatggcatcgaggtgtactgatttttctccacccaggctggggcccgggttccctcgcttccctctcccttgcctcgctgtgcacgcttcctgcactgcgcattgtttcggccggtgatgacagaaacctttacggcatcggaaagcccggcccaaagaggcagggcatgacgctacacatggttaggacggtatctgaggccaccctgttcttgcccttgcgccctgcatgcacgccggggtagggcccctcgagcctggccctgtcgaggccctcggggggtttgccttcgtggcagccccggcacagtgaccccatcatgctactacggtggtttcgcacctgtccattgcgacatcgcaaccttatgcggatgacatttcgtgtgccactctgcttcatcatctgggcggatgagatgcacgccctgcagcaggatgcagtcccccttctgggtcctggctgctcatgtctttaccgttggaggacgcccgcgccgcctctctcgctcaaacattctctgcctcctcttcttcacgcaccaggccatcgcatttgggcaggcggcggtgcagaagatgtgcgtcgccatcgatgcctgggcagcacaggtgggcaagccggccgccgaggccagcgaagcgtccgacgccggcgaccttgaaggctccgcggccctggacgccgtccgcgcccgcttcggcgacgcgtacaagacgctccaccgctccgcgctggacaaggcggggcgtgaggctgccctgcgcgcgctgcgctcggaggcggtggacgccctgacgcccgccgccgccggcgacgcgcccgccccggacgcggcc

SEQ ID NO: 42629 - DNA, 61 bp, Chlorella protothecoides
gcaggtgggggactacctgggggagcgcgatcccttcaacctcaaagtcatgcacgcctac

SEQ ID NO: 42630 - DNA, 86 bp, Chlorella protothecoides
ttgacaccgtacccaaggtgggcgggggaagttgtgtgtgtggtgtggggggggggagggcgggggtcacgtgtaggggtgtacaa

SEQ ID NO: 42631 - DNA, 77 bp, Chlorella protothecoides
aggcgggggagggggggatgatgaagggcgagtggaagtgtgtgtgtgggggggtgatgctatgtagagaggttgga

SEQ ID NO: 42632 - DNA, 70 bp, Chlorella protothecoides
catggaggggtcccattccgctccgataccctccggggatgcgctgcgcacagccggctgctcttcaggg

SEQ ID NO: 42633 - DNA, 69 bp, Chlorella protothecoides
cctccccccaccccctacggcccatctcctcccccctcgcccaaggccagccccagtccctctcccaag

SEQ ID NO: 42634 - DNA, 98 bp, Chlorella protothecoides
gctccgccgccggggacgcgtctggggagcgtgtgtgggaggtgaggaagggggtccggtgcagcaattgttgaggcatgggtgactgtgcacatggc

SEQ ID NO: 42635 - DNA, 61 bp, Chlorella protothecoides
accgtcggcgttcaggctggtggaaggagggggcgcgcgcagggcctcctcgtcgccctct

SEQ ID NO: 42636 - DNA, 395 bp, Chlorella protothecoides
ccgcgcacgtcgtccagcgtcacgttgaacagctcgtcctggagcccgcccatgaccagcagccccgcgccggccagggccacctccaccttgacgctcttgccgcgcactacctcgcgctgccactgcatgcgcaggcacacctgtttgagtggtgggggttgtggatgtgtggggtagggggccgagtcgcagctgcgcgcgagcgctggggggaggcgggcggggccatccatgcagcacaaggtggcaggctcgcagtaaaggggtccctggcaggtgacaccacacccgcaagccgttgtgccggcccaggcgggcaggaaaagttcccctcagcataccgatgcaaacgcatcacaccccacctggagctccgggacgcccgcccccac

SEQ ID NO: 42637 - DNA, 97 bp, Chlorella protothecoides
ggcggggtggggcgaggccggggtcggagaggccggcgggaggtgcctggcggaatgggttgggggcttggactccctgttgctgttggcgacattc

SEQ ID NO: 42638 - DNA, 87 bp, Chlorella protothecoides
gactactgtgaatccaacacgcctcgctccccgccgtgcacgctgccccgagggcatgccggggagaagaggaggcggggtctgtca

SEQ ID NO: 42639 - DNA, 61 bp, Chlorella protothecoides
gacgtccaccacctccaggcgcagcggccagggctcgtacaccgcctcccagcgcgaggtg

SEQ ID NO: 42640 - DNA, 1169 bp, Chlorella protothecoides
  modified_base (104)..(113): a, c, t, g, unknown or other
  modified_base (667)..(676): a, c, t, g, unknown or other
ggcgctcggcgcgccggcctcgccgcggcgcgcggccgcgcctttccggccctacagcctgcagatcagcgcgcgcgcggcgtcgctgaccgcggtgctgtgcnnnnnnnnnngccgcgacgcgcggccgcgcccttccggccctacagcctgcagatcagcgcacgcgcggcgtcgctgaccgcggtgctgtgcaacgacaagccggagacgtttggcgcgccggacgtgctgctggcgggggtgagcgaggtggaggccgggtacgacacggccctggtcctgccagaccgcccgcccaacaaggcggggcagctgtccctcagctcctccgccgccttcctcaactcctccacctcgcgctgggaggcggtgtacgagccctggccgctgcgcctggaggtggtggacgtcgtgtccccgctctacctctccgaccgccgcaccaacctctgggtcacctccgaccagcacctggacgcggccttcaaccccgccagcctcatgtcctttggcgacgcgctggcgttttacaacacgttgctcaggcccgagccggagccggagggtgagccgcgatttgggcggagcggggtgctgggggggccggggaggggttttggagccagggagccagggagtggcgtgctgcagggggtgcaggtgnnnnnnnnnnttttggcgacgcgctggcgttttacaatacgctcctcaggcccgagccggagccggagggtgagccgggccttgggcggagcggggtgttggggggggccggggaggggtttttggagccggggagtggcgtgctgcagggggtgcaggtggtcggtgaaggggggatgggggggaggcggtcgtagcggggcttgagggtaagagtgccctgcacccaggcctcaccggtgcacactctgcaccgtgccacgtcgcgccgtctgcgatggagggccagggaccccagccctgccaaccctccatgcgccctcctcctattgcaacgacaacacacacgctcaccccccgtcccgggccccccgtccccctacagactgggagtctggcagcccagcgccgatgccggcccacccactccatcacaaggacgtcgacccgcggcaggaggcccgcgccgcgcgcccccggccgccgcccgcggccgcggcggc

SEQ ID NO: 42641 - DNA, 400 bp, Chlorella protothecoides
cggcacccgggctatggtctggccaccccgccccctgcccctccttaacccccaccctgtccgaccggcagctcgacctccccaccacgccccaacgcaggagccaccgtctttcaggtccccctgcttcccgcggccgctctgcatcccggaggtgcaagggcaggccgcccgctgaaacgaacccctcctgcccccaatacccccctgacgctgccttccttgcgcttgcatgctcaggggtccgggaaaacgtacacacatgggcatgcgcctggtgaaaaaaatggcaacgaccccatcaagcctgcatggccagcggttggggagaggggagcgcatgcctggcggagagcccggcgccgtcggccagggccgcgccgcggcccgccccggcccc

SEQ ID NO: 42642 - DNA, 61 bp, Chlorella protothecoides
ctcccacagaggctgccggtgtcgggaggggacgggagacagcccacgagggccaccacca

SEQ ID NO: 42643 - DNA, 75 bp, Chlorella protothecoides
aaggtctctcactactccaccaaggtatgggacgtgaggggtcccatcatcacatcggcatcggaggcctcgggc

SEQ ID NO: 42644 - DNA, 133 bp, Chlorella protothecoides
gatggtatcccaggggtggctgctgccattccaggactacctgacaggcatatacatccctgctgcatgcatcactagcaccctcgtccctacacatcctgtcctcctcccagcctccaaccagcaacacgcc

SEQ ID NO: 42645 - DNA, 61 bp, Chlorella protothecoides
ccgcgaggccggccgcaacgccacccgcgacggccccgcgacggccgagcgcttcctctcc

SEQ ID NO: 42646 - DNA, 61 bp, Chlorella protothecoides
gaactccgccggcgcatgccgaagaggccgccgcagggcctgtgggaacatcatccgcacc

SEQ ID NO: 42647 - DNA, 68 bp, Chlorella protothecoides
gggggatccagggtgcgagatagtggctggggggggggcgacgtggactcccgatgccagctgccagc

SEQ ID NO: 42648 - DNA, 83 bp, Chlorella protothecoides
cagccctgcggacccgactgcaggcgcagggtgcgtggcagagccagtgggatgccggcattcgaagcggcgctgaggcggca

SEQ ID NO: 42649 - DNA, 99 bp, Chlorella protothecoides
catgagacaatcctcgtggactggggccatgtggagagcatctgtagtgaacagaaaccgtgataaaaagaatgaaggaagatggcgtgaccaagccaa

SEQ ID NO: 42650 - DNA, 78 bp, Chlorella protothecoides
caagtcacggcatgcacgttcccagggaggaaccagggcaatacatatatgggcgttcaaggtgagcctggcgccgag

SEQ ID NO: 42651 - DNA, 61 bp, Chlorella protothecoides
ctaaccctaaccctaaccctgaccctgacccaaccctaaccctaacccaaacctaaaccta

SEQ ID NO: 42652 - DNA, 75 bp, Chlorella protothecoides
gctctcctccgacgacgacttctacctcaccagtacgggcctggtggtgctgcagaccaccaaccgtgtgctgaa

SEQ ID NO: 42653 - DNA, 109 bp, Chlorella protothecoides
tcctgcccagcccacccccgcgcccactccatcccagcccacgcctgcgccgactcctacccagcctgtgcccgcgccaactcctgcccagtccacccccgcacctgcg

SEQ ID NO: 42654 - DNA, 77 bp, Chlorella protothecoides
cagctgtggagacgccggggcccagggccgagggcggctggtcgggtgcggcgtgtgggacgggcaccgcagctgca

SEQ ID NO: 42655 - DNA, 113 bp, Chlorella protothecoides
ggcccgggcggcgctggacgacgacgcgcggagcgtgcgcggcgcggcggcgcactgcatgctggcctggggggagtgaggcaccggcgctgttgatgcagctcgccagcacc

SEQ ID NO: 42656 - DNA, 74 bp, Chlorella protothecoides
cgaatcctaaaggaaccacaccacctgtgagtcgcccacgcagggtgccgggtccccagaacgcacgccgagga

SEQ ID NO: 42657 - DNA, 118 bp, Chlorella protothecoides
ggacggggatggggagggcggcccggcgccggggaccgcagcccctagcggtgcggcgccggcgtcggcggcggccgccagagacaggacaccccgcctcctgctcaacgaggtggcc

SEQ ID NO: 42658 - DNA, 61 bp, Chlorella protothecoides
gtggccgcccctcctcctctgcagctgcgcgacagtggcccccgtcaacacatctgcagga

SEQ ID NO: 42659 - DNA, 61 bp, Chlorella protothecoides
tgcgccgtctgcagaccacatactggctggggcccgccggggcgcatggggtttggggcct

SEQ ID NO: 42660 - DNA, 75 bp, Chlorella protothecoides
gagctgcgtcagcagctgggacagcatcgcatccgtgctggctgcggggggggggggggggggaaaggggggggg

SEQ ID NO: 42661 - DNA, 72 bp, Chlorella protothecoides
cagcgagggctcccgcacctgctccaactgtggcgtgaccgccacgcccttctggcgcaagagtcgggccag

SEQ ID NO: 42662 - DNA, 61 bp, Chlorella protothecoides
gcattttgaggtataccgctgtatggcaggggtgacgcactttttgaatggatgccagcag

SEQ ID NO: 42663 - DNA, 61 bp, Chlorella protothecoides
ggctacggcacgcagtcgacaggctacggcacacagtcggcagggtacggcgcacagtcga

SEQ ID NO: 42664 - DNA, 112 bp, Chlorella protothecoides
cccgctgcactgtgaccgtcgctccaccctctccacaccctcggcctgcttggtcccacgcccctcccctcttgcccctccacctcctcctttcttgctcaggtccgcgtct

SEQ ID NO: 42665 - DNA, 69 bp, Chlorella protothecoides
ccctcaccaagcgccactccgtccccgtcaaggacaacgccacccagtccagctccctctccctcaggc

SEQ ID NO: 42666 - DNA, 6314 bp, Chlorella protothecoides
  modified_base (113)..(122): a, c, t, g, unknown or other
  modified_base (598)..(607): a, c, t, g, unknown or other
  modified_base (761)..(770): a, c, t, g, unknown or other
  modified_base (845)..(854): a, c, t, g, unknown or other
  modified_base (2374)..(2383): a, c, t, g, unknown or other
  modified_base (3230)..(3302): a, c, t, g, unknown or other
  modified_base (3391)..(3400): a, c, t, g, unknown or other
  modified_base (3489)..(3498): a, c, t, g, unknown or other
  modified_base (3623)..(3698): a, c, t, g, unknown or other
  modified_base (4828)..(4837): a, c, t, g, unknown or other
  modified_base (4932)..(4941): a, c, t, g, unknown or other
  modified_base (5062)..(5071): a, c, t, g, unknown or other
  modified_base (5296)..(5305): a, c, t, g, unknown or other
  modified_base (5641)..(5675): a, c, t, g, unknown or other
  modified_base (5753)..(5762): a, c, t, g, unknown or other
gccaccgtcaccgacgagggcggcccgccctgggccgccgccgcgtcccctgccggtcgcgccgcagccgctgccgccgccgcgccctgctgctgctgctgctgctgcttggnnnnnnnnnnggggccgccaccgcgtcccccgccggtcgcgccgcagccgctgccgccgccacgccctgctgctgctgctgctgctgcttggcgcgctcagccatggcgtactggtaccgccgcacgtactgcttcatgtccgccaggcgcttgcgcagcgcctccacggccgcgccgtcgatgtcggggtccggcaggccgggaccctccatcaacgccagcgtctcacgcatggtcgcagaggagctgtgtgcgccggagcgcgaggcggccacgctgtcgatgcgggccaccagggccttggcgtcctgcgtgccagggggacggcggggaacaacggtggtgaggagattgctggacgactggtgggcgggtgccaggccgcggcgaaactcgggcacggaaacacatgttcaacgacacgtcaggtatcaatcgacctcccccacgcccaatccgccctcaccttgagcagctccctgcgnnnnnnnnnntaacaacggtggtgaggagactgctggacgactggtgggtgggtgccaggccgcggcgaaacccgggcacgcaaactcatgttccacgacacgtcaggtattaatcgacctcccccacgccccatccgccctcaccttgagcagctccctgcgnnnnnnnnnnggggccgccccccgtccctgcctccgtggccgccgcccgggtggcgggcaggggcatgggcggggggcgggaggnnnnnnnnnntgggccgccccccgtccccgcctccggggccgccgcccgggcgccgggcaggggcatgggcggggggcgggaggcctgctgcgactgctgcgcggagtactgtggcagggtgctgggctgataatccggcttctggggcaggtactggggctgggggcctggctggtactgcgtcgctgtcacctggtactgcggcgcggcctgctgcacctgctgcggcggcggcgcctgctgtacgggcagatgggggtactgcgcctgcggggcgtactgtacgccggcgtactgctgcttcgtggcgccgtacgccccggggtaggctcccggccccgcctgctgcgccggcgcgccctggggaaccccttgctgctgctgctggtgctggtgcgtgcggggcgctgcctgggcctgcggcgcggcaccatactgcggctgttgctgggcggggtacccctgcacgcggtactgcggatcgtactgctgcgcatactgggcctgctgcggcggcgccgccgccgcctgtggagggtaggcgcccgcctgcgcatcgtagtacccgccagggttggccggggcctgagccgccgccgatgcagttccgggagcgggggcagcgccgccgtacccctggtaccgtgcatcgactatgcccgcgtagggcgcctgcggagcaggctggtactggtgcggcgcggcctgggcgggtgcgtagccgctctggggctgcgcctgcgcctggtactgctgctgctgctgctgctgcggggggtactgcgccaactggggctgatactgctgccgctgctggggctgcgcctgcgcctggtactgctgctgcgcctgcggctgcggctggtattggggcgcagtggcctgaggagccggagccggcgtcacggaccgagcagccacctgggctcggcaaaggaaagggtggatgggcagcagtgaggttactgacccagcctgcaaactcatcatcagtgcctccagcacaactgcaaacttggtggacaaagacaggccaccaaatcgtgactcattggccctgcacagtggcagccctccaacgcctctctcccgtgcaccacccccgcacctggttgttcttggcaaggatgctgttgatcttggaggacatgtggtgcccccactgcgcccgagtgaccgtgttctcatatatattctcctccgtgcgagtggccaggctctgcgcacgagcctgatcgccacccacaatcttctgcagggcttgcatgctgcacagaggaagcaaggtcggggagtgggggagggggtcgtctcatcgtcacccctggaaaagaggcagcaatgagagacacaccagcacccattataggatgagcagtgggcaactcacagctggagacgcccctgatccctctccgcaggtgtgaggtccatgggaggcatgccggcaagcggttcccttcgccgatcgtcgagttggaaggtgttaggcttgacttcggagctgctgcgcgcaggtgcgagtgaannnnnnnnnnctcccttcgccgatcgtcgagttggagggtattaggcttgacgtcggagctgctgcgcgcaggtgcgagtgaactgaagcccgctcgcctgttgaatgcagggcctgattgaagctttgctagtcattcaatcagtggcttcatcgtgtgatggagagcgcagcattgcactgtcacatgcaaggctcagcacggtgttcgccttccacgggaaggggaaaagtgaattctgctcaaacactcctcacacgctgaaacaatgaccgtcagagcatcttacagctggataaagtgtgtatgtcaagtgtaaccgctatcaaagtcaaagtttggacgggcagcacgctgattgcctcgcatcagctttggtcacggaagacgaggcggggctcggattgatgaacctggacaaagagtctcctcaatctggccccaaacccgatcaacatgcgccaccagccgatcaaagccaggcttgcacaggcattcctgtacatgaaatggcatgtaggatgaatgtcagggagagtaatacctcgatttgtactgattagagcttgtgatgctggtcagaaacaagtatccagtgagccgagtgacccaccaggatggcagcagcaatgtcatcgtctccagcctgttgcaagaagctctccaatgtgatgcttggatgagttgcactgtcccgctcgcctgctttcatgcacaccatgcctagcttgatgctctggtgtggggaggttttcggggagaagggggggtgggtggctttgccacgcggaaattaaggcacggggccgagtaccaattcgagataccgttgtacgcaacctggccctagctgcannnnnnnnnnnnnnnnnnnnnnnnnnnnnnnnnnnnnnnnnnnnnnnnnnnnnnnnnnnnnnnnnnnnnnnnnttggaaacgaagcgcgcaaacggtgggtttctgaccctcttcttggtgactcaagaataggacaccctgtccactccttgcaccaggcnnnnnnnnnnctggaaacgaagcgcgcagacggtgggtttctgacgctcttcttggtgactcaagaacaggacaccctgtccactccttgcaccaggcnnnnnnnnnntcaaggaactgggccgagtaccaactcgagacaccgttgtacgcaacctggccctagctgcatcctcagatggagaagcagttacctggagcagggccgcgcactccctgcaggcctggggtgcnnnnnnnnnnnnnnnnnnnnnnnnnnnnnnnnnnnnnnnnnnnnnnnnnnnnnnnnnnnnnnnnnnnnnnnnnnnnatgctgtcattctgatgaagaacagaatgtgcagggcacacgtgcaggagggcgaagtttcctggtgtgagggaccattgcagcaggcctttgtgtgccttgaggtctatggccaggtgcggggcttgtccagccccgaaggtcaactgcagaacactgctcggacagtcactggctagccacattcctgccgcgggggattctccagctcccggcctcggcatccagaccgcgactcgtactgcccagcacatggagtggtgcatctccatgtcagtcgaggtgtgctcgagtccacctcagcaaagccttgttgggaacatggcatgcgcttgatactgactatatattcatgtaatgccgtgtcatacgctgtaatgagtctttgggggcgattgttattgtcgtggctgcatgagcttgcgctgccgagttcaaaaccgtggatggaatcgtgcggagacccgggaccggcgcaaccaagcatctgggctgagttacgcatctggcattttgccatgttgcattgcgacgaactacaatctgttgactttgtggtgcgaatcgacgtgaaatcggcgatctatagggcacagggtgtgggtgagcacaatggataggacgcatggcaactgtgcgggaggtggttcatgccccgccgtgaagtgcgggtgagggtgcatgtgcgtgcagtgccagtgaagaggccatcttattagatctcacgcgttgccctcgtggtcaggtgcgaggcagggcgatgccgtacctctccaagcaggccctctcgggtctcaagcactaccactacaagcccggtggctacacgatcctcgacaactggcatcagcccctctggaactgtgagtgcatgagaggatggggttgtttacaggatcggaatgcattcctgccacacctctgcagggccaccgctaatggaagggagccggcagctgttgctgcctgccagctccagcaagtactgcatcgtttctcacacctgagcaccccccccacactctcgagaatgcacagatgcggtgtcctgccttcccacctggctggcacccaatgtgatcaccctcatcggcttgagctcggtgatggtggccaacctgatctccgcnnnnnnnnnnatgcctgctccagcgagtactgcatcggttctcacacctgagcaacccccacacactcgagaacgcacagatgcggtgtcctgccttcccacctnnnnnnnnnnttactacagccccgacttccagagtgagcaacgagggcgtggaggggggaatgaagtcacactggcaaagcccatgcatcaccacgcccaatacgcaggggtggcgcagctgtgccctgcnnnnnnnnnnctactacagccccgacttccagagtgagcgacgagggcgtggagggggcgataaagtcactctggcaaagcccatgcatcaccacgcccgatacgcaggggtggcgcagctgtgccctgcctgcttgccaaaggtggaggagcacctgcgacgccaggcgatgccccaccgagacaacccaccccatcctccttccccccacctccctgtcccctaccgcccagnnnnnnnnnnaatgccccaccgagacaccccccccatcctcctcccccccacctccctgtcccctaccgcccagaccccgttcccacctgggtgtactttgcgatggccttcgccggcttcttctacctgcacatggactgcctggacggcaagcaggcacggcgcaccggctcctccagccccctaggccagctgtttgaccacggtgaggggagggagtttgggggaactgtgtgtctggctatgcatgccatgcattgtgtgttgggcgtggttctgtagggggtcaagagcgccgactctgaccgacacacatggttccccccccccccccccccccccccnnnnnnnnnnnnnnnnnnnnnnnnnnnnnnnnnnncacacacacacgcccaccaacctacccaatgcctcgctcacccaatactgaacaaccccatggacctacatgcacaannnnnnnnnncccaccaacctatccaacgcctcgctcacccaatcctgaacaaccccatggacctacatgcacaaccctcacccactctcaacccccccaaggctgcgactcgctggtggtgcagctggtggtatcccagctgatggtcagcctgggcatgtcccccgactggcgcctggtgctgggcaacctggtggtcttcacgccctttgtgctggcgcactgggaggagtaccacaccgggcacatggtgtacggcaacgggctgtggggcgtgacggaggccaactacgcggtggtgctcctgcacgccgccgcgggggtgctgggccctgacttctgggcgcgcacgccgctggcgggcgtcgccgcgcgcctggcgctgaccccagcggtggcctcgcgcctgcccgccggcctgctgccggggctggcgcgcctgccgctcaacgcctgcgccgtgctggcgctgggcggcatgggctgcctcatggtgggcgagcagctgggccgcgtcttcttcccctgcccgcgcctggccgcggagcgcgccgcggccgc

SEQ ID NO: 42667 - DNA, 62 bp, Chlorella protothecoides
ggtcatcgtgttcatgggcaagagtgacccgggcgcggcgccccaccgccagcagagcatgg

SEQ ID NO: 42668 - DNA, 61 bp, Chlorella protothecoides
atatcttacttgtagatgcagaagtggctgggctaaaaggttgtgcaggtaggctggctgt

SEQ ID NO: 42669 - DNA, 71 bp, Chlorella protothecoides
cagggcggcacgggcaaggccagcatgcccagcctggccgctgtggcgcctggcgcagcgccacagtcctc

SEQ ID NO: 42670 - DNA, 6724 bp, Chlorella protothecoides
  modified_base (298)..(307): a, c, t, g, unknown or other
  modified_base (1123)..(1132): a, c, t, g, unknown or other
  modified_base (1730)..(1739): a, c, t, g, unknown or other
  modified_base (2446)..(2455): a, c, t, g, unknown or other
  modified_base (3036)..(3045): a, c, t, g, unknown or other
  modified_base (3451)..(3460): a, c, t, g, unknown or other
  modified_base (4569)..(4578): a, c, t, g, unknown or other
  modified_base (4866)..(4875): a, c, t, g, unknown or other
  modified_base (5347)..(5356): a, c, t, g, unknown or other
tggcgcacatctgaggcagcggcagcctccaggctggcgtcgccggccacgcgggagtagcgcccgtcggactcatgtaccagcaccttgaacatgaggtggttgttcacgtagtacttgtccttcagcttgtagccaacctcgtagccggggcggactggggatgcatgggggcagccgggtcgagctccggtggcaggctacgtgctggggttcgcccacgaagccagtctacctcgcagctcacactccactcgtgaccccaaactgccctgccccacatcaccacaggcggcgnnnnnnnnnngagccagtctgcctcgcagcgcacactccactcgtgaccccaagctgccctgccccacatcaccacaggcggcgcgggcccaggcatccccgaccctcccatgcccaccggactcggggtccagctccaggtcgtaggtggtgatgggcaggttgtccaggatgaggcgcacccggtactgatcccggatcttctccttgagggtctgcagtggattcccagggcacttgctgttgagccggtgaggacgggtgcaactgcccagagggagagcctggtacagtccccctggaaggagggacttggtctgggtgcggcatgcatgccctggccatacaggaccctgcgacctgaggccagacgcatccacatgcaacgcccaccttgacctccttggaggtgagcgcggtgtaagccccgccggggtagtcctcgccctggcagaccaccttggtcttggtctcttcctgcaggtcagcaacatcaggagagaggggatgtcaggtgtgacagcggtgggagggctgtgaccagggacttattagagcatataggctggggctggcaggcattcatggtggggcagctctcggtggagcgacatgaggagggacagagcagggaaattcccaagatgaggagctcccgtgatcgatacaccccactggcttaaacatcctccacccaccatgacggagaagctgtagggcgagttgttgatgcgtatgcccagaagtatggtgcccggatttacagtgctggaggccttcttgacgccaccgacaggcttgcagaacggcatccggtagtatcggnnnnnnnnnncacagtgctggaggcctttttgacgccaccgacgggcttgcagaacggcatccggtagtatcggtacggaatctccgtttccgatgacaccagagagttcgcctccactgcaggtgaagggagcgatgtcccacgttgatgcccgggctcgggatcgcaggacaaggaagtgggagtctcggccacgaacatggcgccgcaccatcacaccttcgatcttgctccctttcgcaaactcctgaggatacgtccccggcaggtagtaggcagacacgggtcctaaagcgaccaacagtgctgccacgagcagcagttgctgaaacttcatactggagcgaatggacttgtccaactcgagcgacggctactcctgatcctgaaagagcctgttcccactagctgcctcgcagtccccggatggtgccagcaggtgtatggcagacctgacgccccggccggaaggggtgcaggctgggatccaacggcctcccacacacgtcctcagggcacgactagcatatatagatgttgaaattttgcaccaccttgtgaccgtcgatggcagtggtgtgggtgagacgcggtttttggttgcggnnnnnnnnnntacgactagcatatatagatgttgaagtttttcaccaccttgtgaccgtcgatggcagtagtgtgggtgagacgcggtttttggttgcgggggcctgtccggccctccttggaactcaattttggaaatgagggaatccacagctctgctcccggattctcagagagcagggttctgcccgggactcggagctggagccttgtgcaggattgtcgtgatccttcgatccaacatgcaggaggtatgatttgggattgcttgcaaaacatgcagatgtggtcgtaaggagctgagacgggtggacgatgtcggaggtgctcgagggctcgctcatcaaggtgagacgtgcttggctatgccatgttggtcactggatgtgtcgacatctcttgcacggccacaacatgcgattatgcccgtctacttggaatcaggtgccatacgagaccctcaagcggacgacaagggagcgcaagtatgtcttggatgacatctacaagatcctggcagccctccccaccctcgcggagggcactgacggggcccagaagctccaggatatggcatccgccctacagcacctcaaaaccaaggtgttggggttaacagggggtctggtgtaactagagatccttgtaggggccccaacatcagtatgcatgacaggctcctatttcctctccagtcctggctgcattctgtagacnnnnnnnnnnttctggtgtaacgagagatccttgtaggggccccaatatcggtatgcatggcaggctccttttccctctccagtcctggctgcattctgtagacacacccactgatgccactgcccccgtggcgcagctggagggcatagccgaggccgagaggggggacctgtcccgcctgctcgcccgcgtcaggtacctgaggcgcgtgggccagccggaggcaggccgcctcatcgactggaaccggccgcgaatcaaccggctggtcatcgactacctcctgcgccgcgggtaccgccagtccgccctgcacctcatccagacatcggggccgggggtgagcaggccatgcggcaaaggggattgggagagggcccaactcggtagccaagcctccctgaggatgccccggacgggggctcacgtggaggaccgcgtccagagcgggatgcgccggccgcacgcgcacactggtgtggccggcgtgcccgcctgatcccctggacagctcttcttcatctgcctagggaccctccccccccatacacacacacacacctccctccctcactggccccctcccacannnnnnnnnnacccccccccatacacacacacatacctccctccctcactggccccctcccacacactcagagcgaggaggtggcagatgggcacatcttccagcccatccagagcgttatcgccgggctggagcagcaccgatgcacagaggcactggcctggtgccgggtccatgaggctaggctggccaaggcccgctcctccctggtcttcaggctgcgcaagcaggttggtggcatggggttggagcaggagagactcggggagcagtggctccggtctcggccccagggcatgggtgccgacgcgctctcgcacccagtggccaacgcggtggggtgcccgtcggcacaggcgcgcccccgtccaaccggcgcgcggttgggcgcctcgatcccaccaacccctcgccannnnnnnnnncatgcggtggggtgcccatcggcacaggcgcgcccccatccaaccggcgcgcggtcgggcgcctcgatcccaccaacccctcgccatgtgcacccccccccactcatccgcaggagttcatagagctggtgcggggaggcgacacgcacgctgccatccggtatgcgcgccggcacctggcgccctgggcggcgacgcagatgggcgagatgcaggccgccgccgccacgctggcgttcccgggggacgcgcgggcgcgccgcggcacgggcctcttcgccgacagccaggtgcgggcggcattgagagagagggaggtaggggccgtgctgcttcaccaggcgtgtatctgatggagcctgcagggaaaccccatacctcgaggagagtctgctcgacctgcgagcccttgtatgaggcgaatcccagggttctgcgcgccgcaccatcgcccctccacccacccgccccatgtgcagtggcaggagctggtggaggcgctgaaacaggaggtgtaccgcctgtattccctgccccctatctcgcccctcaccatccacctccaggtggggaaatgggggcagagcggagggggtgaggagttgtcaagggacggggtgcggcagccgtgccttggtttcacccctcgcagccgcactcggcgcggggtgcccccgcagggccagttcgctgccgtgcctcgtgtgcccgcgaccccgacaccccagcaccccccatggccatccgcaggcagggctggccgcgctgaacgcgcccctgcacgtccagcgcagccgggccgacccgctgcacctcgccacctacgccgggctggccgagggccttccccgcgccaagcacagccactcccacctcatttgcgccatcagccacgtccccatggacgagcacaatccacccctggtgatgaagaacggacatgtttacggccaggcggcgctgagggcgcaggccgaccgcgacgatggtgtggtcacctgccctgtgaccggtaaggatgaatcgacgaggggagggccagtcctggaagcaggggtgtggctggcagcgccggtcccgacggccctgcaccacctcgggtgctcgcnnnnnnnnnngggaccagttgtggaagcacgggtgtggctggcagcgccggtcgcgacggccctgcaccacctcgggtgctcgctcacgtgcgcgtgaggcaccttgtcaaccattatgtatgccatgaaaagttgtgggcgtcatgatgcgctcccttggtactctgaaagagcctgccagggcctggcactggacaacagggctttgcaatcccaccgacacttatgccagttcttaaatccacccacacccttcctcacatcccagatatccccctctcctcaaccatcaccgcnnnnnnnnnnagcattatcatgccatgaaaagtcctgggcgtcatgaagcgctcccttggtactctgggagagcctgccagggcctggcactggacaacagggctttgccatcccaccgacacttgtgccagttcttaaatccaccacacccttcctcacattctagatatccccctctcctcaaccatcaccgctcaggttaccggtgcaaatactcggagctcaagagggcgtacatctcctaaataaggggtcacggtgcatgcatggtgtccaggcatggcagtgctattttttggcatctgctgccgccttcttcgcgagcttctctgcgagggccttggcgtccctgcacatgggagtgacgcggtgacacattgtatatctttgggctcgaaagagaacttccggtacaaactattgacatcaggcagatttacgcgagtgttctgctcaaacagccagcccacctctctttgcnnnnnnnnnnaaaacagaacttccggtacaacctattgacatcaggcagattcacgcgagtgttttgctcaaacagccagcccacctctctttgcgctggaggggtgtcagattgtcgtcccggttccccttggcaagctgctccttgcgcttctgagcccgggcccgatcgatgtcgcgctggttgccccgagtctgcacatgggtgattcttggtgtaaactctagcacacaacgacagctggggagctcggcgagtccacccgcaccggctcaccattgtggaatcttcctgttgcgaagagggagtggctgcaaaagtacgccgtgcccgaaggcagttgcacggaatgttgttcaacagcaattaaataccaaattacagctgcagggtggctccgcacgctccttgaccaccctccgcacccctcgtcacgggagaaaggatttcgcgcccacctgcgcgcggagaccagcgcccatccatcgtggtcgcgcacatcatacctcacactcgacgacagtcccctcttcgccttttgagtatcctttgatacatgccaggaggcggcgatccatcggggccgcactcgccaggatcaccagggcacagtcatgacaggcctcacactggctgaccacgaggtgtccgaggcttccaagcagattgcggaggatcacaagaatcgtgcaaatgaagccttcaaaggtgggaggtagatgcgatgtacgtgcactgtcccctgtggtggctgccggcgcttgaccacttacgccgaccatcctcccgatctgcagccaagcactaccaggaagcggtggatgcatacacagcggccattgatgccaatccacggaatgccgtgtacctgagcaacagggcctttgccaacctgcggcttgagaacctggggtctgccctggcagatgccagtgccgccatcgagctggatcccacatatgccaaggtaacattggagggggggtgtatgttcgaaattcacacgatcataatacctctgccttgctgtggaccgtccgggacgatgatttatgaagtggagaagattgagtcgacatgcatcacctcattttgcccaccccctcatccgatctctttccgcaggcctactaccggcgaggggatgcagcgtttgccctggctcacttcaaggatgctgtgcgtgatttcaaagcagctgccagattggcaccccgtgatccagacctccgtaggaaggtacattgggctgggagctttgtgtgtggcagacaacagtgttggtgcgagtctgcagcccctccgcagtgcagctggtggtcccggctcactgcctccctccctcgttcccatgtgtgcacagctcgcagaggctga

SEQ ID NO: 42671 - DNA, 85 bp, Chlorella protothecoides
cctcgcctcgggcgatgcgcatgcgcgtccacacgccctttcttcccccccctgacctgccatggcggcctgggggtcgccgtac

SEQ ID NO: 42672 - DNA, 61 bp, Chlorella protothecoides
gagctggacgtgctggagcagctgcgggggggccccgccctggtccagcatggcgaggagt

SEQ ID NO: 42673 - DNA, 87 bp, Chlorella protothecoides
aagcaggcctccatcctctcagcccaggagagggtcgaagcccccatcacagggcacgccaaccttccgccccgcacgcacacacct

SEQ ID NO: 42674 - DNA, 77 bp, Chlorella protothecoides
agcgagggagagatgagggcaaacgcacaggcacaaatgcgacgacgctgcatcggggggccggtgtggccatccag

SEQ ID NO: 42675 - DNA, 69 bp, Chlorella protothecoides
gggcaatggggctgagagtcgtgatccagtggcctggaggctcttggtgcatgtcgtaggccacccgct

SEQ ID NO: 42676 - DNA, 89 bp, Chlorella protothecoides
tacctttgcccccaaaactcatccagtgccaccttggaccgcatcccctgccctcccatgcctggtgtcgcaatggactggcggccccg

SEQ ID NO: 42677 - DNA, 61 bp, Chlorella protothecoides
ctgcaggacgagacgcctgcggcggccgggggaggatcgtgggcggtgcatgccgatgttg

SEQ ID NO: 42678 - DNA, 61 bp, Chlorella protothecoides
gcgggcaggacgcgccgcacgtggtggccgacgccgaggagggcggccgcgcggtgggcac

SEQ ID NO: 42679 - DNA, 70 bp, Chlorella protothecoides
aagaaaattaaaccgtggtgccccccccccccccaatcaagcctcacctcccgccagctccttctcctcc

SEQ ID NO: 42680 - DNA, 61 bp, Chlorella protothecoides
ccgtgctcgccgagctccaggactggcaggggagcggggtcgattgatgttttggttatta

SEQ ID NO: 42681 - DNA, 69 bp, Chlorella protothecoides
tgctgtgcctccttcgactggcagctggggccagtgccgcccacgatgccccccttgtccatgctcctg

SEQ ID NO: 42682 - DNA, 82 bp, Chlorella protothecoides
gtcctggaactgcgaggaggagtgtgggggtgggaggtgatggggtatcaggcgcgagctgctgggtggctgggtgtccaga

SEQ ID NO: 42683 - DNA, 4037 bp, Chlorella protothecoides
  modified_base (160)..(169): a, c, t, g, unknown or other
  modified_base (759)..(768): a, c, t, g, unknown or other
  modified_base (1014)..(1023): a, c, t, g, unknown or other
  modified_base (2056)..(2099): a, c, t, g, unknown or other
  modified_base (2636)..(2645): a, c, t, g, unknown or other
  modified_base (3153)..(3162): a, c, t, g, unknown or other
  modified_base (3747)..(3756): a, c, t, g, unknown or other
  modified_base (3894)..(3903): a, c, t, g, unknown or other
cggccgcctcctccaggctcgccgcgcgcgcgacgcgctggcgcagccacgcatccacgccggcgcggcgcgaggcagagtgggccgccacgctgcgcacgaagtgctccagctccagcgccaagaaaacgggcgcgggccgcgcgcgcccggcggccgnnnnnnnnnnaacaaagtgctccagctccagcgccaggaaagcgggcgcgggccgcgcgcgcccggcggccgccagggtgccgtcccgggctttgggggcagcacgattcctccggcccccgtcccgccgccggtcgcgccaggaggccaggcgctggctcagcaccgcacgccgcgcccaggacagctgcaggtgccaagtcagcgcggcgctgacctggcgcgtcagggcctcgtcggccagcaggctcaggggccaggccggggccagggcaaactccaggcgcaacagccaggtggccaacggtttgtccccggtcagcggccaaacccaggccgacctgctgcgcgggggtggagggggcgccggggcgaccagcctcactgcagcggggcgaggtgggcatgggggtgagggcgcgatcagggccaccttgtggggaggaggcacctgcgtttcctttcccggctgtccattcccatgatgatgcattctttgcactgtcgagacagctacctacaaccacagagaatccacagtgggtgggacaaaccgaaaccacaagcgactagctcacctgtgagttcaaagggcaggcnnnnnnnnnntaatccgcagtgggtgggacaaaccgaaaccacaagcacctagctcacctgtgagttcaaagggcaggcaggcgctgaactcggtctccacagagtcgcggagcatatcatccagctcccaggcactcaggccattgaagcccagggaggaactgagagcagaggggcaggcgtgggaagggggtttggagtcgggcactgggcgcagggggagaccggggccgtggctgtgctctccattggcannnnnnnnnntgtgggaagcgggggtggagtcagggagttggcgcagggggggggcccggggccgtggctgtgctctccattggcagatgaagctggtcagctgtgcgcagatcgtgtatactgcccaccggaagaggaagagggagaaattcttccagagcacgggcatggcaccttatcccgcacaaccccatccccacctgatgcggaggaagaggcgctccgcaaagccgtccagcgtgcccggctgagccaggcgctgcagcgcagccaactggtccagcacgcccgcggcatgcatagcagcgcacaggctggcgctggcgagagaagcctgtcgtgggggagaggggtggggggaggggaagtggcggcagcggggcactatgggcaaccagccaatcccttcacaggtgcacccagaccgacgcaacagggtcagagggcccacagcccttcccatcctgggtctcacgcgcctcggcggcgacgcgtgacagcagggtcctctgcagatgggcaggcagggacggctccaccacgcaggggtcggcggtggccgtgtttgttccggcatccgctcccttcggcggcaccctcgcacgagcccgagcccggcccggcgccacgaccaccgccccagccggctctggcgccaccgcagcgccgaccacctcggcaagcctggcgccgtcgcagagctgttgctccagcgccgcaaaccacgacgcccactcctccactgcaaactcatgcctctgccgttcgcggggcgtcggggagccttgcgcaagcacatccttggcctggcccagggttccgctgcggccgtggcttccagggccgatttgaatggcccccgcctcgcagcggtccacgcccagggacaccacgctggccgctgcgctggcggccatccgggccccgacatcggcggcgccgctatctcgcggagcctccgccgcgccgtgcagcgccgggattgcgcctgcgccttcccctgcgtcctcccctgcgtcctcgcctgcgtcctcgcctgcgnnnnnnnnnnnnnnnnnnnnnnnnnnnnnnnnnnnnnnnnnnnntggctcccctgcacgccccagccctgccgcgccctcccacttcacgccctcgtgctcggggaggagcggggcgaggggcgggaggggaggcaggtctggcacggcgcgcgcgctcggctccagcaccagacggcagcagtccctcgccgccctccggcggtgcagccagggggcggaggcggccggggacgtgggtgggctaacggggcacattggcggagagctagcagcggcagtggcatccatccccatgccgccgcgcccaggcagcgcccctcccgctgacggcgagcagctccctcggcagcgtacggcgggccctgcccccggcgcggggcctgcggaggctggagctaccgcgtccgatgcctcggcgcctggccgcccgacacctggtgtcgcagcgccctccccccgcgccgccagtcccagcttcttcgcgccctcggctgcacctgcaccccccatcagcccggcagcagcacccgtcccgggctccagcccaaagcggacggcctggtgccaggtgtcggcgtnnnnnnnnnngcggcaggccctgcccccggcgcggggcctgcgggggctagagctgccacgtctgatgcctcggcgcctggctgcccgacccctggtgtcgcagcgccctccccctgcgccgccagtcccagcttcttcgcgccatcggctgcacctgcacctcccatcagcccggcagcagcacccatcccgggctccagcccagagcggacggcctggtgccaggtgtcggcgtgcgccccttccccgtcaggctcctgctcgccgacccagccgaccacggcgcccgacggccgcctcgtgacctttgcggcctgcccacccgcctcgcccagcgcacccagcgtgctcagccgctgcttggcgggcgaccccgccgtcacccggtccagggtggtcgtgcggcgcagggccggggcactcgagtgctgcccgggcccgtgcccatcgagcggctcttggacgccacccccgggcgccatccgtaccagcgcgcgcgcccgccccccccgcagcnnnnnnnnnntgcagggccggggccctcgagtgctgcccggtcccgtgcccatcgtgcggctcctcgacgcctcccccgggcgccatccgcaccagcgcgcgcgcccgccccccccgcagcacgtccccggcggcgggcgccaggaaggcgggaacgcacgacccgtgccgggcgatggccccccgcgccagcgtcgcgccggcctccgggccaaaggggtgcgccgcgccgtgcacgacgcagaagccgtcgctggggggcggcagccgtccctcctgcatccaggcctggagggagcgcaggtagggccgcagcccggcgcagaacagcgtccgcagcatgcgcgtcgtgtctgcgaggcgagggggtgagggaggtggggcgggggatggcgtgtcgatcccgtgggacctgggcaggagcagtgcatgggctgggggtgtgcccgtgtggccgtgtgggacactgccgcccaccccccgtctcccgtccagcgccacaggctctgaatgatgcaccccgcggcccccaggccacgcggacctccctgaaccacccacccacccacctgatgacctgccacacccccaaatnnnnnnnnnnagctgggggtgtgcccgggtggccccgtgggacattgccgcccaccccccgtctcccttccagcgccacaggccctgaataatgtaccccgcggcccccaggccatgcggacctccctgccccacccacccacccacnnnnnnnnnnccacctgcgtggcccaggagcatggcgcgctgcagcgcctctgccagcccagtcagcacccgggcagcgagggggccggggccgccccgcgcgtcgcgagcgcgcggcagcaggcccgccagcagcgccgcggc

SEQ ID NO: 42684 - DNA, 61 bp, Chlorella protothecoides
tcacaaaggatcccccccccccatccttctcacgccacccaccgctcttgtggcaggagct

SEQ ID NO: 42685 - DNA, 61 bp, Chlorella protothecoides
gacctggcgcgccaaggtcgacgtggctgggttggggggggcagaggagatgggcgccgca

SEQ ID NO: 42686 - DNA, 24550 bp, Chlorella protothecoides
  modified_base (897)..(906): a, c, t, g, unknown or other
  modified_base (1537)..(1546): a, c, t, g, unknown or other
  modified_base (2965)..(2974): a, c, t, g, unknown or other
  modified_base (4256)..(4265): a, c, t, g, unknown or other
  modified_base (4713)..(4722): a, c, t, g, unknown or other
  modified_base (5620)..(5834): a, c, t, g, unknown or other
  modified_base (5909)..(5918): a, c, t, g, unknown or other
  modified_base (6440)..(6449): a, c, t, g, unknown or other
  modified_base (7663)..(7672): a, c, t, g, unknown or other
  modified_base (9155)..(9164): a, c, t, g, unknown or other
  modified_base (9612)..(9621): a, c, t, g, unknown or other
  modified_base (10144)..(10153): a, c, t, g, unknown or other
  modified_base (10357)..(10472): a, c, t, g, unknown or other
  modified_base (10563)..(10802): a, c, t, g, unknown or other
  modified_base (10950)..(10959): a, c, t, g, unknown or other
  modified_base (11050)..(11059): a, c, t, g, unknown or other
  modified_base (11232)..(11296): a, c, t, g, unknown or other
  modified_base (12048)..(12057): a, c, t, g, unknown or other
  modified_base (12495)..(12504): a, c, t, g, unknown or other
  modified_base (13988)..(13997): a, c, t, g, unknown or other
  modified_base (14412)..(14421): a, c, t, g, unknown or other
  modified_base (15252)..(15261): a, c, t, g, unknown or other
  modified_base (15505)..(15555): a, c, t, g, unknown or other
  modified_base (16288)..(16297): a, c, t, g, unknown or other
  modified_base (16551)..(16560): a, c, t, g, unknown or other
  modified_base (17587)..(17596): a, c, t, g, unknown or other
  modified_base (17690)..(17699): a, c, t, g, unknown or other
  modified_base (19298)..(19307): a, c, t, g, unknown or other
  modified_base (19398)..(19407): a, c, t, g, unknown or other
  modified_base (19590)..(19599): a, c, t, g, unknown or other
  modified_base (19933)..(19942): a, c, t, g, unknown or other
  modified_base (20315)..(20324): a, c, t, g, unknown or other
  modified_base (21384)..(21393): a, c, t, g, unknown or other
  modified_base (21477)..(21544): a, c, t, g, unknown or other
  modified_base (21739)..(21748): a, c, t, g, unknown or other
  modified_base (22336)..(22345): a, c, t, g, unknown or other
  modified_base (23304)..(23313): a, c, t, g, unknown or other
  modified_base (23886)..(23895): a, c, t, g, unknown or other
  modified_base (24278)..(24287): a, c, t, g, unknown or other
gtccgcgcctcccccgccgcccgcccccccgcgcgcgggcaggacgacgccgtcggcgacgcagaggcggcagagccagtcgccggggggcacggcgtccagctccgcgcaggccaggtgccaggcggaggtgcaggcgtcgcagcagagcaggtcgccgccgagggcgcaggcgtggcaggcgtcggcgtgcaggtcggcggccgccgccgccagctcggcgctgttcacgatgcccagcagggtcttgatggacacgtcaaagtcgtccaggaagatgccgtcggcggggcgacggtcgcggctgccgctgtgctcctcgaactcggagggcgagacgcaggccgcgccggcgcaggcgcggcagccgcagaccacctgccccgcgccgtccacgcgccccgtcagcagcacgcgcccgttcttggtctggaagcgcaccgaccgccccgccagcagccccgtgcgcatcagcgtgcggaggtgtgcagcctggccgcggcccagcccgagcgcgtcacgcacttcccaggccagacgcaccaggccctcggggtggtgcgccaggctgtcggggacttggaacggggcgctcgggggaggggggaggaaggggcctgccgtgggtgtagggccgccaggagccgcctcggtgccaggggggggcggggccggcgacgccagggcgtcgggaaggtcgcagctgggagaaggatcgatgctcgcggtcttggcatctggggccgactgctgcagcggctgtctggtcaagcccccgcttgcaggggcgtcagccggtgggtcaccttccttcccgtcgggcatcgattgcccggcggcctctgcgggcggcgcagccccggcctcttcctccttgaaggttgccggtccgatgcnnnnnnnnnncgcggacggcgcaggcccggccccttcctccttgaaggttgccggtccgatgccttccacaccgaggagggccgcctctagccccgactttgccgcctccttcagttctggctgaacgatgcctgcaggccctcgcagcggctgctcggcgacgactgtgacgcccgcctcgctgccttccgccgcgccatgcgcgtggccgctggcggcggagagcggctcgtcgactttgctcttgggacccgcagtctccaggtgctggtcagacgccagctcctgcccggcgtggacactggcttccccctcggcgctgtccttccccgccagggtccatagcgaccggaccatggccgggagcgcggtggcgcggctctgcggcgggagcaggcgggaggtagctcgatgccaaggggtatagatgatatgtgaggatcctatggtggccatgttggggttacgtcacggctgtcgatcgcagcagacccgactcgatcgatcacccgcacacgcccacaacatcagcacagcctccagccttcccgcgcccgacgccgcctgtccttcccacccaccaatcatactcactcaccccccaacctccccttcctgcctcaccgtgaagctctggccnnnnnnnnnnggcctgtcctttccgcccaccggtcatactcactcaccccccaacctcccttcctgcctcaccgtgaagctctggccagggcacagggtggcatgcatctccttgaacgtcgccgccttcctggcgctcccccggctggcagggaacagggccagcacccgccccgtcaggtcgcccacggtccgggcctccgccgcggcggccagcaggccctccatctcgcagccgtcctcgggcggagggggcagggaacccctcgtcccaggagagccccgtgcaggcgcggggaccatgacaggctcggcggccggggcgcggcggccgctgctcactcgctggcgcttgcgcggcgcgctgcctgcagacctcggggcctcgctggcctcgggggccgcctcccgtgtcgcctcaggcacagcgggggggtctccgccagcactcagtcttgcgtcgtccggcccagcctctgaggcatccctctggacgcccagcctggcagccgacagggacaggacggactgccgcagcctgacaggcgagctgcccctgcgggactttgactgagccggggtgctgtcgggcgcttgtgcgggcatggcagcgcccccggcctcgccgggcctagggcggccgcccagtcccgcagcgccggactcggcggcgaggcgtgccgccgaggacctgcaggcgcgagggctgctgaggtccaggctctcctggtccaggttggcaagctcgcgcttgggagtccgacgccgcgactggcgcatgtgggatggggaggcaggtgggcggccgcccagtgttggcagttgcacaggtgcgaagcctctcctgcggcaccgcggcggtgatgtcagccctgtcaaatgcacctcctcacctgcaacccatttggtgctgtgggactgcttttgcttgcttggttgaccattcaggcgcaggcaggtgtatgttggtgggtctgcgtcgctggggaggtgcaggagggggcctgtgagggcccagctggcatgtttcaaggtccaactaggtcttagagctccattgtacatgtgaacgagcctcacacagccagctgtaggccgaggcgtgcccagcatgaggtcctcgcaagggctcgcgaaaactcaaacggaccctgacctgggcccagacggaccggaaagcacataattgcttacttcaaacaccctaaatccatgaaaatgctctacctgcgacaacaacctctctcccaggacgcgacaagccgcttccgcagttcaaacgggttgcagcaagtgcttaatctggaatctctcgcagggtgctgttcccttcatctcgcacccactcgttaaatcctcagagcaggagtggttcaaaggtgcgtaaggcagtcccaaggcgcctgtgtaggccatacaaataatcccnnnnnnnnnntatccttagagcaggagtggttcaaaggtgcgtaaggtagtcccaagggcgcctgtgtaggccatacaaataatccccttgaacccaacccttcttcccgcgcttcaatgcgcgctctgtcggggggagctgcaaattccccgatgctccgatgcccagggcacctcatcagtcctgtgcaggggcagaacgcgcagctgtctgcgaaggtccagtcgacgactacaccatggtgggcggggacagggcacgggaaagcatctgggttcagggagtgtggtgaacaacttctctcttctgggtgcccggacctccgacgaccagattggcacctctctcaactcccaggcgtccatgaggacggtggaggagaccttttttgacttttcccagaggaggaaaggaatactgagggccctggtacaggaggtgcgtgggtactttcggtacggaatgggtccttgcaaggtcaggtccgggatgagtgttcctctcctccgcacatcagcccgagaggccttcgcccgcgcaggtggacaagttctacgcggcatgtcacccagaactggacaatctctgcctgtacggcaacccagacgggagctgggaggtccgactgccatgtgatgaggtgggactcttgtgtaactttgaaatttttggcactccacaggcgattccttgccatttttcgccccacaatgcaagcaccgatttgactatgtgaacactgtgtcctacaccaaaccatggagctggcaatgccggaatacccccacccccaccaccccgtcccaggttccaccagagctgcccgagccggctctgggtatcaactttgcaaggtgagttcctgcgcgtgtggaggaccgcagtaatcgggagaatgtgcatcgaatttccgtgcacggcatgcctgcggatggtggaagggaagccaagctcaatgctcggtgaccctacgatgaaaaaatcatcattcaatgctcacccactccttcgttagggatggcatggaccgtcgagactggctgtccctcatagcggtgcattccgactcctggctcatctcaatggcctacttcaatgccgccaggctggatgccgagggcaggtgggcgggggccgaggctgtcatgtgtgatatggatggctctgatcattagattgtggtttgccaatagagatggcaaacagacctctttggagcatgcacgcgttcttgacctgggtcgttcgtctgtcgctcccctcgcaagcattcagtcaataccacactctnnnnnnnnnngccgaggccgtcatgtgtgttatggatggctctgatcattggattgtggtttgccaatagatatggcaaagagagctccttggagcatgcatgcgttcttgacctgggtcgttcgtctgtcgtttcactcgcaagcattcagtcaataccacactccacccctggcccgcaggcggctcctcttcaatgagatcaactccctgcccacatgtcttgaggtggtgacaggcagcgcagcccctggcagcaccacccaggctgccgctcacatctccaagcgccccgcgggagtgccccaggcagaccctgcccccgatacaaaacgcccggccttccaccctgccgtgagtctggctgtggcgctgggccagaccgtgtgcggcgctgcttgtctgctgcactcgttgctccagccggtggcactggctcccactctgtacccccgccnnnnnnnnnnttggtgctgggccaaaccgtgtgcggcgctgcttgtgtgctgcactcgttgctccggtcgctggcactggctcccactctgtacccccgcctgctccgagaatgtcttcgcccttcctccccaggccaaccaggggcggccgcgacaagggcctcccccttcatcggccgccgaggagtcctcggggtcggaggatgcagaggaagcggagtacgagccctgccccaactgcggccgagagttcaagtgggtgcgggtggtgtgggagcccaggggtgtggcatggctggtgtgctcctgcccagagctcctgtgtggtgcagagctgcagtggcatgggcctgtcgccttgcacaacatggcggcaacctaacggcggctccaaatgcatacgaaaccagggacggcgacttctggatcttctgcgactactgccggcgctggttcgacgggaggtgtgtgggcatgacggcgcagcgtgccgaggcctccaagacgtggaagtgccccttctgtaccaaggaggcatagcgaagcacggttggctcgacggcgcggccccggccgccgccgcgggcccgcccgtacgcccctcgctgtagaatggcgcgcgggagcgggggtgttccggagactgcctgcgtggccagaccctgggttgtctatttatcaacgtcacaggctgagcagacggaattgtgtacgtgggtgtgcagggcagccagccggcagaggccctcgctctcgagctcagtgcgcggcgaccggcggccgctgctgcgcggcggcggccgcgccccgccggccccccagcagcatgtcgggggagtagctcgacgccacgtcggtgatgtaggggcctgcgggagaggaagggcgacgcgcctgttgtcgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggtgttgggtgggtgcagatgagacagcagggggggggaagggtggttgcactgcctgcctagtggccagnnnnnnnnnnccaccgattccaggcaagacccgattcagccaggccaggggttctccaccccgctgcagcgcaccgttcatgatctgcagcacggtcaccgcctcgttgaagggcaggcccggcagcagcttgggggtgaggaggaagcactggggcgttcctggcctgagaatgtaaggggttgttgggggggtgcagatgagacagcaggggggggggaggggtggttgcactgcctgcctagtggccaggcctgagctgcaacgaagcagaccctccttccacccaccaaagtcgcatccaaaaccagaacaatggccagcgcacctgcttgccgcctccacgagctgcgtgtacaccttgcgctcgttgataggatccatgccctggttgatctcgtccactacgcggaagggggccaccgtgattccctgggcaggcgtgtgcagcgtggggaatgatgagggaggatggttttgatggactcccaggctctggagtggcagtcgcggctgggtgccacgagcgccnnnnnnnnnnatgtgcagcgtggggaatgatgaggggggatgggtttgatggactcccaggctctgggctggcagtcgcggctgggtgccacgagcgccgatgccccaggacgaggctcgggccctggtccgggccggccccgcccgcggcaaggcatggccatcggttccaccgagggagccgcccagggaggcaggtcaggcccccacctgcacacacctggagcgcgatgaggtagaggatggtggagacggaccgctccccgccggactggcggtgcgcatccagggtctccagctgctgcgactcccggaacttgaccctgatctcgacggcgtacccctcaaagtcctgctccgtctcgcgcaggaccacctcccccgcgcagcccacctgagtgcgtggggtcaggtgcatgctgttgagcaagggaatggttcctgacggaggctgtggggaagtagtgggtggccccatactgcttgatgctcaaggtggggtgcagcttccacaagccagactctcgcacagcgctgatgcgctcccgtgccatgcaggagcggcagacgtcctcctggacttcattgggatcctcaccgaagcaaagttcctctggaagctgccgttgatatggtccacgatggtacggatcctggacagccattgctcctgggaatggggtcgggcaacggtggggatgatgccaggctgccgcgactggtcaccagagtgtgcgtgaaaagctcgcgcatgcagcgccgtgcagcactgagatgccacgccgcagagggaacccatacaactgttttgagtctgtcagagggaatttgagagtgcatgggcgggccacgaacccccagcaagcacacccctcacctggacggactgcagctctgcgtcgcaggcactcagctgcgcctgcatgccctcgagctcacgctcctgggaggcaatctggtcctccctgagctggtactcctcccatgctccaggattcgtgatcaccagcccagccagctcggtttcctgtagatttgaatgagggtggagaggatacgtttcgtctctggcatcctgtagatccccacattcacccttgtgacaatatttgtatgcacacaggcggaacgatacctctgtgagagggccacatgctgccccgagcgcctttgtatcgctggcaccttccccccacacacactccccaacactgaggatacagnnnnnnnnnntgagcgtctttgtatcgctggcacctccccacacacacacactccccaacactgaggatacagtgtcagaatcccccctcccaccccaccatgccgtaccagggtctgctggtgctccgtgagttccaggagatcgtcagggaattgggcaaagagcgcgtcgtctccggtcttgtaggcttcgtggaacatctgacgcacagccctgctcaggaaaggggggtagattcatcgagctcaggaccgattgaccaacctgggacacatgccatgcactgtaaggtatgcggccagggttttgcgggctgagcgtccgcatcgcagagcggaaactcattggtaccaaagtgttatgaggcacccgatcacctccgcccttcaggactcactccagctctcgagtcagctgcatgaccctgcgtatcttctccccagcctcctgcttcaggccgtccatctggcgaatgcgtcccctggggaaacaagggcgggcacgcaggtgagatgcttgtgcgcccagaaacacaacccgactggagacttggacaaggcacctcgcaggtagctcgccctgtaatgtcacgatcattcccttgcccccttgcttacgtggagacctgcctcgcggccagcatgcgcaaggccagcgccttgcactccaggtcggcgacagcaaagtcccggtgcgcctctcccagcttcaggagtgttgccgcgagatccagggcctgcggcggtgtggtagggcgtggttcatagataggtcattgtggaggctccgtggtgctggcgtctgggcatcgtcagaggccggcacaggcgtggaaccccctaaccgccacccctccctcgcacgcagtgccaacacacagcgccacagaccagagcatgggcggcggcgcggatcctcgccgactcctcctccaaagccggtttcctggtcaaggggctgccctgctcggcgaggcgtgccagctctcgcttcttctggtccagggtgacatccaggttcctgtccctgcacaacatgggcacggaacatggtgtttaatgtcagaatagcatcgccctcgtcctcggtgcgcctgtacttgtctcacactctcctccacctccaagcatagctccgtgcaactcccttcccttccacatctcccacctggcgtggatgtcacgcagctgctcgctgacatcggcatactgcttcccgacctcctgcagctgcaggaggatgggctgctgcgctgcacggaccgccgccagctccgcctggtgcttggccactctggcctggcactccgaaaggctggcctgggctccctccagctccgacccgcgggtgagggaggcgggcgagaagatgcggggggcagagatctgccaaacgttaggggggaacgtgggtgcttacctgagcggcagcttgagcgagacatcagactagcacgcaggaaaggacagatacactggagtggccgactgnnnnnnnnnngacgttagggggaacgtgggttcttatatgagcggctgcttgagcgagacatcaaactagcacgcaagaaaaggacagatacactggagtggccgactggtgcaggaggcaccttggaccgagcacagtgcatgctccagtgaaggtgagcccatggcctgaggctgtcgtttggcgcaagacagggacagcgtcagggccgaggcgtcccatctgaagccattggatcccagtttcacactgcaaagcatcattccgagccaagtaggagagctcgctcaccgtaaggatggagcaagactcggcactcgcgttgtaccggctccggatgcgtctgcaggcatggaatgggctcgctggtatggagcgcaggagaggcccacatggatgttgcctcatccccatccatggacgtgtaacgtaccaccatccgccctcccctcctgtnnnnnnnnnngtgttgccgcctccccatccatggacgtgcaacgtaccaccatccgccctcccctcctgtccctccatccactacccaccgataggagagcttgggggtatacaggttggtgaggcggggcacctgggccagaatctccttgaccgcttcctgacggggtcggagtatggagagaatatactgttcacatgccctccagtaccccgctcagcgctggcgcccccctgctggcccttttcatgggccacactccctggacgtcatgccagggccgcgccaggccccccctcaccccacatgtcccttccttgcctgtgcctgggaattgccaataaaggcctcggtcaggcggctctcctcctgcaagaagtgcttgaccaaggccggcgactcgaacacctgatcaagcgagtgcgtcacgccatacctgcgacgacggggccaggggagcgtggatgatggcgggggaggcttgggcaaatggggggcttcaagtgtgtggatcgctgacccaacagaacannnnnnnnnnaacgacggggtcgggggagcgtggatgatggcggggaagcattgggcaaatggggggctttaagtgtgtggatcgctgacccaacagaacatcgcaccccaggcaccctggcagggacagctgaagcctcaaagcagccagtcacgcaaataccccaggcatccaatgcacctggcatagtgcgcggcctcgcccaggggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtggggggtagggattctgggcattgtctgggtcagagtgccgatctgcatcctgagaacatgatctcgacctacgcaccatgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccaagccatgcctctccagcacgcttgctcattaccaatacgcaatgacacaggcctctcagattctagggttgaagcctcggcacaaccccttttccaacaaacagtactcaactgccccccaagaagcagagtccgcccctnnnnnnnnnnagggtggggtggggggattctgggcattgtgtgggtcatagtgccgatctgcattctgaaaacatgatctcgacctacgcaccatgccctnnnnnnnnnngccctggcagggacagctgaagcctcaaacaagccagtcacgcaaataccccaggcaaccaacgcaccgggcatagtgcgcggcctcgcccaggggccggctcagggcctcctctgggttgcctgtgaagttggcgatgctggcgtcaaacctggcagggcgcgggagaaaannnnnnnnnnnnnnnnnnnnnnnnnnnnnnnnnnnnnnnnnnnnnnnnnnnnnnnnnnnnnnnnngtggcaccaccgatacccatcacgagccagccgccggcagcacccacccgcactggcgctggagctcctgcttcagcagatcctggtcctcgcgatgctgcaccacaaagtaagtccacttgtcggctgtggggaatgggtcgagcgtggggccgtggaggggctgcaggcaatgcgcagggtgcatgcaagggctaggcaggggatggagacgtagttgtgacatgcgctggtccaggctgtgcatgcagacacctgcctgagtggacccccaagccatgcttctccagcacgcttgctccctaccaatacgcaatgacacagccctctcagattctagggtggaagcctctgcacaacccctgttccaacacacagtactcgactgccccccaagaagcagagtccgcccctccaaccaacccaccagtcacatggcactccagggcctgggcatgctcaatgctggacacctccacgcacgcggctacagggcccagcaccatgcccctgaaccgatcccggttggcctccagccactgcgcggccctagcgatgccgggcttccgccgattcagctcctgcggggggtggaggtggagcgtggggtgctcatgatgccattctctgatcaaaacgagagaacctcgggccgcaagtgtcggggcctgtgcaccagcagaccacccatccacccacacatgcgccccccctcttccaaccccttctctgcagcttccgtccagctgccnnnnnnnnnnaaaaacgagagaacctcgggccgcaagcctcggagcctgtgcaccagtagaccacccatccacccacacatgcggcccccctcttccacccccttctctgcagcttccgtccagctgcccacctccaggcgcaggcgcctggtgtcctgaagctccgagacggccgtggaccagcgctgcgcgccctgctccgcgaggcccagcgtgtgctgggcgtcgaccgccctttcctccagcaggcgcgactggagctggagatcgttctgcagccggctcagccgaaccttctccgcggccagcactgtgcggccgccgtcctgcggcgcccgggcctctgtgggtggggatggggcgggtggagtttgcgggcactgccaggctatgtgcaggggccctcgccagacaggcccccatcgcatcggcaatgatctgacgacnnnnnnnnnnctctgcagccggctcagccgaaccttctctgcggccagctccgtgcggccgccgtcctgcggcgcccgggcctctgtgggtggggatggggctgagggagtttgcgggcactgccaggctgtgtgcaggggccctcgccacacagacccccatcgcatcggcaatgatctgacgactcgcgtgctgagcgcctaggctgtcattgcacccgtgctgctctgggcttcaggccaagccagagtgagaaaattggccagcaaggtgcccccatgccagggtacatggcttgctgcccttcgacgacgtgacaaaccctcttcgcaccacacaaccgcaccctcaggcccagcctcccccccggcatccaacgtaccttgctccagctgcacgatgagggtccgcaggcccgtgatgcgagcctcccagccagccgcctcgccctcgaggccgtcgatgccgcgctggcggacgcccaggttggcggccagttcctccagcgccgacagcatgctctggcccctttccgtgccgttgagcttcccctccaccacgctcaggctccgctgggccttggtgcgcaccctgtccgccgccgcctcctccttgctcagcgccctgatgggtgccagggggggagctgggcatgatgtgtgacttcttggtccccattgtgagacaagtcccgtgtcaggcacgctgccgcgccattgtgcccgctcaaagacccagcagtgagatgaggtgacccacgctgtgcgcggggcgggctgagatggtcacgcccatcatcacgctgccatgcccaggcccccatacactctgtgttggcgcatttttcaaaaccccacccccaagcaaagccccactcacttggaggtccccgtctcctccctgatctgcgcctccagttctgccactgcgtctgcggcggctatggattcctgtgcagggagtgggtgccatggggggtccgaggtggtccccatactgtccatctttcaggaactcaggaagcgccgtgcgccattggaaacgccggtcacagcacccgacccatgctcggcagcgattcgacaacccccgacaggcagcgctccttccccttcagtcccctctgcacctgctccgcatctctcagcatcctctccacgctccggtgcttcagccaggcactcttggagccgcacagccgtatgtcctccttcagccgtttgcgccgcttcaaggcacgcaccgctggctcggcccgcacattggctgccctcagggtatccaaactctctgccagcgccttggtggcctggaaggggagggttggccgggtttgggtgggtaagggttggcagatgcagggattagacatgggcgctgctcttccccgcgccctgccagcccatgagagtggcatgcaccgtgtgaggattgggggttgaaggattcaggccaggggcagcaccactcacgctctcgagccgcgccgcgtnnnnnnnnnngttggggttgaaggattcaggccaggggcagcgccaccactcacgctctcgagccgcgccgcgtccttcctgccctggatcagcctgtcgtgcgctgtggtgagcgagtcctccccgatggaggcctgcgttgcccgcagcagggcctgtgggttcagcctcgcaaactccacgaccttgtcctggggcaggaactgcgggggcgcagaggggaggtcatcgctcgtgtggaggcgcttgtggctggcgctcgcaggttctggcgagcacatggccgcagcgtgcatttctcgaggggacgagggacgggggccgctgtgtccgatcctgcaccatggtcgcccaacacacctcaacacttcccccccaacccccccatacattacctggcacaagttgtccaggtggatgttgnnnnnnnnnngtcctgcaccatggtcgtccaacacacctcaacacttccccccaacccccccatacatcacctggcacaagttgtccaggtggatgttgagcgaggccacccttgcctgcacatcccggttcaggcactccttgcctgcaattgtgtaattggcaatgtatcattcaaaaaacatggatgggcggtacggtagagtctagcacttgacgccacatagtttttctgcctccaacaacccccgcaccattgatgctccaatccgaggagttcttgctggaatacatgattcgctggatgagagtctcgcggccctcagggccaccagccagcgtgatcttcacccaacccttgtcagctcctcggcgtacgtagtttgacacttcgtcggccctgcccagcagctgtgggtttggcgagattggggggattaggttcgcagattgatgtgagagaggtttgcgtctagcgcattggttggggtgggctggcatgccttgcactgaaggatgcatacacaagcaaaggacatagcgcctgcagcaatatccaccaccagcacttggcccagactacctcccaagcaccaagccgggtcaggtttgcaaaccggcacccacccctgtctttccgccgaggccgacgcacagagcgcacaccagggagcttttcccagttcctgtggtgtgcatgccatcagggtctgggttacagacctgcagagagatttctgaggctcctacatctattgacccccgccatagtcaatcctgcccaacctaccgttggggcccagcaccaggttaagctgggggcctgggttgaagacggcannnnnnnnnnaacatctattgacccccgccatagtcagtcattcccaacctaccgttggggcccagcaccagattaagctgggggcctgggttgaagacggcatgcttgtacgtctgcgaagcgcatggtgaggacgctgccagaccgttgtcaggctggggagccagatccctatgccatcccccccaccccttcctaccatgaagtccttgagttccaccttcaagacggcaccacgcacggcggccctggnnnnnnnnnnnnnnnnnnnnnnnnnnnnnnnnnnnnnnnnnnnnnnnnnnnagaaatgcgaacatgtaaacctctgtgatgtgctgtgcatacctggagtgcgcaggctcctcccccatctcgaccccctgcggtgcagcctctactcagcccgtgcagcacctagttgcgactcgcccatcatgagcatggatcgagttgaagaataagacgatattatcaacgctcaatagagcaacaactagcgctttccttatgttcgctgcactgatctctgccacaggagacgattgttgtattcaactttcggaacctgatgaataaggcgcaagatcggcagaccttgtaatctgacgagactcagggctcttagagcgatgcatactcattttccatccagcaaccacacaagatacaacctcactggaacgtcggcgtaggcatatggttgtgagatgccaaggctggaggtcggattccatatacccattcagtccaagctgcgaggctgcaagtccatcgaaaccccgagcgatcgtaggcgtgcgttgccaatggtttcagcttgtagcgcggttctacgtgatctcttttgtttctgaacttcgttgagagtcatgcctgcccccatggcgagttgggcgtcactactacaccagcaagtgctgtatgcacccctctgccccatattgcctcgacaagacttctaaaattgaaaattatgattttttcccaagcgtttccttcgaacgttgtctgcgaaggcaggagtagctttacgaannnnnnnnnnccccctctgccccatatgcctcgacaagacttcgaaaattgaaaatgatgattgttttttcaagcgtttccttcgaacgctgtctgcgaaggcaggagtagctttacgaaacctgcaatttcacaccgcgcctgtaggtcccagacacctgagctgaattataaggtcgtgcttgtcgacagccaccggtaatacatcgtgtactatgctgcagtccgcaaagcaagcgaacgtcattggtgatgctgacgggnnnnnnnnnncccaccagtaatacatcgtgtactatgctgccgtccgcaaatcaagcgaacgtcattggtgatgctgacgggaactcgaaatggatggccgtacgtagttggatccccccgcgcgctgaaacagccgatctcgtccaaatgggagactgaccaccgcgcatcaccgaccaccccttcacaacattgcatttctacataatgagcgcgacaacgagattcccagcacccttcatgacaggcccctgggggcgggtcgccaaagcagcgatgagcaggcccacaccttgcgggtcatttgccgggtcacggcatgttcaagggcggatggcctcgcattactatactttgggaattgttccatcctctcccatggtccatcacgctgccagaaatcaaagcgctgtgccgagggggggcctggtgctcagagcccagaggggtggcaatcctcaggtcgcagaccgggtagtgtcctccctgccctaccttatccccctgtttgatggcctgcgatatggtaagcttattgtgcaggttttggagcctccatggctctgaggtgtccccatcctcatctgcatggccatgccccccctgagggacagccttacgcccctcctcggcacttgcaggcaagttcatcttcgtgcagtaccctgcagtccagtacgtgctggcgcctctgcagcccctcatcagcctctactttgggttcccctttgcgaggtgaggcgctgacttgcgtgccaggatctgtttggagatggcagctttggagagcacgcgattctactgccagcaggatgggacgatccctatctgcaagaatttgacacacatgcaatcaccctgtccacctcgcagcctggtggtcttctttggggtgtatgccggcatcatcaacaaccaatcgttcaggtgaggagcgggacgggctggggaaggcggaaaggggtcgatccactcgccaaacccggccctatgctgacaagtatgcatacctgggcatgactgtcgtgcagacgcnnnnnnnnnnatgcatggatatgcgggccctgtggggcaggaaatgcctgcatgctccccgtttgcaagaatgttcaccttgctcgcccctcttgtaatcctcnnnnnnnnnntatcaacaaccaatcgttcaggtgaggaggggaatgggctggggaaggcggaatggggtcgatccactcgccagacccggccccatgctgacaaatatacatacctgggcatgactgtcgtgcagacgcttcaatcagcctcatctcaagtctcatcccagcctcctcgcaacacatgcagccgattcgtgaggttgaatgcgctgcaagcggtcctgctgtcggtcatcctgatgtgagtcccatgccttgtctgggcctcagagtgcattgcatggatatgcgggccctctgggccaggaaacgcctgcatgctccctgtttgcaagaattttcaccttgctcgcccctcttgtaatcctctgcagcctgcctggcctgctggaaagcgtgttcctgcagagccctccccggggcactgccctgcaaatctacatccagctcagcaacgccatctggctcttcacctctgtctgcgtcgcctatggcattggcgcgagcctggctggacgcgtcgcgcagctgcctttcgtcagcagtgcggcagaggcacaggtccgctgacacctgggcgggtttggggggcccgatgccagggccacggcatcgcgttcccccatgcaatggtcatgcatgctctggatgcctcctctggttgcatgtcccgtggtccccgtctgcgctgcatatggttgttgagatattgttgcaccgacgattgtgggggtcacagcaagaggctgagggatgcagccaaagtccatgtgccagccagagctcagactgggttgccatgcttggcaatgtactcgttgatctcctcggggctcatgccctcaaatggatctgctgcgctggcgcctgccgtggccttgctcacatactcctgaatggcctgtgtgggtgtggggtggcaaaaagtgtgagatgctgccgcgtctcgaaagcaggcggggagctgccagtgagcagcagcacgcttgcctgcccttctctgccagggagcctagacagcaagacctgactctctatattctcatcaaccagctggaccccacagaagaagctgggacttgcctccggctccagaccgtcgaactcctccccatccagcacgctctgccctgccaggatgagccgtgtcctctccagcttccgcgcctccttgtcctcgtccaccttgggtggttccttggtcttccagaaccttggcaggttgttgtaggccagcaggctcatccctgcgacaaaggcaccccagtacaccttctcccatgtggtcagcttgccgccctccatctgccgacgctcccagggaaacatccaaacagtagctgcagggggtgggtgtacatgggcatggaggcaacgtctgggcaacgaagctgagctggcttgttggatgtggttgatagcgctccatcgttccttaaacgccgagcccaaattgcagcgaccgtcccactgcatgcatgctcaccaatggcagcaccctctcgctgagcctgtgccagcgtgcgttctcctccaggagccatctgggcggctgcctcggatgtggaggccagcgaggaggacgtggtccctccatcgactctnnnnnnnnnnactgagctggcttgtcggatgtggttgatagagctccatcgttccttgaacgccgagcccaccgtcccactgcatgcatgctcaccaatgnnnnnnnnnncgcgtacgtgcgtcgctgggatcacctatggagatggctgtgtggatttagtgagcaaatattcctatatctgcgacaagacggttctatagtgtacagcctttcgtatcagtatataaagttgttccgaccaccgttcggcgaatgaacaccaactcatgcaatggtcatcgtcgcgccctnnnnnnnnnnagcgtacgtgcgtcgctgggaacacctatggagacggctgtgtggatctagtgagcatatattcctgtatctgcgacaaaacggtcctatagtatacagcctctcgtattactatataagttgctccgaccactgttcggcgaatgtagaacaactcatgcaatggtcatcgtcgcgccctgtcgcattggttggaccactaatgctcgttcccaagagtctcacacatcaaatggttgatgggttatacagacgaagttcaagctcacgtaaaaacagactgagagacatctcgcccttaactttcagagaagccgggccttgatgatccgcnnnnnnnnnngatgctcggtcccaagagtctcacacatcaaatggtagaagggttgtacagacgatttttcaagctcacgtcaaaacagactgagagacatctcacccttaagtttcagagaagccgggccttgatgatccgcacctcgcccaatgggcggtcgccggcatctgtctgcacattgcccaaccgcttgatcacctccatcccactgctcacacggccaaagatggtgtgcttgccgtccagatgcggtgttggggctagtgtgatgaagaactgggggttgaacaggtaaagtgaatgttgggcggtgagggacgtgatgaatcacctctcgcgctacctgtacttgcatggaggactctgctgcatgatgccnnnnnnnnnngaagtgaatgttgggggtgagggacgtgatgaatcatctctcgcgctacctctgcttgcatggaggactctgctgcatgatgccaaatgtcctcatgcgcacaacaagcaacggctgcctagatggcatattattgatccccttgagtacaccggcaagcgtcagcaccaaacgaattccaaacagaccccattgtccaatcaatgcccacctgactgccattggtgtttggacccgagtttgccatcgacagaatgcctgccccagtgtgcttcagctctcttgtcacctcatcctcgaacttcccgccaaagacagacgtaccgcccctcccggtgccggtggggtcgccacctggtgtgccaccgtgaagacatgtgggtacagacagccaggacagcaatcgatgaaaacaacatgcatggcaatctgcatgcccagaaacgtggcgaccctcattggataccttgaatcatgaagtcccgaatgatcctatgaaactgggcatcgagggcgagtggcaggagtcactcatcgtgggtcagctccaggagcagcatgtggggaacaagctgcatgcactaggcagcgcgcatggacactcaaggaggtccgacaacctgttcccactcaccacagtgccgtcgtaataccccttgattgctagcccaatgaagttctgaactgtgcggggtgcctggcgttcgtatagttccaccgtgaaggatcccattgacgtctgaatctccaccattggtgccgccatgttggagagagtaagtggaggatgctcctgcctccctagattgaggagcggcttgtcccgtctatcgctatttggagaacgctgcgcgcaaggtgagatgcgatcgagctggaactcaagctacacgctgatttggacgtggtgcgtaaagaacatcaacaaagtaacgccaagagtggatggctcgatcagcatgggacttcgacggcagtgagtgtctggcgccccaacaccaacgcatgccacgtcgtcacccgggttgaagttccgatcgccatgggcgctccagggctnnnnnnnnnnaacacgctgacttgggcgtggtgcgtaagtaacatcaataaattaacgccaacagtggatggctcgatcagcatgggacttcgnnnnnnnnnnnnnnnnnnnnnnnnnnnnnnnnnnnnnnnnnnnnnnnnnnnnnnnnnnnnnnnnnnnnctccatttgtaaccactcggaggacattcgccattcctttcgccgataattgcatcctgcacctcggcatacctgcgtatcgctgccttgtcgctcctcctctcctgtgaggggtgttcccctcttttccgaggggttacaccgccatgcgagccctggctttcccccagatcagcttgccacgatgacagacgnnnnnnnnnngtctttttgtaaccactcggaggacattcgacattcctatcgccgataattgtatcctgcacctcggcatacctgcgtatcgctgctccgtcgctcctctcctcctgtgaggggtgctcccctctgttccgaggggttccaccgccatgcgagccctggcttttccccagatcagcttgccacgatgacagacgggacggaggcaagcctccacccaaagagggtggctgcactgcccgcctctgcagccccgcccccggccaagaagaagaagcggcaggccaccagccccgacctcatccggcgggagatactcgatgtgtacagcgcatatgacgccctgctgtcgtctcccgcggacccggagccctacgtgcagacgctcgtctctgcaggcgccagtgagttgaagggtgtggccgcgctgggcggctgcccatctccatggcgccacccccagaatccctgccctagagatcattcgctgcccatcatcaacttccctcctcacccaaacacacatctgctcgaatcgcagccgggtcggcgcccgccagacgcctggccgcccgcctgctgccccgcttnnnnnnnnnntccggtgagttgaagggtgtggccgcgcttggcagctgcccatctgcatggcgcttcccccagaatccctgccctagagaacatttgctgcccagcatcaacttcccccctcacccaaacacacatctgctcgaatcacagccgggtcggcgcccgccaaacgcctggccgcccgcctgctgccccgcttcgcctcgctctgcccccgcctctgcctccccgccagctcggcgctgctggacctggcggcgctgagcctgggggccggcgaggaggcgctggccgcggatgcccgccgcgacgccggcgcggggctgcccctcgtggttcccgcgatgctccgcgccggggccgccgggcctgcggccacccgggcggccatcggcctgatcgacgccgccttccgcaggctggcccggccccccatcccgggggcagaggccgaggcctgggtcgaggcgctggtggtcgccttccgcgcgcggccccgactcgtcctggcggcctgcctgccggcgctgagggcggagggcgggggttcgcgcgccgtcgccgcctccctcatccgcgaccggctgctggccggcggggtggcggcggaggtgctggcgcagctgcccctgggcgaggcgctctggttcgacagccagctggagggggcgctgccaggtgggcaggtggctcgatggggtgacgatgcaggcggggggtggtggatggagggcagggcggcttgggaaacgacagggggcagcctgacggggggcgttatcgcgtctgccccgctgaaactgtatgacttcatgcagtgtgcgctcatcagtcctctgtcgacacgctctcaaccatggcgccccgcccacaacaaatgcccaccccccacccaggccttccccccgagtgcgccagcctggtgcgccagctggcagtgaaggtgcctgggtcggcggcccaggcannnnnnnnnncccctgagtgcgccagcctggtgcgccagctggcggtgaaggtgcctgggtcggcggcccaggcagcagaggaagcccgactggcagagggagcaggcggggacatcttggccgatgggccacaggatgggtgcgtgctctttggtgccttaaccttgtgctgtgcccaagggccatggggctggttgcatggctcgccaggcatcgctgctgtcacgattcattgggtgctgccgtgccctattctcaccgcgtctctcttccctttttgcctggcagacaccgagcccctgcaccagcctcctgcaacgggaacggcggcccgtccaacccccccctgcctggagacagcggcgcggcacctgcggccccccttcccccgaccgcccacgttttcccgccgggagcaggaacccctgcctccccactcccgcccctcccggctgcaatggtcatggggggtccaccaggtgacctcccgcccgccgcacccccgcttcctcctggggaccacccggaatgcatcgcgccccctgtccatgccccgagaaacccagcggctcctctggcgtnnnnnnnnnngtcccccgagcacgcacgtttccccgccgggagcaggagcccctgcctccccactcccgcccctcccggatgcaatggtcacggggggtccaccaggtgacctcccgcccgccgcacccccgcttcctcctggggaccacccggagtgcattgcgccccctggccacaccccgagaaacccagcggctcctctggcgtcggtagcgcctcggtcagcatcccagggccagctgagcccggaagggaggcacgcctgctcggggcgcaggcgtgactgcgaggaggacccgtccagtggcccggggccctccgatgggcaccggcgccgcgatgggccgccggcgtggaggggcgcggccgtcgtccgccccccctctccgccnnnnnnnnnngtcccagggccagctgggcctggaagggaggcacgcctcctcggggcgcaggcgtgactgcgaggagggcccgtccagtggcccggggccttctgatgggcaccggcgccgcgatgggccgccgacgtggagggacgcggccgtcgtccgccccccctctccgccgcggcaaccccgccccagcggccggctacgcgcacccttcgccgccaggggccctccctcacggcgcagccccagcccccccctcccacggcgcggcc

SEQ ID NO: 42687 - DNA, 67 bp, Chlorella protothecoides
aggggtgcggggtctcgtggtactggcggggcgcggggggggggggggggggggggacttccccgga

SEQ ID NO: 42688 - DNA, 68 bp, Chlorella protothecoides
ccccccccccccccccccccaccccaccccaccctgaccaggaccactgcaatccagcaccagtctcc

SEQ ID NO: 42689 - DNA, 15805 bp, Chlorella protothecoides
  modified_base (227)..(290): a, c, t, g, unknown or other
  modified_base (1211)..(1276): a, c, t, g, unknown or other
  modified_base (2814)..(2823): a, c, t, g, unknown or other
  modified_base (5328)..(5337): a, c, t, g, unknown or other
  modified_base (7298)..(7307): a, c, t, g, unknown or other
  modified_base (7838)..(7847): a, c, t, g, unknown or other
  modified_base (9755)..(9764): a, c, t, g, unknown or other
  modified_base (10338)..(10347): a, c, t, g, unknown or other
  modified_base (10944)..(10953): a, c, t, g, unknown or other
  modified_base (11389)..(11398): a, c, t, g, unknown or other
  modified_base (11824)..(11833): a, c, t, g, unknown or other
  modified_base (12248)..(12257): a, c, t, g, unknown or other
  modified_base (12715)..(12724): a, c, t, g, unknown or other
  modified_base (13141)..(13150): a, c, t, g, unknown or other
  modified_base (13542)..(13551): a, c, t, g, unknown or other
  modified_base (14745)..(14797): a, c, t, g, unknown or other
  modified_base (15055)..(15064): a, c, t, g, unknown or other
ggggggggggccgcaggcatccggctcacagcctggcatggggggcggcgctcttccgcgtgaccaccgcctcgatggtcccgtgcggctcgctggttgcgacgtacacgtcgttctcaaagcggctgaggaccggtgtgcagggcaggaagtgcaggtttggcatgttgaggaagaccgactccacctgcggcacactgcgaaggggggggggggggggggggggnnnnnnnnnnnnnnnnnnnnnnnnnnnnnnnnnnnnnnnnnnnnnnnnnnnnnnnnnnnnnnnngggcgacacgagaggagacaggtatggtgacaggcgccacaagctggcctgggaatgggtcgggggagctcgtccttttcttcaatgggatgcttgagccatgcactgccctcccaaccacggatggcagtgggtgccaacgcatcgagccctctatactcaccgacctcctcgccgcccttcccaccaaccccgccccccttcccccctctaccaagattgttatacccacttgctcagcgcattctgggccatgcggtacagcgtgtactgcacgctggggctgaacacgcccttggcgggcgggccatagaaggcggcggcgaacccggccttcacgccctcgaacgcggcgtcgaagcagggcgggggtgcgctgtacttccaggtggcggtcaccgaggtggccacgatgcggtcggggacgtctggcagcgtggtgaacttgtcatgcaggaagccggattagccgctctgcgtggtcttcagcaccttgagctccttcaccccgccctggatggcagccttgccggccttgtcgtaggtcgcgtagccggtgcggatctccgtcccggtcatcatgtagccgtgggagtggggctgcaggaggagggtggcaggaggagaggatggaaccatgtcgatacgagagccccgtgctccaaagctggagggtcatgtccgtaggctgggtgagaccttgggcacaagtgcttgcgagactttgtaccacccgagtatgccggcctgagcaaggtcgttttaccctcttacacactcgcccaccccatttcctaaacatcgagcaccctggatcccggactcaccacgccgtcgacgctgatgcgcttccagggctccatctccacaaagaccttggccttggagaccagggggtagttgtctacaaagtgcttggcnnnnnnnnnnnnnnnnnnnnnnnnnnnnnnnnnnnnnnnnnnnnnnnnnnnnnnnnnnnnnnnnnnggcttcttcatctgtggagatgtggtccaggggccgatcttggagagggtcgacacgtatgccctcctcactgagggaggcatgtagtccacgcacgggggtcccaggcgcaaaccattgcatccctcaccagtcatcacgatgcggttcacaagccacatccaccagcggtcataccctgtcatccaactgcaccccatgcaaccatacctgcttggccacatagtacactgtattcttctgggtgtcggtggctgtcatgccctcgttcgactcggtgaggaaggcgtgctccatggcgctctccagggtggtggccaccttgaattcggcaaaggtgtgcactgcaaggacaggtggcaaggaggctcctagggtcggacaggggattggggtttgcacatgcctgcaacccatgtattgatccaggctcataacactgtccccggcaatcactcaccgctgccctcacgccaaacgcgaccgactcgcacgcggctcttgccgtgctggtggagggccagggtcgccatgtcggtcaaggggatctggacgggcgggagggcggaacaatccgcaacaaatatttctatgatatgtatagggtttgagggccggacatgcctgcttcgcggacctcaccattgccgggcttgccccacatgaaaccctcgcacccaggacccaccgaagaaagaagggttgggcagatccctggacggggtgtggatgtgaagatggagctatacttccgcactactcacaaggaaacatgcagatgcagacaagatggactggtgatgacctcacacgcggacggcgtcgggagctgggcagaaaaaagtacagcgtaccagttcacgtgaccctcgttcccccggaaccctagaccggctcacatcggctgtgcgtgaaggcgacaaaatgctgaaactgggcaggggcatgaggtttcggatctcccaagtcaagtgtggtagaggggccagaacaaggcgagtcacaggacagaattgtgcaagggggcgaggcttagcaccaagcgtcgccaacccgctgaatacggagggtccgctctgtccctcgtcaaggagcggtggtcagcggacttgcgttgagtcagggcttctggtcaaggtgccgagaggtcggtctggtcgacctcggcggagcaaatgtcatcgggggagctgaaggccagggcgggctgggtgggtatgtcaccggcgccaggcatggggcatgcctccaaacacatactccagggctgccttctcctcgatagataggcgggacactccagaggaggcggccagcagcggggctgcacaggaccacgcccccacgggacgtgggggtgtgaccctgggggattgcactgcagcagcggggtgtggagcgcgaggccgggggtcgccaacgtgaatggatgaggggatgaggaagaaacgccccctcgaccctctctctgcgtatcgacccgcccgcatcagcagcgccacgggaagccatgcaccctgctggcctctcccagcacnnnnnnnnnnatggagcgcgaggccggtggtcgccgaaatgaatggatgaggagatgaggaaggaacgtctcctcgaccctctgtctgcgaattgacccgcccacatcagcagcgccacggcatgccatgcaccctgctggcctctcccagcacccacctctggcgagcttggcagggggctggtgatcgtccaccaccagcctgacgcgcctgacctccttcacctccagcgccaggtcgccgggctggcctcccagccccaccggcgatatctggacggccggggcatcgttgggggactccagcgccggcgtgccggctgcagacgccgcgcggtcctgacggggcaagggaatggtccaagtcggcgtgggaacaggacactgggtggcggaggaggagggtgctcaggagtttactgatggggcacgggaaactgggcagacgccgctcttgcccggaggccccccgaaactttgttccccacgcctcacctccccggcggggacaggggtgctgcgtgaggcagggccggcccggtgctggaggggagccggcgcccgcgcgggcgcgggctccagggcggcggccgaccccgggcgaggggtggcgtgccgggagggccccatccccaggtcgtcgcccaggccacccacgccaccaggcatccacaaatcagacagatctggcactgcaaggcacaaggcgggaacgctcggatggtctgcaaggagggtggggccccatgcagccatggggccaagatcaatgcatgccgtgcaggccaagatccatgcatgccgtgcaggccaggggggcccacgccccgtcagaagagccagccccccactttgactctgctcacctcccagcgagtagtcgtcgacgtagggcaggccgctggggcccgaggaggggaacatgtcatcgaagagggagccgcgccccaacccctcttccagactagactgtgcgggcctgtgctgcagggagccctggccatctggctggcgggtgctggccccaggcccgtcgatggacggcagggcctgcagggagccgcccaggaagtcgtccgggcccacgccgatggcgtcgaacatccaggagttcagggtggaggagttggacagcgggcttggccccctgacccccggctccacggcattggacgcggagccgggcatggcttgcctcctccctccgtacagcgccgcatggctcccgagggaccgagactgggttgtggtgacggtggacatgcccacacgcgtgaggggaaggtgcgcagcggggcagggtttacaccccggaaagcgccatcctggaggcctctaggagcgagctgccggcctcaaagaggtaaatgacagggaattggtggtaggccaggcacgggaaggactgagccgcagggaagatggcaatctctcgaaaacgagctgggcgggggaaaacaggccacaggtgatgggggcaaaattcgggggttggtggtccttctaacctcggaatagcagctttggttgctacaggagccctaatacgaagtcgcgtgagaatctgcatcaccgaaacctcgtgccttgtagtggaaatcgatcgtacgggacacatcagggggcgcatcgcacacattgcctcccgaatgtgcaacctcaagctctcattctctgcgttggctccattctcgcggcatgtgctaagtctagctagaataagaactccatcatggcggtgaggagggtcccgtgtcgacaggagttgggtgcaggtgtgaggctggtgccatgccctcaccctgtgcctccacccgttgcagagcgccctcccaccccggaagccggatcccaaccgattcaagtcggtggtatccatgcctgaggatgccgtcaaggacccagactacctgcgagccgtgcaagacgtgaggggctgagctcgaggaaggccttccggatcgatgcctgcaggatgagggtgcagaggtctgaaataccatccccaccccttctccacgcaccctcgcagctggaggaccagcagagcaaccgggctgggtggttatttgccaagggcgcctttgacaagggtgacctgctccacctacgcgacgaggaggagcggggccggcacctggagaaggaggtgcgcgatgcggagcagcgtgaatttgcacggcagcgggctgagctggaaaggagggcggagagcgggcagggagcgggggccgctccgtctgccggaggagcaggggcggcgcccagcaagcgaccccctggagcggagatcccgagcgggaggtgcgtcttgctgcgcagctgcgccctgcacgacatgcatgtgcagcaaggagagggagggagtcagtcactggtgtccttgatggatccgtgagcgtttgagtctctgctgctcgacagtctctgagcatgccagctagactgagttgcagcacgaggtggcatgcagcacgccccagccatgcacaccctcatcgagatctcaaccctnnnnnnnnnntttgccgcacgagatggcatgcagcacgccccggtcatgcacaccctcatcgagatctcaacccttacaggcaaaaacggatggtacccctggtccggatcaagcccttgcgtccggaagcagctgttccggcggtcgcgcacgagagcactagagaagctcacgagagcgcgcaggagccgtcagcggaggcgcgcggcgaggcgggatccgagggggaaggcctcgcgggactcctgggccagtacggtagcgactctgacgacgagggcgaggctgcctcgtcctgaatggaggtggtgcactgtagcccgcccatccgctggcggtgtctatgtcttggaattaatatcggcccatgcgggcgcgcagcgtagagaccaggggtggaagcatgttgcctattaatcaaacgtatgcagccgggatcaggaggatgccttacataagcaatgcaaccaacattttgtcgcaatccgggatagtgtcagcagtctgggaagagagtacacaacgatgacaacagcggcaacccctctgggtgcatgcctgctgtgcctggacgcagacagcgtagctggatcccaagcgacaccctggagggttatgtgtgagagggcacccatggcagcgtgcagggcactgtccgttggggatgtccttgcgcttttccggctgcacagcgcaggcggcgcctgtcgacccgcggactgagagtcccagaggagcccctttccaacaacaaacttctcgctccccgcactcccactcagctggcggggtgccccgccgcccgctcccagatttgggtgatggagaactggtcgcccatgaggcgcagcgggtcgcagccggcgaggatgtagaagcggcaggcgcgggggaggtgcaggcgcgcggccaccagcgccgcctccaggcctgcgggcgaggcggccgccacgctggcaatggccatgccgcgcggcgtggtggcccccgccagcaccgccaccggcttgccgtcggggcccggcagcgcccagacccggcgctcactcagcgcggccaccatggtagagtgggtgagggggaagagcgtgcgctcgccgggcaggaagtccctgaggtgggcgggggcgggggagcacgcgtccagggcggcgcacgcctcctccagcgtggcacacacctgccggggtttattacggggaggtacagggggggtggggtgggaggcggggaagagagggaaagggaggcgagacgcagacgaatagaacaaggcaggggcatctatgtcggtgggcacaggcaccggcacctcgctccaccccttgccttggcggcgtgtgcgatgctgtgggcctcctgctcctggggcgggtgcaggactaatagatccaccgacagcccctgggtgatggagaggtgcagcgcgctggaggtctcccagctgcggagcggggaggagaggagggagaggtttggaagggtcttgaggagaggaatttgacggacagacttgaggctcactgaaccagtccacatcgcgtttctgtcctcccaacatcccagcgcggaagatcacaaaccaatgtaagtggccaacaaacactcccaccgcccacccgccatgcaggacccaacaaaccctggccccccccaacgcctaccttggccaggctaggacgtcggtgacgtggtgaaatcccagcccagaaaacagggcctgggagccggggttgaggctgggcagcgcggctcggacggtgcggcaccccgcctcactcatcacggaggcgatcaagcggtgcgcgtatcgttgacgccggaactcctcgttggtgaacacggcgtggatccacagggcatcgtccacggtggaggtcaccactgcgcaggtggggaaggggaggtggggaaagagcgtcggggccctgccatgggaaagagcgaggagtcaccatggggggcacccnnnnnnnnnngagggggggtgggaaaagagcgtcggggccctgccatggggaagagcgaggagtcaccatggggggcacccggcaactgggcatttgccaagcccgcgcagcaggacaagttcccacaacagagccctccagacgcacagctcgctcacccaaggcctggatctggcccttctcattcacgcaggccttcatgaccgcctctccatcctggcaggcagccaccaggctcctcacccaggcggggacgccatctgcaggtgcgattcatgcatgaagcgacagacaaagaggagggctaatcggcgtgcatgcgaccccttctcacctgattcctgtgtaagctcgatctcgagaacctcattgctatcggaagtgaaggacggggagggctcgagggtccgggcggccggcaacggctccgctatcgctgtttccattcttacgatggtgcttgtaatcctcaagagccgctttaacgatctgataggatcccactccaaggaagtacaggtcgcgcccgttagtaactannnnnnnnnngaacgatctgattggctcccactccagggaagtacaggtcgcgcccgttagtaactatcagcgcgctgtaaatagtagatctgatgtttttaagcccacgtgggggggtggacgatgggagcgcaccaattgaagggacgcattgattgcgatacgccactccattcatctgtgccgcagcaaagctggatggaagcattggcaaactccctgtatcgcgtccgaacctcccatgaatcatgccgtggggcccagggcctccgtagacgtgccatgccacagagctgcatctgcgatgccaccgtcatacgcatgtctcgggaagcgtagccgggccaggaacctcacgacttgcggtgcgcgagcgaccgatgaatgcgcatgcgcgtggtctgggcgcatcgcttgcatgcacacatgctggctcatggtggtggggtgctgtgcgtgttggacccctcccgctcatatgcgcagtatcagcccctaccatggaggaccccccccaaacctcacctccaactctttacccgtcctccttcctccaggtgccacccggcctaaaaagggcctgagtatcctggagtggacgggcggcgtgatcccacagggcgtgctggtgagcggggtgaaggccgcatggaaggcggcctggctcaccttcatgcgcgagctggcgccccaggacgccgagggggcctacgtccgccccacctactcgttcgagggcgtgctgggatccccggacttcccgctggagaccggaaggtatcgcctgtacctcggcaacccctgcccctggtgccacagggtgggcctggcccttgcagcgcgcggcctcagcgaccacgtcgaggtggtgcacctgctggacgacgcggagcgtgcatctcgtggcggctgggtcttgagggccccggacccagtgtctggagcgcgggacctgaggtgagcgcctgtgctggactgcgtgctccctgcgcaatgcgagcccagggcagtcccggcagctgggacgctgcctggcaccttggctcctgctccctcaaccgcctctccctcgctgtgcaggggcgtgtacgatagcctgagccccaggtaccggggacggtgcacggcgcccctcctcgtcgacgtcgccgcccgtcgcatcgtgtgcaacgaatcctcgctcatcgtgcgcagcctgaacgcgctgcgcctgccgggggactcgggcgtggacctggcgccccagcacctcctgcctgagatcgagcgctggaacgacaggtctgaggcaaacactgtgcggcggagagaatgggagaggggctcgcctgactccaatggcgaggggtttccagtgtcctgcactgggtgtggctgcctgcaacagaccactgtgtgtagttctggagggcagcgccctcagggcttggttgacataggaagtcagttcggctgcgcctcttgccacccaacaccccctgaatgacccccccaggatccaggcggacatcaacaacggggtgtatcgctgcggcttcgcgaccacccaggcggcctatgaggccgcggagttctcgctgcaccaagccctggaaacggtggagtcggcgctggccgcctccccctttctctgcggggccgccgccaccgaggcggacctgcgcctccttcccaccgtgcagcgcttcgacgcggtctacgccacgctgttccggtgcgggcgcaggaggattgcgcacgactaccctgccgtcgacgcgtggaaggcacgcctgcttgctgcgcatgtgccgggccaagccttgcagctgcaggtgggtatctttgtgtgtttgagagtgtgtgtgtgttcttaaatggggagagggaacacgggaaggtgtgtctgaggagtgaggcagatctgtgggctgatcnnnnnnnnnnagtgtgtgtgtccttgaatggggagagggaatacgggaaggtgtgtgtgaggagtgaggcagatctgtgggctgatctgacaccacccagaaccaacggggtggtagtgccccaggtcaggatgggctgagcatggagtgtgctgccacccaccgatgcctcggaaggctgctttggccgccagggaccctccccatacaaacctgtccacaccaaacacaggactgctatgaccaggcggacgctgcgcgcagctactacacccagctcttccccctcaacccgagcgggatcgtgcccgtcctggaggacccagggaagagtttggagcgccaaggagcagaggagcggccagcgcctgtgcccatcacatccatcttccaggtgcacccccagaaggccttggctgcgtgatgagccgcgctgtatcataaccatggagacgacatgtggcgctcccagagagaccgctgtgtaggagcgcctgcgttggccgccctgctgcacaccttcctgcataggctgcaccctgccatcacagctgcacaacaatgctaccacagtgtacaacagnnnnnnnnnnacaggagagcctgcgttggccgccctgctacacaccttgctgcataggctggaccctgccatcacggccgcacaacaatgctaccacagtgtacaacagtctctcgcagagggaatatatgtgatgacgccggggccgggtctgtgcatcgaggtcgggcttgccaggggctgcatgcatcatgtgctttcctcgctgcgtgcgctgagcacgacgcgcgaggatcgcagggtctccgccgcctgctccctcgaggtggctcccgcatgcttgctggacagctggaaggatcggatgcgggccgctatggccgcaaagcgtggccgtttggcggggtcgggggtccggcaggcctgcacgagggcgaggagggccttctgcgtgctcagcgccacctccatgtctgcagtgcttggggattggtgtttgggcggacgtaagccggctgctcgtgtgagcgacatcaaggaacggcaacagcgacccgctccctgtgagggacctatggaagggcaccggcttcagagcatgcatgggcccctcttcattgctgcgcggaggagttcaaggtggggcagcgtgcactttgcctctccnnnnnnnnnngtggaagggcaccgacttcagggcatgcacgagcccctcttcatttctgagcccaggaggtcaaaggtggggcagcgtgcactttgcctctccggtcaccagccccccctcgcccacctgaaaagccaatgtcgaggtgctgcatcaacccactgagcatcagggcgtacgcccggacctcctgcagctcgtagtgcgagtcttggcggcgatcgtaccggaacgacgctcctgcgtgggtgcaggtggtcggctgggtgtgactgcgtccaggacagcctgagcgaggccctggacagggatgcgctgcgatgcccgggctgggcctgaggtggatcctccagggatgccttgcgtggaggggaaccttcggtgcacaagtagccctccgttgctgcgatttcaaaacaacgatccttcaacatccccccccccnnnnnnnnnnagtgcacatgcagccctccgttactgcgatttcaaaccacgatccttcaacatttcccccccaaagggccccgcaccgtagtcgcagaggacggccttgccgcacggccccgccagaacgttgtgcgcatacacgtcgccatgtgcaatacccctggcgtggaggtatgcgagggcaactgccacagagtgggcgatgcgcagcagtacggccaaagtgtaccgcgtgcccggcgcccaggtgcagcgcagcaggctctgcggatggtggggagggcgggcaggtcggaggcctggagcgatgccagggctgcagaggccagcgtcggagcacggatggttggaagagcaggagaaaggccgccgaaccctgtgacactggttccgcactcatgccttcacagcaccttgtggtcgggcttggctnnnnnnnnnnattggaaaagcaggagacaggccgccgaacccttcgacactggttccgcactcatgtcttcacagcaccttgtggtcgggcttggctgccaggggctggccctccaccagctccagcaccagtccccagggctcggcggtcctggccagcaccctgaccaggcaggggtctgccagggcgcaggccacgctttcctcgtccgcggcgcggccgtcgggggacacctcccccacgaacagcttgagcgccacctcgcgcgccccccacgtcgcgcggaagacctcgccgctggcgccgcagcccagcctctggcccagggtgaggtcggtgaaggggatggtgggcggcaggccccggccggctggggatggttcaggggccagcgggttgccggcgagggagagccagcagaggnnnnnnnnnnagtgggcggcaggccccggccggctggggccggttcaggggccagtgggttgccggcgagggagagccagcagagggaaggcagactggccagggcggggggcaggtgcgtgagcctgcagcaggcagcgcgaaggagctccagcctggtcaggcgcgcgagctccgggggcaaggtggccagctcgttgaaggaggcctgcagcttcaccagggactccagcccgccgatggagggcggcagggccgtcagcgcgttgtcggtcaggaacagctccaccagggcgcgcagacggccgatggatgggggcaggcaggtcaggcggttgcccttgagacccaggcgccggagtcggggcaggtcgccgacgtcctccggcaactcacgcagacggttgcccgccaggttcaggacctccaggcagggaaagccgggcaggaagccggaggcgatgtacnnnnnnnnnngctcatgcaggcagttgctcgccaggttcaggacctccaggccggggaagccgggcaggaagccggaggcgatgtactccaggccgttgtcgcccaggtccaggaagcggagggagtgcaggggccggagggtggccaggtcattggcggtcagcccgcagccagccaggcgcgcctcctccacagagccagggtcgatggccccggctctgaggtcgtcaagatctgcacgactgttcaaagatgctctgggactcgcagggctgggggctgggggtggaaggactgtgcagggccggggcgcaggcctgcggcggaacaggaccgcgcctccgactagggcggcagcagccacagctgtcccgacgagcaagcctgccgtctggcgcgagggtgttgggagattccatgtatctnnnnnnnnnncagggcggcagcagccacagctgtcccggcgagcaagcctaccgtctgacgcgagggtgttgggagattccatgtatctaaaagcattgaagattcttactccacccggctgggcgtgcgttgcgcggtcgaggtcgccttgtgcgagattaagggtagtgcgcgggggtggtcgctagaggccggacagagctcggcttcgaagcaggggcctgcacataccgtacaagacgtcccagaatgcagctgccagactcctttccgagataaccgccaggcgatcgcgctcctcgtttggctgtggcttgctttcgaaaacctctggcgatgaacagatcgcgcgctctcgacagctctattaaatccggacatcagggttaaggaaagggatnnnnnnnnnngctctggcgatgaacggatcgcgcgctctcgacagctttattgaatccggacatcagggttaaggaaagggatgagacccatggaagcagcgtgctttgctacgatcattgattatgaagaaagagcactctggtcacaagagaatgcatggatcccggcaccgcctcaatgcagcgaagcgatgcgcggcaggtcatgctccccctctcccgtcccctccttggcctggaagcgagcgtacgcctcctcgaacagctggtggcatggcacccgcgccttcagcttgatgcaggccaggaaggcgccgctgagcttgcggtgcaaggagtagctgtcgtccggcggcggcgtcagccggtgccgcagcatcaccgcccccagctccgtcacgcgcttggtcaccgtcgagtgcgtggcaaagtcgtacagccccggggtgccaaaggggatgcccaccaccgagcccgcctccacgtgcgcatccagcatgacttgctcctcctcgcctgcattggtgggagcttggagaaaaggtgggatttgaggagtcgggatgggcaagcatcaatgagacatgcgtaattcagctgcccatacacattgtatacaaactgcctcccccgtttccccttcgcacagcctgcgcacccgtcaggaagcccatgttgatggagtggcggatgatggcctcccggtccctgcgtgcgcaggccgccaccatgtgcaggtactcccgcacgaaggtgatggggaagtcccgggacgcgccaaagtccaccaggttgatgcgtcccgtggcctcgtcgtacagaaagttgccccagttggggtcggtctgcatgaagcgccagtcgaacagctcgcgcagcgtcagcgtcagcaggctggtcgccacgcggtcgcgcgcctcctgccccagctccgccacgcggtcgatgtgcacgccctccacccagacgctggtcagcaccccgcgcgagctcaggtcggggacgatgggggggacgaagaagaggggggccagctcggggtcagccgccaccagcgccgcatagcgcgcctgcgaggccgcctcatactcgtagtcacactccagcgccagctccttcttggccacctaacgtgacgtggtgaggaatgagaggaggtgttttgagggtctggcatggggtggcagactgtggttctgcggnnnnnnnnnnnnnnnnnnnnnnnnnnnnnnnnnnnnnnnnnnnnnnnnnnnnnggcatgcgggccttgcgcagaggcttgggcttacagaaggagcacccggctgcttgaacttttgggtgcatgagattaggtgatcgccacactccttgacccgcatggcccgcacccttgcagaatgccatccctctcagtaacaacaaccactgaggctgaggagtgggtaagcatgcgacctccaaccattcaggggtttgggccccaactcacccctccccctgtcctctcatagcattcaatcccccccttcannnnnnnnnngcggccctgaagctgggccagatgctgagcatccaggacgaggacctgctgccgcccggcttccaggccgcgctggagcgcgtgcgcgccggcgccgacgtcatgcctcgccgccagctggatgccgcgctggcagcggagctggggcccagctggcgcgcgcgcctggccgccttcgaccccgcccccgtggccgccgcctccatcgggcaggtgcaccgcggcaccctgcacgacggccgcgcggtggccatcaaggtgcagtacccgggcgtggcgcagtccatcgagagcgacgtggacaacctgctgcgcgtggtgcgcctgaccaacatcctgcccaagagcctgttcgtcaacaacctgaccaaggtgaagggggggattgaatgctatgagaggaaagggggaggggtgaggtggggccaaaacccctgaatggttggaggttgcatggttacccactcctcagcctcagtgattgttgttactgagagggatggcatactgcaagggtgcgggccatgcgggtcaaggagtgtggcgatcaccgaatctcatgcacccaaaagttcaagcagccaggtgctcgttctgtaagcccaagcttctgcgcaaggcccgcatgcaccggaatcccccttcaccttccgcagaaccacagtctgccaccccatgcctgaccctcaaagcccctcctctcattcctcgccacgtcacgttaggtggccaagaaggagc

SEQ ID NO: 42690 - DNA, 61 bp, Chlorella protothecoides
cgccggtcgtcgatgggtggggccgccttcacctcctcatgctcttctggggcagtgtcct

SEQ ID NO: 42691 - DNA, 4606 bp, Chlorella protothecoides
  modified_base (567)..(576): a, c, t, g, unknown or other
  modified_base (838)..(847): a, c, t, g, unknown or other
  modified_base (1806)..(1849): a, c, t, g, unknown or other
  modified_base (2305)..(2314): a, c, t, g, unknown or other
  modified_base (2704)..(2713): a, c, t, g, unknown or other
  modified_base (2841)..(2850): a, c, t, g, unknown or other
  modified_base (3026)..(3035): a, c, t, g, unknown or other
  modified_base (3466)..(3475): a, c, t, g, unknown or other
gcgcacgcggcggaggccgactcgcgcgccgcgcgcctcgccgcgcgccgctccgtgcgccacatggtggaggtcccgctcgccgcgctgggcgacggccaggggacaaagggcgaggcagggaggggcatgggcggggcgaggaggggggcgagtgcggcggggggcctcggagccaggcgatccctggaggcggcggatggcgacgagccctccttgtcccgtcagacccctgtgagtggagccagcgatgccagcagctccaggtccacggacgcgatcagctcctcttcggaagcagacagcccagtcccagggcccgcagaggcacgggagcctggcgctcgcgcagacgctgccgctgccagaccccaaggcggccggtacggcgccgcctcatcggcgaggggcggcgggcgcggcgcaggccgcggcggggcccggcccagggaggctcctgcgacggcacaccggccggtggggaatcccccagggaagaaaggggaagccgaggcagccgccgagaaggcgcccgtgcgtggcggcatgtccgccagggtcggcaannnnnnnnnnaaagccgagacagccgccgagaaggcgcctgcgcgtggcggcatgtccgccagggtcggcaaaggtgggtgtgctggatcttggcagtgaggaggatgggcgaggggggcttgcggcagagcggggcattgacattagcacagcgcaggttggccggccctgggcgcaaggcgggtgtgggactcgctcctcatacgttcccacccacgcaaaccttctgcccgccctccacacaggtgctgcgctctccaggaagagcagnnnnnnnnnntttcccactcacgcaaaccttctgcccgcccaccgcacaggtgctgcgctctccaggaagagcagcccggccgaccaggccaaagaccccaacaagcctcgagccccctcccgcttcaccagagcaaagagaaggtgactgtcccgccagctgcatcaaaggcccgacgatccagcgtgcccgtgccagccaaggcaaggaggggacgcttgtgacagacctgctggcctgcaaggaccccactcccatggcggtggagcaaacatgacatgacctctccctcacctgaccacacttggacagcattgcgtaacacatcaaattggacaagacacagtgcaccaaaggtcgggggcgaatttgcagggagggatgccgggggtacagatcctctcttcaaaaccgaatgacgtggcgatgcggggttagtcaggtgtacccgactcccaggggctcaagatgcctcgtgaccaacccctcattgtgcactccttccctgcaatccacgcgacgatacactgggtaacaaacctgcgagaccggaagctttgggtcgcaccgtggtcgcagtcccaggcccacccagaccagtgctcgcagccatgaccaccaacagagggtgagacccgggatcgccagactccgctcaacgcatccacactgcaatgggaaggtcatgtgcatccgttgcaaggcttgatcacgactcaggtcccacccgaccccccgaccggcaaccaacacccctcgcaggcacgcctcgcacccgtggcacgatctggagatcggcgagcaggcccccgacctcttgcacgccggtatggacgcagcatgaagattggagtgccgagcagcccgggagtgaagggttgcggccgtgcacaaacctccttgttatgcaccctgcagttccctccccacctcacggtgcccctgtccccatcccccccccccccccnnnnnnnnnnnnnnnnnnnnnnnnnnnnnnnnnnnnnnnnnnnnatcgagatcccgcgcgggtccaaggtcaagtacgagctggacaaggtctccggcctgctttacgtggatcgtgtgctctactcctccgtcgtctacccccacaactacggcttcatcccccagacctactgcgcggacaacgaccccctggacatcctggtgctgatgcaggagccggtcgtgcccttctccttcctgcgcgccaggcccatcggtgtcatgcagatggtggaccagggggagcaggacgacaagatcattgccgtgcacgccggtgagagggaacaaggaggaagggggcggcgtgggcagtgcgtccgccgctgctgccgggctggagcgccacatcgccggccctgcgtccaggaggcggagcactcccccgcagcagcacctgccctgcggctcctgttccccggcacacgcgttgttaccccagcctcgctctgcaccctnnnnnnnnnntagtgcgtccgccgctgctgccggctggagcgccccatcgccagcccggcgtccaggaggcagagcactctcccgcagcagcacctgctctgcggctcctgttccccggcacacacgttgttaccccagcctcgctctgcacccttccaccacacagacgacccagagttcaaggactataccgacatcaaggagctgcccacgcaccgcctggccgagatccgccgcttcttcgaggactacaagaagaacgagaacaagatcgtggtggtggacgagttcctgggacgcgaagacgctctgaggatcatccgcgagtcccaggtgcgtcgtggcgcgcctgggtggagggcgtggagtgcgccgtgtggtgcagggcatgcctcgctnnnnnnnnnngcgtggagcgcctgggtggagggcgtgaaatgcgccgtgtggtgcagggcatgcctcgctcgggattgcgagccctggatccccggtctcaccctcattcacaatgcctcgctgcaggacctctacannnnnnnnnntggagtgcgagccctggatccccggcctcaccctccttcacaatgcctcgctgcaggacctctacaaggacctctttgtgcccaagcggtctcgctgaggagcacgagcgtgcagtgggccacctggacgtggaggtcttgccgcttccctcgggcaggagcgtgtctgaataccnnnnnnnnnncgggccacctggacgtggaggtctcaccgtttccctcgggcaggagcgtgtctgaataccgatgcgcacctcaccatcaccaccaacccccacccgaccccgtacctcacgtgtgtgccccgcctttggtgatctaccccttttgtcaggcacgaacatcacaggcaaagacgggagagggtacctccctcgcgatgttgccctgattccaggaggggagcagcagccgccgcttcagcatccggctgccggctcaccacgcaggccacgagagcttgagctcggccacggccgccagcacctcgtccggcaggcgggagaggctgggcggccagtcctccacgggcggggcaacgacggcggcgtgcgcccgctcccgcagggccagctgagcatgcaggatcaggggcggcggccctgtcacgccgcgnnnnnnnnnncacgacggcggcgtgcgcccgctcccgcggggctagctgagcatgcgagatcaggggcggcggccctgtcacgccgcgcgcccgcgccgggagcgggacgccgtggcgcagcgtcgcctcgccgcacgccgcggccaagctttcttcggcgccggcggcgggcgcgggcgggcccgcgcccgcgccttcctctgccccgcgggtcaactctgccagggagcacacgcggcgcaggccccaggcctctgcaaagccgcgcaggcggtcggggtccggaaccaccacgctgcgctgccctgccccgggaggcccaggcggcttgccgctgccgggggcacgggcatgcacccccgcgggcagcgcgcacagcgcgccgacgtgcgggtcgagggcgctgcacatctccgcagccgtgacgggcacctgtgtgggtgttggtgacggggacgaggagggctttcgtcgccggctcatggggctcggcgcatcgccggcacatgccggacgagcactctcagcctcgcaaccccatccagagcgatagatggtcgacacggcgccgggcgccagggtcgcgcaccttcaggttcgcgacctgcagcagctcccgcgtcctgcgcgtggccgccgcggcgctgcccttcgccccggcggtggccgcctgctttcttctcggccgcgccgccgccgccgcccggagcacctggaggtggatgggcagctccaccggcacgtcccgcaccagggcgcctgcacgcagcgatagggagcaggagcgctgtttctttcttcgcttcttgagtaagagggggtgggttcgaggtggccacggaatgcacagaccaagggtctgtcggcctgtttaggcgagagatcccagcccgcaaaattgccatccaccgcacacacggtgcaccccgccgccgcccctcacccttcatggccggcacgggcgcgtccagcgtcctggcctcagcccttcttccctcttcgggccacccggcgggccagaggacggccgggcgtgcctcgccaccctttccttcccccgccgtcgggtccattcgaccgaggacgaggtcggcgagcggggtgaggcaggccaggagcgcgccgccgcccgccagcccc

SEQ ID NO: 42692 - DNA, 61 bp, Chlorella protothecoides
gtccgtcaggctggcggtcaggttctgggccgcgaggaagcgcgacgccgcgccctccagc

SEQ ID NO: 42693 - DNA, 76 bp, Chlorella protothecoides
tcaggagctgcaagcctacatgaaagatctcctcaagtgggagaaagacgtggaggtcaaaccaagggtacgcacc

SEQ ID NO: 42694 - DNA, 61 bp, Chlorella protothecoides
gccatggcagggttgccctgtacccgcagcaccagccacaggctgaggctgactgcccccg

SEQ ID NO: 42695 - DNA, 71 bp, Chlorella protothecoides
ggggctggcgcgggggctggggctggggctggggctggcctgggggctggggctggggctggcaggctcgg

SEQ ID NO: 42696 - DNA, 78 bp, Chlorella protothecoides
acctccagctcccatatttcccctgctccttcgcacccccccctcccccccctctcgcacccctgctcacctggcatg

SEQ ID NO: 42697 - DNA, 165 bp, Chlorella protothecoides
gggggggattggagtgaagcagatggcaggcgagctcaagcaccataggtgcggtacctggcatggagcgggggccttgcccctggaccccacgctgcagacccagaaagagggggggcctggggcagccggtggtggggccgctgaaaccccatcctcccccac

SEQ ID NO: 42698 - DNA, 61 bp, Chlorella protothecoides
aggccaggagggacttgcgctgcttcgtcgccgccctgcgccctgccagccggccctcctc

SEQ ID NO: 42699 - DNA, 69 bp, Chlorella protothecoides
tggcgctcaggagccctccctgcgggggtgcggggggtgtcggcgggtcggcagcaggcagtgccacga

SEQ ID NO: 42700 - DNA, 71 bp, Chlorella protothecoides
tggggggagcggcgcagcctttggtctcaacggcgctgtttcccagcccggaccagtggtgtgtcaacccc

SEQ ID NO: 42701 - DNA, 513 bp, Chlorella protothecoides
  modified_base (275)..(402): a, c, t, g, unknown or other
cccagcccgagcgcgcgctgcacctcttcagctcctgggtgcaccaccagaggctgtgactctggggtcgcggggggcggggctggcggcggcgcccggggaggtggggttcctgctgtgggcgacgcggcgagggacccccccatgagtcatcctagcttccatgggccgtcagggcgcctcgcggggctcttcggccttctggggcagggcgaggagctggcgccggatggcgcgcgccagcgactcgccgtcgggcgggacctgcgcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtaagccaatgggtgtggagagtgtcaggggcaggtgaaggagtgaggtcaggcaggcggggggggggtgtatggtgaaaggctgtgcgaagtgatggctgggcgggg

SEQ ID NO: 42702 - DNA, 5742 bp, Chlorella protothecoides
  modified_base (158)..(167): a, c, t, g, unknown or other
  modified_base (548)..(557): a, c, t, g, unknown or other
  modified_base (853)..(862): a, c, t, g, unknown or other
  modified_base (1214)..(1223): a, c, t, g, unknown or other
  modified_base (2456)..(2465): a, c, t, g, unknown or other
  modified_base (2540)..(2549): a, c, t, g, unknown or other
  modified_base (2901)..(2910): a, c, t, g, unknown or other
  modified_base (3176)..(3185): a, c, t, g, unknown or other
  modified_base (3729)..(3738): a, c, t, g, unknown or other
  modified_base (3893)..(3902): a, c, t, g, unknown or other
  modified_base (4317)..(4326): a, c, t, g, unknown or other
  modified_base (4758)..(4767): a, c, t, g, unknown or other
  modified_base (5229)..(5238): a, c, t, g, unknown or other
tgaagggggtccgggggtgagcggatggtccaggggcacatgggggaaaggtgggacgggggtgctgaggtgccaaggcccctgccaagccccccagcccacgacaccagcatcattcgcggcagcaagcagcaaagcctgcggcgccgttccgcgcnnnnnnnnnngggggcacatggggggaaggtaggacgggggtgctgaggtgccgagccccctgccaagccccccagtccacgacaccagcatcatgcgcagcggcgagcagcaaagcctgcggcgccgttccgcgccgcagacccccccctccatcctcagcccacctgccaggaatgcacgcgccgccccagcatgtcggtgagcatggcggagagcatgccggtgtgcttcacgcgatctgacaccttgagcgccatgtacacgcaggtcacgtagaccgacaggagggtgggcacgctcttggtggcgcgcaggaacatcctctgtgagggggtgcatgcagggttggggggggatttgcgctctgggccaggggactgcccctgcgnnnnnnnnnnaagggggtgcatgcagggtagggggggcatctgcgctctgggccaggggactgcccctgcgagcatggcggggcaggatccagggaccgcgaggggaaggggccagcctcgtcctttgcatgccagcgctgtggagggagcctgaacccaggcatcacccgagtggtggagcatccctcaccctctcataccaactcccacctcgcgcagctccagctttccacccagggcctccgtggggtacggcaggaagtagtcattggacaccgccagctggaacatggggatgtgatttnnnnnnnnnnatccttcgcatgccagcgctgtagagggagcctgaacccatgcatcacccgagtggtggagcatccctcaccctctcccaccgactcgcacctcgcgcaacgccagcttcccacccagggcctccgtggtgtatgggaggaagtagccattggataccgccagctggaacatggggatgtgattttgctgcagcaccagagggggagtgcaatgtgtgagtcaggaactacaccttgacgcttgctgcgcctgctcaccactgccaccgcccaatgcagagtgtcacctggctggcgctgcaagtgcaccccccgacggcatccctttacgccccccaaccccccccccagnnnnnnnnnncaggaccaccgagatggcggggatcccaaatttgcgggcgcagcagaccatgagacaatcctcgtggactggggccatatggagagcatctgtagtgcacagaaaccgggatcaaaggaatgaaggaagatggcgtgaccaagccaagacatcccaaaggagtacatagctgcaccccaccccacctccctaaaaagaaacgatgtcatactgtggcctgttgaagggctgattacacccaggcaccttgcaacgcagagccgggaccccctctcctgacaacgatataggttggtgcaaggaacgtcgatgccgagtatccctgggggaagagcttctggccgcccctcactgtggccctcctcccgtacacccccacacagcgcagctcccacctggcagggggagctggcagatggtctggttggcctcgctcaggagctgacgcgtgatctcttgctgcccccgtggcagtggccaggttggcagcatcagaaagtaccgggtaggagggtctcttgggagtacactctgaggtgcagcggaggccaaggcggaggatgtctccacgctgtccgaggcagggcacatggcgtagctggcagaggaatcacctgcaaacccggcccgggggaggaaaggagaaggggggaggagtaggaatggagagcctggccgatgtttccagggccaggagcggcattaggccagacttggcatgcgtctgaatgccatttaccagcatgagagcagtcctggtacgctgcaaggatccagtacctgaaggattctctccttggcttccttggacaagacctggcaccttcatggatctgtgaaattgtcgaacgggcgaagagcgtcggtggaggcggcaatcagacaggatttcggaggatgagaacaatttggcgggctaatatgacggaacaagggtccacacgctctcgtgaacaccttgttggcgaacaaacccatacccccgcagcccgactttcgcgggagacacgcgccagttcaacccttcaaatacccgacgacggacctgtgcactgcatgaatcctccgatgagacctaataacaatgttcgatatcccgcaaggagagcgcccactacctggaaggcgattggaggatgcttcgcggtccggcgactcgcctcgtgacttcaggcgagtgtgaggcccggaaatgggatcgcgagccgcagtacaccagataatggctataannnnnnnnnnccctcgtgacttcagtcgagtgtgaggcccgaaaatgggatggtgagccgcagtacaccagataatggctataannnnnnnnnncatgccatttacccgcatgagagcagttctggtacgctgcaaggatccagtacctgagggattctctccttggcttccttggacaggagctggcaccttcatggatctgtgaaactgtcgaacgggcgaagagggtcggtggaggcggcaatcagacaggattttcgaaggatgagaacactttggcaggctaatatgacggaacaagggtccacgcgctctcgtgaacaccttgtcggcgaacaaacccatatccccgcagcgcgactttcgcgggagacacgcggcagttcatcccttcaaatacccgactacggacccgtgcactgcatgaatcctccgatgagacctnnnnnnnnnnaattgaagatcatgagggtatgaggggtagcaccttcgtcggtccatttgatactgctggaaatgcgaacccaggggctaccaaaccaattgccccgggtgagtgctcattaacttcatttgtacggcttccaggctgcaccactgctgggtccacagtgcaagtgagactcgttataacctcaatcaactatcttttgggtcgaggggggaccttcgccgtatcggtgtgcatacaggaaggacatgtcgaagaatctcggtacnnnnnnnnnnctaggccacgctgggtgttacgactgtacagcaccgctcgatgtgtcaagggggggatcacaagtcactgtaatgtccgtcgaaaatgattgaagatcatgaaggtatgaagggtagcaccttcgtcggtccatttgatcctgccgggaatgcaaacctaggggccaccaaaccaattgccccgggtgagtacttattaacttcatttgtacggcttccaggatgcaccactgctgggttcacagtgcaactgagacttgttataatctcaatcaagtatcttttgggtctaggggggaccttcgccgtatcgatgtgcatgcaggaaggacatgtcgaagaatctcggtacgtacaagtttgtcaaccatcacatgggcaagacaattggcatctttgcctgatgtacgcgtcgtggcgcatcacgatcttgagccagacgcattctaatgacatgagaatggcacattccaaatgcgagtccccctcccgcaaggtgtacgatgaggatttctgtactgactgtcgctggcctccatgtacnnnnnnnnnnagacatgaaaatggcacaattcaaatgcgagcccccctcccgcaaggtgtacgatgaggattcctgtactgactgtcgctggcctccatgtacagcagattcttgtgcgatgtttagcggtccaacaggagacctagaatgcatacgcagtcatnnnnnnnnnncgcagattcttgtgggatgtttagcgatccgacaggagacctagaatgcatacgcagtcataacacagtccagaccgataatcattggttcatgtatgtaatcctacattaaagggcccggctgcatggcacagctaatgcggcgccctgtgctccgtacagtgtatctcgtgtgcccatgtcagcccggtacgaaacgcagaggcgtgcaccacaccacgcaattgtcgattcgtcatgcagacccagggtatcgcactctgcgacaaggttacctccggtgtgccgcggcgacgatgctatgtgtctcgcggctccaaatggtaacatcatggacgcccccccacatctgaagggggagcggggagtgcatacgcgacagaactctggcccgattccttgctgcttcactccnnnnnnnnnnggccccacatctgaagggggagcggggagagcatacgccacagacctctggcccgattccttgctgcttcactccgctcccggtccttcgaggaccacgatcgcgaaggcctgctcggctttgtcgaccccgctcccctccctacccctcagtccgctccacggcggaaggcctcccagccctcccccggcacgagccaggcgcccctgtccgcctgcacatgccacatcgccacctgtaaacgtgcaattgcgacgtacttcttgaggaaggtcattgtccgagtgcctaggccgcaatgtacgatcggggagtctggcccctgcagggatgccatctgagagagaccccacgagcacgacgccgctactcgagctgctacgagctgtccctcccacccctctggcgcaggacggcgccacatgcacagcnnnnnnnnnngggtcattgcccgagtgactagggccgcaatgtacgatcggggagtctagcccctgctgggatgccatctgagagagaccccacgagcacaacgccgctgcttgagccgccacaagctgtccctcccccccttctggcgcaggacggcgccacatgcacagccgagctatagagccctcccccccctccacacatgcccactccctcgcaccgcggcatgcagccgcttctccatggtctggagcccgccctgggcggtcagggggtcgaccgccagcgcctccagcgccacgccgccctctcgccgccacgggtccatggcgaagctgtagagcgggcgccccaccacgtgcacgtacgacaggcacactgcgcgggcgtgtaatgggggattgggggagggagtttgcgcagggctgggatatgacttcgggaaagggcgtttccacctgcatggcgccnnnnnnnnnngtgggggggttgggggggggagtttgcgcagggctgggatatgactttgggaaagggcgtttccacctgcatggcgccatacggtcgcctggcccgcacggccgccgcacggccgccacggatgtgcacgggtcgcaaggccgccgcgcactctgcccccctccagagctgtcccatccaccctttcttcctcctcccccaaccccccaccgaaaatgtactcccactcccggcgccgcaccgtacagcagcccgtcctcctcctgacgctgcgtcttgcccagcagctccacggtgacgcacccgccaacgcagagcacggggcgtggcaggcggaaggcctgcacctccgcaaccccgggctgcaccgggaacaccgccgacacccaggtcagcgtggctgggtcccagccgccgcgctctggcgccgcggccgccgcgcgccccgcgtccagcgagggcacagcggtcgcgggaccggcgggggtgccgccgccagtcggg

SEQ ID NO: 42703 - DNA, 76 bp, Chlorella protothecoides
ctccacctcgctctcgctgtcagccccgcacttgtgccgtctcctggccacagcatgggctggcgctggattcagc

SEQ ID NO: 42704 - DNA, 77 bp, Chlorella protothecoides
gatgtggacatgccgacctcccacccccccaccctgcagcctgcgcgttcctgaagcactgggacaggctgctgcac

SEQ ID NO: 42705 - DNA, 75 bp, Chlorella protothecoides
gacctggtcctgactggcggagcaaagttgccccccgtaccgcggctgtccgacatcacggcaagcaaggaggga

SEQ ID NO: 42706 - DNA, 118 bp, Chlorella protothecoides
gcccaggggttcatgcaccatgcacaccacctggaggcccgccttcgcatgatccaacatgctgcttaacaccacctgctgggtggggtgttctgcctggaccgcactcggcgcaggc

SEQ ID NO: 42707 - DNA, 121 bp, Chlorella protothecoides
gggggggccgggggattggatctccgtccgttgattgatgtccgacccgacccgacccgacccaacctgatcccaacctgacccaacccgtcctgcctgttgcgcagggcttccgcacgcc

SEQ ID NO: 42708 - DNA, 6786 bp, Chlorella protothecoides
  modified_base (139)..(260): a, c, t, g, unknown or other
  modified_base (563)..(572): a, c, t, g, unknown or other
  modified_base (1222)..(1231): a, c, t, g, unknown or other
  modified_base (2950)..(2959): a, c, t, g, unknown or other
  modified_base (3932)..(3941): a, c, t, g, unknown or other
  modified_base (4151)..(4160): a, c, t, g, unknown or other
  modified_base (4267)..(4276): a, c, t, g, unknown or other
  modified_base (4949)..(4958): a, c, t, g, unknown or other
  modified_base (5154)..(5163): a, c, t, g, unknown or other
  modified_base (5668)..(5677): a, c, t, g, unknown or other
  modified_base (5771)..(5780): a, c, t, g, unknown or other
  modified_base (5939)..(5948): a, c, t, g, unknown or other
  modified_base (6025)..(6034): a, c, t, g, unknown or other
gatggccgtggggcgtgggtcatgtggggggagggtgacagaggccagctcgcgttctcgcgtgcagaccctcacggacgccctgtgccgcccgggccaaggcccaccgagccccacgcaccttgatggaccgcagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagggcaggtcggcggggagggggcacatgtgcggagtgcgagtggctggctcaggtgccgcgccggctgccgcgcgtgcagcggccccccgcgtggggcgaggggcaggcgggcgacgcgcggctggcgagtcggcgtcgccgtccgcagccacggccgggccctggaccgcgacggcgggctccccttccggcagcccacgacggcgccgccccttggcgtcggcgggcagtacatcgcccggcaccgctgcggctccgacaccactagcgctccgtctcttggccttggtgcccacgnnnnnnnnnntccgcagccacggccggggcctggaccgcctcggcgggctccccttccggcagcccgagacggcgccgccccatggcgccggcgggcgggacatcgtccggcaccgccccggctccggcaccacctgcgctccgtctcttggccttggtgcccacgcgttggccggcgggcgccgacaccttgggctcgggcagcggggcagatggcatcccaggctgccctccctccacaccgctcccgcagccctcgccgcgcgcatcgccgcccccgcgcgcatcgtcagcagcctccacagtgaccctggccctcttcgaacggccctgccagcccccctccctcaacgccagctggctgaagaggggggcgcggtgcgggccgcgctgcttgcgctgcgcctgccggggccgggcctccagcgccgcggcggggccatcgaggggagcgagaccctctgccgccgtggtaccctgtgggcccccgccgcgggccggaccgtcgcccgccgcgtcgccgtctcccgggaccggcaacagcacgcggccgcggtcctccccgccgccagcaggggcgctgcagggcgtagacgaggggggacctcgttcgggcagcgcgcccgcaacaggcgcgctgcatgcgcccggggcctggcnnnnnnnnnntggagcgagaccctctgccgttgtggtaccctgtgggcccgcgccgcgggccggaccgtcgcccgccgtgtcgccgtctcccgggactggcaacagcacgcggccgcggtcctccccgccgccagcgggggcgctacagggcgtggacgaggggggacctccttcgggcacggcgcccgcagcaggcgcgctgcatgcgcccggggcctggctggggggtgaggcaatggacgggggggggatgttctcgacgcccacagccaccggcacgggtccccctcgactcgccctgcggcgcccgggccaagccacgcgagcgtgatgcgcctccccccgcaccgcctgcccacgatctgacagagcgccggctgcagagcggggctgggctgctacaggtgcgccgagcgcggcgctgtcagcctctgccgccccctgggacgggctcctgctgccaccctgagacgggctcccatcccccgccggcccgaagctgaggtcggagggcgtttggtcgccgtccatggcattcggctgggcattcgtctgcggggatggcggcgatggcgggacggtccctccgctcagggccgggtctgccgcgtccaggtgtgggtgcccatgcacctgcgtggcctcacgagcttgaacattctcggccaacactggccccggctcctcccgccggatgtccatgtgatcttcccgtgccggctcaaggtccagggagggagccacatctgcttccaggccgggcaaggccgccgaggcaacagacggctcgccgggcgcttggctggcgccctggcgccgcggcgcctggaaccttgcttggctcaggcgcagacccaggctgggccggccgccggatctcagcgccggcgctggcagggctgggcacgagctggggcgggtgaggctcgcggctgggagttcagcccactcagcgatcgccacaggtaggctacaagtctgcggggccaccgcgagctgtgagctgggtccattcttcacaggctggactgctggtgctccttccaggtcgagcggggcagcagccgccatggaagctgcattccttgctggagcctcgtagcgctcacatgggctctcagctaccgcgcaccgcgcctggctcgccggcacctcatccagctctaccggggtcctgtcttccacggacaccccttggctggccggcacctcgtccacatcgcatgcgtccaaccctgcgctgctcccttccagaacctcctgtcctgcgtgcacctggaggaactccagcacgcgcatcccgccctcgtccccgcttgcggcgtttgcgagcgcccagccagccaggcaccgcagcagccagggtaggcccaccaccgcgatgccgtgggacctggccacgtccagctttgtggagggcgcgctgccttcgtcccaggtggccagcaggtgggtcgtagtgctgacctgcattgccttgctggctgagaacccggcgcagcgcagcaaggccagcgccaggcagcggtgcgcgccgcaaaacccggtgaggctggccgtcacggcgcccgccccgggcagggccgcgctggggagggggcgcagcagcgacgtctgggaatggagaggaggggatggtggactgcgcccctcaggatcaacgacatcggacaagtgctgtacgccgcatggcgtcgtgcatctggcgcacagatgcacggagaatannnnnnnnnnagggatggtggactgcgcccctcaggatccacgacatcggacaagtgctgtacgccgcagggcgtcatgcatctggcgcacagatgcacggagaatatcgtcgagtgcatgccctaccttgtctccaggagggactggcagcagcctgccctcctccacacaggccaggatccacacaagggagacggccactggacggtcatgtgcacaggcctccagctcaagccagctctcctgctggcaatgccgcaggatggcgtgcgttgcagccgcagcagaggccgacaggctccctccatgtgactctggggttagacgtgggcataagatatgtgaggtcattgtgaagccggtgatcatgttgcacagcggccggctcgcaacccgccagcgccaggcgcattgctgcttgagagaacaagcgcattaccaatggacaacgatcattacctagaagcttgctgacttcgcgggcggaatcggggaggggcaacgctggcactggcaacggacccagacccggcaggtcgacgaagaacacgcaggactgcgaagaatgggaggtagggacgatatcagcaatttgcatcgaatgcaagctcgttgtaggcagcaaatggatctggcgccctgttcaccttaaaaatatcagacgacatgttgctgccaggctcgggtgccctgaggaaggatccgggaggcctcccagtgtgctcggcacgatagttacacccttgcctggagtgatattgggtaaagatgatgctttccactgtgctgccgtgctcccgtgccagcatgggcacgacctgcgaatcgaggttcgaaagggtcacgccgcgcgcagcatgatcgacatggaggtcgtaggggggggtcatgcagggagagcactcgatgacgccccatgcctgagaaatcgaggtgcctagagtttaggtaacattcctataggtattgatgcttggcgttnnnnnnnnnntgaggtgcatagagtttaggtgacattcctataggtattgatgcttggcgttctgcccgctccctgcatcttccaacggtgtctcctggcagcccccgccttgcgcaccgcctgcaagctgccggcgtgtgaggcagggataaagtctcagctgcggtttgggacctcaaattttccaattattaacaagcgtcaatctcggcatcgctnnnnnnnnnngatccgggaggtctcccagtgtgctctgcacgatagttacacccttgcctcgagtgatattgggtaaagatgatgttttccactgtgctgccgtgctcccgtgccannnnnnnnnncaattctcagctgcggtttgggatctcgaattttccatttattaacaagcgtcaatctcggcatcgctccatggcgagcacacaggccagcaagccggcctggctaggtccgacctcccgcatcctgctgggctcctcctccaaatctcgcaggggtaggtgcgaggggacaaggcgactcatgctcacaccatgagatccaggtcttccacgctgaggatcagcccacaccttcatcctcgcacgatactgccaggtatcatggacgagctggcggccgagctgggcttcagctacgaatgcgcatcggctgacatcgacgagcaggccatcaggcacgaggacccccatcagcttgtccggcagctggccgccgcaaaggcagatgccattgcctccaggctcgcgagccagggaactgccccctctgggctgctcatcacctgcgatcaggtcgtcgtgcacagggacaggatcctggagaagcctcgggacgaagcagaggtgcgtgagggttgtgggccacacattggcctgggaagcgagatgagtattaaaagacgccacttccgagggaaactctgcgaggtcatgatgggaagagtatgaagaccatcctgtgggacccccccacccttgcccgtctgtgtgcggcgtaaacatgaccattgtnnnnnnnnnnatgggaagagtatgaagaccatcctgcgggaaccccccccctcgcctgtctgtgtgcggcgtaaacatgaccattgtcactcccccagcgcacgagcaagtgtcacatccctgcaccccgccccaggcaagggcatttatccgaggctatgccagcgcgcctgcgtccaccgttgggagtgtcatggtcaccgacnnnnnnnnnnatcacatccctgcaccccgccccaggcgagggtatttatccgaggctatgccagcgcgcctgcatccaccgttgggagtgtcatggtcaccgacctggaaacgcgggcctcagcctgcgctgtcgacgtgaccactgtgtgttgccttgggcagggttggagtgggtgggcagttgactggagcctcaaagcactccggctcggcccggctccaagatggagggcccgttggctgactgtgccccctgcaagcatcttgcttcttccaccgttccacacctgtgttcgatcccccttccaactaaacacttcccaagatcgagttctctgccatcccggaggccagcatcgaggcgctgatcgaggagggcgaggtgttctggtgcgccggaggcctgatggtggagcacgcgctggtggccccccacatcgtgaggatggagggcggcatggacgccgtcatgggcctgtccaaggccaccacgctgcgattactgcagcaggnnnnnnnnnngtacaagcatcttgcttcttccaccgttcttcacctgtgttcaatcccccttccaactaatcccttcccaagatcgagttctctgccatcccgnnnnnnnnnncggcccagagatgacgatactgatccttcgcagggcacccagggcatgcgcgggtctgcccacccgctgcacccactccggtgaggctctgacaacgttcgtcatcatttccccttcacaaccattaagtcatgattcgatagagtgtacagaagtgcnnnnnnnnnncgggatgcgcaagccgagttgcgtgcagggcgcggctggtgagggcgccctcgtgatcccacacgcggcgttcaatnnnnnnnnnntggcccagagatgacggtaccgatccttcgcagagcaccctgggcatgtgcgggtctgcccacccgctgcaccccctccggcgaggctccgacaacgttcgtcatcatttccccttcccaaccattatgtcatgattcgatagagtgtacagaagtgcaccaaggtgcattacgtggttgagggcagtggatcagagtgggggcaatcgggggtgggatgtgcaagccgagttgcgtgcacggcgcggctggtgagggggccctcgtgatcccacacgcggcgttcaatccaaccccggagggtgggccgcggcctcagctccctggggccgacagtgccatcagtgggctcgctccagaggcggccatggtgccagggctgcagccaggcagccgtcgcggcggcgcactcattcccactcacgccggcccgccatcctccccatccccctcgtcatcctcccccagccgcagctcggtgtcgtggaactcggccaggtcggcccactcgaagctctcgtccgcggtgccccgcgcgtaggtcagcgcgtgctcccccgtctccgcgcggtagccggtgatctccgcggcccaccagccgccctcctcgggccagtagcggtccacgcgtcggcccaccgccgcctcgcccagcgtggccagggtctgtcccacgcgttcccgctcccgctcggggcgggggcgcagagacggcgcgacgcgcgccgccgacggcgcggcgcccgcgccgg

SEQ ID NO: 42709 - DNA, 81 bp, Chlorella protothecoides
gagacgggcttggagacgggctggggctggtctcgggggaggggctggggttggtctcaggagaagggctaggggagtcct

SEQ ID NO: 42710 - DNA, 63 bp, Chlorella protothecoides
cgcagccagggcgtgggtgagaggtatgcggcgcaggcgcccggagatcgtttctcagcccag

SEQ ID NO: 42711 - DNA, 447 bp, Chlorella protothecoides
caccgcgccccgcgggcggcgcgccgggcgacgccgggacggctggggcctgcgccgctcacgagggctccggccccgccacgcccacgggcaggtcggaggacggcagcagctgcgggccctcgttggatgcggcctcgccctccgaggaggagggcggcgggcatcagggtatcgaggagagtcaggcgccggcgccaacgacggccgcgctggccgacggcgcggccgtcctccacgcccgcccgtactccacacccactcccaccagctcggccttctccagcgaggccagcgagggcgaggccagcgagctggccgccgcgctggcggcactggcggcccgcgaggcggaggtcgcggcgctgcgcttgcgcgtcgccgagctggaggccaagctggcggtggtgggagttggggcggccgcgggcgggggggcggccgcgg

SEQ ID NO: 42712 - DNA, 1934 bp, Chlorella protothecoides
  modified_base (151)..(175): a, c, t, g, unknown or other
  modified_base (260)..(269): a, c, t, g, unknown or other
  modified_base (680)..(689): a, c, t, g, unknown or other
  modified_base (1061)..(1070): a, c, t, g, unknown or other
  modified_base (1768)..(1777): a, c, t, g, unknown or other
gtgctggcggccgcgccgcgcgcgcgcctgcacgccgcggcgcgcttcaaccgcgcgctgcgcctgctgcgctccctggcgctgctggacgaggttacgcctggtggctgggcgcgccagctggccctggaccggctgctgggtggggggnnnnnnnnnnnnnnnnnnnnnnnnnaccttggatcgaagccgtgcccaggcaccccgccgtcgcggcgctgggcgagaccctggaggcgctgcgggcgcggcagggggannnnnnnnnncgtgcccaggcaccccgccgtcgcagcgctgggcgagaacctggaggcgctgcgggcgcggcagggggagggcgaggcggaggcgcgggcccggctggagacggcgcttgggatgctgggcgcgtagcatgcagggccctcactcctgcacccaatcctcctgcgtagccgtgcatggctttgtcacccatcccgccccccgtttatttctacaagaaggtcgcgcggtgcgcatggtacagcaggaaggatgacgctgcacaaagtcacggcagtgcagcctggcatgatggtcgcctgggaaatcaccacgaaagcggcgtcgcatggacgaaaggcctgggggggggtcacagcgcaccagggccagcgactcctgccccctccaggcccgccaccggcgaggcgcgnnnnnnnnnngatgcagggccgccgctgctgcacccaagcctcctgcgtaaccgtgcatggctttgtcacccatcccgccccccgtttatttctacaagaaggtcgcgcggtgcgcatggtacagcaggaaggatgacgctgcacaaagtcacggcagtgcagcctggcatgatggtcgcctgggaaatcaccatgaaagcggcgtcgcatggacgaaaggtctggggggggtcagagcgcaccagggccagcgactcctgtcccctccaggcccgccaccggcgaggcgcgtgcagtgaggtgcgccaagggtccccctgcgccctccagcccaccgactgggtcacgcaccgcctcctccagcagcgtctgggccatgannnnnnnnnnggggtccccctgcgccctgcagcccaccgactgggtcacgtgccgcctcctccagcagcgtctgggccatgagcttggcctcggcggcgcttggcctcctggacgggtcctgctccaggcaggcgcggatgaggggctggaggcaggccaggtgcttgggctcctcggggaatgtgcacccgccactgggatgcagggggcgagcgctggggggggtggagtgtgcggcgctgtcgagcggaaggacgaagcagtgctgcacccaaagtgatgtgagcacgtggatgaagggcggtcgccagggaggatgggcaggggctcggcaacagcaagacccaacccgcacacactgcgccctcccagcccccgttacttgagtatcgccagcttcaggctgccccccgtcgtgcccgtggcgcgttcgaagggcgactcgcggtacgcgaggcagtacagcacgcaccccgccgcccagacgtccaccttctctgtgaggacggtcccagggaccacctcccagagctcgggggctcggtagggggccgtgcagtgcgcctgcttggtggttgtgagtgtgtttggaggactctttgctggctgcgattggaacagcagtcctccatgcctgtttccgtcacgccctctctgcaatcggtgtcaaaaaccatgctgccacaccatgcgagacgctattcccnnnnnnnnnntgccgtgcagtgcgcctgcttggtgattttgagtgtgtttggaggactcttcgctggctgcgattggaacagcagtcctccatgcctgtttccgttacgccctctctgcaatcggtgtcgaaacccgtgctgccacaccatgcgagacgctattccc

SEQ ID NO: 42713 - DNA, 73 bp, Chlorella protothecoides
tgggactgggactagggcttggactcgggggggggctgggagaggggctgggacttggagtcacggtgggcgg

SEQ ID NO: 42714 - DNA, 11997 bp, Chlorella protothecoides
  modified_base (825)..(834): a, c, t, g, unknown or other
  modified_base (1269)..(1470): a, c, t, g, unknown or other
  modified_base (1549)..(1558): a, c, t, g, unknown or other
  modified_base (2354)..(2363): a, c, t, g, unknown or other
  modified_base (2916)..(2925): a, c, t, g, unknown or other
  modified_base (3622)..(3631): a, c, t, g, unknown or other
  modified_base (3711)..(3720): a, c, t, g, unknown or other
  modified_base (3782)..(3791): a, c, t, g, unknown or other
  modified_base (3994)..(4003): a, c, t, g, unknown or other
  modified_base (4477)..(4486): a, c, t, g, unknown or other
  modified_base (5383)..(5392): a, c, t, g, unknown or other
  modified_base (5984)..(5993): a, c, t, g, unknown or other
  modified_base (6139)..(6260): a, c, t, g, unknown or other
  modified_base (7130)..(7139): a, c, t, g, unknown or other
  modified_base (7820)..(7888): a, c, t, g, unknown or other
  modified_base (8335)..(8344): a, c, t, g, unknown or other
  modified_base (8677)..(8686): a, c, t, g, unknown or other
  modified_base (11507)..(11516): a, c, t, g, unknown or other
cgcccgcaccgggcgctccgtcgcgggctgggccggggaggccgcggcgccgccgcccgcgccctgcccctcctgccggggtcgtgccccgccgcgtcccgcctcgtacccgcgcaggtccagccagcgcccgatgggcatgccgttgccgccggcccgcacctccggctccgcccccggcggcaccttgagcgaggtcttccacttcttggccgaccccgcgcccgcgtgcacctcgaactgggtgcaggacatcaggcgctccgcttccggcttcaactcgcaggcctggcactcgcatgccacacgctggtcggcgatgtgcaggcggccgtgcatcgcgccgcacatcacggccacggtggcctgggcccccgggggattcgtccccggcgccggctccgacgacggcgtcgggcgcttggcgggggggcctgcggccagcgcgtcaccagggtcggggctgccgccgggcagctcgcgcttggcgtgcgcctgggcgcccggcgcgccgccggcccggccctggccctgctgcgggtggctgccgcgcgagtccacagaccactctgggcccggccctggcccaggtgccccgtgccccgtcggcccgacgtctggggagccggtgcccgccagtcgctgggcatgcagctgaacgtgggctgcccgctgctcgtggaagctggggtacccctgctgctgctgctgcctccccagctgctgctgctgctgctgctgcatataggtggggctcagggatgactccctggcctggctagaaggcccaagctgctgctgctgctgctgctgcatgtaatgctnnnnnnnnnncgactccctggcctggctagaaggtccaagctgctgctgctgctgctgcatgtaatgctgctgctgctgctgctgctgctgctgctgctgaagtaggcgggcgtagtaggggtccagcccggggcggacgcccccgccgtcggtcgccagctggcgctggaggttgagcgcgtgctgctgccagcccttgtagtcgtgctgttcgcgcaggtagcgctgctcgtcgttggcggctgcgtgctcgtacagatcgcgcttctggggaggggtctcctgccaagcctgcacgcgattgggggagggccgtgagggaagggttggttaggagatggataggtgatgcccgtggagtgggaagtccagagctggctggattcagggagaagaaatctccctggctattgatgcctgccttaaaccctcaccccatgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacgcaggtgatgctgggcggaccagggaagagcaccacagaaaaccagtcctcagttcgatgtccaaaccatgcgcnnnnnnnnnntgctggatcaagggagaacaaatctccctggctatgaatgcctgccttaaaccctcaccccatgggcgccggaacccacattcactaggaagcgatgaaactcgacctggccctctggtgtatcgatattcgcattgtactcctgcatggcgggagagaggaccgctgatgggtggcgagcgtggggcagagaatgtgagctggagaatttagcccagggaggtggccagcaattaacgcaggtgatgctgggcgaaccagggaagagcaccacaggaaactagtcctcagttcgatgtccaaaccatgcgcagtccaatacgatacgacagacgggaggcagggacggacaatgcgccccttatgccgatgtaatgcacgtatggtcacgctttgtagcggtgtgttaggtcggaaccaaagtttgggtgcagggaggagcctttcggacgcgcagccgggaccatccccgacccaccccctccagcaccacacaccggtgaagggggtcctacctgtcgtagggattgcccaaagaattcaatggctttgatgggccgtcgaggccgctttgttgccaaaacgatctctgcctcccgaagatccgccaacaggcttgcccgagctgacatccttccagccgtgcgctccccttggctatcccgcagggttgtcttcccagcggcacctgtacattccaagctatttcagaagtcaaattgcaccgtgtctcacgcggcagtgggggagaacagtcggagctctctctcggcagggttcttaataggacatcaannnnnnnnnntgcgacacctgtacattccaagctatgtcagtagtcaaattgcaccgtgtctcaaggggcagtgggggagaacagtcggagctccctctcggcagggttcttaataggacatcaaaactctgctgggtactgcggagccctccacgtaatggaggaacaggggatgggccttgaatacaccgcaccgtctacacaatttggctggcgatatgctagcataaggtgcacctcgaacgatttctgggtatttcagctgggtgcggctccctcgcctgccgtgatgcgaggggtctgcatccgagcgttcacccctctgcgccccttcctgcgttgccatggatctcgtgcgcatgttcgggtgcacagcacatctagaggtagaggaaagggcgatcttggtggcgatgggcgctcgcatgtggtgcacacaggctatcggatccccatgcagtgccggtacccttcctccgactcccacgcctgctgccccagatcactgcccctggaagcgctccacccccaacctctcccccgccagcgcttccgcgcctgnnnnnnnnnnacgcccctccctgtgttcccatggatctcgtgcgcatgttcgagtgcacagcacatctagaggtagagaaaggggctatcttggtggcgatgagcgctcgcatgtggtgcacacaggctgtcggttccccatgcagtgccggtacccttcgactcccacgcctgctgccccggatcactgcccctggaagcgctccaccccccacctctcccccgccagcgcttccgcgcctgattctgggcatcgagagcagctgcgacgacacgggagtgggcatcgtctccccggatggccgtatcttgggagcctcattagcagggcaggcagccatccacgcggcctggggcggagtggtccccaacctggcccaggaggcgcacgccgccgccatggagggatgcatagccgaggccctggatcaggccggggtgcggccccaggacttggcagccgtcgccgtcaccgtcgggcccggcctcagcctgtgcctcaaggtgcgcaggcgcgagggaggactgactccctcggcctgatggtgtcggggtcattcatgcatcaggcgcgctggcccttggctggtgtgatgtcatcgtggtccctgaaggttggatgccatcgccgcaccctgccgtcggcctcccacacccctggcacgtgagccactgtggccaaggaagtcgagcacgagatggctgtnnnnnnnnnntctcggcctgatagtgtcggggtcattcatgcatcaggcgtgctggcctttggctggtgtgatgtcatcgtggtccctgnnnnnnnnnntcgttcccgctctacccaccccccccacgcgccatcaccaccaccaccaccccgcgccggcnnnnnnnnnnccgttcccgctctccccaaccccccaatgcaccatcaccaccaccaccaccccgcgccggcccgcaggtgggcgtgcgcgccgcgcgccagctggcggccacgcacggcctgccgctgatcccggtacaccacatggaggcacacgcgctcatggcgcgcatgggctccggtgtgcgattcccctacctctgtgcgctggtgnnnnnnnnnncctgatcccggtgcaccacatggaggcccatgcgctcatggcgcgcatgggctccggcgtgcgattcccctacctctgtgcgctggtgtcggggggccacaaccttttgaccttggtgcacgacgtggggcgctacacgctgctgggcaccagcctggacgatgccgcgggcgaggcctacgacaaggtggcgcgcatgctgggcctgccgctgctgcccagcggcggcgcggccgtggaggcggcggcggcgcggggggaccccgctgccttccccttcaccgtccccatggcccgccaggccaactgcaacttctcctttgccgggctgaagacggcggtgagggtggccgccggtcgccacctccccgccgagggccagccgctccgtgggaaggtgggggcttggagctgggatggttgtgtttgtgtgtggggggatgagcattcgggtgtgcaccgggcaggacgacnnnnnnnnnnaatgtttgtgttaatgtgtggggggataagcattcgggtgtgcaccgggcaggacgactttgtcgtcctgcgtacatgggtatcatgacgtgtgcagcaccatccactggatggttcaaaccaccggtcgtctctccccagcccgccagcgttgcaatgatggaaacactctccagctctctctgcacgccccttcagacgctctaccagcctcacccacccaccgcgcgctcacacggccatgcaggtccaggacgacctggcggcaggcttccagcgggcggccgtccggcacctagccgatcgcacggcgcgcgcggcgcaatgggcggcggcctccgaccccggcgttcgccacttggtggtgtcagggggtgtggcggccaacgccgccgtgcgcgccgcgctttccgatgtggcggcccgcgccgggctggagctggtggctccaccccccgccctctgcgccgacaacggcgtgatggtggcctgggcggcgcaggaggcggtggcggcgggggcggcgacgctggccgcgccgcccccggcccccgtggcggagcgggactgggaggacgtgaagccgcgatggccgctgaccggggagcgccaccccaacatggccgcggaggctgcgcgcagcgccaagaagcagcgcatcttccccagcctgacccagctggtggcggagcaggccgcgatggaggcggcccagaccccatgactcccgtgcagaccgccagacagggtgcgcctcagcagggcccagagtgtatgtgcgcggagactgagagaggcccggccagaaactcccccgactagttcccgtgaccttggcatgctgaccgcctcccttctttgccgttatcccaacctggcgtcaatatgccggtttgnnnnnnnnnncaaccccccccgactagttcccgtgacgctggcatgccgaccgcctcccttctttgccgtcatcccaacctggcgtcaatatgccggtttggatggcaagccctttctatccttaatatcttgccttgtgatcatgcaagacatcctgcgcctcaatgccgagggttggaccccataatgaagaaccccaggatgcaggcagtatcttgtcaccgcacccgcagggcgcaagcgatatatcgtccttgccaacttcgccattcttgtgcttcggtcgcgcatgtgagaaactgtcatcccactcaaagatcgtggattaccaagctcgcatggcgaggaggccggcagcgtgatccgccaagcgtgcaagcatgttcctcggcacgtttgtcgcgaggctcgtaatgtgagtacgcaggaggcttgatctgctgcgcccgatgtgtgatcaagccctccgtccaacgatgccctggaccctgaagcttgtgggtgcatcggggtcgtgccgagacaccgtcgccctcccaacgcgtctcccgtttccatgacccaggagcgtggtgggctacctctacccagcctactcctnnnnnnnnnncaatgaagaaccccaggatgcaggcagtatcatgtcaccgcacccgcagggcgcaagcgatacatcgtccttgccaacttcgcccttcttgtgcttcggtcgcgcatgtgagaatctgtcatcccactcaaagatcgtggattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgatgccatggacccagaagcttgtgggtgcatcgaggtcgtgccgagacactgtcgccctcccaaacgcgtctcccgtttccatggcccaggagcttggtgggctacctctacccagcctactcctgctacatagccttgcaggagcttaatgccgagcgaatggtgctatggtgcaaattctggtgcgtcgtgggtctcgcgcattgcgctggggccctgagcttcccccaggtgctccgttcgatgggcgcaggaatccgtccatgccaaaaccccctccatcatccctccctggcccaggtgcataatgggatgtctgtctgccgccatgcccatcgtcgacatcttcctgttctggttccctttctacaacgagatgaagcttgttttcgtggtgttcctgtggtacccaggcaagcatgcggggttgtgtggattatcagaggtggggggggtgttacaggactgaccctagcaggggctggcatggagcaccccggggcaacccatgtcggccatggcagacactcctcagctcgcacccccctcatacgcaccgcaggtctgaagggcactgactacgtgtggggcagctacgtcgagccgtacatggcgacccaccgcgaggtgttcgaccagacggtggccgccagtcagggctggctgaccagcgtcttcggccagcaggctgcctgggtggcctccgccgcccaggccaaggccatggcggcgctaacggggctgacagggtaccagctggtggcgcccgccggggccggtccgcccgagccgggtgcggcggcaggttaccggcagaatcccgccgccgccgtcggcagcgagcgcagcgtccacggccagacnnnnnnnnnnaagccgggtgcggcggcgggtcaccggcagaatcccgccgccgccgccggcagcgagcgcagcgtccacggccagacatatgggtcgggcgaggccgcctcgcaggcggccacggcgtcgtcctccgccaggcccagcgagggcgccgaggtcggggccgctgcgacccggcccgcggcgccgcaggccagcccgccggccaagcatgcggggcgcattgccccgctgcaggacctcatcgactccgtgtggagcttcgactgaggcgtgggtcgatgagtggggccggtcatgcagagcgcgggcccctgagatgccaggcgaaacgctcccatctgttgacattctgccacatcctccaccatcaccgctcactccccgacgctcaccccgacatccttgctgaaaaccctcttgtggtgcccctgtactctacgccggcagtgtctcctgtcttctctgttacatgtcaggtcaggtgtgacgtcaggtgcgggagtggctctcaaaaaattggatccaaggctgcccgccaatgcgggggcaggggcaatgggtgcgcaggtgagggttatacaatgtgtgtgggggggtgagggtcagagaggagcacacaatgtggtcgagtgccgatgcacacgggcaacacccccgcggggtggcagaccgccgcgtcggggnnnnnnnnnnnnnnnnnnnnnnnnnnnnnnnnnnnnnnnnnnnnnnnnnnnnnnnnnnnnnnnnnnnnnaacaaggctcacacgccgcctggggcctgcgccgcagcatccccggcgtctgccaggccgccgctgatccggcgttggacccccggctgcgtgaacaccgcggccgtggcggagagggaggccgatgcggagcccacggccgccgccatgaccctgggctgcgattgtgcgggcggcgcagggccactgggggcgtcgtggggcgccggccccggccccgccacgccgcccgaggcggcggggacgatgtttgaggaggcggcggcatcctcgccctcgcccccctccccgctctcgccctctcggcacggctcccgtgcgtccaggtaggtttcgctctcgtcgtcgtcccccgacccgtcagacgtgccgtctgccaaggcaggcaggcgcgtggcatccacggtcggcgccggcggcgcctgcagcgacagcgcggccagctcnnnnnnnnnnggacgtaccgtctgccagagcaggcaggcgcgtggcgtccacggtcggcgccgtcggcgcctgcagcgacagcgcggccagctcgttgccgctgccagacccgccgggcagcatctccagctgcagccggtttagcgccatggtggccccgttcctctccacacagtcgcggaacgcgaggagcaggtcctgcttgactgcggcaggaggtcatcatggtgtggtgaggggtcgaatgtcaaggggcgagcaggcacactcgtgaggtgtgtgcgttgcctgggccccccaggaacccggatctccatggcccctcagcggccacccttcccnnnnnnnnnnggaatgtcaaggggcgagcaggcaacactcgcgaggtgtgtgcgttgcccgccgcccacaggaacccggacctccatggcccctcagcggccacccttccctccaagatgaccagctaacaaagcacagcgcgaaactcactggccatgaaggagtcacggttcagggcctccacgtagaaggaggtgtagatcgtggcctggtcccgagtgatcttgtccaggaacacgcggcggtgcagccgctggatcacgcgcgtgtcctgcgggatggagggggtttggggtgtggtcagactccatgcacaccgcccctcggcccccaccagccagatgccgtccaagcccagtccctggactctcccccacccgacgacactctccctcccacccgccaacactctccctcccacccgccgacactctccctcccacccgccgacactctccctcccacccgccaacccactcccgcgcccacctgtcgcaggatcttgcgcatgtcgttgaccacagcctccacgcggcgcgtgtcctccacccggatgcccaggaactcgtagaagcgccactccttgaccttgcgcgtgacgttgaggaccacggtgcgcgagaagacggagttggggatggtgtagatttcgcgctcgaaggagcggatggtggtgcggtaccagcccacgtccaccacgatgccctccaccacctggccagaggtggggcggaacagtacctcctcgcccacctgcaggggggtgacatgggttggaggtattatcctcttcttgtttgggggtttggggttggggttgggggggtggggggggactgcaaaggggccccttcaacacggctgctggagtaggctccgggggccaaggtcctagcagggaggacgagctgatggcagcagagagtccctaaggcgaactgccatcccaccaaagcttcctccaacacccccatacgacgagtacgccacaaccccacctcgaaagggttgctggagaggatgatgagacccgtgaagaggttctccaggatctcccgccccgccagacccactgccaggcctcccacgccgccgatggccagcacggagttgacgtccaggcccagagcctggagcgagaacacggcggcaaccacatagatgagcagggagaccagcttgtcaatggcctccatgcggcgctggcgcgtggtctccgccttgagctccagcagccagagggcctcacgcattccgcgggccttgatgttcagcgccacacgcgcgatggagaggaccagggtgaggctgagcgtgctgcgcaccatggtctgcagcacgctcttggggatggcgatgagctggggcaggaagttctcggccagcgtggcaaaggccgccacgatgaacaggaagttgaggggcttgtgcagctcgcgcaggatgtagtgctcggccgacttctcccaggggccctgagcgtccatggcgccgcgcagcgacttgagcagcggggacaggccgtactggacgaaggtcatggcgcccaggatgcccagcacttggcgcagcgccacggtcttcaggaagcgcttgatcaccttgaccgtggcgccgcggaagcccagcccgtcgctggtggcgtacagcaggacggtgaggaagagcaggccgcccaccagcaggcacaggaaggtggcgtagtggtaggggcgcagctcgaagggggtgctggcggcagggacctcggtggggggcttgggggggggctcgggtggggtggtggtcacccaccgactgccggggccgccgtagccccctggggagggagtactggacgagttggcgcggggacagaagcgagcgggctctcggaggggggaaggggggcgcaggcgctcgagcccaacgcgccgggcgtgcctggagatcgctaggcgcctgggacccggccaggagcgggacgccgcgacgaacgggcgtcccaacggcatgttggatgcagataacatgctgtatccatgcgtctgtgtggcggggtgggcaggggtctccggcatggacgtggttgcgactcgctgcaacacggacttgagggtgttcgcgatcggaaattcctgttgccggggtcgatcgcgggccggccctaaccaccctcataactgatccgacaccgggagagactgccgctgccctgctcagcgcaccagcgctcgtcaccttgggcaattcacaacaggacactcttgggagtgcatgcgtggtgtaagagggtgtgattggaaaattgaaaggggggtcagtaagtttccgttgggtcctaggaatctggtaccatgtcaaggcaggggcctgctgctctgtcgcttgtgccccgtcagctgctgccgcacaaactcctgggcggccgcctccatcaccgcgtgcgcgccgctctgtccgttgacgtccgccagtgcctgctcgatggaggtcatgttctccagcccgctgttgcgccgcatggcgtgcacgcccgcctggtggagggggtgcaggggattgctcgagcaagggagggggggggtgatgccgtgacactgaggaaatgtctggaccaccggcagacaaccttgtccatccccatcatccctgctgggcccccaactggacaccccgcgcctcgttcacaaacatcctcctccgccagcaccctggacactcaccttgggtggcatgccgccacgcgaggccgaggacagcgatgcccccacccggtcggctgcggtggtggcgacagaggaggagcccgggtggtctggcaggtccaggctctccagcttgctcatgnnnnnnnnnntcggacaccccgcgcctcgttcacgcacatcctcctccaccagcaccctggacacccaccttgggcggcatgccgccgcgcgaggccgaggacagcgatgcccccgcccggtcggctgcggtggtggcgacggaggaggagcctgggtggtccggcaggtccaggctctccagcttgctcatgccgcccagcgagggcgcgcgccccgagccgaacagcgcgtcgccgccgccgtgctgggccagcagctgctccagctcgccgctcatcatgccgttggggatggaagggaactggccgagggacaggcccgtggccaggcccgggatcttggacaggtcgcccccgaacaggccttggaggttggcaaaggagaaggagggcgtgtgatgcgggccctccgaccgctcccccccgtgctgctgcgacaggaggaggccgaagggcgaggggcccgtgccgccgccgccgccgccggccg

SEQ ID NO: 42715 - DNA, 19059 bp, Chlorella protothecoides
  modified_base (407)..(416): a, c, t, g, unknown or other
  modified_base (515)..(524): a, c, t, g, unknown or other
  modified_base (962)..(1085): a, c, t, g, unknown or other
  modified_base (1190)..(1199): a, c, t, g, unknown or other
  modified_base (1304)..(1313): a, c, t, g, unknown or other
  modified_base (1445)..(1536): a, c, t, g, unknown or other
  modified_base (2175)..(2184): a, c, t, g, unknown or other
  modified_base (2557)..(2566): a, c, t, g, unknown or other
  modified_base (5369)..(5378): a, c, t, g, unknown or other
  modified_base (6326)..(6335): a, c, t, g, unknown or other
  modified_base (8279)..(8288): a, c, t, g, unknown or other
  modified_base (9639)..(9648): a, c, t, g, unknown or other
  modified_base (11213)..(11222): a, c, t, g, unknown or other
  modified_base (12459)..(12468): a, c, t, g, unknown or other
  modified_base (14621)..(14630): a, c, t, g, unknown or other
  modified_base (15300)..(15309): a, c, t, g, unknown or other
  modified_base (16397)..(16406): a, c, t, g, unknown or other
  modified_base (16825)..(16834): a, c, t, g, unknown or other
  modified_base (17353)..(17362): a, c, t, g, unknown or other
  modified_base (18055)..(18064): a, c, t, g, unknown or other
  modified_base (18436)..(18445): a, c, t, g, unknown or other
gggcttgggaggagcgagggaggaggagggttgggtgggtgggcgcatctcagccggtgaggtcagggctcggggcatgccgccctggtctgcatcgcgcccaccggcaaagatctcctggggaacccctgactttcttgtgtcttccggagttcatcatggaccagctccatctgtcggtctgcattcaggtgcacccccctccgattcccgtccaccaccccccttcatgtcgcccctgaacaggaggggctggcccccgggcggcccccctgcctacgacgtcgaccaggcgctggtgagctgccgcgggcgtggattcgcgcccggcctggtgttcctgtacgaggcgtcgggcctgtaccgcgaggcggccggcgtgctgcgcgccgcgggcgacgccgccnnnnnnnnnnccacccccctccgatttccctgcaccaccccccttcatgtcacccctgaacaggaggggctggccccccggcgggccccctgcttacgacgtcgaccannnnnnnnnngcgctggtcagctgccgcgggcgcggcttcgcgcccggcctggtgttcctgtttgaggcgtcgggcctgtaccgcgaggcggcgggcgtgctgcgcgccgcgggcgacgccgccgggctgctggcactgtgcgagcgccggggcgacgcgcggcaggggggcgacgccacgctgtggcgcgacgcgctggagcactttgcgcgcctgccggacggggaggaaagcgcggcgcgcgtgcgcggcgtgctgcagcacgtcgaggcgcgggcgctgctgcccccgctccaggtgctgcacatcctggcgcagaacccggcgctccggctggacctggtgaaaggttacgtgtcccgccagctggaggcagacaacaggtgcactgaggaggtgtggggccattcttgggaggggggtgggagggaggctgggggctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggcggtgagaactgcacgttcagtggcgtggggtggcaaggggcatggcgaggctgaagctcgtgcccttgcccatgctcggcgcgacagcaacaggccgcnnnnnnnnnncttggcgatgagaactgcacgttcagtggcgtggcgtggcaaagggcatggcgaggctgaagcacgtgcccttccccatgctcggcgcgacagcaacaggccgcnnnnnnnnnngctgagcaagtgtggggccattctggggaggggggggtgggagggaggctgggggctggaggagttgcaagcgtgagggaagagtagcagagggcttggaggtccaagccgcttgcgcttgcggaacggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggggttgcagccgtgcccgtcccccctctgctccccgcactcgaggctgcttcaccccgtgccaccacacacatgcgacccctgtcgcacccacccaacctcccgtcgcccccgccccacgcagggccatggcggcggacgtggaggaggcggagcggctggaggaggaggtcgagcgcgcgcggctggccctggagcgcctccgcagcgagccggtggtgttccagagcaaccgcgacgcggcgacgggcgcggcgctggagctgccctccgtccacttcatgtgcggccactcgttcaacgcgcgcacgctgggcgacgacggcggggggggcggcgccggggacgagccggggtgccccctctgcgccccggagcatgcgcgcacggcggcgctggtggacagcaaccgtgcctgggcggccgacaaggacgccttcttcaagcagctgcgcgccgcgccggacgggtttgcggtcgtgaccgagtacctgggcaagggcgtgctcaacgccagcagtgtctcggtggacgccggtggggaggggcgctgatggcgtttggggctcggcggctgaatgtaacgttgcagagattgcggcctgcttgcagacctgagagagggaagggcaggggnnnnnnnnnnagcccggcggctgaatgtaaagttgcagagatttcggcctgtttgcagacctgagagagggaagggcaggggagggtcaggggcggttccctaaccaggcgctcttcctgagtgggcatgttcggacggacgcagggctcgtcgaggatgctcatgctgggcatggcacccctgcgccaatgcatcacttgcaccactgcatcggtactttcctattacagctcagcagggtgtgcagaaggcagcaggttgaagggtgccgagtcgacaggggcgctccgtgcgccacggctggcagtcggcgccgccaggggggtatgtcaagaaaggcccattcccccatcgcagcactgtcgcccctttcctcccacannnnnnnnnnagaggcgacaggggcgccccgtgcgccatggctggcagtcggcgccgccaagggggtatgtcgagaaaggcccaatcccccgtcgcagcactgtcgcccctttcctcccacacctccgactacccctcctgccaagcaccacaacgcattcattgggaggccttgcccttgagccccgcggcggtcttcagcaccatgcccaccagcgccttgacgttgctgccggcgtggtaaaagttgcgctgcagcgtcacgctgggctccagcgcgaccgcgtagtgccaccagccggcggggacgagcagggcctcccccgccgtcagcgtgcaggccagcggctcggcgcgcgagtagagaggaaagcgtgccgcgtctggcgccagcgggtccacggggctctgcgccgtctcgggctcgcccgccagcatgtgcagcgcggccgccgccgagggcggcagcagcacgaacagcttgcgcccacgggcctgcgccagccagccgtgcgcgccaccggcgtcgtagtgtagccgcgtcacggtgcccgccggccccaggaagagcttggaaagcgcggcgtccagcgcggcgacccaggccgggggtgaggtgccagtgacggcggggggtgctgaggtcgctgcggcattggcgggcatccctctggcggccggcgccgcgcggccgctgaacagcgtggcatccagggccgccatgagctcggcggtctggtcgatgccgcgcgcccaggccgggtccggccaggcctcgccggcctcggagaaggcgcgccagccgttgaggtagaagggcgcgcctgcggcggccggggcgccgtggacgtgtccctcgatgtaggcgcccaaggtcagcgccagcgtgcgctgcgcgccgccgccccccggccgcgcgtctgcgtggcgggcgggagcgcggttgttgaccaggacgggggccgagacgtggcgagtcgcaaagtagtcccaggtccactcccgcagggcggggcaggcctgcagggcatctgcgatgatcaggggccgcccctccccactctgcgagagagggtgggcgaggtcaggataccatgaagggctggtgccggccatgccctcttagggtcacatcctggactgcggcacgtcgagcactaccagcatcgtccgccacccaccaggcaagcctccagctctggcagggagggagaccagaccctgtccggccctcctttgcactggggaacggacagatgagggctaccagatccatgtcgcgctatgaaggcaaggaacgagttatgctcgggggtgcttggaaactgcacagacttcgccatgtcatgtgtaagtcagaactccgccacgagatgggaggcaatgctggtcaatgctccaatgccttcataatgccgacatcctccaatgtatggttggggtgaagggcgagaaatgtgaccacaggctgatccttgggacatacgcgacgactccctcagggttcggtcagagccgaatgtccgatatgaatttgacttttgcagcccgcgacgcgcgagggagtgacagcagtcggcatgcgcgctctcggcattctgtgccgtgtacataattttttgagacgacgcttggttcctaaaattccttggcctgtccctggaggatctgaaccagcctggtccctgcaccctcgcgcccagggactgatcccccggaagtccgcctgctccatgactgatagcggcgctgcgggctgacacccgtgcagccgtgcctgatcccatacattaccatggattccctcgtcacagaagaggaggtggccaccctgctggtgagccacctgcagtcctgtgggtatgaccggacagcacaggttttccgcaggtccgtttttgcggaagcattggggggaaaggtatcgcgtgtgcgttccttggtcctattcctattgcctgctttccacgccatgcatcggcccctcccttccccatcccgctcagggagctcaaggagcagcatggcctcagtttccgaggcatcccacccgggatcaagtccctgcaggagatcctcgccgactacgttcaactaaaagaaagggagagcttccgcgcccgcttccttgccagcaactcccttgcccgctcgctgcagggcaccctggatcggcacgccggcctgggaccgacccatgctgcggggcccccgccggcttctgtgggacccgcaccccgatcagggaccgtcagggacacggacgccgcgcccccagagccgcgcgaggagcaggtgggcggcgcaagggcggtgcggcgtcgacggggcgcggcgccgcccaggaaacgccagcgcccggccgccgaggtggcggggcgcgcgctggcggagctcggggtggggccggagagcctcagcctgtccgacctgctgcgggacgaggggctgcaggcgcggctgggcgcgcacttggccgagcacatcaacgccgccccggccgagccgtgctcgccgccgctcttcccgcaccctggcgccgaatgcccggccccgcacggtctgttggcggccagcggggggcagtacccggcgggctcgccccgcgccccaggtttatggagtggggggaccggaaggcagggggttttggctggcttgtgtgggttcgcaggagatgcccgaggcctgtggagcgaaggcatacgctggcgacgatgcgttgggcccgggcataaccaaagggcaatcaccttgtgcatgcccatggcaccccaccgcgcctctgaccatggcagccgccccctccctcnnnnnnnnnnaaggcatacgctggcgacgatgcgtcgggcccgggcatatccaatagggcaatcaccttgtgcgtgcccatggtaccccaccgcacctctgaccatggcagccgccccctccctcgcagactcgaccaatcccctgcacaccctgcgcctgcccgaccccatcgccaccaacgacttctggggctcagaggtcagcaagatgggcctccccaccggcgacggcaacaccctctttgccagcctcttctcggccgtgtcgcgggacggcctcggcaccgcgcagcggtggggggggccgtggcagcccacggcgctccccggggggaccctagggcgcctggcgccctcctcggagccgcagggcgcggcggccgaggagggcgtggcccttgctgcctggccgtgcatcacgccgcggctgcggggcggcggagccttctccctggcgccgtccctgctgcggccccggtccggccacacgtcgggccagccctcccgaccagagcccctgccgcaacaagggcccgcatggccgccggtgagcctgccagggcttgatgccctggtggaggactgcatcggctactgacgggcgtgaggctggcatcccttggacgtttgcagtcgctacctcgtacttcccctggctggctgtggtgccgcgctcgggccacacccctgatttacaggccaagttggtaacaggaatgtaggtgggctgaggcggtgtacagggctctctgacctcgatgctttggaagaatctagccctggctttggactggccatggagttaccgacctatggggatggcgagggcaggctttgcaatggagcagagggtgcctgtatccacactgagccaggggcaggaggttcctcacactctgggcctcgtatctaaattcgacggaatgacgacaatcagcggcggacaatcgtggccgnnnnnnnnnntttgggccacacccctgatttgtaggccaaattggtaacaggaatgtaggtgggctgaggcggtgtacagggctctctgacctcgacgctttggaagaatctagccctggctttgaactggccatggagctaccggcctatggacatggcgagggcaggctttgcaatggagcagagggtgcctgtatccacactgagccaggggcaggagggttcctcacattctgggcctcgtatctaaattcgacggaattacgacaatcagcggcggacaatcgtggccgagccggaggtggccacgatgcattgaggagttgtcaaggcagctggtgccatgcggtcagcgagaccagagaagtcgacccggggaagtgagtgctgtgcatgacgcgcaactgcgtccggagatgccccggatgcgccagctgcagagaacagatcccgaagtattgctgggtggggcatgcactcgatatagtgcgtctgccttcgaaacgacttgtcacaaaacgagtgtacttcaagctatccgagataaagctgtacagaggtcacgaactcgcagagacgttgttgtgcctgtgcaagctaggcacctgggccccccccggcaccgatacgtcgcatcgacgcggcattctgagccgagggtttcctctttttacaggagctcagctcaagccagatgggtccccccgtgacggaggtgcggcggcacctgtcgtggggcatgtttgcggcatacctcatgttcggctccggcttcctggtctcctggaacgccatcttctccatcgcgaactactggataacccgataccccgtgagttgaacgattcgagcactgacgggactgctggggtttcgatgaaggtctgtcggcggcgactctgccaccgccgctgctctaggtgcccctcaccgaaaagcccctgcggaagggggatcggcctggcacctccggaaccaccagggccggccatgacagctcaaccccgaggtgtgcatactgatacacccaggatcacccttctctccccaatcacaagcacagggtaagaactcgatcaacctcttcaccatcgtgtacctgccggtgaacccggtcacagtcctgatcaccacccggtggcactcctccatgcccacccacacccgcatcatcgtcggctatggcggcgccacgctctgcctggccaccatcctgctggtcactctggcccctggcaacgacgcgtcgctggccggcaccctggccgccacgggggtgtgcagcatctttgatgccgtgtcccaccccgccatgtacgccgaggcggcgctgcgcccaccccagtacacacgcgtcctggtcctgggcgcgtccctggcgggcgtggtgaacaacatcctgcgcatcatcaccatggccgccttcgacagcgaggccgacggcctggccaacggcgcccgcatcttcctggccctggccgcgctgtggacgggggcctgcaccgtactgtacccgctcctgcgccgccgcgggctgctggtggaggcgggccccggtgcgcgcctggaggcgggggagggcgagcaggaccccgacgccgagcccgtggagaaggaggggcaggaggggccaaagcctgggaaggaggaccacgccgccctggccgtcgcgccgggggaggcgctgcagggccgggcggccgtgctgcaggtcatctgcgacacctggcgcctctgcgtcgcgctgatcctcatttacatgtgcgtggggcaaagctgggagtgctgagggggagaggggggtgtccaagataatggcctcgtcagtctgggggccccaccaagattcagagactcgggtctattgccagggcagggccagcgaccccactcacatgaagcccggcatgcaggcgcccgcggggcttggtcatcctcggcccctgcgcactnnnnnnnnnncgagggggagagggggtgtccaagatgggggcctcgtcagtctgtgggccccaccaagattcagagccttgggtctattgccagggcagggccagcgaccccattcccatgaaggccggcatgcaggcgcccgcagggcttggtcatcctcggcccctgcgcactgggcatccgtggtggaggacccccagccccccctacactccctgggcacgcctaccaacaattccaggcactccccctttccacagcgtcacactctccatcttccctggggtgctcgtggaggacgcccacagctcacgcctggggggctggtaccccatcatcctcgtcaccatctacaatgtgggggacatgctgggcaggatcctgcctgccacctttgccgccctggtctggaccggccagaacatcatcctcatcagctccagcatccggctgctcttccttcccgccatcatcttcttcggtggtgagctgggcgtgcaggaagggggacgggtgggcgggcaagggagccagttcttcctccatctggaatctgcagagcgcatatgcatctccagcaacgagtcactcgacctgaacccatccacctgacccgccgcagtacaagtcgtacccgtcatggcggtcctcacattcctgctgggattctcaaacggcctgttcacctcgcacgcaatggcggcggggccctcccacgtccaccccaccctttcggacatggcggggagtgtcatggtgctggccctgatcgtggggctgaacattggggcgggcctcagcttcctgtggctcctggagtgacggaggttgtgcatcccccttttagatttcgaagtcttgccttcctgactatcgcaagaaagtactcgttgtgcatttgctgctgcacagtattcctgtttcatagcctacgcttgtgcgtaggggtaccagcccacctgaccctgcatgtatcttgactgattccttgtctgtattcgaattgctgccctcgctttaacaatcagtggtgtggatgtaatggcgcagatctcgagttgcgcctcggtggtttcagtaccacctcttcttgagaccattgggaagtgtcaggagcaccagatcagcagggaaccacgtatgtgttattatgagcgcaatgagacctcacaagctgtgttgagaaatgaaactcgagtatccgtgatgtgtccatttacatcatctggaggcaaggtgctccaggagggtgcttgtgctggttttctggcatcccacatcctcagattatctccgtcaagggttcagagcctcgtcatgtacacgacctgttcgcggagtcccagaggcatgcgctgcnnnnnnnnnnttggcccacactctcagattatctccgtctagggttcagagcctcgtcatgtacacgacttgttcgcggagtcccagaggcatgcgctgcagcatcggtctaccaacgtcggggacacctttggatgaatcaaagttgatcaagcactccttcgtgtcccatcgaggagctttggggaaatccacccctcgcgcacagctcaagatcacttgctccagcacaggaccacgagccccgcgctgcttgaagcccggccccgccacacatgccgaccaggagttggtccgtattcctcctcgatgaagacagccaccggtccagacacgtggggcactttcctgacctacacaggcctgggttccggcaccctggccgcctggaacagcttcatcctgggggcagactactttgagtcgcgattcccggcaagtggttgtgtggcggggtgtgcgctcgatctggattcttcgtgcacgagggagcagctctggtggaggatggctgcgttattcacaggggagtcgcaggccctgcacacccagcatgcaccaccgctcccacatcactcacgtttccctccgaaacacacacgcacacgtcatgcacagggccagcacgccaaccgcctgttcacagtcttctatctccccgtcaacctgagcgtggtggcgggcctgacgtactggcacaccctgctctccacccgcacccgcatccggataggcctggccggctccgccctcggcctggccctggtgcccctgctgggcgcgctgcctcctagtggcctcaccctggcggccacgctgggcctgctgtgctgcgtgggcgtgacggacggcctgacccagcccgcgctgtttgccgaggccgcccagggcccgcccctgctcacgcacgcgctggtcacgggcaccgcgctggcggggctggcggcctgcgcgctgcgcgtcgccaccaaggccctgctcccacccacgccgcgcggcctggccgccagcgccgccgctttcttctgggtggccactgcctgggtcgcgggctgcctcgccctgtacctcacgcgcgcgcagcgtcctcgggagggtgtcgaggaaaccacgcccggcgcgcggacccccaccccagcgtcacccccgccccgggtcgagctgtccccctccgtccacggcgcgagcgaggaggacgccgaggcgagcttgctgccgaggggccccgccccggaggctgtcctgcgctcgccgtacctcgtgccactgggtactgcgaaggccggcgtgggggaggtgagagccacgctgcgcacgatatggcggctcagcttggccacgtgcctcatttacacgtgcgaattctggagagacagcgaggctttctgaggggaaattggagggtcgcatgttgggggagtaggtcgcatgaggctgcgagcatgaccagcgatgcactacctccggggacgacatacgacatcaccctcgccgcttgggaagggcccacgcccctccggcacccgcacccacccacccgtttgcacacaatcttgcagggtgaccctggcgatnnnnnnnnnnccaccctcgccgcttgggaagggcccgcgcccctccagcacccgcacctacccacccgttttcacacaatcttgcagggtgaccctggcgatcttccccggggtcctcgtggaggacgccagggctcccagcggggacgcggggcgcggctggtttgtcgtcagcatgatgaccctgttcaacctgggcgatctggcggggaagggcggccccaccctcgtgccggcgctgcgctggagcaggcagggcggcatcctgggggcggtgtgcctgcgcgccctcttcattcccgccttccacctcgcaggcgagcggcattggcctggggatcgacttgtttctcagcgttcctcggagaggggatcaagcaggggggacagtgcccccctcggggctgtggggatggaaggtggagctcatcgagcggaagggcaaggaatgctcatcccagcgtcgtgtgctctccccccgagggagccggctgatgcctcctggtccccgctctcacatccgctcccaccgttggccccacccaacttcgcagtgtctgcaccagccgggctggcgctgtgcacgctgggcctgggtttcacaaacggcgtcctgacgagcagtgctatggccacagccccggctcacatcgccccaagccaggccggcctggcgggcagcatcatggtcctctccctggacgtcggactggtcctgggcgccgcgctcagcttcctctggctgctgtgaggggcgccggggggagggacgcgagggcacccgcgggcccagggcgagggcgcgttctgactggttcacaggcgccggagctgcggctcgacacggcgcctgatgcgctgagccaccagcgcttcccagggtgctgctcctcgcgccaccagctcaggcctctcggctcagagcgtggtgagccagccatcaacccaccgcctcacgtcttgggctctagcagcatggcacggaagtcagagttgctcttgggcggcccgggcttggcctgcgagcccagccgcgccgcacgaggcatgaaggccgcgcggggcttcatggtcgtgctggcaggagcgacgggcgccacctcggcatccagggggtcgggcgcctgttttgctcttcctcctcctgcaaatgtagtgtgggcatgggtcctcctagatactgatccaaaacgagcagcaacgtccttggcactttaccccatgggcatacaattgaaatgtagtcnnnnnnnnnngcctcggcgtccagggggtcgggcgcctggtttgctcttcctcctcctgcaaatgtagtgcgggcatgggtcctcctggatactgatccaaaacgagcagcaatgtccttggcacttcaccccatgggcatacaattgaaatgtagtcgaacaatgggaagtgttgcgatggggcctagggggatcagatgtgataccctgccagagcctcacggctcaaaggcctgtatagcgcaccgaccctctcaagtcaccccaatcacctgggggggccttgtcgggaacatcgtgtcctgcgctgggcttgggcttgtttgagggggcgatgaagatgtgcttgccgtggaagtcggtcctgtccagggcgcacgccgccttcaggccggcttctgtcttgaactcgacatatgcaaacccctgggtggagtgtggagtgggacgaccacacatcttgtgactgggcatccaagccagaggaatcttctcggtacgtgcatgggctgcggcacctgatccagaggagacacacatcagagtcctgtaccacgtggcccgctggccatcatccccctacaccaccttgctctttttcgtggaggggttgatgccgaaccggatctcggcgatcccgccgcagccggagaagagttcctctagctgttcccgacccacgactggtgccaggtgcttcacaaaggcggtgaaggtcggcgcgggctcggtggccttctcggcaagcggtgcctccttgccagcagtcctcgaatcgaactggatgtcctctttggcggacgccacgtccacggcaatgcccccttccgcgttgccctgctctgcctggcgcggccgcttggggtggggcggctttgtctcgtcaccggcggcagcctcactcggggcccgcttctcccgcggcttgaaattggggtcagcggcctggcgccgcgccttctgctcctcgggatccagaattggtggcgccttgcctgcggctggcttggcagtcctggccgaccttggcgctgcggcccctgacgcatgagcagcctcggcatcggcttgggcgcgcgctgccgcagcggatgcgagctccgacaggattgggtctgcctgggtgcacgcctccgcatatgactgtgcactgcttgtatggtagtgagagccagggtggtcgaccagcgtggctagggcagagtggacacggaggcgcttcaagtcatgccctgaatgccctgcaggcaccagacaggattcagcctgccccagcactcctgcatccgatgcaaaaacccagcagcccacaccgccgcgtcaccccgactcactcgccaaaaaggccctcgaagaccagccagtcctggaggagcctggcctggcccccgtcctcgagcttacgcctgtggcaccgctggtacagcttgcgggctttctccggcccgccatgtcgcagctcgaaggagattgcggcggcccaggcccggcgccgccaccccagtggcgatcgcagcactgcctcccacacctgccaccccggtgttgtgccggagtgctcctcccctgccgccgccggctcgctcagctgtgcctcggcctcggcccagaatgtcggcaggctgtgtgtggccatcgggagagagaggcgtggtgagacttgggttccacagtaggtatggggtgagacagccgagcatagtcacgcagggctcgcaagaggacccctgagaagccaacgctgacgtcaggaccccctgtgatgagaaacacatagcgcactgctttcagtttgccaagctcaggccaaggcgtgaacgtttctggagtcaagttgcctgccggcagaggatcggcaattgttttcctcctctcaccctcccccccagaccagctgcagcctacgctaagctgtggtccagctcgccctgaaatctcgtctccaggtgcttctcggcctcggtgagcagcgactggagctggctgagctccttcttgcacttcaaatagtgggcgtaggccagcaccacccgcacgacgtcctcccgcacctgcaccaacgaggacattaagacgtggttggcatgattacgcgattctgatgaacgatgcccacccaatgacatcacagaagtgctcacatctcaaggccaaaacctcannnnnnnnnngacgaggacattaagatgtggttggcatgacaacgtgattctgatgaacgatgcccactcaagggcatcacaaaagtgctcacatctcaaggccaaaacctcaatcagaggacacagtacgatctccatcccaattcctgtgacccataaccccctcccaaccctcccgcggtcccaagtagcacaccggaacatgagccgccagggcctcgctgtacaccgcagcaagctcgccctctgctgcccccgcccggtgcagggcccggatgcgccgctcccacaactggccgacccaggggcagtttcgggtggcgcgagcgtaggcactggtgatgagccggttgacgtcctgctgacgcaggagcctgctctccagaaacgagcagtactggagccagaggaagtgggtcacggggaacacggccagcacccgctcgtagagacactgcggccggggcagcattgcagtgatgtaaggaagagggggcgagctgtctggcggatgagaaacagggaaaaggacagcatcaaacaggctcctgcatgcctcttgttctgaagcccgaggcccacatgccctccaggcaacacatggtcttactgaagtcatccactgagacagtccctgacgacatggaacccagagccacctctgacctggcagcgcgcnnnnnnnnnntgaagcccacatgccccccaggcaacacatggtcccactgaagtcatccattgagacagtccctgacgacatgggaccccagagccacctctgacctggcagcgcgcaaggtcgcccttcttcttctcaaactccaggtacgacatgtagctgcccaggagctgggtatctgcagcggccccctcctcgccgatggccgcctcgaaaggctctcgctccccagccgaacgcatcgccgcctcatgggcggcaagcacctccttgcggcgcggatcctcggcgccgccggcatgctcccactccgcgagggtggcgccggagtgagcatgaggaacggccagctggcgccggaagagggcgagcaccttttctgtcggctgctgggctgaggcagtgctggtctcctcctgcggggccaccagcccagcctcaaatctggaatggaaggaaggggagaggcttggacggtcgtgtgcagttggctatcgatgcacctatgccctactccacggattgcactgcagctcatctgcgcatgatctgagcgccagtcacccatgcatgacttcccgtcgatggcttgtctcatcgttcctggaatttacctcaggccgcgatgccagccctcagaccgccctccccaaactcactgtcggtatgctgcccagactctagcgccctggctgaagtgcaagctcgtggcggtgagggctctctcgaagagatctcgaacctcactgattgcggcgctgtccccgctctgcacgccagaggatatgaatgccagatacgccagccatatgttgacggacaggtagtcctgcacggcaagctcatgcagtcgtgtgacatcctcacgggtggccgagccagattcaaaagctgccacctcatccttcagccactccagccagatgccttcaccaagcgggaagagggagtgcatggcctcgcgggcatccttgagctttgcttggagcccacagcgacgcacatgggatatgtactggagcagcaggggcgtagacgtgagtgttaaggtgagagctgtgttaataacgcagagaggggctgcatggagtgcatgnnnnnnnnnnacaggggcatagacgtgagtgttaagatgagagctgtgttaacaacgcagagaggggctgcatggagtgcatgatgcgacaaaccgcgtccgatgctcattctgcattcccttcttcagcccccatttcagcacagccaagcaggtactcacattggcgtgtccctcgtagtcgtacggatttgactccagggcagcttctgccgtcatgatggcagaggcatcctgctcggatatgtcgatctctcctccatcgctctcctccgaatcggactgcgacgaggacgcctccgccatcggctcgtcgttgggcatggcactgcttacagctgcgacacaagatagatttattattcaccacatttcgttgatagtctggttggcaatttattatcaggagctccccgctgctttgctctnnnnnnnnnngtttattattcaccacattttcttgatagtctggttggcaattgattatcaggagctccccgctgctttgctctgcctgtggagcaccaagcgatccagatcctgagggcgcgcagacggaacggtgtcgtagcatcaagggcgaggcagggaacgtctgaacaccacgaagtgtcgagttgtgtgcagaagcccatgattcaattcactacaggattgcgagagaatctcagtatcctggtgtcaggttgcaagggcgtgtggggaaaggggggatgtcgctgagcaacgagcaactggaggcctttgagcgggatgggtacctggtcattcccgacttcacatcccgcgaggaggtggctgcgatgcgttcccgggctctagagctggtggctggcttccagccccccaaggccgtctctgtgttcgacaccaaggaccaggtgccggaggagctggggggaaccagttgggactcagccagagggatgccatccacaccgccaacctccactaccnnnnnnnnnnatctgtgttcgacaccaaggaccaggtgcctgaggagctggggggaaccagttgggactcggccagaggaatgccatccacaccgccaacctccactacccccccgccagaccagcaaggtggaccagtactttttggacagcgccggtgccatcagcttcttcttcgaggcgggggcctttgattcccagggcgcccaggtcaagcccaaggagctggccatcaacaagatcgggcacgccctgcacgacctggacccgatcttccaggcctggtcctactcgccccgagtctgcgccctggcgcagagcctgggcctgcgccgcccgctgcccatgcagtccatgtacatcttcaagcagcccgggatcgggggggaggtggtgccccaccaggacagcaccttcctcttcaccgacccgccctcagtggtgggcttgtggctggccctggaggacgccacactccagaacggctgcctctgggccatcccggggtcacacaagtgagcaggaggagtgggtggggtttggccccagggtcgcctgggttgatagtctggggaaatggagccagagaaggaccagaggggtgtttcaggccgccctttggcaatgttccacctgagccttgctatagcgttgctccgctcgtgcaacgcagagttgcctgagatctgctcacgcgagaacnnnnnnnnnnctccacctgagccttgctgtagcgttgctccgctcgtgcaacgccgagttgcctgagatctgctcacgcgagaacgcgcattgctctgcacctagagcgaggcttccctgaacagtttcccctcatcaccgtgaggatgcccccgaaaacctccccccctcgtcccatcaagcagggcgggggtggcgcggcgcttcctgcgcgcccccgacggccgcctggccttcgacgcgccccccgctgtgcacgctgaggccgacttcgtggcgctgcccatgcccgccggcgccctggtcctgctccatggcgccctggtgcaccgcagcgacgagaaccggtcgccggcctcgcgccacgccttctcggtgcatnnnnnnnnnncggcgctctggtgcaccgcagcaacgagaaccggtcaccggcctcgcgccacgccttctcggtgcatgtgctggagggcgcggcgggcacgcgctaccccgccaccaactggctgcagcggccggcgggcatgcccgtggcaccgctgtacgagccggccgcagtagaggcggcgtgagggggcgtgtgtagccctctgtgaggcctcaccagcggaaggttgccatattgctctaccctactgatgcgccagtctcctccttgcgctgcgacacaccagtcataggatgcttacagcactggggtgcagggcggcggtcaggggggcagggaaggagagggaaaaatggggcatgcaaggggggggcacagcagtatctggatcctgtcgtctctatctgtctgtctgtctgtctgtctgtctgtctatggcatcagggccccgcagaggcgcctggggggcgccagggaaggggccgggaaactggcggcgcgcctgcccgctgggccgtcaggcgtcggagcgggcggcgcgcagcgcggcgcgcgcggcgtcgggcagctcgaagcgcagcgggttgcgcgccagccggcacgccagccgcgcgtcggcc

SEQ ID NO: 42716 - DNA, 61 bp, Chlorella protothecoides
tgtaaccccaactggagtttgtcggcagggggttcaacgtggatgaagaggttctcacgca

SEQ ID NO: 42717 - DNA, 78 bp, Chlorella protothecoides
cgccctccatggctcggtagggtcccttttgtcctattgtgtttttccggggggggggggggggggggaagggggggg

SEQ ID NO: 42718 - DNA, 62 bp, Chlorella protothecoides
aggggtggtcagggcaggaggggtctatgaccgggggtggggtgagaggagggcaattctgc

SEQ ID NO: 42719 - DNA, 78 bp, Chlorella protothecoides
aggccgcgggaccggccgggcactccacatccccgtcagcgcgctcaccccacgggggcggtggcgcgtgggccggcg

SEQ ID NO: 42720 - DNA, 588 bp, Chlorella protothecoides
  modified_base (104)..(113): a, c, t, g, unknown or other
  modified_base (187)..(289): a, c, t, g, unknown or other
gctggacgaggcggacacgatgctggaccgtggtttcgggcccgaggtgcggcgcgtgctggcggcggtgcgtggcaagccccgccccgcgcgctgcgtgctgnnnnnnnnnncggtttcgggcctgaggtgcggcgcgtgctggccgcggtgcgcggcaagccccgccccgcgcgctgcgtgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccgggcatgctgacggtgcagggcgagggcctgcaccgcggcgtggcgggcgcgcgccacgtcttccaggcgttggagccggggacggacaagatggcggcgctggcggcgctggtggcgcgcgaggcggcgcgcgggcgccgggtcatggtcttcgccaacacgctggcctcctgccgcgccgcggagcacgctctggcggccgccgggctggacaccgcctgctaccatggcgacatgcccgccgcggcgcgcggcgagagcctgcgccgcttcggcggcgcgcgcaccggggc

SEQ ID NO: 42721 - DNA, 1190 bp, Chlorella protothecoides
  modified_base (200)..(209): a, c, t, g, unknown or other
  modified_base (495)..(504): a, c, t, g, unknown or other
cacatccccggcgtcgttcgacggccgggccggcagcgcccacgcgccagcccgatccggggccgcctgcttgaagtacttgagcttctgcaaccggcggccctggcccggccccgctgcgcggctcggggcctgcgctggccctccgaggcccgtccccacgccggccccagccctggacgtgctcgcctcagccggcnnnnnnnnnngggcccggccccacgccagctccagccctggacgtgctcgcctcagccggcgacgcgctcgcctccctctgcgccgcgccgccccactgccgcttgctctgcctggaactggcggcgggcgcggcctccaggggccgcttggagctgaggccagcgcccgggaccgaggcggcgggcggccgggggtttgaccccggggctgcgggcggtgcccgtggtgccagcagtctgacggtcggggggtgggccctcggagcggcctgccaggcggtcgcgtggctcgtcnnnnnnnnnncccgacggtcggggggggggccctcggggcggcctgccaggcggtcgcgtggctcgtcgtcgctctcggcgcgtgctccactgtcaatgtgccagccagggacgtcgcacacggccctgcggcctgccctgccgggggcgggcctggcggcgatgctgggtggcaggcacctgcttcgcccctcacagtcaccctcgggtcgcaagtggcccctgtcctcttgcttcccggtggctgcgcctcgtttgccggcgcctcgctctctatcggcgcctcgctctctatcggcggctcgcatccgatcggcgcctcgcaggcgatcggcggctcgctgtctatcggcaggcaggcgagccccagcgtcccctcctcctcgcccccgtcagcccgtccgccagccgccgccgggcgcccggcccccggcagcttggcctccaggaccagcatgcgggtgagcttgcggcacaggccccgcgccccgtccttgaagggcgcggggtccagccgcgggcgcgccggctcctcccagtcgtccccgtcgccctccccgccgccggccgccgcgccggcatgcaacgtggccgcgcccgtggccatgaccaccgccaggtcggccagccgcggctcgcagtagtgcgcgtgcctgccccgggccaagcgcgcgccgcgctccagcgccgcggccg

SEQ ID NO: 42722 - DNA, 79 bp, Chlorella protothecoides
cgccgtccgctcggccacctccttcaaaaagcggaggtacttggggtcagggctggcagcgccatcctcccccgccgcg

SEQ ID NO: 42723 - DNA, 5306 bp, Chlorella protothecoides
  modified_base (152)..(412): a, c, t, g, unknown or other
  modified_base (1284)..(1293): a, c, t, g, unknown or other
  modified_base (1390)..(1502): a, c, t, g, unknown or other
  modified_base (1660)..(1669): a, c, t, g, unknown or other
  modified_base (2137)..(2146): a, c, t, g, unknown or other
  modified_base (2661)..(2670): a, c, t, g, unknown or other
  modified_base (3167)..(3176): a, c, t, g, unknown or other
  modified_base (3521)..(3530): a, c, t, g, unknown or other
  modified_base (3730)..(3739): a, c, t, g, unknown or other
  modified_base (4212)..(4221): a, c, t, g, unknown or other
  modified_base (4825)..(4834): a, c, t, g, unknown or other
  modified_base (5117)..(5156): a, c, t, g, unknown or other
gtggtgagggcggtggggggctggggctctgtcgtggtggggaagggcttggcgcggcaggtgggggcggtgtgggactgggaggtttgggcggcggcggagagggactgggttgtgctggaggcggaggtggatttggcttcttacgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctgagcttgctggggaatgttacccgtgagctatgcgaagcggaatgtggcaagggggacggtgagagtattgggggcctcgagttgcttagtggctcagctggcgatggcacggagtactcatgggtggccgacaaggccggcagcgtcgctccatcgcgaccctctattcggatttcgacatctgatctcgaattctgtgaagatgttccgaagaactcggcgtgtacaccgttgtcggattctgcgggaggcgaagggcaaggggggagggggggggatctcatttatcaatttagtcgacgctcgaggtgtttatcgcgccatcacacaaataatcaaacctaccatctaattgctcgctatatgttgtgttgaaaggctccacgcctttgttcgtacttgcagccacctatgaggaagtgcatgtacaatgtgtactcacagcggtctccggaacagaacgccccccggtccgacggcatgtaagtgcaggaagctcacctgaggcgccagagatctatcgcacaaaatgagaaatatgagagccagaggggcggtcctccgtagtagcacttggctgtggagcgtcgccatagcccgaacgcgctgtggcagacatagatgccggtcctccacttgctcgagcaaagctcgcggttcggagagcatatgtttgaggaattgaaaaggagggcatctcgcgcttgccggtatgtctcgatgcctctgccttgcctccaaaatgtatgcttccggacccggtgctgccaagtggcgcgacgacgagtggagatcgattcctttggagccgagcatcgcttggaggtaatttccacctattccagaccacatctttcgctgccatcnnnnnnnnnntcgaacgcgcggtggcggacatagatgccggtcctctacttgctcgagcaatgctcgcggttcggggagcatatgtttgaggaattgaaaaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagatcgatccctttggagccgagcatcgcttggagataatttccaactattccagaccacatctttcgctgccatctatttgaagggaagatgggttcatcttcgttcaaaaaaggagtgcggatcgatgccgcgatacaggctaccgtgtgccnnnnnnnnnntgggaagacgggttcatcctcgttcaaaagaaggagtgcgggtcgatgccgcgatacaggctaccgtgtgcctggactacatttctttgttgcatgtattgcatcatgcagcatctcatgagatgaatgtcggaatggcatgaaacggtggctcactgtcaattcatgtgcactttcaggatcttcgagctatccaattaaatctaacataaacaagattgggcgatcgccaaaagggggggggggggtttaaaggggccaccatggcagcaggttgacgcaaaaccgttccctcggttgccaccttgaaatggccatgcagtggtgagtgaggataatggagctctaggtggccgtctttgggatttggggagcgtcagaacggagtgggcagcggcgagtccacatggggctcttcaaaactttgaagtttaggtataaaggtgccagatcgccactccaggtctnnnnnnnnnnagcgccagaacggagtgggcagtggcgagtccacatggggctcgtcaaagctttgaagtttaggcataaaggtgccagatcgccactccaggtcttggcgctagccgcctcgttgttcttggactgaggcttctgaaggtggcaactccttttaaggtccagatcacgtcgaattctgggctgccatcgcccctggtcacccattagctgggcaagggggcatgcagcttgccaatcttggcaagggctgtgaccacctggacccgtgtgtttgacgacctgtcaaagccagctgtggcaccagaaggaagctggggcagagacgggggcccgggcgggcaatagacgtccacggaacgggtggctatggcgatggggagctcgggggcggggaagggggagaggcgaggaaagccgacagctgaacgatctctgacggcggacccacctccttcccatcgttcaaaatttgggcctgtgctttcaccgtgtcaccggactgatagatgaaatcnnnnnnnnnnaatgtctgacggcggacccacctccttcccatcattcaaaatttgaacctgtgcttgcaccgtgtcaccggactgatagatgaaatcgattttggtgtaggtggaggtatacccatagtggtcccagacggggttggatgtgaaggtgcgggctgagtcccagatgtggcaggcgaccgtctcgccgtagaaggcggagatgaccgtgcaattgcacatgaagtcgtcccgagcccaagtacaggggcaggccagcacgggtgagatggtgaaagggtcgacagaggacggaggtggcggaagggcaatggagtctgaggtgttgaagggcccagccggcgtgaggctagaaaccccacgggtgaccgcagagttcagcacaatcgctttactctctccatttacttcagcatcctcatccagctgaaaagttttcaacgatggattctggattactggaggcgggacttccgcggaatctgcggtatgtggagttnnnnnnnnnncgaggtgttgaagggctcagccggcgtgaggctggaaaccccacgggtgtccgcagagttcagcacaatcgcttcactctctccatttacttcagcatcctcatccagctgaaaagttttcaatgatggattctggattactggaggcggaacttccgcggaatctgcggtatgtggaggtgcatgtcggcatgaatacaaaaggtaccgaatcgtgagctgtcttgatgtgctcaacatgccaatcgcgcttttgctcacacctaccctcgaattccttgcgatcagtcgtcacgctggacttcaagcgcatactcgccctcgcagccacctgtaagaaagagnnnnnnnnnntttcatgtgctcaacatgccaatcgcactattgctcacacctaccatcgaattccttgcgatcagtcgtcacggaggacttcaagcgcatgctcgccctcgcagccacctgtaagaaagagccatgacgctaccctgagcactgtctccggaaaaaaccacaaggtgttattgagcacacgatgctaaaatatacctggnnnnnnnnnnttaccctgagcactgtctccggaaattaccacaaggtatcattgagcacacgatgctaaaatatacctggtgcgtcataatgccgatgcagagcacgagtatggtgagcgccgctgacgcgggacgccgtcgcagtctccggctggtgggtgtggtcatcgcatgaacacactgtaatctgagattgtatgcacgtcgtactctggcccgaaaaatatcctgccagtgggatttgtatcaggtttgttaaagcaaggccctttcggtcgccatgtgatatagccattctccccagttcacctccggacccggtgccagatgtcccgcactcgtggcgttcacgattttcgagccgccgatcgcccaagcatgttccagctccacacgacctcatctcattcatcgttttccgcgctcttgacggaaggaatgtccaaattcccaatcgacgggttcgggtcgaccttgcgaannnnnnnnnncgtcatcgcgtgaacacactgtgatatgagattgtatgcacgccgtactctggcccgaaaaatatcgtgcaagttggatttgtatcaggtgtgtcaaagtaaggccctttcggtcgccatgatatatagccattctccccgattcacctccggacccggtgccagatgtcacgcactcgtggcgctcacgattttcgggccgccgatcgcccaagcacgctccagctccaaacgacctcatctcattcatcgtcttccgcgctcttgacggaaggaatgtccacattcacaatcgacgggttcgggtcgaccttgcgaagcaagcgagatggtgcttatcggtggtcatccgtgtgttgctgcattcgaaccgagtggtggcgatcggtgaggagatataaaacagactctgaggctgaggctaggggcacaagcagaactcaccacatcacctgtctgacattcgggttgacgtatgatgggctgggacccatcaggggagtgcagggcggtagcgtgagacttgaagactcaccctgatgcttcatcatgagtagggcatgcagggctcaaagaggatggtatggctacaagaagaccttgnnnnnnnnnnaacattcgggttgacgtatgatgggctgggatccatcaggggaatgcagggcggtagcgtgagacttgaaggcgcacccttatgctccatcatgagtagggcatgcagggctcagagaggatggtatggctacaagaagaccttgtttcctgcatccggagcatcttgattgcatgaggaagcggcgagcgcttatccttggcctcaaggaacgggcttagagaatgcagatatcagctcgccattctgtgctagaggggggggggggggggggggggggggnnnnnnnnnnnnnnnnnnnnnnnnnnnnnnnnnnnnnnnngacggtctacaaggccatgtgcagccacatccgatggactgcaacggccgcatctcgtcatacagcagtccagcctcaggcccaagagtacaagggtatgtaggtcgatcgtccccaaccagcctcgagctgaactagacagaggttgtt

SEQ ID NO: 42724 - DNA, 100 bp, Chlorella protothecoides
ctgcctggaggcgacggggcccgagccgacgggcgacgccctgccggcccccgacgggacggtgagccccgggcgcgtgcgccgcctgctcctccgcgcc

SEQ ID NO: 42725 - DNA, 97 bp, Chlorella protothecoides
gagcattacgagcaggttacctttggctgcactttcttctccaggagcttgaagcggcatgggcagacccacccgaccaggactccttggcctgcgc

SEQ ID NO: 42726 - DNA, 61 bp, Chlorella protothecoides
ccccagccaggcagtgatgcagacatgtcgagccaaccccgcgccccggccgctcgacgag

SEQ ID NO: 42727 - DNA, 61 bp, Chlorella protothecoides
gagggctccggccccgccacgcccacgggcgggtcggaggacggcagcagctgcgggccct

SEQ ID NO: 42728 - DNA, 424 bp, Chlorella protothecoides
  modified_base (105)..(342): a, c, t, g, unknown or other
tctcaatccaatgacatggccacagccccccctggaggaggtgagaagcactcagtatcacaccatggccaaaccccaatccctggctgccccccgcgtcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcagggtaggtcaatgcttccaggtgcggcgtgggtgagggacgccgtcgctgccgcgcggcagtcgtctcatcgcaggc

SEQ ID NO: 42729 - DNA, 64 bp, Chlorella protothecoides
cggcgcctggcccccacgggccgccgccgccgccgccgccgggcccccacccggcggatggtgg

SEQ ID NO: 42730 - DNA, 106 bp, Chlorella protothecoides
ccagcgctgccacccttgccggcgggtcctcccccaggtgatggtccctgcagatgggacatggagcttctttgcgatgctcatggcgtctgaggccctgctcgac

SEQ ID NO: 42731 - DNA, 79 bp, Chlorella protothecoides
accctgcggcactccaggcaagcacaacatcagggggaaggggggggaggcgtggtggcagtcccgggtcgaaaacttg

SEQ ID NO: 42732 - DNA, 91 bp, Chlorella protothecoides
acaccccatgctctagcccagcacatcccgcatcaaaatggcagaggcactcaccaatgtgtatcacggggctcccgggaggttcctcggg

SEQ ID NO: 42733 - DNA, 61 bp, Chlorella protothecoides
gggctccctggacctgggcggctcctccctggaggtctgcttcgaggctgagccggaggcc

SEQ ID NO: 42734 - DNA, 61 bp, Chlorella protothecoides
gccactcggatgctgaatgtggctcgccccccccccccggcctagcctccctgacctagta

SEQ ID NO: 42735 - DNA, 61 bp, Chlorella protothecoides
gcgtggtttgtcccttcccactgcggcaggtggaccatgtctacactccatggggtgattt

SEQ ID NO: 42736 - DNA, 75 bp, Chlorella protothecoides
agtctctgcaatgctgggccagcaggtgcgaaggagctcgcctcccttgctgtgtgctgttgtggaatgtgggag

SEQ ID NO: 42737 - DNA, 11297 bp, Chlorella protothecoides
  modified_base (468)..(477): a, c, t, g, unknown or other
  modified_base (825)..(834): a, c, t, g, unknown or other
  modified_base (919)..(928): a, c, t, g, unknown or other
  modified_base (995)..(1004): a, c, t, g, unknown or other
  modified_base (1343)..(1352): a, c, t, g, unknown or other
  modified_base (1792)..(1801): a, c, t, g, unknown or other
  modified_base (2667)..(2854): a, c, t, g, unknown or other
  modified_base (2953)..(2962): a, c, t, g, unknown or other
  modified_base (6204)..(6213): a, c, t, g, unknown or other
  modified_base (6302)..(6311): a, c, t, g, unknown or other
  modified_base (6373)..(6382): a, c, t, g, unknown or other
  modified_base (7041)..(7127): a, c, t, g, unknown or other
  modified_base (7587)..(7685): a, c, t, g, unknown or other
  modified_base (8083)..(8092): a, c, t, g, unknown or other
  modified_base (8252)..(8261): a, c, t, g, unknown or other
  modified_base (10295)..(10304): a, c, t, g, unknown or other
  modified_base (10779)..(10788): a, c, t, g, unknown or other
  modified_base (11132)..(11141): a, c, t, g, unknown or other
ctgcggcgttgcggcgtgaggcccaggcggtgaacgggcccaccgccacgcccgccctcccgccctttgactgggggcgggtgaatgcctcgctggcgcacgccacgccgcacgagggccagccccggcgcttcgagtacgagttcgcctggatgacgcccgacgcggcgcgctgggagcggtgatgcggagctgtgtggtggccagcgtgggcgaggctggtgagggaggaatgtgagcaggcgggatgatggggtgtgcccagccgcggagccagctgagcttggcgatgaggtggcagtcgtttcgttactcaacagtctggcaaggtgctatcgcacggtcggtttgtccacacgacctggcatcacctgagaatcacccatgcacctctttgccaccccgtcgactgtgcacccataagtcactgacattctaattgagggctgtgtgtacagtactgtctannnnnnnnnngcctgaaaatcacccatgcacctctttgccacctcgtcgactgtgcacccataagtgactgacattcgaattgagggctgtgtgtacagtactgtctacgtagtacggagtgaaacaagtgcagggaactgacaagtgccttggatgaggcgggtcctggggctggcagattgcagggcacgggcaacccggcagcaaaatgcccgggacccgctggccagcgggatgtagtgcacaaggccagcacatctgcaagcaacagatgggccgagtggtgagcgcccactcgcgagggcggtcaggaacgggggtgaagctgcatggaggctcatcaacaatgggagcccnnnnnnnnnntaaaatgcccgggaaccgctggccagcggcatgtagtgcacaaggccagcacagctgcaagcaacagatgggccgagtggtgagnnnnnnnnnngtgcagtgccgatgggtggggtgggggggggcgggggcgcacgaggtgccctccatccccacagctnnnnnnnnnnatgcagtgccgatgggtgggtgggtgggtggggagcgcacgaggtgccctccatccccacagctgccgtcgatgtacccgtctcagagctgcgagctgagccaggacagctgctcggggggcatgggcgccatggacagcatgcccgggtccagggtgggcatggccacgctgcccacgctgaggctcggctcgcccagcgccgcgtacaggctggacggggcgggcgggggcgccgccgggtgcatgaacgccccgctctcgccgctggcatcctggggctgctgccacgcctgctgcgccgcctgctgcgggaactccccccagccctgtccggccnnnnnnnnnngcgccccgctctcgccgctggcatcctcgggctgctgcagcggctgctgccacgcctgctgcgccgcctggtgcgggaactccccccagccctgtccggccgccagccagtgctgcaggtgcgcgacctcgccggcgctcgctccctgcgccggggccgccgcgcccggccccgccccgccgtacacggcgccctccggcgggctcatgcccagcaggggcaggaggtccgggggcaggttccagggctgcgcggcagcgtaggcgccgcctccgaaccggctgctagcctcccagtccgcgccggcgtccggctggcacgccggcggcgcggggtgcatggcggagcaggcggctaggttggcgtgggaggcgtggggcgtcgcgcgcgactggctagggccgccggtgtcctcgcccgtctggccgccctcgctgccnnnnnnnnnnccgcggtgtgcatggcggagcaggcggccaggtcggcgtgggaggcgtggggcgtcgtgcgcgactggctagggccgccgccgtcctcgcccgtctggccgccctcgctgccgccctgcttctcgcgtcggcgctggttgtgccgctccagcgccttcttgcaggagcgcttggccccggagaagtcctccaccgggtggcccacgccgcagcgctggcagaagcgggtggacacgccgcgcacggcgtaggccccggccttcaggtgtgcggggcagatgtggttgcgctggtagtagaaggagcaggcccccaggtcggcggtgcagttgtccgcctggcaggtgttcttcttgaacatgcgcgggcgggggccgcgacgcgctttcccccgcccgccgctggactcgtccaccgactgctcgtcccaggtggcggaggagaggccgggggtgggcggcgggtagccgggggccgcgtgttgcagcttggggcccgggtccagtgcattgggcgcgcccccggagcccaggaccgggtgggcggcaggcaccgcgctgggcgcggggcccggcgaggggcagctctcggccttcaccagctcgtccagggcgaggtgcagctccatctcgtcccattgcatcggtccgtccaggtgcaggtgctgctgggaggggcctgtggtcggggacggcaagaagagggagggccaccgtcaacacacacctccaatgtgatccttggccccatcaccttccatctcagccattccgagagaaagcgccacacctctccatgaacgcaccatagctcgcatcaacggtacagtctccgctcttgcggggggtgccggacccatggccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgactagagtccttatcctgaaacggccctaggagcctgtacagagtcagacgccttcctcagaaaaggcacccgcggcgcattgtgttccagaatannnnnnnnnngtccaatgtgatgcttggccccatcaccctccatctcagccagtccaagagagagcgccagacctccccatgaacgcaccatagctcgcatcaacagtacagtctccgttcttgcggggggtgccggacccatggccatccaacaggacgagcgtctctcctgtcattacccccccgaccgtgtctagggctgagcgtaggggtggagtgggcctccaggaggagcgaacttggttgtgacggtgtccgccctcgcaagacagtgttcacagcccagataaactccaggaacggaccgcaaccgactagagtccttatcctgaaccggccctaggagtctgtacagagtcagacgccttcctcagaaagggcacccgcggcgcattgtgttccagaataatgcatggcgatattgggatgtaacgcttccttgccggcagaccttatcacgtgtgtggtgccgcccggcttcgacacactcacggacgttctggcaaaatgtgacagcggtcacgtaaggcttccccgggtgaatcacgctttcctccccgcatgtgccgcgcgcatggaccgtttctgtccctgcctgatttacgggcctggacccattcgtctcgcattgatccaggcttggttgattttgatattgaacacataacatctagaacctctacccctccctgtatcggcgcgagcccctccctgaccagcagtggcgcaggtcccgggaaaccgcctagtcagacaatgctctcccatgtcctgagggcctccagtggacgcctggggtgccgtggcctccatgccgccgcccccgcactggcagagctctcggaatggtcgcgcgtggaccccgcacagctttccggatccagcccggctgccctgaacaacctgggtgcgtggaaaacgtgccggagtgtcaggggctgccttgcccgcaggcacaccacatgtgtgtgcactgtcactgaagcacacagctccagatcctctgtccgaacaccctaccgtcccctccccccagtggctggcgagtggacccagacggcccagtccctgtcggtggtggaccccatgaatggcgagcccttcctctccgtccccgacacccagctggacgaaatccagcccttcatcgacagcctgcgcagcgtgcccaagtccggcctgcacaaccccctcaagctgccggagaggtgggaacagggggcgagggggcatggagatcgtgtgggaggcctggagatggcttggtatgtgcagcgttgagatgctgtggggtcgacagtcccatggatttgataccaccatggccgcacggttgtatgccgccgccgggccgctggaatacttctgcaacaccagcgtaggcctgctcatgttgcacgtcagcatggccccccccccccaacagacatgcacacatgcacacactgcacgcaaacaaatgcctatctccaccatcccaccgcctccgcaggtacctcctgtacggcaacgtgtcccgcaacgccgccgcggagctgctcaagcccgaggtggcagaccactttgcgcgcctgatccagcgcgtggcgcccaagtcctacccccaggcagaggcggaggtgtcggtcacgcgcatcttcctggagaacttctcgggcgaccaggtccgcttcctggcccgttccttcggcgtgcccggcgaccaccccggccagcagagcaacggctaccgctggcccttcgggcccgtggcactcatcgccccgttcaacttccccctggagatccctgccctccagctcatgggcgcgctgttcatgggcaacaagcccctggtccatgccgaccacaagtgagcagactggctgttgtgttttttttggggggggggatgcaacaggctcccatggctggggtacaggaggcgatgaagcgcttccgtgcggcggaggcccggcagcgcctggcaggcgacgtccggggttggtggtgtgatcgccctaccagcgcagtaccgtttcctggccgacaagggtggccttcatcaaaacgcacacacgcgcgcactcaaacaccccaaccccctggcccggccagggtggcggtggtgctggaggagtttgtgcgcctgctgcacgcctgcggcatgccacgcgcggacctggacctggtgcacggccgaggctcgacggtgaacgagatcctgctgcgcggcgagccgcgcagcacgctgttcacggggtccaagcgcgtggcggagaagctggcggtggacctgcggggcaaggtgttcctggaggatgcggggttcgactggaagatcctgggcccagacgtgcaggccttcgaccacgtggcctggcagtgcgaccaggacgcgtacgcgtgcagcgggcagaagtgcagcgcgcagagcatcctgttcatgcacgacgcctgggccgaggcggggctggaggccgcgctggccgcgcgcgccgcgacgcgcgggctggaggacctcaccgtggggcccgtgctgagctggaccacggaggccatccaggcccacgtggcagacctgctggccatcccgggcgcgcgcctggcctggggcggggaggcgctgaccgggcacgccatcccgccgcgctacgccgccatccagcccaccgcggtgttcgtgccgctggaccaggtgctgcgccccgagcactggcccacggtcacgcgcgaggtgtttggccccttccaggtgctgacgcgctacggcgacgccagcctgcccgacgtgctggccgcctgcgagcgcatggacgcgcacctcaccgccgccgtggtgtccaactccatccccttcctccagcacgtgctggccaacaccgtcaacggcaccacctacgccggcatccgcgggcgcaccacgggggcgccccagaatcactggttcggcccagccaacgacccgcgcggcgcgggcatcggcacgcccgaggccatcaagctggtctggtccactcaccgcgagatcatccaggacgtgggacccgtgccggacgcctccaaccaggtccagtcctgacctggtggaaggggggggggagagtcagtggacagagatcgggccggcggcggcgcgtgccgactgtcctgcgcccgcgataccctccccaccgcccggggtggcaccctcccctgccgtcaaggggcttccctcgctcgtgtgcagacatgaacgacacctgcccctgccgccggcaggctcgcatccnnnnnnnnnntggcaccctcacctgccgtcaaggggctcccctcgctcgtgtgcagacatgaacgactcctgcccctgccgccggcaggctcgcatccnnnnnnnnnngcgtgtgatgtgccgcggggattcagacaccgccacagcgttcgtgcgattggtttgtcagnnnnnnnnnncttgctcatgctcttttcccagcttcgcctggtgcctctgctctccccttcctgctgcctcttgtcaacttttggacaggcggggcgggggtcacagggcgaagagcagctgggaggaaaggcaggatcgtgacagcgagcgttggtggctcccgctcccatgtgtgatgagccgcggggattcagacacggccacagcgttcgtgcgattggtttgtcagggcaggggggcaaacatgcatgcgcgtcgagccgctgctcactggatggagcagttttggggcctgccgtccccgcccgccttggcctgcagcgagggacggggcgggtgtggcgaaaggtgagaccgaggacagctgatgtcgtcggcgccccacttcctcagcatcggtaccggcggtgggcgtggcttgccatcgtagtatgaggtaccacaccctgaaacccacccattcccctgccccttcacctcgtcggccttcagatcgatcagcttggtgccgtcgatgacgccctggagcccaggcagggccgacgcagcgcccaggtctgcggcttcgccccgctcctggctcgggtcccgcggctgcacggctgcgggggcggcggcgccgccagcctccgcgcttcgcgggctggccggcgccggccccgcaccnnnnnnnnnnnnnnnnnnnnnnnnnnnnnnnnnnnnnnnnnnnnnnnnnnnnnnnnnnnnnnnnnnnnnnnnnnnnnnnnnnnnnnntggcggtgcaccgaccccaggcggcggcccagacactgccgcgccgacctccgagccggatgccgccgcagcgctgccccccagccactcctcggctgacccgggggagtctgtgacctccgacccgacatccgccacggcatgacttgccagggtctcgtcggtctgggcctctgccgccccctcatcgccatgccctcccgccgcgccgcgctcgtgcgcagcggcctcgccgccctcctgccgccgagggtggcgcttgcgccccccccgccgcgacctccgtggcttggcctcagcaccgggctcggcggggaccgcatccacgccctctccccccgcgctcgactcctgctcgggcacgtcctgggcaggcgcgctcgcctgctgggccggggccttggggcgggggaccaccagaattcgcgagggcgggtccgcgggcgccggcccgccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcacgctgcgacgctcgcggaccttggcgaccccgcccgctgcttccccgggccgctcggcatgctgcggccggggctccgggccgggtctcgcacggggcacaggtcgggcctcgaggtgctcctcccctcccgcagcgtcccgcctgcgctcacgctccccccgccctctcctctgacggcctgtgggctcggtctggggggggccggtggactgtgcgtcccttgcctcctcccgcacggcctgtccccgatggggttgtgcaggggggcggcgctgatcgtccagagcccgctcagcctgtgacgggtgtggaagagggaacgcgagaatcgctgggcaggggcagactctcagggtgagttgcacagtgagcaaggtttactgtttgcacnnnnnnnnnncgctcgcgggccttggcgaccccgcccgctgcctccccaggccgctcggcatgctgcggccggggctccgggcggggtctcgcccggggcacaggtcgggcttcgaggtgctcatcccctcccgcagcatcccgcctgcgctcacgctccccccgccctnnnnnnnnnncggaagagggaacgtgagaatcgcagggcaggggcagactcccagggtgagatgcacagtgagcaaggtttactgtttgcactgcattcacttcaacatgctcttcaacccccacgagcaggtacacccgccataccttcccgtttcggtccaggtccagcttgggctgggaccccaaagcgggcggcgggcgatacgcagcgaacccctcccgcacgcgtgtctctgggcggtgccggggggccgttgtgacgttctcgacatcttgaggaggcgccactgactccagcctgtgaggggagtgggtccatgatgatgcaaggccgctggatgcggcatgcgagtacggatcccaagcaaggcctggctattgcacacttgtgatggtcacactcgggccccctcccgtgcccccacgcactgtcgggaggttgagcgggactcgacgggggagcgtctccaccttttttggtagtcgctggcctttgccatgccctcgcgacactcttgctcgtactggctccgcagtttctggttcttgacctggattgcgaggtgagtgggcaccagtcgctgcaatagatgggcaccgacacgccgggcgccgttgggcacacttccgcagacaacccctgcccgcaggatcccgcatccactcacgatctcgcgatggaatccatgagtcagatccagtcgctgacggctgactccccgcttcacgtccgcagactcgtcccatccctctctcgtctcgtatctgggcctgcctgcactgtcagagtgcagcgttgagggtccctcaacctcctcatcgtccactgcatccgcccagctttccctgttagtcatatcgagagtatctgttcactcaaagtcgcctggaaccaggggcgagggctgttgaggggtggcgagggaggaggagctgcccgctgcgaccgaaattcgcacgtgcgcgcatgtgcatggctgcccaaatcccctatgccatgcaatgttccgccagcctatgcaagggcaccattcaattatatcatctctggtgcttctcccgggaagacactgactgctcgggacaggggcgccatgtcggggctgacccactccgcacactgctctgggggattgagccgcttccatctctcagctcgccctgcctctcgcgtcatgcgtgtgtgtcggccgcgctgcacttctgcccctgccgtggcagccccggcgaccaccctgcgcttcgccaagtaccagggcctgggcaacgacttcatcctggtgaggaccttggagacaggttccttgtgacaggactgggatttcacatgttcttgggcgcataacattccatcataggggggccaggttgccttgggtgctgcctgaggggctcccccctcccttcctgatgccgtcagcctgccacccaaacacaagcgcctggccctccacctcccctcataattgcaggtggacaaccgccactcggccacgcccctggtcaccccctcccaggcggccaaggcctgcgacaggcattttggcgtgggtgcagacggcgtcatcttcgccctgccgccccaggcccccgactccgactacgccatgcgcatctacaactccgacggcagcgagccggagatgtgcggcaacggcatccgctgcttggcccgcttcgtggccgagctggacgcggatgcgccaaggcgataccgggtggacaccctggcgggcctgatccagcctgagctgctgccggagggaagggtgcgggtggatatgggggagcccatcctggaggccaacgccatccccaccaccctgcagcccaccaccccggtgaggagaggatctggacggtgtgagcgagtttgggaggaggggggggagggcgggggtgatgatgggagcgaagaatctgggttcgactggtaggaatggccaggagataggatttttagtgccacggcgctgcagctgccgaccgaccgaccaggcctgccctcaacagcctcgtgggaccagcatgcagccagggannnnnnnnnnaggggggggggtggggcggggttgatgatgggagcgtagaatttgggttcgactggtagggatggccaggagataggatttttggtgccacggcgctgcagctgccgatcgaccgaccaggcctgccttcgttagcctcgtgggaccagcatgcagccagggagcccttgctgggctaggaaaatacgatgcatcactcaagccctacgcttcccccttacaaacctgggcaggagggcgcggtggtgaagcagtgcctgacggtggacggcaaggagtggttcttcacctgcgtgagcatgggcaacccgcacgcgatcacctttggctaccaagacgggacgctcatacaggtaggaattatgaaggatgagatgcatgacagggatcgggtgcgtgtacgctcgccgctccccaacctgaaaggaccacaaaaatttcgcctgtatataccgtcgtcaattcgtttttcacnnnnnnnnnnttccaacctgagaggaccacgaaaatttcgcgtgtatataccgtcgtcaattcgtttttcaccactggcttcgggatcttggtctagtggtatgattctcgcttcgggagaagcaccacccgtgttccacgggtttcgggctgcgccttgtgcgagcttgcgagaggtcgggggttcgattcccccaggtccccactttttttccccacttgctgcatacagttttccctgttcaagtaaacatcacgcaaaaacactgctcccatctccgcagacggacagcatcgacctacaaagggtgggacccctcttcgagcacaaccccgtcttccccgcccgaacannnnnnnnnnactgctcccatccccgcagacggacaacatcgacctacaaagggtgggacccctctttgagcacaaccccgtcttccccgcccgaacaaacactggtgaggagtgtgtgtgtgtgggggggggttaatgtgatgtggacatacgccccctaccatt

SEQ ID NO: 42738 - DNA, 72 bp, Chlorella protothecoides
gcgcacccaggactggggagggagggttgctgcacaggatctgggcgagcagcgtgaggatggtgggggaga

SEQ ID NO: 42739 - DNA, 61 bp, Chlorella protothecoides
tcgccacctcctttgccggatgaggcggggggaggtggaatcttgagaagatccagtcgaa

SEQ ID NO: 42740 - DNA, 3584 bp, Chlorella protothecoides
  modified_base (280)..(289): a, c, t, g, unknown or other
  modified_base (535)..(544): a, c, t, g, unknown or other
  modified_base (942)..(951): a, c, t, g, unknown or other
  modified_base (1272)..(1281): a, c, t, g, unknown or other
  modified_base (1345)..(1469): a, c, t, g, unknown or other
  modified_base (1526)..(1535): a, c, t, g, unknown or other
  modified_base (1598)..(1607): a, c, t, g, unknown or other
  modified_base (1742)..(1751): a, c, t, g, unknown or other
  modified_base (2104)..(2113): a, c, t, g, unknown or other
  modified_base (2344)..(2353): a, c, t, g, unknown or other
  modified_base (2663)..(2672): a, c, t, g, unknown or other
  modified_base (2755)..(2764): a, c, t, g, unknown or other
  modified_base (2830)..(2839): a, c, t, g, unknown or other
  modified_base (2923)..(2932): a, c, t, g, unknown or other
gtgtacggacactcagacagaacggatagccttggtacgctccgcattgtttgcaagctctgttggggtgtgaagtgtacgtgagctatttaagttcgttttggcattttggggggtgttccgcgactccaaactcgacggatattgggaattccccagtgcagatctcgcaattgacagatggcacgttctcagcgtttccgacgtacagacttgcggaccggaacccccggcgaacaaccggcacttgattcgtagatttggcagcacacggcgcccnnnnnnnnnntcgcgattgacagatggcacgttctcagcgtttgcgaggtacagatttgtcgcccggaaccccggcgattaaccggcgcaggattcgtagatttggcagcacacggcgcccggggcgcggagcactcgggagaaaagtgtagaatgaggatcccttatggtccacattgaacctagattcgactgaatggagcgggaaattagccgcacatacttgtggaccgtctgcactgcgtggagggcgccnnnnnnnnnngcgcgattgacagatggcatgttctcagcgtttgcgaagtacagatttgtcgcccggaaccccagcgtttaaccggcgcaggattcgtagggcagcacaaggcgcccggggcgccgaacactcaggagggaacgcagactttaaagattccctccattcacacattaaggtggctatattcggttttatggagcgcgaaaattgccgtacgttatagttgaccgtccgcattgtctggttgtgtggccggcaagggcgagtcgtgcgtgtctggaatattcggggacccgacccattaccctcctatgggcgctcctgatggcttgccaagcaatgaatgactcagaggtaggtgtatgaggattgcgcttcgaccacatgctgcgctggcctgctcnnnnnnnnnnaccggcaagggcaagtcgtgcgtgtctggaatattcgggacccgacccattaccctcctatgggcactcttgatggcttgccaagcaatgactgactcagaggtaggtgtatgaggattatgcttcgaccacatgctgcgctggcctgctcctgctctcaaagcctcatattctcccatttacctcacccctcctttcccactctgcgcacaggtgacaccggccatcaccatgaacttcatggagtgcgccatcatttccgacgatgcttcgcccatccaaaggagcgattgcgcagtcagtgtgacggtgactgagctnnnnnnnnnnccccaaacctcaacgtcttcccaactacccaatgttcacccctccttccccactctgcgcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctctggggctcaacatcctcccacctaccccacctttcaaacccctcttcgtannnnnnnnnnaatatctgagctgcctgtggatggctactacatcgagtacaccaatggtgatgatgagaacannnnnnnnnntggatggctaccacatcgagtacagtaatggtgaagatacagatagcatcagctcaatctctacccagctcaccaatttcatcacatggcaagcaccagggatcttcaccaagggcagcgcctacgcgtggttcnnnnnnnnnncttcttctcatgatgcatctcccacccgcataatgacatgcacggccagtgtgacggtatctgagctgcctgctggtggctactacgtcgagtacaccaatggtgatgatgagaacagcacaagcttccagcccacccaactcaccaccttcaccacatggcaagcaccagggatattcaccaagggcagcgcctacgcgtggttcaaggcttctgatgggagtgttgtccattccaacgacatccccatctcggccttttcgagcccccctccccctaggccatccccaccacctccattactgctgccacccattcctttgcccccaccacccgagcctattgtgtttgannnnnnnnnnaacatcaggttcacgccttcccagctcaccactgtcatcacgtggcaagtatccgggatttcaccaagggcagtgcctacgcttggtacaaggctcctgatgggagtccactccaacgacatccccatcacccacttcgcgagcccccctccccctcggccatccccaccacctccatcaccgctgccacccattccttcgcccccaccacccgagcctattgtgtttgannnnnnnnnncccggggaattcaccaagggcagcgcctacgcttggtacaaggctcttgatgagagcattgtccactccaacgacatccccatctcggcctttctcaagcccccccgtcctcctccaccctcacctccttttccttatcccccaccacccgagcctattgtgtttgactccgtccaatgccaaaagtactatgatcaaaggatcgcatgcaatgtcaccatgacctttcaagttctgcccgagactgtatggctcaccttcgccatggaggatggctccaaggcacagcagaagcagtttaccaactccnnnnnnnnnncgaggttacccccgacactgtgtggctcacctttgccatggtggatggctcaaaggcacagcagaagcagtttaccaactccnnnnnnnnnngctcagcccaagccctcctccaccaccaccaccaccacccgtcgacgtgacactgagcaacgcatnnnnnnnnnncccacccccaagccctccaccaccaccaccacaaccacccgtcgacgtgacactgacactgagcaacgcatggtgcacgcagcnnnnnnnnnnggcattcccccacctccgccgaacccctccccacccccaacacttccgcccccgccacccgccgacgtgatgctgagcaacgcatggtgcacgcagcaggagtcagacctctacaagtgccaggtcgaggtggccaccagcagcctgctggcgctcatcaccgtcacctacgacgtcggcggggtgagtgccacccattcctatgcgccccgagatctcaacacgatcagcaccatcactgtcaccacgagctccatggaagggtctgtgtcggcagtcggtcaggacaatgatggaaagcagttgagcgcggcggccgtgcccatcaccactgcccctccctcccccccttcccctcctcaccccccctcaccaccaccttcaccaccaccttcctcaccgccaccttttcccccacctccctcgcccccaccttcaccaccaccaccttcaccaccacctccctcaccctcacattcacccccaccttcaccacctccaccttcatccccacctctttcacctccaccttcaccaccacctccctcacccccacattcacccccaccttcaatctcacctccctggcccgctccggcacccttgttcccgccgagtccagctccctcaccctcagccacgcccccaccca

SEQ ID NO: 42741 - DNA, 432 bp, Chlorella protothecoides
  modified_base (164)..(327): a, c, t, g, unknown or other
gcggggatggtgagcgggctggggtcggcgaaggcgggggggtctttttggagggaggcggtggcatcttctttggtgagggcggcgaccttgtggggggtggagggggaggagacttcctgctgggggagagcggtggtgacttcttggcggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggaaggtaaggttccatgcactcttgcgaagctgaagcaagctgcattcgttggcgactttccgatccccaacgctgttgaagcagcggttgcccttgccc

SEQ ID NO: 42742 - DNA, 78 bp, Chlorella protothecoides
tcatcgcactgcggggggaagggtagggtgcaggggtgggagggctgagggctgagggctgagcctggggcaccggcc

SEQ ID NO: 42743 - DNA, 61 bp, Chlorella protothecoides
agcagttcggtcacgtctcctccgaggtggggcattggccacggtgcaactgccccttctc

SEQ ID NO: 42744 - DNA, 93 bp, Chlorella protothecoides
ggggtcacggtggctgggtcgcggcgtgggaagcacagggtgcccttagtatggtggtgccccgctgggcaccggctgccagcactccatgtg

SEQ ID NO: 42745 - DNA, 68 bp, Chlorella protothecoides
gctggcagctggcatcgggagtccacgtcgacccccctccagccactatctcgcaccctggatccccc

SEQ ID NO: 42746 - DNA, 61 bp, Chlorella protothecoides
gaaatagctcatgtcatgctgctggcagggggtcgaaacaagcttagcagcttggtcctgc

SEQ ID NO: 42747 - DNA, 106 bp, Chlorella protothecoides
cggccaggacgcgggggcgggggcgggggccggcgccgacagcgacagcgacgacgaggagcggggggccggcgggcccgcggcgcccaccaaggaggacgtgtac

SEQ ID NO: 42748 - DNA, 145 bp, Chlorella protothecoides
ggggggggagctgaggccacgtgggtgctgccaggtcggggcggcatactctcgtgtggcaatctggtggtggtccactgggcgatggatgtccaccatctcatcgccagtttccatgtagcaggtcactgtgaggcttccacac

SEQ ID NO: 42749 - DNA, 61 bp, Chlorella protothecoides
ctgattgcaatgcgcagctctactggctggggaagcccgccaccactgacacccctgcttt

SEQ ID NO: 42750 - DNA, 95 bp, Chlorella protothecoides
tgggcgcaacacaagagcgtggccaggccacgcgcccagatgaccgtccaggaatcaatgcctcagccatccttgagctggggcagggaatgctg

SEQ ID NO: 42751 - DNA, 15150 bp, Chlorella protothecoides
  modified_base (8438)..(8447): a, c, t, g, unknown or other
  modified_base (8583)..(8592): a, c, t, g, unknown or other
  modified_base (8935)..(8944): a, c, t, g, unknown or other
  modified_base (9286)..(9295): a, c, t, g, unknown or other
  modified_base (9954)..(9963): a, c, t, g, unknown or other
  modified_base (10024)..(10033): a, c, t, g, unknown or other
  modified_base (10265)..(10274): a, c, t, g, unknown or other
  modified_base (10428)..(10584): a, c, t, g, unknown or other
  modified_base (11735)..(11744): a, c, t, g, unknown or other
  modified_base (12201)..(12210): a, c, t, g, unknown or other
  modified_base (13563)..(13572): a, c, t, g, unknown or other
  modified_base (13830)..(13839): a, c, t, g, unknown or other
  modified_base (14547)..(14556): a, c, t, g, unknown or other
  modified_base (14915)..(14924): a, c, t, g, unknown or other
gcgcctcggtgacgcgcgcccccgcgcgcccctgccgccccgcgcggcgccggagggcttgccagccggccctacgggtgccgcggcgactgccgcgggactgccctgtcccgcctctggggccgcagcagcctcggcgtctggtgaggcaggggctccttgtggctcggctacctccgagggcgcagcagccccatctgtagcccctctctcctcgtcgcccggttctggccctgatggagcagcgacgccggcggcgaggccggacgggacatcggcggctctcgcgccttcctccggcatggcttcgcgctgtaccactgtgggtgactctccctcgacaggacaccctgcaggttgcgcccgatcgccaggcgcggattcgtggccatctcccgggtgctggggttctgccgcgggaccatcgtggtcaagcttctctgcctcgtcctccttcactccgccagctctgggcccggggctcgcctcctcgtcagctccgcctgcggtacactgtacttcagcgggaagcggtactccggcctgcgcagttggttcgtcgcgcacgtcaccgtctgactccagacacgttgcaacctcaggctcagcctctgtgcgggcttcgcccaccaatgggaagtgggtaacgccaccacccacaggtccctcgtcagcggccacagatggcaggccttcctcgccactgccagcagcgctcgcctgtgccgccccctcggcggccggcagatgactcagggtgcaatccttgcctactgagttctcttcgtcctgcagtggaggaagcggtgctgctcctttggggtctcattcaagaaaaggaagcccgagaaagacctgcgccaccccagagcacgacatgcatcatggaccttcaactgcaatgcacccgagaccttcaagcctgggacctacatgttgtctgtctggtctgggcgcttccccaacctcagctgggaatgcttcggccactggggcagggctcggctggcgtccctctgccccagcagcctcgaagtctgtgctgtcagccatgcacaagagggctggaaaaacaggactaggcttaagggttgccagtcatcgacgtctgtgggggtgaaaggggatgatggatggatctagagtgaggttcatgagcacttggttcatggcagggcggactgtgagcccatgtgtgcgcagcgcgcaggatggtctcggagagctgggtccgcggtcacaggtcccgcaccaccattcaatgccgagacaggagtgcgtggggcgacatgcatggctgcatgaaagcctcacaccccccaacgaatcgtgcgtcctccccaccctcccgttcgcacctgcaatcccctgcagctccgggacctctagcgcgcgcttcgccgccctgaatcagcgcggtgaagcgatcgaggtggtccagggtgttccccgaggtgccgaccggtggtccagctggcagtgctccgcggttcaaaatatttcgagccgggtctgcgacagaaggctggcggtgaagtcccgacagagacccttcccgacacttcccggatgtgcagcacactttttcaataaagtcccggcctgttgggaagctgctcgggcaggtgacagctgaggttgcacacagctttggagacccctctctggcgatcgtcaggatgctgcaggcccccgtttaactctttgattttcatgaccatcgccggggcgtccatgacgtagaccaggctcccacccgcccgtctgtctcccggggtcgcgccagtgcgggggcatcttctcggagtggccccggcggtacaaaagcggtacggctttctgcatggagtgctccggcacagtccacatgcggggcagccatcgacagccttactcctgaacacccgatctcttgtctttgtacgcggcagttgggcatgcctcaaaaacgaagcacagatggcaagaatggggggagtggcagggtggggcagcaacatggagcaggaacggcaggggatggaagggccagccggggcgcagggctgtgccacgtgggagcacgatgagcgcgtacacaaccccccaccgccgtggtcacctcccgctgtacgtcccgtccggcacgcccgccccgcctctgcccggcgcgcccagcaccagggtctgcgccgacacgaggtgcgcgtaccgccccccccgcgccagcagctcctcgtgcgcccctgcctccaccacccgcccctcctccagcaccaggatctggtccgccgcctgcaccgtggacagccggtgtgcgatgaccagcaccgtgcgctgcgcagtcagcgtgcgcagcgcgctctgcaccgccgcctcgctcgccgcgtccagcgccgaggtcgcctcgtccagcaccaggatcggggcgtcgcgcaggaaggcgcgcgccagggccacgcgctggcgctggccgccggagagcaggccgccgcgctcgcccacgcgcgtgtcgtagcccagcggcaggcccgtgacgaagtcgtgggcgtgagcggcgcgcgccgcgcgctccacctcgagcgacgtggcctccggcgcgccgtacgcgatgttctccgccaccgtgccggagaagaggcgcggctcctgggccaccgcggtgacccccgccacccaggcctcgcgggaaaaggactggatgggaacgccgcccaggctgatctcgccagagtcaacagagtacaggcgctggatgagcaggcccaccgtggacttgcccgccccggagtgccccaccagcgcagtcacgcggccggccggcaggcgcaggttcaggccacgcaggaccggccgctcggggcgggcggggtaggagaaccagacgtctttgaagacgacgtcgccggtgggcaagggcgcgggagccgggcggggtgatgtggtcgggacgccggtgtcgtttgtgttgccgcgctcggaagagctgctgctgctgtgggtcgggccgccggaggcgggggttccatcatccacggccccagacgcagcggaggtggaggtcgcccggctccacttcccgtcgtcgggccggttctctgcgttgctcgtccctggaagctcgcaggcgtctgccgcggcgttggccacctcccaccacgcgcctggaggagagagggagatggtttttgtgaggagggaaaggggcggaggtgtgtacgggacaccagagcctcgcctggttgatgcaagcaagccccccatacacagccaccaatgccaaccatcttcaggatcccgacgccaagctttagaaccaccgcacgaatgcacgtgcctctctcgcatgcacacctggcgccaggctggcagccatggaggggtcgggcggcagctccgccagcacgccctgcacacggaggagggcggcggctgtggtccgcgcgtcgatgaagctctgcagcatgccctgcgtcgcgaacaccaggctgaaggtgaagccgatggccgtcagcatcgtgcccgtgggcagcaggccccggctcaccaggtagcctgtgtgggggcggggggaagtggagggttgaggtgggggggggactcggagttacgcggtgaagatggggaaggatttggcacaaaggaggggggataggaaagctccgtacaactacttgtagacaacccccctccatccatccactgcaggctccacaacccccccaccccaaagctcacctccgagggcgtagagggcgaggagggaggcgtgggtggcgccgcggttcacgctctccagcagcgccttggccctgctgaatcccaggcccgcctgccgcgcctcggccacatggcggtcgaagcgctcccgctccagcccctcccctgcaaacacgcgcacagtgcggatgttggcaaaggtctcgtctgccgcctcggccatgcgcgcggcggcggccgccgccgcacgctccacggcccgagtctgggcgcggtagaggaaagcggtggcccccgccgccaggatcacgcccgccagcacgggccccagccgccaggagagcaggcccagcaccagcaccgagccggtggcctccagcagcgctcgcaggccgcggtcgcgtgagacgttgttgaagaccagcgagcgtaccgtgtccaggtccttgcagatgagggcggtcagctcagaggaccttcatcattgttattattcattattgtgtttggggaggaggggggagtgttggctaggaaggaggacaagaacaaggagtaaggaggttgaactttccaacctagaggggcaacaagagtgcggccacatgacaggcttggcaaagtgtgtaggttcatggcgacatcttttgtgatgcgcaaacacccctgccgccctatgcaccctcccccctccacacacccaagcaccacccagcgcccacctgtgagcatcaaagaattcgatgcgctgcatgagaagcgtacggaaggcctcggagcgaaggctggcctgcaccgcctcgcccgcggcgcaggccgacctgatgtagacctgggtcagcagcggctccaccgtgtatgttgccgccaggcccaccagcaacagcttgtacctttgaggatcgggggtggggaaaaaggttgaacactcggagaacgacaggctgtgggcattcttaaggttgcggcatcacgccgccaggcaacgcctagcagggagaggcagccgcatgcagatgtggctctatagtggtggcgtggagcgacaatcgtgctctaatggatcgggcgaagcagcaggcgggtgacggcacaccggcaaatgccgtcaccagggccattccaacaccggcatctagaaccactgcccaaccacactcactgctcaaagggctgctgctgcaccaggttctcaaacagggcgccggagagcacgggagacacgaggttgcaggccacacacaccatcacggcgaggccggccctgaccagctgcggccactgcttgcgcaccagaccccacacgtactgatcgtccagggggcctcgtcgtggggtccaggggctgtgtgcgccctgggctggggcgctgaccccactcaaggaggcagctgctgtggcagccagagggattcgccggcatcgcgccaggcccacagggcgacgtgcccagtctgtcggagcggcgcgccatctcaaatgctggagtgtgggctggtgtggtgactggatgggcgtggggcgccagagaaccccggacgcatgacgccctgcctgggcgaacatccccggcaacccacgctgctgagtctcagacctgggtgcccctaagtatcatccattagacgagatacactgacaatggaccatgtcctggaggcgcattaagggcacgtcgcatgcccgatatggtgggatctttgtatcgcgagtgcgccacgatccaatcgtcgtgtagggcgcgacactccgccactggttcgacagctttggggggtcatgtgtctacatattgtggatgatagaataccatagttgcgatctatggtatttcaagccctactccacaatccctgcacctcgaagcctgtggtgccgacagtctgtatatgacttcccacgtatgctacgaccatgcccggcactgcgccgacgcagcccagctgcgggagatggcagccgatccaacgctcgcgtcctgctgccagcgcgatgcccaggagcaggctgtggttgccaagctcaaggcctcgctgacactcgtcgaccggagcaggcacagggagcacctgagggagtcggtgctgggctgcacccccggcgacaccaggccagatcgtgacagcttggagacgagcgacgacgaagagctcggtacgtggagcagtgtactgggcgtgtagagagaatgtggagcagccgggtgtttgtgctggcccatggtaaagaaccctcccaacaacccttcgcactcccacagacaagttgcgctctgcacgcctccatcagctgcaagctgcagcgagggaggctcggagcaggagggagagtgggcatggtaccttgcaaaccctcgatcttgtcgagctcaaggtggcgctttggttcagaggatcttgcctgggaactgcagcgggtgttcatgcacgcatcagggtgtgttcccatatcccccgcgtcaccctgatgttgcaggacttcttaaagagggcggaagcacctgtcgtcatccatgcatgcctggagggaagctcatctggtcacgaggcggatgaaattctgacattgctggcgagtcgttccttggaagctcgtttcattcggattgaaataggaaggaagcaaatcccccagctcccagcattcttccaaggacaagtaccaggtgccgggctgacagagggagtgggaggatcgaggctgcatgcgctcttcctcaagctcttcaacagttcctgggggtcacggctcctcccgagtgcatctcccaatctccaatgccgagaccacttcacgccacccatctgcagccctggcatggattcatgaggaggtcgctggccccgtcctggctctgccggcggatgacgaggaggtggggaacctggagccgcgcattcagcgctggtgcagtggcctggcctcgcgggcggcgagtctgggtcctgcgtcgacccgcggggaggccacgcacgagcctccatcagaggtgaggctgatcatgacaccgttaccgcctggagtgtgcctagtacttgcgcatggggcgacgtccaccacaaaggtcatacctcgcgctgcagggggacagcgatggggagggcggcctcctgccctgcgctgagtgtggccggcggtaccctcaccagcacatccgctccgtgacggcccacgtgtactctgacgaggatgacgacagatgacatggatgggcatgggctgctggcgagctgggagatcccagcatccactttttcttatttagtttctgtgtggttctctgcggtttgacgctgtcaacacgtggaagacactcgcacgggttcagcacgacagcacctgggacaagagggcgcggcacagaggctccgtctccagggatcccgaccacccccatcacaacccctctgcatccgacagctcctggtagaggccccccaccccgaatccggtgcgccagagggggaaccagggcgggatgccacgcgcgtagatgaagcctgccagggcccccccgccgagcagggcgcccagcagtaggccgagcagcgtggggccgtgatgggaggggtgcagctcggcgcgatgggagcaggcccgactcacctcgcaggggccgccgccctcagggcaggcacactctcgcaggcagacgctggtcctggactccgtccacacatcctggcagagaaagtttgagcatgggatggtgagagactggtgttgcatggcactgcatgcaaggaggagctggacgactcaatgaggccaggcataccagggcacgcaagattcctctgatgcatacactgcccaggcaaaacgagcatcccctgccacagagcatgccttgacgcaggcgtccaccacacaacgtagctccgtccccgctcgtctgctggggctggggcacgtatagtccacacactcatcctcgtcaaacctggaggagggaagggggtgcggcaggctgggtgctccaacatcaacgcctcgtagggcactgcacacatgggttaggcaggcactcggtgccacaaagaccctcgtcattcccgccccttagagagttgcacccttccagacagcctccccatcacccaaaaaccccaccccacctgcaacctgcgccctcgtcggggcaccgacactcctgccagcacgtcccgttgcccttgctgagggtggagtttgcggcgggccggcgactgccctcctcacagccccctgaccccgagacggagcagtcgcccccctgccagtcgggctcgcaccggcacacaccctcctcactgcactttccatgcccgctgcatccattcaggcagtggccctgtcgctccagggtcaggctgaagccgacctgggccaagtgggaggggacgggtaggctcacagggtcgctcagcgagtgggccgctgcaggagcgcgagcacatacactgatagagcacgcttctgatctcctgacagggctgcagcatgctttctaacaaggtgtcgtggaatcttaagcaagaaaggggccctgagcctgacctggaagccacgcagggggttgtacactgccagagcccactcgcccttgaccagctgggtggggcacagggtgagggtcctggtgacattctgctcctccagcacgagcttgtgcgtgtaggcctcggccgtgggatatgcagtgtgtttgatctgcaaacgggtaaggaaatcatggaggttggggagtgaggtgtagnnnnnnnnnnatggttggtctgcaaacggggtaagaaaatcatggaggttggggagtgaggtgtagggtggagcagggcaacagctggcccggaccaggtagagatttccattcaaatgcttggtccatgctgatgatgaggattnnnnnnnnnntcggaccaggcagagatttccattcgaatgcttggtccatgctgatgatgagtatttgcaggatcgtgcgcggagcaatgctcagcacttgtctgcataattgcaaagggcaaaagctgtctgagcctcgctcccaggctgcaacctctcaccggtgagaggagtatcgcaggcttgacctgtgcccactggcccagggatgggccgtagtagctggcagagataatgacctcgctcgacccgttgagcatggcatctgggggaggcacgggaaagagaaggggcttgggagagctacaatcgagtgcacgcatcaatgtgcaggcatggggtgcctcagcgnnnnnnnnnnagaaagagaaggggcttgggagagctgcaatcgagtgcacaaatcaatgtgcaggcatggggtgcctcagcgcgaaatcgccaaagcagcggctgtggtaggcacacgatgtcgcaccccccccacaccctcccctcgtcactcgcctgtgatggccggcatgaggaagtactcatactcgaactgcgccggctcccgctggacgacatccccgtattccagcgccgccctcgacttgctgcaggcctcgcccccatatctgcaaacggcttcggaagaattttgagcctccgcccgagcaccaacactacaaatcaccccatggagtgtagacatggtccnnnnnnnnnnctgagcctccgcccaagcaccaacactacacatcacgccatggagtgtggacatggtccacctgccgcagtgggaagggacaaaccacgcggaaaccacatcagccaaccaccccggcggcgcctgccccgcacccttcgtcgcaggtgcaccgccgctggtcgaccggcgtgccggggtcgcaggtcccgtgccccgagcagcccagcgggcagtcgaagcggttgaggagcagggtgaaattggcggggcgcaggccccccaggaccccggcgtaccagtcgccggggcgcaacgtggctgaccagggctcgggggagggccgggcgtccagcagcacctccagctgccggtcccgttccgccgcgttccagcgggggcgggcgtcaaactggccgaccccggtggatggggggaccccggccttcaggaagaggtccagcatgcctgtcgggtttgagggcagagaaattcgatgcagatcagaagtgatgagttggaaataagagtgagaagctcgttcagaaagtgcagcccacatcgatggcctgaagtttgacaagtcttccatcttcaatcgccagcacctcatcatgacaacacaggaaagggcccatgccctcatgccccatgctcacctggtgtttcactctcctcannnnnnnnnncggtcaggcgaaaccctgggggccctgtgggtaccttcagcacctccagctaccctgacgnnnnnnnnnntggtcaggcgaaatcctgggggccctttgtgtaccttcagcacctccagctaccctgacggcccgtctgctgtgctcccttgcgccattcaatctcaccatctgtctggctccacgtgctgatgctccaggctcacaaccgtcgcgttcttttccccagggaccgtggcattgagatcggtcacgggggcagagcagtcctcaaacccgaggcctgcaagagggtgcgggannnnnnnnnnaaacacaggaaagggcccatgcccttttgctccatgctcacctggtgtttcactctcctcaacaacggcaagtgagacttggaagtcgtcgtgggcaacatggaagcggtaaaactgcctgatgttgagagaggagttgggtgaaaggagcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcagaaactcccactcctcgcgccaccatgatgtgctttcctcctgcatgtacatgcacgcatgaacgattaaaaacaccacacgcctggtgtccctctaggccaataaacgacagtcacagcatccaccccttcaaacccccttgcctgggacaacttccggaaccggtttggcatactggcctgtgcagaggcactgcccatcggcagtacagccctcgtatcgcttctctgtggcatcctggcgggtgctgcagatcagggggctggcgtcgccggcgtcaaaccccacggggcatacgttcctggctgccttgagcgagaaggcgaccgggacagcgccgtaggagcggacgcagagcagcacgccctcgtagtccgcctcgggcccctgggcggccttggtgaccttcttcaccaccactgcacgctgggcggcagaggtgtcctggaagtcgtagccgtgggaggagcgggtcgggacggccaggccacgctttccacccgagaacaggccgaagaggtcggggtcccccttctcgtccgggctggtccgcgccaggcgcaccgccaggtggttccaggagtccccagcagcgctgtcggtgaatggaggtggggttgtgggtgggtagcctgcagcgtgatcagtgcaccccactgcagccctttcatgcaggagggcatgcccagcgccccccgttgtaccaagcgcatataggacttcgaggcaggaccatagcattgtcctcagctgaagttcggagttgagggccaggggtccaacccgcaccccccactcactcccaggggaactgggcggcaaagcaaacccatgcctgaggctccagctggtcacactggtccgcagcccgacaccagtcagtcatgtcctcgctgtcggcggggctgccatagacggggatggagcagtccttgcccgtccagcccctggactcgggagccggccaggggttgtcgcagtcacaccctccggagggcgtgagccggccatgcccgctacaagcatcctgagccagtgctatgctgaacaggctgaatagaatggcaagtacacatgcgtagatagcgtagtgtcccatggtcacgcccgagctcgatcgctcgaccaagccgctgacgaccggnnnnnnnnnngggcaagtacacatgcgtagacagcatagtgtcccatggtcacgcccgagcacgatcgctcgaccaagccgctgacgaccggaagtgatcacaacagcaaggcggagcacaagctgcgcaaggacgagagcatcgggcccatccgatacctgagtcgatagattcttggagctcggcataagagggcagcccgatccagggacctgacgggcctccatgccggcatcggggagtccagagccggggctgttccgcgagatcttgggtcatgtttccaaggcacccaaccttgcacccctggatggactgggtgtctgaaggaataacaaaggagcaccgggaaacgttcatggagtaataggtccttgaaggtggataaaagaacggatcattcagatggacatcgagggcagggcagcattgaccggcagcgccagctgtctgtcctaagcctgcnnnnnnnnnncccaaggcacccaactttgcacccctggatggactgggcgtctgaaggaataacagaggagcaccgggaaacgttcatggaataataggttcttgaaggtggataaaagaacgggttattcagatggacatcgagggcagggcagcagtgacaggcagcgccagctgtctgtcctaagcctgcccctccccctggccgggctgggtgttcccaacctccagggacaggcggtacgaacgcttcttgggcacgcgcagcgactgggacacggatgcggccgcggaggagcgggtgtgccccgcccgcatcgccaccgccagcgccgagcgcacgtcctcgtccgtcaggccctgctctgggccgcccgcaccgtcgacctcgggcggggccaggaccagggtgtactcgcctcgcggtgcccgcgccccttgggccggatcgtgcagctgttccagctcgcgcagcgagcccctcagaaactgctcgtgcagcttggtcatctcccggcccagcacggcccggcggtcgggccccagcacggcgcacatgtcgctgagcacagcacgcagagcgtggggcgacacgaacgcgaccaccgtggccggcagccctgcagaagagcgagtacaggagttgcagactgatgcggcagatcgtgcaccaggccaggcatccctgtgccgccgtgcgatggtcccgggtacctccatgcccctctacccacccgcatcgttggcaaattctcaagtctatccaacgcctgtcctttacgcttcccacgccaaactttaaattccagctcccaccttggatctgctccagctccttgcaccgtgcctgctgcttggccggcaggaacccaacgaacagcatgcgggaggtgtcgaatcccgaagccaccgcagctgtcaagagtgctgaagggcctgcttttcaggtgtgtgcggggttggtgaaaggggagggtgcgacggtgagggtgctagttcgagtacacgaccatgactggataccctgcgctgcctcccccactcctcaactcagccattttgccgcttcctaacgcctgatctgtggatctggtcgagaacaaaacggaagcgacacacagtgtcccattccacccacctggcacggggatgatgggaatgccagcctccaccgcagctgctatgagccggccgccaggatcgctgacggcgggcagccctgcatccgacaccagtgccagggggatgcccgtcagcagctcacgcacgatctacaacgtgggaattgacgccgggagcagttttgaagcactgtcggatacaagcctacagcggaagccgttgcccagcatacgcatggtcnnnnnnnnnnaatctacaacgtgggaattgacgccgggagcggtttcgaagcactgtcggatacaagcctacaacggaagccgttgcccagcatacgcatggtctagattgggtctgggctatgggttgctgcctcgggcagcatggacttcttctcggtgagccggcttgcacccccctactcaccatccaccactcaccacacaccacacaccacacaccacacactcatacacacaccttggcgcacttggccgactcgttgtgnnnnnnnnnntggtgagccggcttgcaaccccctgctcaccaccctccaccacccaccacaaacactcatccactcaccttggcgcacttggccgactcgttgtgctcatgcaggctttccaggggggtgcgcacgtcaaagtaggagcagaggtgggccgtgtgcctggtgtcctcgcagaggatcctctccacggacctcaggacatgcagtgccctgggactcaggtcctgcaggttgccgatgggggttcccaccacatgcaggccggcttggaggagctgatcgctggcgccagggctttgctctagagccgatgagctagaatgtgtctgatggctcgttgctcccgccaaccacccgctgcatggcctagaccgtcccactcgggtgtgtgccgagcgacacaggcccacccaacggggaaggggcatgcacccccgcatgcactcccacggcgttggaattgggcaatcatgcgcaccttaaagccgatggattggtcctgtaatagttttcatgcatcgttcgcgctctcctggacagtgaagcgtgcatgctgagcgggaaatgacttccggcacctgtgcaaacaggaggcccgcccacggggcgatactcaagtcttcgatcggacgattgggtgcatgcatcttgaaaaccctgctgttcccctcccgcaccttcctcgtcccagactggggattgcgacgatcnnnnnnnnnngaaaccctgctgttcccctcccgcacctccctcgtcccagactggggattgcgacgatcgcctcgcccgctcggaagtcctgactcatagcccggtgctgcacggggggtgtgcacgagtaggcaatgctgcagggcatcgctcgcggcttgcgtgcggcacgtaatggtttgacccatgtgcgacacttcaggtaatagttgccggcgagaaggggcgccagggggcggagctacgtgggggcccgtgtcgggcctcctgccttccagggcaccccgcccctcccggtcacggccctttctccaacccccccccactttcatcccttccccatcgttcccactccagcgaggccaagnnnnnnnnnngcccccctcacttcatccctgccccatcgttcccactccagcgaggccaagcccccgggccccgtcaccagccggctggcagcgctggaggaggagacggccagcggccataagctcttccaaaacgtcagcctgcccgagggcgcaggggccgcggcggcgaccgccgcccgcgttggcaccgccggcgcgggtgccggcgccggtgcggcggccgccggccccg

SEQ ID NO: 42752 - DNA, 61 bp, Chlorella protothecoides
accctgctgagagtgcgtgcagtggcagggggtcgttgcgttggtggtctggggtgcgtca

SEQ ID NO: 42753 - DNA, 159 bp, Chlorella protothecoides
tctcgccggagcagggcgccgtcatcagcgcggacgcggcaggtggggcctcggagcccgcgtgggtgtgcacatgctctgggcaggggctgcggccggcggtgtgcggggtggaaagcgcctctctccggcgtctggatccctggccactgcccgtcc

SEQ ID NO: 42754 - DNA, 18259 bp, Chlorella protothecoides
  modified_base (120)..(129): a, c, t, g, unknown or other
  modified_base (810)..(819): a, c, t, g, unknown or other
  modified_base (1365)..(1374): a, c, t, g, unknown or other
  modified_base (1975)..(1984): a, c, t, g, unknown or other
  modified_base (4860)..(4869): a, c, t, g, unknown or other
  modified_base (5938)..(5947): a, c, t, g, unknown or other
  modified_base (6331)..(6340): a, c, t, g, unknown or other
  modified_base (7341)..(7350): a, c, t, g, unknown or other
  modified_base (7487)..(7496): a, c, t, g, unknown or other
  modified_base (7967)..(7976): a, c, t, g, unknown or other
  modified_base (8624)..(8633): a, c, t, g, unknown or other
  modified_base (9429)..(9438): a, c, t, g, unknown or other
  modified_base (10146)..(10155): a, c, t, g, unknown or other
  modified_base (10256)..(10265): a, c, t, g, unknown or other
  modified_base (10326)..(10493): a, c, t, g, unknown or other
  modified_base (10580)..(10672): a, c, t, g, unknown or other
  modified_base (11626)..(11635): a, c, t, g, unknown or other
  modified_base (14426)..(14435): a, c, t, g, unknown or other
  modified_base (15023)..(15265): a, c, t, g, unknown or other
  modified_base (15469)..(15578): a, c, t, g, unknown or other
  modified_base (15751)..(15760): a, c, t, g, unknown or other
  modified_base (17462)..(17471): a, c, t, g, unknown or other
  modified_base (18136)..(18145): a, c, t, g, unknown or other
ccacccacccccccgggccctgcagtaagtcctttgccacccaccccaccacccccggtaccccaccccgcacatcgtctccgctgcttgcaggggcgcgggaccagcacggaggacggnnnnnnnnnncaccccaccacccccggtgccccaccccgcacatcgtctccgctgctcgcaggggcgcgggaccagcacggaggacggcgtggcgctggcccgggccacgctggagcacctggcgacacgcacacgctgcctgacgatgttcgtgacgcactaccccgaggtccccgccgcggccgcgcgggaggagggcctgcgggttgcggtccggctggggcgcatggcggtcctggaacgggggggcacgccgcccagcgtcgccttcctgcatcgcctggagccgggggccgccaccgcctccttcgggctcaatgtcgcgcgcatggccgccctgcccccggccgtgctggccgcggcgggggcgcgcgcggcgcacgcgggggggctgggcacggtcctgaaggacctcctggtggcctcggagagggataaggaggacctgggggcgctgcagcagcacgtgcgtgccgtgctggcgttgtgctgatggtggcctggtgctgcctccgttgttaacaatgggtcggcaggcagggcgcaagcggggcggagggccaggtcttgcacacatctcgggtatgtgtgaggagttcagcgcttttgcgcagacgcatgtactggaaagcgattcatccagcggggcatgcccgtcctctcgattcaatgttgggggacgaccctgcnnnnnnnnnnagcttttgcgcagacgcatgggctggaaagcgattcatttagcggggcatgcccgtcttctcgattcaatgttgggggacgaccctgcatcgacccgggacgggatgaccccccaacggacgatcgatctgcgttttcaaagggactgaatataccggacgctccagcattctcccatcatccactccacactctttgcagagtagttaatcaacaggtgtgaaggctgtctcggtgcttcagttccgcgactcacgacccggcccggactccgttgccgcgacgagctgctgcctgccaacgcacctcgcgccccactccccgcagaaacctgccatcatgagtggaaaaggagccaagggactgtccggaaagggagccaagggcaccctcggaggcatcaagggcggagacaagaagaagcccatctcgcggtctgccagggcaggtacgccgacaacaggccacggcactccctacttggatattctacatccttcgtgtatctgaaaagggtttgcggcgcgggatcgcggcaacggtacnnnnnnnnnngcaggccagggcactccttactcggatattctacatccttcttgtaatctgaaaagcgtttgcggcgcgggatcgcggcaacggtacacacatctaaccaatccccttctgccacccgacaggtctgcagttccccgtgggtcgtgtgcaccgtctgctcaagtcccgtgctacggccaacggccgtgtgggagccactgccgctgtgtacgctgccgccatcctggagtacctgactgctggtaggtgacagctgggcgccaggttcaaaatttcagggaaaggcccagcgacttctgtgtctgcaacactcaactcacatttctgtcccccaccacaccatcgcagaggtgctggagttggcaggaaacgcctccaaggacctgaaggtgaagcgtattaccccccgtcacttgcagctggccattcgtggcgatgaggaggtgcgtgggggatcggttctgttccatgttttgcctagttgcagctgcctctcagactattgtgtatgctagacttgctgcatcctctgccctcccaggctctcagcacccacactctccacctgacctcccacagctggacaccctgatcaaggccnnnnnnnnnnccgcatgctgtcagcacccacactctccccctgatctcccacagctggacaccctgatcaaggccactattgctggtggtggtgtcattccccacatccacaagtccctggtgaccaacaagcagggcaagaaggagggtctgcttcccatcatctaaaccatgccctcacaggcctctgtatacagataatggctcgtctggcgctgagacgcggcctagtgcccagcctgaaacacggtgcctggccacccctgactcttgacatctcccccacctgactactcgcccagtatcgtgttgttcatgactgtgtgtaacctgcgccatttacctgcatgaaaagagtattttttcgtttctggtagcaagggaaggttggggtcccacctggtggagctgtaaggccagtgaaataaaccacttaaaagacccagcgttcatgcggggcaccgacgcagcacggccctcgctcgaaatcatttccggcagctgaatatagagacccacgcttgcgcatgatgcacttccgcgaacctcgaaatagtaatggcaggcacatgctcccccctcctggcaggtttcttgtatgcgctgcctcatcagaggcctcccgacacctactcgaggtgagtgactcgccgatggaccttgctgtgtttcctatatgcttgcatgaatgcctgcacgcatgccgatgaacttaagttcgttctaatcgtagaggctatggctgccctcgtgttgcatcggagagcgaggctcagcgaacactggaactcctccggcccgtgagtaagccagctcatgcggtctacaagccattcgtacccaggtacatttcgcctccgaggcggggcttatcgaagtacagactggcatcgacggggtgaaactttctttgatcgccgcggacagcaaacagccccttcccttcccctgttgcaggtcgcaggctgaacccggcccacgcccccagcggcccacccggcctgcgcaacacccgcccagctgccctcccgcggtctgtcagcctccaaagcatgcagaacccatccccacacatatggacgacgacgatgcctttttcgaggggatcgatgtggacggcctgatcacagggcagtccacggggcttgcccaggaggcactgcccagcagctggccagctcacaatcccccagaacaggcacgtgcacgccctgccccgccgccgccgccaccagcaccccaggctctgtcggagccggagcgtgcccgccggcttgcggccgtctccgcggccctggcggctgcggccgagaagatgctggacgccgagggcgaccccggggcgctggcgactgtgatggcggagagccggcgcctccgcgaggagaagtctgcgctgctcgcacagccaggggagtccagatctggcacggacgccgctaccaggccccagcccttgggaggccccggcccggcctcccagttccccgagggtggcaacccaaccggcggccctccatggcagcagacctcccgcgcctcggcaccgacggtgcaggccgcgccgtaccgagccagctcctgggtccagggccccggtacagctccccctcccctcacaaacagctacagccaccaaggcgcctcgctgggctgggaggagggcggcgccccaccccagccgccggcctggacgccggacaaggccctggcgcggcaggcggcgggagagcgtgtggacgcgacgcacgacgcctcatggcgtggcgagacctttgcctggagccgggagctccggtccctgaacaccacgcggtttggcaattcggggttccgccacaaccagctggccatcatgaacgccagcctggcgggaaaggacgtattcgtcctcatgcccacaggcacgatgatgagcgttcattggtggatggggcatgccggctgcacttggaggttgctgggatgccacgaagcgagggcaagcccagcagaggcgggacctgccgctgggaatatgagtggtagcactcgctgacctttgagtgatgtggctcgagccggaaagacatccgcacactttacatgcctggccccactcacgctcccccccttctaattgcacctccacctgatcccccgcacaggcggcggcaagtcgctgtgctaccagctcccggccgtgctgtccaccgggatcaccatagtggtgtcgcccctggtctccctcattcaggaccaggtgtaccacctgggcgtgctgggcatccccgccgtctgcctgggcgggtccatgggctgggaggagcagcgcgcggtgtacgacgacatgacacgcgaccccgaggcctccaaggtcctgttcatcacacccgagaagctggcggcctccgggcggctgcaggccaccctggatcagctgcaccagcggggctgcctggcccgcgtcgtcatcgacgaggcccactgcgtcagtcaatgggggcacggtgcggccggggggtcccacatgactgctgaaaggggctggacggggggcaaggcgcgatggggaggggaccctgcgaagctggcccatgagcacatggtcccacccacgccacccgtcgcccccgcagacttccgcaaggactacacgcgcctcagcttcttcaagcaaaagtgggagggaggggtgctagtaggctgggctgcctcggtcgtgtctcggggagcgtttgggatgtggcaaggacagcatcaagcatccagacgagcaggggattgggacaagtcgagcgttgctgttcaaggttccatccagactccatttccccaacacctgtccattccccccacatcatcattccctacctcccccccacctttccaggtaccccagcgtgnnnnnnnnnncgggattgggacaagtcgagggttgctgtgcaaggttccatccagactccatttcaccaacacctgtccatttcccccacatcatcattcctaccccccccacctttccaggtaccccagcgtgccgctcatggctctcacagccacggccacgccccgggtgcagcatgatgtggtggcacagctgggcatacactcctgcctcatgttcaccaactccttcaaccggcccaacctgaggtgggacgggaaactgggtgagggcacgattgtgccacgttgcagggctgcggtgccaggccggtgaacccgagtaggcatgcatgccccgcccgcccactggcagccacccccttggcaggtacgaggtggtgaagaagaagaaggtggacacctgctgcgacgagatcgccacctccatcgtgaagaactacaccgagaaagtggggacgtccaaaagggcctggcgcatgcaggtctgtggctttggaaggcttgtattgcaggcggctgggcgactggcaggcccaaggaccgggcgcgagccacccgagcctgcttccggctggcgctgtgtgggtgcatctggcagagagcatgggtatctggcgcgattccacccgctccgccctacctgcacgcagtgcggcatcgtctactgcctcacgcgcaatgagtgtgagagcgtggctgacaaactggaggtaggggggtgaggagggattgggcacggccgtctggacgtttgtgcccacctctgtcctgacgaggctgaagagggcccctggtggaacctggcaaaacaggagcacggacttggcatcagtcgtgcacggactgcgtcacacacctgctcattcctcgctactaatcttccttaaatgcgcagcggaagctaggggagctgctgttccccctggggggtgggcgccgccgtgtcaggtaccacctgcctgcacaagagtgtgcctggggaggggttgggggcagcaccatgtataatgagccctgaactgtcctgaaaacgcatggcacagctcctcctcgtgcgtctcagccaggggtacannnnnnnnnnctatataatgtgccctgaactgtcctgaaaacgcgtggcacagatcctcctcgtgcgtctcagccaggggtacacctcgcctcgctcccctgcaggcactaccatggcagcctgactgcagaggagcgtgagaacgtccagtccgagtggactaatggagaggtggcgctgatcgttgcgaccatagccttcgggatgggtgggtggcatggccagggaggcaggccgagggattgaccagcttcatggacctgtgtgtgatgagagaggctggttcttcatgctgaacaactgaggatggggcgtggtggctgcgcatgtgtcatggtggtgcaggtgctgggcccactttcactcgttgcatgatgatggatgatgccatcnnnnnnnnnncgaggctggttcttcatgctcaacaactgaagatggggcgtggtggctgcgcatgtatcatggtggtgcagatgctgggcccacttttactcgttgcatgatgatggatgatgccatctacaagctaccgcagtcagcgtgctgcctccaccccacgcacaacacccaatgcactttccaggcatcaacaaggccgacgttcggttcgtgatccacttcagcctgcccaaatccctggaggggtacctccaggtgcgctgggatgtttggggaagggacagcgtgtgctgggcagtagcacatgtcctgtctgcagctgtgatcaaggtgtatccacccaaatgctcgggctccccgctctcaccccacccgctctcaccccacctgctctcaccccacccgctctcaccccacccgctctcaccccacctgctctcaccccacccgctctcaccccacccgctccccgccaacctcgccaggagagcgggagggctgggagggacggccgccccgccacctgcctgctgtactactcatatgctgacgcagcaaaatcgcgacacatgctgcgccaatctgcagaggagaacaggtcgccgctggagcagctgaaaagcaacgaggagtccctgaatgccatggtgggtggccgaggcttttcaggggcagggctgggggttggaacggcaggggtatttgaagtgacccccaggacggcggcttgcaatgctatccttgcgatggactccaagcccttcaataatagctgttgccgcgccctggcccctgcccgcccatcttccccgcctgcctgcccctccctgcgcaggttgcgtactgcgaggagcaggtcgagtgccgcagggtgctcatgctgcatcactttggggagcacagctttgataagagcaaggtggagtggctgcgggaaccttgtggggcaagggcgggtcttcatgacacagccgggatgcccatagactgcagagttctggggnnnnnnnnnnaattggggttggctgcgtagcccaatgctctgcctccctacatcatccttgcctgtggccaccctgagccccacacacatccatcgccctgccgtcacgcagtgcagcgggacgtgcgacaactgcgcgcgcagcgnnnnnnnnnnccgtggggcaagggcaggtcttcatgacacagctgggatgcccatagactgcagagttctggggccaggagcagtgcatagtgcacagaggcctggcccctcaacagcaaccccctgtcggggttggctgcgtagcccaacgctctgcctccctacatccctcctgcctgtggccaccctgagcgccacacacatccatcgccctgccgccacgcagtgcggcgggacgtgcgacaactgcgcgcgcagcgccacgcaatcctatgtgtacgaggaccagtcggaggccgcggccaagggtgcggtgggatcggggcctggcgggtctcacgcttctcccttgctggatcgatgctggagctgcccggtctcacccttcagatttcaaagcacttcctgagcagcgactgcccctcctgtggacggggtcactcttggtccctcctcaaaccgccccaccatccaagcagnnnnnnnnnncgctggggctgcccgttctcacccttcacatttcaaagcacttcctgagcagccactgcccctcctgtggacggggtcactcctgtttcctcctcaaaccgccccaccatccaagcagatacccctgccaccaggcatacgccgttttcccacaccccactctttccctacatctccagcaccctttccccctcccccgcaaccaccaaccctgcagtcctggaggccagccgagccgtgggcccggcctccatgtcgctgctggtggacatggtgcgcggtgcgaacaccgccgccatccggcgcgcgggcctggtcgggctggcggcgcacggctgcggccgcgctttcttgaagaacggcggcgaggcggagcgcctcatccgccgcatggtggtccagggcctgctcctggagcgcacggcgcggcaggaagtgcacatggcggtggtggccacgctgagcgtgtgcgaggaagccgccgcgcgcctggcggccggccggctggccctggtggtgccggtgctgcagcccaggcccggcagcagcggggccaggagcggctcgggcgagggcaggagaggctcgggcgagggacggggggggtggggcgaggacgccgcgcccgggccccggccgacgctggcnnnnnnnnnngcaggagcggctcgggcgagggcaggaggggctcgggcgagggagggggggggtggggcgagggcgccgcgcccgggccccggccgacgctggcgctggatcgctcgctggcggccaacccgctgcaagaggactgggcgggcggggctggacaccgcaagggtggccagcgggcggcgccggtgtgctccgccctggccattgccagggcggggcagggacgggcaagaaagcacggcgcggaggaggaggacgaccccatcgacctgtgcctggacgtcgaggaggtgaaaggaaggggggaggggaggggggggctcggtaagtggcatggcttcttgctctgggcgggatgctgatggctgatgcttctacatagtgagtggggctctgcaccatgcgccgtggcccaggacccactccctacacacgcccttccctcccacatgattccctgacagacggcggtacgcacgcagctgatgaagacggcgctgcaccagctgaacgccgcgctgcgcctccagcgcaactcggcgcggggccccttcaccggcgcagtgcaggcctcggtgagagcggccggtggggggttgggggggtgggatcgcaagtggtgtgccggggacgtgcactgcacctccagacaccagcgcatgtcctgcagttactgcctgcaggctggtggcggtatcgcggcagcctgcagcatgtgcatccatgccgcgcctccaccccgcccaaccgctcgcccacgcaaccgcatccactcgaaacacctctcgcagctggcggnnnnnnnnnnataggggggggatcgcaagcggtgtgccggggacatgcgctgcacctccagacaccagcgcatgtcctgctgtcactgcctgcagggctggtggcagtgtcgcggcagcctgcagcatgcgcatccatgccgcgcctccaccccgccccaaccgctcgcccacgcaaccgcctccactcgaaacacctctcgcagctggcggcctgcgcgccgcggacagtccaggacttccaggccatggtgatcagcggggtgtcggagcagatgaagcgccagtatggagagcatgtggtgagcacagagtgtacagttgggccctcaagttgtaagccgccgggctgtttggagggcagatgagccccatggtccacctggcggggccaggcggcactgcacccccgcggtcaaggctgacgttgcccgaggcccgctgatcgcaccatggtgccacaactccgacctccttcaggacagccgccacagcttgcagaacagtcgcccccaggccccaccctaagcctttgccatccacctctccccctccatcccccgcaaacgcaggtctcggccatcaaccaggcggacgccttcctggccaggatgcggacaggcggcgcgcaggcggaggagtttgcgctggacatccgcgccctcacaccctccatggtggggcgcccgagagatcatgcggggggggtgggggggtgnnnnnnnnnnggatatggtcggcctgccatgcatctaagctgtcgggcagggtgcgtgaacttcatctgtctcgaccccagcggtgctccttccttccttcgccgaggcannnnnnnnnnggttgggccctcaagttgtaagccgccgctgggctgtttggagggcagatgagccccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcagaacagtcgccgccaggccccaccctaagccttcgccatccacctctccctctccatcccccgcaaacgcaggtctcggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcgccctcacgccctccatggtggggcgcccgagagatcgtgcgggaggggtgggtgggggaatttgggtgcccagatatggtcggcctgccatgcatctgagctgtcgggcagggtgcgtgaatttcatctgtctcgaccccggcggtgctccttccttccttcgccgaggcaccccccccctcccaattccctcgctgcaggccggtgctgggatgcggcagcccaaacgggcgcggatagatgagcaggcgtggtcggacagcgagggcgaggaggctgcctgggcggccgtgggtgagcaggctgtggggatcctgggcaaggcccaccatgggaggggtgtggacatggtgcgcatggatcgccgcagcctgtggcccacccctgtcgttcccgactgctggactcgggtgcgcatgtcccagggcgtccccactctgggcccccccccccctcaaacgtcaccaaaccctgcagagaacgccgctcgggcacaccaggggcccatgcatgcgcccatgctggagggcttcaggtatcaggccgggacaacaacaccccctctgcgtcgacccccggccagcttgcagagcccggcctggcacggcgcggggaagggccaggaggagccgtcctcggcatctaggtggcagcggagaaaggcgggaactccggaggcagcatgggctcgcgtccggtccctcatgacggaaccgctgggcatgcacaaccaggcatgatgcaggcagcagagcaccgcttttacactgaatgtgctgtacatgtaggaggttgaaagaaacagagcctggtcagcgaggcgatgcgagctgccgttgcatgctcacgattcaagctgggaaactgacgaggttgtcgattatacgagcatgacactgtcatcgtgcgattttcctgcttccatgttcatctcgatgctggcgcatgnnnnnnnnnntagcagagcaccgctttttacaatggatgtgctgtacatgtaggaggttgaaagaaacagggcccggtcagcgaggcgatgcgagctgccgtggcatgctcacaatttaagctgggaaacggacgaggttgtcgattatacgagcatgacgctgtcatcgtgtgattttcctacttccatgttcatctcgatgctggcgcatgctgagatctgcgaggcagcacggtgtcagtccagtacgactcatcagcgcgcgagcttcccgtgttcacgactcgggaatcgtctgccaggtacttgcctgctggtaactgcacaaacctcgttccagtatccagtcactcctgaatcctccctgttttgtatccagcacggactccaaatccacagaaacatcccttccccgcccgtcagtggcactctccgcgacagatcagggaccactcgatccgtccacccagcctcatttctgcacttcaggccatatctaacgcctgagcctcgcattacaagtgcatcatgggattccaaggccgatcagcaacggctgtgctctgtttgagcatcctgctggtgggctccatccaggcgtgcgtcgtggaacaactccagaacctttccggtcttctggtggtgtctcaggccctgcaggtaggcatgcttctctgaatatgccatgcatggatggtagactgtcgccaaggctgcaatggcacccacgggctcccccgagcctcgcaggccgcagagctggctggagccttggagacgccgacgacctcagtcaccctgctcgcacccagcgacgttgccttccaaaagtttctcttggaggtgcgattacggtctgcgtgttttctgcgatggcggcgcctgcctcgggaggatcggtgcttgattggaaggggtggggaaggacctcggggctgcagtttcccgagcttgtccaggtcccctcagaaaccctagtctcaccaaccctccttaccacaggccgacctcacccccagtgagcttttcaacaacacagaactgctgacgacagtgagctgggttcttgcatgagatgctgcagagattggaaggcttctggtagttgttgttaatcctgggggctctcgtctcacgccagtatccctcactgcaccttcccgctgcagctactgtccgctcacacactcccgggcctcatcccggggagtgatctggtgactggagctacctgggagtctctggagccgggcgtgaacgtcacggtgtgccagagtgcaggggtcttggatggcatcatgcttattgccgtttaatggtcctgatatgcaagcagggggacctggcttttcattgtgtgggccgacacatctgcccagttagtccctgcaagctagcgtgcccatgctccttccctctcccctcctcattcaggcacagattcctgcatacccaaatgtcgtggcctccgggtcgtacctcacctctgggtatgggcccccggcccggatcattgctgtccacaaccccagcgactgcgagagcattatctacgtgttggatcaggcaaggcaacgaggtcatgggtttgcatgttgagtggtgggaatgggttgctgttgacccggggatcctgctcctggccggagtgcatgatgtcattcttggcaaagctcagccacatcatcttcaccatttcttgcgacatcacaggtcctcctctctcctacactcaccactgagctgagcatccgggagtgagcagtcctatcaccaccctgggagcccatctgccttgaaagtgtgtgtacaaacatgatcccgccaggctccacgaatgagcactagaccatgagtgagctgttcttgaacgtcctgatgaccctggccactttgggcagtcttgccctgcatcactataccgaggttctacccctccttttgtgctctctttctgttgatgaggtgtaggcaagtttacactagatacaataggtatcatgtgagaggagaatggttatgtgatcaggagttatgacccatttgtgtcggccagtggtattgctgcctggagacggtcaaaattccaacagactgggttatgataccaacaccctcagatgtgccgatccccccccgcccctgcgctggtgtgtgagacacggtatataactgccatataaatgtaccgtcgaggatgtgcttgacgagagactcaaagcatggcatgtagatcgattttatcgcacaggaggtggcgtatcagtgaaacaaagcagcatcacagcggagaatcgagcctccgatagagccatcgcttccgcttccaggcgtcgtgcaggcagcactgggcgcgcatgcgtccagcattgacacgattacagtgctggaggacctcgttcgcgactttgcccaagtcaatccaggagtacaggtctccatcgcgctcctggcacaggggagtccacgaacgcagccaaggtagacgatggcgctatgcgtgtgatcccagcatgcggatcgaaaatcccaaagtgagctatacccaccaggacacccatgccagcaaccacatcacgctgcagcactgcgtgccatggcggaggcaacgctggaagggccttccttaagcatgctgcatgtgaccgtgcccagcgaggaggttggccaacagatagccggcgccctggtggagggcaggctggcagcatgcgtcaacattattccaggtggggtttgggattcccggggacctgccgctggggggttggatcctgccttccaagtctagcctgcggcnnnnnnnnnntggggacctactgctgggggtccggatcctgccttccaagtctagcctgcggcgtgccatggcccatgctgggagtcgcacactggctttggcacggcgcacttggcagctgcatcagcgcatccactccaagtttcatgccatccattcctgcaccacccgcccaggcattcagtctgtctacatgtggaagggcaaggtcgagcgcgacgaggagcacctgctcgtgatcaagacccagagcacgctggtccccgacgtggccgccagggtcaaagccctccacccttacgtagagccggaggtggtggccctgcccatctccgggggcagcgccagctacctcgcgtgggtcgctgagtgcaccacgcacaagacagcctgatcaagcacgtttgtttcttactgtgaggcaggctttgtaccagtaggcgatggcctctcgaccatgcagcatgcaagctgaatccacatgcacggcccaggccaaatgggaacattggccctccactcaaagctttcgagtcggtgggaggcatagagtctgggcaacacatgctgcgcacatgctgccgctaggccgcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaatgactgtgacggagagggccagggggggttgacatgctggtcatgctggctgcaccacggggcaggagaatgccgaggtgccctccagatgcagcccagggcaccggagccggccccacacatctcttccccaacaggctggtgggttccaacaccagcaggcatgagcctcaccggacgcttggcgttgttgctcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctgcatcgcagggcaggggtccctggtgaaaaattcttgtgggatgacgtcccggggatctggtcaggcggatgttgccctgttggtcacgcacctgaggaatggctccgattgatatttgccccaagagcccgatgacaacaggccccgaaagaatcccgccgacggcnnnnnnnnnnacacagcccaggccacatgggaacgttggccctccactcaaagctttcgagtcgctgggaggcatagagtctgggcaacacacgctgcgcacatgctgccgctaggccgcgctttccagtgccgccagctgtaccttcacattgttggtgatggccgccacccgctgccgagcgtgctgcagccggcggtactcgtaatccgggttgaactgggtgtggaactgggccagctgggactgcggggcgggggcgggggtgtgggcggccaggcggcgatgcacctcctccggcggctcccacagcacgatctcatcataaacttcgtgcaccacctgagtacagcatgagaagaaagggcattgagtgactgtgaaggagagggcaggcggggggtgacatgctggtcatgctggctgcaccatggggcaggagaatgctgaggtgccctccagatgcagccccgggccccagagtcggccccacacatctcttccccagcaggcttgtgggtcccaacaccagcaggcatgagactcaccggacgcttggcgttgttgctcccgctggcgtcgtacagggtgaggtgatggtacagctccacaggtccttccctgacatcctctcggaagtgtacctgcattgcagggcaggggtccctggtgaagaattcttgtgcgatgacgtcctggggatctggtcaggcgtatattgccctgttggtcacgcacatgaggaatggctccgactgatatttgccccaagagcccgatgataacaggccccgaaagaatcccgccgacggcggcatgccctaccgcaccttgatggtgatgtcaaattcgccccacccaacctcggtcaactcgaagggctggtactccacatcccggtttggattagcaaaggaagagtgcaggccaaatgtgacctgggggggtggtgagggtcatggcggaggccatgaagtgccggtgcaactggcatgtgaaccgacgtgcatttcacatgtcgtaacccagccagcatccctccccccgcaaccaaccttggacaccaggtgcccgaggtcttcgttcttggcatggcgcaaatagatcgtccacttgtgtgaagcatggtctgtcgcctgcgcaagggcccagcaggaattgggtgggctgtcccggcacgagcacggagggggtgcaagtcaatgcaaacctcagccatcccaggaatgcgtgcgtgggccaccgaccttctttgccagccagaacgagatggtgcctgtcacgacagggacaacaatgctcactcccttcatgcgcctgaccccatcctgcggtgagtgacgtcacattgctgagacagagcatgaaggtttacaccaatcacaacgccacagtctgcctccttaccgtgtccgtgaacacctcgggctgggcctggccctctgccatggacgctccgtctagcggctcgaccgatcagtcttgcatcacatccggtcgatgatgtcgacgcacactctctttggcagtacccaacaccttgggtgtaatgacctcgtccattgtgcctctcatagaggtctcaatgtgcacttcgattgcccaccgtgcccctgggcgcgaactcgggtgggtccccccttccagctgtcaccgtgcccgaatcccttccttcatgtaccacccgctgaggctccagttccatcgcgtcnnnnnnnnnngcgattgcccaccgtcccctgggcgcgaactcgggtgggttccccccttccagctgtcactgtgtccgaatcccttcctccatgtatcacccgctgaggctccagttccatcgcgtcaacagcgacatcaagcacacaagccttaagccgtcggtggcatggcagcgacgtcctcgccgcggctcttgctcgaccctgcaagcaacatactaatcgtcaaagtcatctcgctggttgggcacgggggtcggctccacaccccagatgtccctgcacaggaggcattgtggcgtagggtactgagccgggaatccatgattcaggcaatctgaccccaaaagctgaggcaagcgctgcctggctgagactgagcccgccggtttagacacttgaccatcgtccctcttccccttgtcgacctcactggctgcaatccgattccccttccaacatcccctccatctcacttggcatactccaggatagtgcggtcggaggagaagaaaccgctcccggccgtgctgttgatggacatggccgtccactcctcaggcttctggtatacacggtccacgcgctcctgcaccaagttgagaaagggaggcagggtgacgcagggctgccttgggcgacaatcgcatgccgctctcaccaccatacattgnnnnnnnnnngggcttctggtacacacggtccacgcgctcctgcatcaagttgagaaagggaggcagggtgacgcaaggctgccatgggcgacgatcgcatgccgctctcaccaccatacattg

SEQ ID NO: 42755 - DNA, 61 bp, Chlorella protothecoides
ggagcccagcctggatgaggagtccctcctatccccgggcgcccgggccaccatccccagc

SEQ ID NO: 42756 - DNA, 62 bp, Chlorella protothecoides
cccccccccccccccccccaccccccccccaccccccccgccgctaactcctcctcccagcc

SEQ ID NO: 42757 - DNA, 470 bp, Chlorella protothecoides
  modified_base (115)..(201): a, c, t, g, unknown or other
cacgagccgggtgaggagcgcctgcgggccgtggcccgcaggctgcgcgccgacccccgcgccgcgccgcccccgggcctgctcggcgcgctgggcgccacggccctgggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnncctggtcggggccttctcctccgactccgacctggcggacgagatttctgagtacaaggggtcacgcctgcgcttcgacccctgggtgacgctccccgtcggcgccgtcgccccaccccacacgcccgcccttgacgcagcgcccgcgctgcagctgctggcggccgtgcgcgcggggggcggggcgcggaaccccgcgggggagcttgctgtcctgcacctgacgctggccgccgccggggcggcggcgggcggcggcaaccaccgct

SEQ ID NO: 42758 - DNA, 72 bp, Chlorella protothecoides
cccacaccacccccgtgccccctcccctccacccccagcgatcgcctggagcagctcaaggtggagatcgag

SEQ ID NO: 42759 - DNA, 18237 bp, Chlorella protothecoides
  modified_base (224)..(297): a, c, t, g, unknown or other
  modified_base (417)..(426): a, c, t, g, unknown or other
  modified_base (772)..(781): a, c, t, g, unknown or other
  modified_base (1245)..(1254): a, c, t, g, unknown or other
  modified_base (1699)..(1708): a, c, t, g, unknown or other
  modified_base (2177)..(2186): a, c, t, g, unknown or other
  modified_base (3349)..(3358): a, c, t, g, unknown or other
  modified_base (3437)..(3446): a, c, t, g, unknown or other
  modified_base (3719)..(3728): a, c, t, g, unknown or other
  modified_base (5686)..(5695): a, c, t, g, unknown or other
  modified_base (5785)..(5794): a, c, t, g, unknown or other
  modified_base (5895)..(5904): a, c, t, g, unknown or other
  modified_base (6687)..(6696): a, c, t, g, unknown or other
  modified_base (6865)..(6874): a, c, t, g, unknown or other
  modified_base (6980)..(6989): a, c, t, g, unknown or other
  modified_base (7228)..(7237): a, c, t, g, unknown or other
  modified_base (7323)..(7332): a, c, t, g, unknown or other
  modified_base (7809)..(7818): a, c, t, g, unknown or other
  modified_base (8460)..(8469): a, c, t, g, unknown or other
  modified_base (9487)..(9496): a, c, t, g, unknown or other
  modified_base (10109)..(10118): a, c, t, g, unknown or other
  modified_base (10263)..(10272): a, c, t, g, unknown or other
  modified_base (11411)..(11420): a, c, t, g, unknown or other
  modified_base (12045)..(12054): a, c, t, g, unknown or other
  modified_base (13732)..(13741): a, c, t, g, unknown or other
  modified_base (14336)..(14345): a, c, t, g, unknown or other
  modified_base (14983)..(14992): a, c, t, g, unknown or other
  modified_base (15075)..(15084): a, c, t, g, unknown or other
  modified_base (16382)..(16391): a, c, t, g, unknown or other
  modified_base (16665)..(16674): a, c, t, g, unknown or other
  modified_base (17688)..(17697): a, c, t, g, unknown or other
cctgtccccgatgcagccccgaaacccgcggtgacgccggtccgggccgccctggcgagcctgaaggagaatgtgccaagaaaaagccccgtgccgcgcgttccggccgccgcctggggcccggatgccgccggctcgcaccagagattccgggaggcgctgcgcaccctgaagactgcggcggagggcgctgcttctcaggcatgcgaggctggccagtctcnnnnnnnnnnnnnnnnnnnnnnnnnnnnnnnnnnnnnnnnnnnnnnnnnnnnnnnnnnnnnnnnnnnnnnnnnnaggcagcctgccgtgcacgtcttctgcgtggagcgcagcggcaggtgggtggtgctggtggtatgaggagtggggtttaaggaatcagcgtgctcgcaagccacccgcttcacaagcgcnnnnnnnnnnagaggagtggggttccaaggaatcagggtgctcgcaagccacccgcttcacaagcgcacctcttgtctgtctgcccgtcgacaatgagtccgcaccgcttgccgtgattcagggggggcgcgttctaccgctccttcgcggcggcttcctaccccgccgtgtggcagcagtatcaccagacgcccgcgctccagcggcactggtatgaggtgcgcgcacccaggactggggagggagggttgctgcacaggatctgggcgagcagcgtgaggatggtgggggagaggacatatcactgctggtgcctggcctcaatcaatcagcccctcccagctgcgtgaaaccnnnnnnnnnntgacagatcgctgctggtgcctggcctcactcaatcagcccctcccagctgcgtgaaacccccgctcgcccccccttgctgcaggtgatccgcgaggggcacccctgccacctctacttcgacctggagttccccattgagctcaaccccggcgtggatggccaggccctcacacagcgattgctggtgctcgtgcaaaagtgcctctggtgagggccaggcttgggggtgtgcattgtgatgctggctcaggccctcggcgtcggtcgcagggtcgggcaggctggaccctggggaccggtgtcctggttctggtgcctcctctcttggacgcctccatgtacctgatccccgacccatactctgtcccatatagctactctcgatggcagcacgcaccttgggccccatcccccataccctatctcaacatccaggaacaagttccagctgcgcatggatgnnnnnnnnnntccatatagctactctcgatggctgcacgcaccttgggccccaccccccatatcctatctcaataaccaggaacaagttccagctgcgcatggatgcccgccagcacgtggtcctgctggactccacctccgccaccaagttctccagccacctcgtggtcaagctgcccgggcacgccttccaggacaacgccgcggcgggccgtttcgtgcgcagcgtgctgctggcgagcgggacggagctgacggtggtccagggcctggacgcccgcaccgggcagccggtgcgctcccccttcgtcgacaccgcggtgtacaccaggcgaggcgggcggcggcatgttgtgggtctgagggggtgtgtcggacgccgctcactgtttggcccatgcatcactgcctggaggcttcagaacagcaaggccacacccacgcccgcatgccnnnnnnnnnnacatgtcgtgggtctgaggggatgtgtcggacgccgctcactgtttggcccgtgcagcacagcctggaggcttcagcacagcaaggccacacccacgcccgcatgccccgcccacgtaggaaccgccacttccgcatggcggggtcgtgcaagggcgggaagaccgccgtactgcagaccctgcacggccaaggcgtcccgccggagacggctttcatgcaggccctggtggggcatgtacgcggcccggtttccctgctccaggtgggaggagtactctgggggctggcacatggagcggccctcggtggctgtatggtaggtcacctgcctcgccaggggtctgccaggtggcgggcgcgcatagcaggccaggcacaggggcaatatttcatccttccccaggcatccactgtgcctcgcgctacatgcgacgcctgatgtccctccttctgcacccctctgcgcnnnnnnnnnnccccccccctccccaggcatccactgagcctcacgctgcatgcgacgcatgatgtccctccttctgcacccctctgcgccaggtctcagacccctgcgccctgcatgacgccagcgggggacctgggagggctgtgagccgcacggggcaggtgctttctgtccctggcgcccccccgcgcgtttgctggaagcaggagggccgggacgactcgctgcctgccgcttttgtcgaaggcaggcagagactgggccaaaggggggaggggggagatggcggtgttttgtgggccgatgagtggaggggtgggagcgctgcacactggctgccggtgtacactttggatgagcgcgacgcaggcccccaacgatggccccaggtgcctgccatggacccttgggtgtccatctttggcgctgcaagggaccgtcgctgggtcagattccatctctgccttgcagcttattcacagctgttgttcaatgcatcggcgccaaaccatggcccctttgcccctgctgcagagctcaaggtgctggccaaggaggcaataccctttatggaaaggatggccacggccagggctggccagctgacgacgagggtgaggaccctggcattctgtggccaacagggccatgtcgcctatgggctcgcgggtgcgtggcatcggggtgaggggtagtttgcgtgctaatcaggggttgcagtcaaggtgccagaagggaggagctggccgctcgctcatccatgtgtgctgcgctgggtgctgctcatctgtttgtgtgtgcaatgcgcaggtgcttttaagaccttggggacatccctggtgcgaggatgactggtgcagcatagcaatcagcaccccaacgtcgctcttaaatcccacgccgcaggccctggatgccactactgcgagaacattggtcgctgccacaccagcaaccatgccttctacgtcgtcaactttgtttcggggcactttgcccaaaagtgctacgaccccgactgctcgggctacaggtgtattgagggtcgattgcaatctgtctgccaatggagctggggatgcaggccgggcgcttcagcgagtgccttgaaggagtgtggaaccctctcgattgatcagattcgtcagacacccacaccaacttctgaccacnnnnnnnnnnaatgactggtgcagcatagcaatcagtaccccaacgtcgctcttaactccacgccgcaggccctggatgccactactgnnnnnnnnnnaggcgcgtcagcgagtgccttgaaggagtgtggaatcctctcaaattatcagatccgtcagacacccacaccaacttctgaccaccccctgcaggtctgcctggatgcccctgccctcagggctgtgctgctccaatggaggcgaacctcgcggtgcaagagtgtcagaggcgtaacgcatctcctgctctactgggaggcagggagtgaattaagatgccgccttgcatgcctcgtatactctgtcggcctctggagtatgaatggccaaannnnnnnnnnatgcaagagtgtgagaggcatagcgcatctcctgctctactgggaggcagggagtgaatcaaggttccgccttgcatgcctcgtataccctgtcggcctctggagtatgaatggccaaactctccccaaggggcgagcatggcaggcattgggaccttgtctgtgcaataaaccttgtgatcatttacatacaaaagtactgccaggttcgacagcagtctggcgataagtggcatgtataacaattcattgcaccccaccagtgcctgccgcactggtgcaagttgggcagtacggagagcaacaacacaacatgtgccgcaagagctaagcagtcattagcgatggcctcgcggcattcagtctccccaaccacccctcgggcagcacgacatatctctctgcctctcccgggacgtcggcaccgtgctccttgacgtgtgcagaaaaacacgaccccaggacagaggtgggcgacgtcacaccttttgccccctcgagtgccaggacgccatggaagcagagggcgtctatcagcgcctccgcagagggctcgccaacgatgaggaacttgctcaccagttctcggtacggaatgcctggggaggagggtggcaggttgctgggatggcacaagtgcaaccaattgcaacaggcacgggaagctgcacatgagccaggtaagcgccgatctcagagaatgggggctgcacgtttccagcacagactcctggctgccacgcacgagcatgccggataccgtctcccccatgcctcaccaggtctggcggccacagcctcgactgctctggctgccagggccctccagagggtcgcgttcaggcgcccgtcgtgcgtcagccagggggcggcggtcatgcacgctactcttggtgaagtggcttcctccactgccggcgcgagagttgccagcgcctcctgcctcggctccacgaccacactgatgtcagcgtctaggtgtcccagctgctgcgcggcttccgggtctgtgcccgccgggacgttggggtgtagctgcacccggagcggccgcacggcggccagccctggagcgaggtgagagtgcgaatggaggcttctggtgagcgagagagtgcatgctcattgcgtgggacaggggtcccggaggcagcccaggtcgcggtccctcggcctgcttgcacatggattagatccaacacccgagcgccataccttccgctgcctgggagatggcgaggaggacggatgcaggggaggattgtgaggcgttggagcgctgcagtgagtctgttgacgacaagaagaccggcggcatctggagggagaggtggggccagcgggtgagtagtaggagggacaccacgtgagcgcttatgcgcaggaacatggtggacatgcatgcggagcccggtccgagcatgcagtgccatgtcatactccctctgcccgtggtcagcactcccctcacaggccccccagccccacaatagctccaggcccagagtgatcgccaccccagggtcccccagacgcacccctatcaacgacttcaggcgtgggctgatgcgcagcgggttgctggccgaccccatcgggttcacggcccccgcccgcaccagcaggcgcaccccggctcggatctgagacctgcccagccgccgaccgagcagcgacaccacgtccagggcgggcgggggcgccgaagagcacgccgggtcgagctcgcacagcacgcccagcgcgaaggctgctgcgtcggctgctgacggggcgggcctcgacccagggaggagcgatccgaccgcttctgcactcccacccgcctcctccgccacctccgcgtcatcctcgccctgtgagggtcccagcagaatccgagccagcgcctggaagccgccggggagcgggctgccggtcggcttcccgccctcctcctcctcctcctcctcctcctnnnnnnnnnnctcgccctgtgagggtcccagcacaatccgagccagcgcctggaagccgcccgggagcgggctgccagtcggcttcccgccctcctcctnnnnnnnnnnagagccggccaggcccctcctccctccgtcctcgccctcccgccaccgctcgagggactggcggtgtgcggcaatggccttcttccaggccgggggcaggnnnnnnnnnnggagccggccaggcccctcctccctccatcctcgccctctcgccaccgctcgagggactggcggtgtgcagcaatggccttcttccaggccgggggcagggctgaggcatgcttgtactgcccaggtgcggcggccgccacggcctcgatcagggcggcaatctcgggctccagggcttctgccgagcggcgaggtcgcttggcactggccgaggagggcagggagccgctggggagctggcgcttggcgcctggcgcgtcgctgccctgctctccttctcggtcatcgctgggggtgaccagggacgcatgcctatcatctgcggtagccaggctgctgtccggctgtcgctctgcagatgaatcggggcctgcagccatgccaggatctcccgttgccagatcatctggagctcgcatgacgtcctggacaggtgcggcggaggggggcgggatcacagactctgaatcaggttcttccttgagctcaccgagtcgccgcgaatagattgctcctgcatcgcatttgagatgagtgggattgaaggccacagatgggatgcctcacatatagagggtccttggcatgatcagaagcttgcacagatacagcagagccagtgcaggccaacctcccggtggccatgttggctccctccttgtcaacacggcacgtccaatgccgcactggaatgggaatgccctcccttcctgatctctcctcgacccattcttgtgtcagctcgtcccctgctatcccacctgcaagctccttgatcctgnnnnnnnnnnaagccagtgcaggccaacctcatggtggccatgttggctcccttctcgtcaatatggcacgtccaatgccgcacgggaatgggaatgccctcccttcctgatttctcctcaacccattcttgtctcagctcgtcccccgctatcccacctgcaagctccttgatcctgnnnnnnnnnngacaaagctgtggagaggtaaaggttgctggatggtaggcaaggcgaacacaggaatgggcatgggatgttcacgctcctcatgtctggtgccagcttcattgggnnnnnnnnnngccatggcctgcgctgtgtcggggtgctgctgcagcaccttcagccggtgcctgagggaggctgtgcgcaggccaggcgggcgatctggcacggacctccagaacaggatcttctctggcccgtgtgccgccacaaagctgtggagagaggtaaaggttgctggatggtgggcaaggtgaacacaggaatgggcatgggatgtttcccctcctcatgtctggtgccagcttcattgggnnnnnnnnnngaagcaaccagcaaagccacacataccccaccgatgagcctcaccctgcccaacaacgcagaagctggcggtcctccgcctggtgnnnnnnnnnnaaagcaaccaacaaagtcatacagaccccaccgatgagcctcaccctgcccagccacgcagaagctggcggtcctccgcctggtgccagcgttgcttgcggcgtggggcctcgaagaacagcgcgctgggcgggaggcgcagcgcacccacggcctcctccccgcccgatgccacgtctgagtcggagtcagactcggaggcgctcccagatccggagctggaggaggtgcggtccggccgcccccgctgtgcagcctggggagccaggggcaggccggcggggcgggagccgtgcgctgcagagaccctgggtcccaggccccagccctccagcccctgcagcctctccgctcgcagccgggccttgcggttccgcacgaatgccatgacctggggaggaaggcacaggatggttgaaggaggcacatttgatccggaaggcaagtctgggggatgttctggcgccctgccgatgnnnnnnnnnnacacatttggtccggaaggcaattctgggggatgttctggcgacctgccgatgccaagctgggcaaaggagcccagtaaccgaatgcaagactctcaagcacccatactttctcctgcatgccctgctgagcctcatgcacagggcccaaggcaccacgacctcccactcaccgcgtccacatgcaggtccaggtccgccgccagctccctgcagcgcccaatgctgaggtgggcgagcccctcctcccccacagccgcctgcaggcggacatgcaaagatacaggcgtgactgacattgcgatagaaggtagacaaggcatgtgtgagagcggcacaggaggcacggccatgtagccggcccgagcatgctgtctgctccccgcccatcccctgccgccatgcccagggtgccatgcacggcatttcccccagctcaccaggagggcgctctgctgctgtgcagacagggcccgcctcctcagccatgctttgtccgtgagtccctgtgggatggagggggtattgtgggggcccccccgtgagccaggcccacctgatgccacccgatacttggagcaggtgccaggcttgctgttcaaaaatcgagccaacaagtcaaccctgccatccgtcccacacnnnnnnnnnnatgggatgggaggggcagtgtggggccccccccgtgagccaggcccacctgatgccacccggaacctggagcaggtgccaggcttgctgttcaaaattcaagcaaacaagtcaaccctgccatccgtcccacaccgctcgagcagctcacctcaggtgcacggtcaaaggggaagcatgaggccaggcgggaagtcatgctggggtgaccccgcctgccggcccccgtctccagagcggcgtcctccagtgcagaccagtatgcatcagcccccgtcggtgtctccagcgagaatgtctcgagggctctgtcctctgcggtggcaggagtttatgtttgagagtgtcttcactgctgtgagcccccaccgcactcttcgcctcggcaactgtacatgagaaccttgcccacatcgcacactactgaccacctcctcacccaagcgctccagacaagcgctggtgttgacatagtacagattctccgcggaagcacccgctgtcgcagcagactgactcttgctgctcaggggcacggctgcgggagaagtgggtgcacagggcgggaaggttcgagggacctcatggttggcgtgaatgtgcatcactggcagtgccaggacgcgcacactgccaggtggcacacacctggcaaaatcatggcgacagccctgcacacaaccacctcagcaatgcacgacctctggtttctcatgccgctgccgacctgagctcaggagccccatgcggcacaggaggtccagcagctgactcagcgcaatatggcaccgcgtgtgcgcctcgggagattcccacagccaggagctctcctcccgcgtcagactggctgcagggtgggaggtgagggagcaagctgagctgccgaggactttgggagggatagtggacatcatgcatgcctgcctcggccaggctcagcagtcttgtattcaaggctgtccctgcagagtgcatcacatggccactcacccagcgttcttcccgaggcagccaggctnnnnnnnnnnaggagcaagctgagctgccgaggattttgggagggatagtggacatcatgcattcctgcctcggccaggctcagcagatttgtattcaaggttgtccctgcagagtgcatcacatggccacttacccagcgttcttcccgaggcagccaggctcaccagcccatcctgttcggcctggctgccgatgatctgcgggtgcagcgtttggcgcgcaggggagcgatgagccagagagtcgtgcatgggccatgaattcaggccggcaggcctcagcgccgcaggaccaccctctgcatgctgacccctcccgcaacaacccatcctcgccagggtcttggtgcatgcaagtgtcaccacagcaagcatgcgacgagaaccctagcctacctgaagaaaggtctggactgacatgtgctcccacactgtcacagagctcaggacgtacctggggatgggtgttagcaggtctttcatcgcacgcccaagtgcaaatgccgccacatgccctgctgcataccaactgctgtcaaaacttgcgcactgggccacaccaggctgccggccaacgccccctaccctcataaacccacttgtgctcctcggcgctggggtnnnnnnnnnngcgcagcgcctccgcccggttcagcacctgcacgcggcgcacgtggggagcggctggggttggagccggactgagggagcttcagcacgtcatgtccagcgcaaagcctgcccgtctcggcgcgtacggcatcagacgcgcgagnnnnnnnnnntgctgccggccaatgcctcctaccctcacaaacccacttgtgctcctcggcgctggggtcgagggtgaaggcctcctggcgggcaggcgccagcgcctccggccgagccgtcacgatgtagagcgactggtggcttgccagctgcgtcaaggcgcgaccgtcaccaggctcaaagctgagaagactggtctctcgcgccgcccggcctgcgccaggcccgccggcggcgctctcatctccccgcagaacaagtccaaggatggcgacgtgcagggtccgcgcccgcaccatcttcccaatctggaagccgttggctatctgctgtcgcagcgcctccgcccggttcagcacctgcgtgcggtgcacatggggagcggctggggttggagccggactgggggagctttagcacgtcatgtcaagcgcaaagcctgcccatctcggcgcgtacggcatcagacgcgcgagcctcgcaaggccacacaacgcatgcaaagcagacatccagaacctgcaggtctggaaccaggcccttccatcctgtgggacccagtccacctcgctgcccgcagccaggtccaagcctgggtgacgccggccctccctggacaggcccagcagtcccttgctctccacttggggtaagggggtgcctaaggtacgattgttgggagcggagtgtggcgttccggggcagggcacagctcctgtggccctaccatgcataacggggggcttgcccgcgacaacagccctcgtagacctgcagcgcaggaggcacccccccactgctgcgatgcgccccatctctccattccccggcacccagagcctccatcgcatccacacacccaagtccatggccttggccgccaggctggcgaccgagttgggtgcgccccgggagtgggcgtggtgggagtaggccttgcagtgcctgaacacgcgcgtgacaaatgcctcgtctggcacggtttctggcggggccaggaccagctgcgctcgattctggaggcagccatgcttggaggggatgttcaccgacagcacctgggcggggagggagggtggaggggggatgtgcatggccgtgcatggatgtcctcggtgaagcatgtgcatggggttggacccatccnnnnnnnnnntggagggagggtggaggggcggtgtgcatggccatgcatggatgtcctcgatgaagcatgtgcatggggttggacccatcccagccctgtggccgtcgtgcagcgccaaggcaagcgacgtcctttccgacgtcccacagcaccaccgcccacgctgggccccagcctctgccacactccacactccgcgcttccctactcaccgccagcttgccggccgccaccgcgcggtccaccacgcgcgtgcacgtcttgcggtcagggggcgcgtccctggggaccccggtcacctcggcctcgcggcgggtcaggaagcgcgcgatctcggccgacagcatgaaccccgcgcggcccacttcctccacgatccagtccatgcgcaggtggtgcagctcgccgcaggccttgcgtgtgccgggcggggctgcctcctgcaccccaggcggcgcgggcccgggctcctccttctggagggcggtgggggtcccttgggcgccgggcggcgctgcggcgcccggcgcgtcaggcatacccagtgggtcaggcaagtccgtcgcagtcagggcgattgccgcgccaggcgttgcggcttggaactcctccgtcgtggtgtgcgccgctgccnnnnnnnnnngtacccagcgggtcaggcaagtccatcgcagtcggggcgattgccgcgccaggcgttgcagcttgcaactcctccgtcgtggtgtgcgccgctgcccccgcctccgagcccactgtaccgctgtactttgccagcatggcgggcgtggcacggtacttgcccaccagcatgcggccctggttggaggtggtgggtttcaggtcgaagcggcgctctagctcccgcaggcggtgggaattgcgcttggagttcagggccagcgcttcgtgaagctcagacaccgtggcgccctcgggacctgataggtgggttgtgtgcgcagggtggtggggcatgtgtgcaatgaaatctagaagcacatgaagtcaccaagggaggcgtgaatgttttggggggcacttccagcaaagcttcatctaaaatctcaagacggagagcctccatgctactccaaaacctcggcaatgctcttctgatgcaaggcatcaccgagatatagcccgcgacctgccgccacatcgcaacctcaggcaacccatcgccaggatggaagttgcaagagcagctccttgaactcacccagcaagccctcagcctactgcaaaagaggccatactcgtaatccctgttgcgcaccagcttccaggatgtgttgcaggagttgcctgtctaaagtgatctctgccacctggcgccccgtcagccactggccgccgccaggctgcatctgcagtgacagctcctcgtccgagccagcctcatcatcgctatgcggcgtccaagcctggagtagcctgtagcaggatcgaggggaggcgaggcctgatggctgacccttcatcagagggaagcagcagggctctgcctgcacatgcgatgtaaggcccattctggtgccgaaaactcatcacaaggcacaggatcccatccagccctgtccccttcctcctccccagtgccaacttacctgatgcacttgacaggtttagagccggactggccgataaactcctccaggcacccctttttgacgagcgcacccttgaggcggcgccacagcctgtggcctctcgttcccacaaatccaagcgccacctgggaggtcacatgattgcagcaggacttcaggaagtcactggagatgaaggatcaaaatataaaccctcaggctgttgtttccactccccaaccccccagcagccccgctcaccttgagttcgctctcgacagcagtgctgtcaggcagctctgcaagcttggtggaaatggcagagaagtaggccccgtcgtcgactgccccaagggtggaggccggagtggtagggttggcctccctgccagcacctgcttggccagctggcggctccacctggctttgctgatactgtgcatcctgggggtgtagagggtcaggaggcctgccatggtgagactgtccacagggatgcagttgccggacctttcaaccccccaaactcaccaacaagcgagtgtctcttcccaggtcgggtgcaaagcgctggagatggaccacattggtctggatgtggttgctgaagtaattgttggtgcggggcgtcgccaccaccgccggtcgctttgtgacgagccctcgctgctccagattctgcataaggcgtgtcccaaggtcagatctgagatgaggtgaggcgatcannnnnnnnnnccgctgctccagattctgcataaggtatgtcccagggtcagatctgagatgaggtgaggcgatcaggtagccccgcggcaggtatcggctccatgcaataaactgcctcccaacaagagaggaacctgggttttcagtgcccagacaatcccatacttccagcacacttcctttctcatccccacaccacattctgccccaccagccccagcaccccctttagatccatccatcccagcacacagtcgcacccgtatgacatagaagaagttgcggttctctgagcccaccgtcgccgccagctcgctctggagcgcaccctgggtccccgccgcccctacgagtcgcagcgtctgcatctggatgctgctcagagcaaagcgcgcgttcagccgcgagtcatagaggcccattgctgcgtcctggaggtcgtccgaggcctgggcagggggaggcggttaggcaggcgagcgttggggtgggggagggcaaagcgctcaggctcagaggctgccaggccaggtgcagggggctccctgcctgtcggactccctcccagacgttgcggggccacctgccctccagtccaccacgnnnnnnnnnngggctgccaggccaggtgcaggctgctccctgcctgtcagactccctctccagcgtcgcggggccacctgccctccagtccaccacgcgcccctcaccttcaacaccaccccgtcgatgtaggagccctcccccgctgtcgggggggtgacctccgagtcgccaccggggttcgagtcgcggaggaagcggatctcgggccccatctcatgcaacctgcccagcaacgcttcttggagtcccggggtcaggaaatcttcaccggggtgcgaacgcccgtaatgcgcctgcagtgccccccacagttccgccaggcgacagcctgtgggaaggatgggaagggcacgcctcgacaaccctgccctccttttctgccaaagacctggagattgcagcacatacgcgcaatagttcactcaagcgctagtttggaccatgcatcacctacctgagggtccacagaaggcgacaacctccacggctgtcgtcaccaggtcgtctagggacgccatcgcagcccgctgtcccggtacaaactatgggatcatcatactggtccgagcatcccgataccattcgagtctcttactatcgggcgtgttgtacagatgcgccttcctcggcacagacggctccgtnnnnnnnnnncattgcagcacatacgcttgatagttcactcaagcgctagtttggaccatatatcacctacctgagggtccacagaaggcgannnnnnnnnnctcgaatctcttatcatcgggcgtgttgtacgaatgcgccttcctcggcacagacggctccgtgtgataatggtgcccaccagaatcgaccaacgaaggaattgggtcggcctgcggcttcgcgcgcgcgattttgccatgcatatgaatgtgcaagaggatgggcagatgggacagtgtacctttgaatgctagtttcagtactcactatgcttgccaccttgcaaaggtagcgacgctgcccgcgattcacccagcgggtcctcgtcaccatgagcctgctggacgaggtgttccagcaggccgtgcaggcttccaccacagactccctcgcactcgagacagcatgcaaacaactgaatctcttggccccggggctgtccagggtgtctgcaggtgcggtggacaagtttgcgcagcgtgtcggcaagggagtcggtactccagcatctaaaacggtgagggctcagaggtttattcaatggtggtgagtatgcatctgtggagtgatgtggagtgctgggagaaacctcgctggttagagcacagggatgcatctcccaggtgctggctgccccatcctgtgcctcagagtggctccactcccaggggttgcactgtccatgcccaccagtcttctctttctatttccgtccccttatatcaacaccgcagaagggaaccggctcgagggcggcccacttccgcgccgcggccctgctcgccgccgagtgcggcgcccccgccttctccgcaggcctggcggattgggtggcggcggcccacgcggccatccgcgccgcgccctgggacgaagacgtcgcacccgcctggcgcttggcggccaccattgcagcgcgcgtggagcggtcccaggactccaccctgggcctggctcgcgccgccgcgccgctgctctcgcgcctggccccgctggcggcacgctgcctggccgagaatggcggccacccggccacgctctgcgcgctgcgcgcgctggccgccgtccagcgcgcgctgccccagtcgctgcgccagcaggccggcgacctgcgcgccgccctgggcgcggccctgaccgacgccgtgctcccccgccccgtctggctggcggtggcgcgctgctgggccctgctcccggcctcccccggcgccgcggcggactgggccgcggccatgcagaccctgctggcctctgcgcacgacctcctgggcgtcctgtatgctgggctggaggcagaggctgccgtcaaggaagccaggtgtggggagtggttggcggctgtggaggggctggnnnnnnnnnnatgtggttcctgatggactatcatgcgggccggaacctcgccatgcagcgagtgccgcttggtgctctctgtgtgtttgcgcgtcagccaacatcggccatcgcccgcatggcttacagttctgaactcgccgtttttcgccccaccaaccctgcgcctcgctgctccatgcactcacacaaacacactcacactcactcacgcaaaccccaatccctacaggtcactgtgcgacccctcgggcgccacgctgcccggcctccccggcggcgtnnnnnnnnnnatttgcgtgtcagccaacatcggctatcgcccgcattgcctactgttctgaactcgccgtttctcgccccaccacccctgcgccttgctgctccatacactcacacacacacacacacactcactcacacacacacacactcactcacactcacactcactcacactcactcacacacaccccaatccctacaggtcgctgtgcgacccctcggccgccacgctgcccggcctccccggcggcgtgctgtccctgcccgcctttggcgcggcgtgcgacgtgttcgtgcgtctgctcgtcaccgccggcttcctcctgcgttcctcctttcccgtggccgtgccgctgccgctgcgcgcgctgctggctctggcccgccgcacgctggcgctggacgacgcgctcctgatcagccgcccgggcgtcccgctgaccaaggccgccgcgctgtgccgcggcctggcgcccatgcacgccggcgcgctgggcttggtgcggcacgtgctgggcgccgcggggccggccgccgtgcctctcacactgtccgtgggcggcgctctggggtcctacgcgcggcgcggggcggatgccggcgaggaccgcccgctcgtgctgcaggcgcccgaggtgagttgagtgtgtggggctgggagccgggggcgtttggttgtggcggggaggagcgtcagacatgagtgtgctcctgcgtcggaccgggacggccaacgccgccggccgccagcatgcgcaggccgatgtcgtacgaccgcccgggcccctttgcccaccgtccaccgcaggtgcgcgaggctttctacggcgcggcccgggccttggccagcgtgggcggggtcgcgctggccgccgacttcggccccagcctgttggcggccgtggcagccgatgcgtatggcgccgccgggcatgccgggccggtgacgggcggcgcgactgcaacccgcgcggcgcccgcaaccgtggctgacgccgccgggtcgcgctcgctgcaccagnnnnnnnnnncgacgggcggcgcgactgcgacccgcgcggcgcccgaagccgtggcggacgccgccgggtcgcgctcgctgcaccagcgggtggacctgtgcgcggcggcgctggacgcgctgggctcgctgctcgccggctgcgggcatgccctggcgtcggaccagcgggaccgggtgtgtagctggtggaggcgatgtgggtgtgcctgggcgtgaggtgtgagggggtcatgcagaaatctgcgcggccggcggcgggcttgcatcgcggtggtggcattctggacgggtcaactggatcgcaccaaaaccctccgctcagtccagcccccgccttgcttccccccctccccgctccccaggccgacgcgctgtgcatccacctggcgacgctgagcatggacgcgcgggaggcggcgcgcgcgcgcggcgcgccctccccccacgccgtgcggctggagggcgccgcgctgcgcgcgctgcgcgccagcgtgctgagcccccgcctgcaccgcccccccttcctccccgcggcgctggacgcgct

SEQ ID NO: 42760 - DNA, 81 bp, Chlorella protothecoides
tgcccagaacaaagtggtctgggagtgtcctgaagggatcccgcacaccttccctccctgccaaggcacacctgcttgagg

SEQ ID NO: 42761 - DNA, 61 bp, Chlorella protothecoides
tggtgtgtatggtgggggaccactggcaggggccatgcacattgccgggcccgcatgctcg

SEQ ID NO: 42762 - DNA, 71 bp, Chlorella protothecoides
cgaacttggaccgcgtcagggtcagctgcaggtgcttgggccccgtggcgtcggcggtgatgaagggcagg

SEQ ID NO: 42763 - DNA, 61 bp, Chlorella protothecoides
actccctgctgggaccgagccacggcggcgtcgcggccctcgtccaggccgtcgatccggg

SEQ ID NO: 42764 - DNA, 32327 bp, Chlorella protothecoides
  modified_base (123)..(132): a, c, t, g, unknown or other
  modified_base (456)..(591): a, c, t, g, unknown or other
  modified_base (2685)..(2694): a, c, t, g, unknown or other
  modified_base (3481)..(3490): a, c, t, g, unknown or other
  modified_base (4304)..(4313): a, c, t, g, unknown or other
  modified_base (6159)..(6168): a, c, t, g, unknown or other
  modified_base (6340)..(6349): a, c, t, g, unknown or other
  modified_base (6573)..(6582): a, c, t, g, unknown or other
  modified_base (7063)..(7072): a, c, t, g, unknown or other
  modified_base (8874)..(8883): a, c, t, g, unknown or other
  modified_base (9265)..(9274): a, c, t, g, unknown or other
  modified_base (9483)..(9492): a, c, t, g, unknown or other
  modified_base (11639)..(11725): a, c, t, g, unknown or other
  modified_base (12316)..(12325): a, c, t, g, unknown or other
  modified_base (12533)..(12542): a, c, t, g, unknown or other
  modified_base (12740)..(12783): a, c, t, g, unknown or other
  modified_base (13513)..(13522): a, c, t, g, unknown or other
  modified_base (14014)..(14023): a, c, t, g, unknown or other
  modified_base (14076)..(14085): a, c, t, g, unknown or other
  modified_base (14316)..(14325): a, c, t, g, unknown or other
  modified_base (14876)..(14885): a, c, t, g, unknown or other
  modified_base (16134)..(16244): a, c, t, g, unknown or other
  modified_base (17119)..(17128): a, c, t, g, unknown or other
  modified_base (17607)..(17616): a, c, t, g, unknown or other
  modified_base (18147)..(18156): a, c, t, g, unknown or other
  modified_base (18530)..(18539): a, c, t, g, unknown or other
  modified_base (18848)..(18857): a, c, t, g, unknown or other
  modified_base (19811)..(19820): a, c, t, g, unknown or other
  modified_base (20314)..(20323): a, c, t, g, unknown or other
  modified_base (20654)..(20663): a, c, t, g, unknown or other
  modified_base (21163)..(21172): a, c, t, g, unknown or other
  modified_base (22368)..(22377): a, c, t, g, unknown or other
  modified_base (23042)..(23051): a, c, t, g, unknown or other
  modified_base (23369)..(23378): a, c, t, g, unknown or other
  modified_base (23738)..(23747): a, c, t, g, unknown or other
  modified_base (25520)..(25529): a, c, t, g, unknown or other
  modified_base (25817)..(25826): a, c, t, g, unknown or other
  modified_base (26721)..(26730): a, c, t, g, unknown or other
  modified_base (27872)..(27881): a, c, t, g, unknown or other
  modified_base (28051)..(28060): a, c, t, g, unknown or other
  modified_base (28605)..(28614): a, c, t, g, unknown or other
  modified_base (29071)..(29080): a, c, t, g, unknown or other
  modified_base (29438)..(29447): a, c, t, g, unknown or other
  modified_base (29694)..(29703): a, c, t, g, unknown or other
  modified_base (31043)..(31052): a, c, t, g, unknown or other
  modified_base (31358)..(31367): a, c, t, g, unknown or other
  modified_base (31693)..(31702): a, c, t, g, unknown or other
  modified_base (32107)..(32116): a, c, t, g, unknown or other
ggtgtcaccagcatctggcttggtaacagcagagcaaaggctcgctcaagtcccccttcttcctcggcactgggacccaggaatgtcgcgcaaaggtttgtcaaggaggccgctcctgcaccnnnnnnnnnnacactgggacccaagaatgtcgcgtgaaggtttgtcaaggaggccgctcctgcaccgttcccatgagtgtccagagcaccccacactctctgcggtcctatccagcgtaccctccaggccaaagttgcgccttccacatggaggtatctgagacacttcttccccatcggataccgatgtttgatgtcccctcgccacatgatgcttgtccagacgcactcctgtcacgtacccgccgccagtaccccttcgcacgtgcaaccttttcccaccgctcagcctcagcggtttgttctggtccacggccagaacccatctgaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtttcagcaggggtgggagcgcatgtatcagtcgggtcccagttccccagtcgtgcttcaagcagtgtttctaaggtgggagtccccggcccctcgcgggccgggcatgaagcgcaggggccccggcctctgcgccatgtcacccgtcagtccaggcacccggcctgcgcgtgtgagtagatgcgcatgccctctggcacctccagccccggcggcagcgtggcgccgggcggcagcaccatgccgtcgcgcagcggccagcagttgaggggcaggcccttcttgaaccgcactccgcacgcgttgcacagcgtgcggggccccagcgggccgcaccgccactggggcgtggagtggcagccacagttcaggcacgtcgtgcgctgggccttggcgcctgcggggtttggggaggacgagggggtatgggttggggccgagtatgaggcagtggtggcgtacggggcggggaggtgagcaggggccgaggtgcattgaagcgggcagacagtgggaatggatgacaggggcctagatagttcaatgcccaagagaggggtacgctcaggatactatcattcaacggggtggtcgggtgcaggggagctccggcggtcagcacgcatcatggaaaagatctggtgtggccacactcaaccgacccttcctcccagacggcatgccccaagcctccgacagtccagcctcacccctgccgcgccgtcccaggcgcccgctgccgaggtccgcctcctcccctgactccccgcccacgctgagctcggactcggagccgggcagcgctcggagggccgcgggggctttagccgggctgacggcctgcagggcctcccccgcccgcttgccgccgacaaaggaggccaccctgcgcacccgccctgacttgctggtgagcagcaccatctccggggcctcgaggtcctcctcctcgtcctcctcgtcgtccggcgggggcgccgcgcgccgtccagcacgctccgcagatcccccggtgcgcagccgggaggggccctgccgccgggcacgccagcggccgccgggggtcgtccccgtggcgggtggctcgcaggtcgggggcgcagcccggggaggagtgctgtaggtcacgtagggctggcggatgaggggcctggggtgcgcgcgcggggagggcaggccgtggtggggctggtccggcggggacccaaaggccggctgctcgccgctgcagctgcggtccaccaggtcaaagctgtccagggggaggtacagggggggctcggcggggtgggaggagttcatctccatgtcatccagcaggccctccaggaagtggagggagggcagggggacgaggccggacgtggtccgggatactgagccctcctgtcgaccagaaagctgcaggaagggggtgtgcaaacttggggattagcaggcatgcggctggcagggaaggggagaggccctgcacgaagacatgacggcagggtgtgatgttaccgggccccgctcccacactcgtacacggagtcgggtctcggagatgctgtctcgcggagcccctcacctgttcgaggacatcttggaagatggagtgcctctcgggcggggtatccgtgtcgtgcgccagcgcggctgccgtgaggaggtccaagctcacttgccgaagaggcccgacaagggccttttgcagtgggaaggatgtcgacacgccggaatgcacggccgcggcaccatgcgccgtgcttgtggagtctgttgagctggcgcgacgttcctcggcgttgagcatgtaagcgggcagggcggagggggcgacgtcctgcaggggagggttgtgtgggcgcgttcagggtcggcccattgtcacacccccatcaccaccctgggcagtcccgcggtatgacagcacaggcgacgcacgacgccagggtgatcctcttgtttggttccgggtccaggcaggaaggactggtcgtaggcttgcaggtcggacgtggtgggcagcaaacccacgggaccctgcaaatggcagcgcttgcggcgagatcacgaccaaaccaattccacgccggcggcacgtcacccnnnnnnnnnntagcaaacccaccggaccctgcaaatggcaacgcttgcggcgagatcacgacccaaccaattccacgccggcggcacgtcacccattgttggtacctttgagagggccaaatcaccatcatgacccacctgcatgccccatgagtccatcctgacgagctgccggtaactgccaggcttggcaccggccatggcttgtggcacgggccccaggcgccaaacaggagaccttggaggtggtgggtcttgcgtctctacaatttgatgttcggaatgtgggacacgcgaggggaaggggtggcagcacctggtgccgaacacgcaaccgctcgactctgttctgctgcgcccggggtggttggccagggtcgatccctgcggcacccgtgccagccccatagccgacgcggcctggcaagcctccttgcccctccggaacggcgctcaaccagcgcttggatcgatgaacccttacagaacccccctctggcatccagtactggcatgtgtgccatgtttggcctctgcagctcggcggcagtcacaaaagccaggccggctctgtggtcttctccgccaaccgctgctgtgctgcctgcacatactcctgcagcgggggcaggctgctactgtctgcctcctttcgaatgacctgtgcggggaagaacgtcggacgctgggtcttcgttttaagttggcgacgcggcgcaggcatggcaatcgccaggccgcccctccgtgagccacagacatcacacgagaccgcagcccttcccctgccgaccgcnnnnnnnnnntaagaacgtcggacgctgggtcgtcgtttcaagttggcgacgcgtcgcaggcatggctaccgccaggccgcccccccgtgagccacagacatcacgcgagaccgcagcccttcccctgccgaccgccccgacaacaccttggaggcccagcgccgctctgcctgctcgcagacgtccctcaggtcccgccccgccagtccgagcgtcccgccggccagctctgctagctcttctggggtcaagtgcttcgcatactgctccaggatgtgggccctgcagcgtgaatgtgtgagtggggcggcagcggggtcggcagtggagccccagctggcgtcgctggtcaggcaggacgcgcagctacgcgcatgaggacaactgcctatccacacatccagcacaagacgctgcccgccgctgcacggcgtgcgcaacccacgcccatgcaaggtttcacaccgatggtcgaacctcagtccaagtaccccaccacccagcccctcatctcgcctgtcggcctccgtgggcaggccaaagtagacgctggtggtgaagcggctgagcagcgccgggtccaggtcgctcttcctgttggtcgccgcgatgaccactgtgcatgtgaggtgaggggagtcatggtgccctgacaccatccaagggggggggggcgcgctaatggggggcacatcctcgttgagtccctctcacagagacgcttggaggccacccatgccattgccccccccctctacacacacatacagggtgcccctgcccagcgacccaactccaccctcacccgtgcgcttgttggcgnnnnnnnnnnccgagttccctatcacagagacgcttggagggccagccgtgccattgccccaccaccactacacacacacacagggtgcccctgcccagcgacccgactccaccctcacccgtgcgcttgttggcgtcgaaaccgtccatgtgccgcaggagcacgcccagcgtccgtcgggtggcctcgtgcatgctctccccccgcgccgtcgccagcgagtccacctcgtccaggaacacgatgcagccgctcggcagcgcctcgcaggccgccagcaggcgccccagcctcgcctcggcctcgccgtaccacttggaggcgatggactccagtgggatgtagaccagcggcacgccggcctgggtggccaggatgcgcgcgctggtggtcttgcccgtgccgggcggcccctcgaacagcacggcccgggggcggagggggccgggggcggctcgggtgcgggccgcgatgccggcgtggacctcggggtgcagcagggagagcagcagggtgtcctccatctgccgcttctgagcttcgtaacccgccagcacgccccagtccaccgagccgggggggcccgggtggatgacggtggcgccgtgctccgtcagcaccctctcggcagccgccgcgggggagggggcctgctcgcggccgccgccgccccagtcgtcaaagcgcttggcgcgatgctgggcggaggggaagggcgccgcatcacgctcctccccagggtagactgggcctgagaggggaggggggagtacactgtgccacagtcacatgaggatgagcaaggggaaggcacaaggacaccaccagtgaagcacacagactgccagtgggagcccgcactgcgcccagaccatctccctctgcactgcgcccagaccatctcccacccccctttcggccacccacccgcctcctcgccctccagggcctggaactcgcgcatgaactcctgcatgtgctgcatcatgggacccagcgggcccaggtcgaagacggagctcaggccccgccccaggcccagcaccgctcccagctcgtcggcccagggccgggcgccgcccggcaggccgcacgcgccgcgcgccgccgcctgcagcagcgccaggtcggccgcctggaaggtgccggcgatctccaccctggacgcgcggggtgggtttggggcgaggaatgaatgctcacgagcccctggtgcccctcggcctccagcgctgcccccccccactgggctgcgcaacgcacctggcaggccggtcgctggccgcggggcggaagacccgcacgctcagcgtgcccagcgcgtcggaggagcgctggagcagggtggtgccgccctccgcgccccagctggaggactcggtgacgcgcaggccgccaggcgcgcgcggccccgcggccagcgcagcgcgcagggcgcccaggcacccggggacggagaggccggcggggatgtgcaggatcacgcgcaccgagccgtccgcggtctcctccacgctgggccggggcgtcgccggcgcaccggggctcccctggcgcgaggcccccgctcggtgcatatgctcgtccagctcctgccagctcagctcggcggctgcccggatctgctgaaggctcggccgcgccgcctgtgcatgggacgaaagggacctgagcttggcgtggctccaagggacctgcactgacattcagcgtacaggtggatcgcagacttggccaagcatgccatgagaacggcacatgcgcatgctccagcagccgccagaccgacacccgacagtccttgcctccgatgccagggcgacgctcgtcgtggctgccgttccagccgcgagcnnnnnnnnnnccagcggggctcccctgacgcgaggcccccgctcggtgcatgtgctcgtccagctcctgccagctcagctcagcggctgcccggatctgctgcaggctcggccgcgccgcctgtgcacgggacgaaagggatctgagctttgcgtggctccaagggacctgcactgacattnnnnnnnnnnttgggtgcctggcaaggggagcatgacagaagaaagaaattgtacaggacctccctgggcagcacggcaccactcactggcgctttgtgcacggtatcggtgagaaatcgtgcaaatcacagcctgaacctgtgtccctcaccgctgtgctcgcagcgggccatgttgtcgctgaggcgagactcgttcctgcaaccaggggagtggaacaacgcgctatcgannnnnnnnnngcaacgagggcatgtgtgcgccatgctccagagctacttgcatggccgtcctgtgcgcatgtcaatgcctggcaagggaagcgtgacagaagaaagaaatcatacaggacttccctgggcagccacggcaccactctctggcgctttgtgcacggtgtcggtgagaaatcgtgctaatcacagcctgagcctgtgtccctcaccgctgtgctggcagcgggccatgctgtcgctgaggcgagactcgtcgttcctggaaccaggggagtggaacaacgcgctatcgaggttctgctctcacacgcctttgccgaggcattcaattgatcacccgcacacctgaattggctagtatctgcaaacatcggacatcaaggagcgatctcgcggcatgtcgcatcatggggggagcctgggcgcgaggggcaccctaaagcacggagtaccctaacccctccctaccgggcatgcgccggttgcnnnnnnnnnncgcaaacatcggagcgatctcactgcatgtcgcaggctggtttgcataatggacggtcaattagggtgcacccatgtgtaaaaacatatacacgacggctggctcccggaatttttgttcactgttttttcaagttaacgatttcggactttgcctgtgtctcgaggccccccaatggctctgtgctacgctacggctctacttccgcgccctggaaatgtcgagaaccggaatctccgtcgatggaatatcacaatatctcactccccatattcacgacattcacacagaagtaataagcatatctgaatggggaaggtcagactcctggttgcgcgcaatgcaaaaagcgggcatctttagcagatactgtccagcttccagcgactagtttttcggaacaacctcatcctaaagggtagagacgagggctggtgagagaaggctcatagcaacgagaggacatgacctagagctcacgtgatcctgtcaagcgtgtaatccagctcaccgacaagttcctcatgtttggggtgcgggactcctccggcaggctgtagctactatccttaaatgcctcctcagcgactccctggaagttggaaggacattgcattgtcaaacgttcccttgtctggagccaacgagggctgagcacgcaaggccctcccccccaagacgcaccttctcccgcatcttcttggcggcctctttcagctgcttcttgcgtgcagaactgtccctcagcgcttgcctaggatctaccccgaaagctgctacagccggggctggcatcagcaatgggacggccaggagggccagcgcatccctggcatgatgacgcgcacaaacaagtgatcaccgaactgtggagtcgcggcggaaacaacagttcccgtaaccccagcccattgcccattcgtgtcaagtacctgcgggaggttgatcctctctgtgggcccttggcatcagagccttgctgacacaaggccctcacatttcccctcggtcgagagtggctggggtggcacacccccgcgcgtcccaggctcgtggaagacagcattgcgctttaggtcgtgcttaatgagtccaaatcgtgttttaccactcaagtaaggagtgcacaccccctccgcgaatgtccgtggtgtggatggcaccgcgtcgcgcttccgaaagataaagaatctcctcctgcccgcacgtgagccatcatccacaaaacacaaaccgaaggtatgctgttccatggctcaccctcaccggccctgtagaagatgctgataacagcaataccagtatggatccgggaatggcgatggaaggtctgccattgcattcctcaactgcacgctcacaggttcttcgataaggagggcgcaatcatgtccaggagaccctgggggttgtccacatggacccagtgcccggcgtctgggagctcgtggtactccagcacacctcggtctgccatgccaggcaccgcagccaggccccgcagcgtctccacgctctcctcggtccagcgatccgactccagagcacgcaccatgtgtattgtggtccccggtggcggcgtggtcaggaggccagtgtagtctgtgcaaggattgggccaaggacactggattggaggggcttcgcgctgcgcggcgggaggatgttcaagggtgcgtcggatcatgctgccctgcttccctgcaccgctcccttcacacttgctgatgcatgagtggcaccaggagcggacccctttgcaccggccctcccagctcaccttgcgtgcaatagtcctccannnnnnnnnncggcggcgtggtcaggaggttggtgtagtctgtgcaaggattgggccaagggcactgggttggaggggctttgcgttgccaggcgggagtatgttcaagggtgcgtcagatcatgctgccctgcttcccgcaccgctcccttcacccttgctgatgcatgagtggcaccagtagcgggcccctttgcaccggcactaccagctcaccttgcgtgcaatagtcctccagcatggacctcgccccctccagatcaaactgccacacgtactgccccttgccacgctggcgcaggttgctgcccagccactgctgcagtccttcgctgaagccctgctcccccaatcgctggtacaaggcctcccggctgggcaggggctggggnnnnnnnnnnggcggcgacggcgtccagcactcgctccgtgtccctcagctccccaaacgaatccctggcctggaagggccaagagtcgagcacccaggtctggaagggggcggggaatgtggtgggattgtgactcgaggatagagtgcgggtggatgagaattgtcagatgcgatggcaagactgaagactgatgtgcggtgcacccgaccatccannnnnnnnnnatgggattgtgactcgaggatagaagacgggtggatgagaattggcagatgcgacgacaatagtggagactgatgtgcggtgcacccgaccatccagaacccgccgccttcctctcagcatggaggtcagcgccccattgccatgtcttgcctgggaaggaggcttgcccagccgcgacatctgggctgtcagttccaggcacactttccctccaagagagtggccgatgaggacatcaggggcatctgcatactctagtccgctgcgaaacagcctcaggatgtcctctgccgaggcagccaggatgtgcggaggaggcaagcccaggtgacccgacctcccgtgacaccgctggtccaggaggacggcttgccagggcctgccggactgctgctcggcccgggccagcagggtgcgggtgagggtggccaggttccggccaacccccagcaggccatgcaccacgcagatcgtgccggtgtcagcagttggtccagagcctgcccctggactggcgagtcgctcgctgtaaatctgcgcagcctctgtgtgcagaccggccgtggcaggggtggcctccagggctgggagccaccgccgggccagctcccgcaccccccgcgacagcatggcttggggggcgatgcctcagcaatttgtctggatggtatcagatgaactgggtggccagggctgggcgaccgatgtgcatgtcgtggatcatggccgggtcacgaagccagctcgcgccagctaggttttccgggatgagtgtcagtgccacagcgcgctccctgcgctggtggaggggtcctgacccatggcggggatcccaccagcatcaattggactcctgctgatagtgatcgattggttcggggtgcgtgtctgctggctgggatgcgacgcgcattggtcgtttcaaaccggcaccccggggtgctcggggtgttctgaggcctccccactccgcggcctccattcggatccgacccacatcccatgcgatcatgggcctccaagggagccccgtggtgcatgggatcgctgccgggcagggcggccaggcgggcagccctgctggccgtcgggggcctgctggctaggggcccctccccgcctgcccgcccgctccagccccgacatgccgaggccgggcaccgcgaggccctgcaccatccgaggtttgctcgggcctcgcgcctctgcagctccagaaacggtgctggccccactcaggaggacacagcacacaggggctgcacccagaatgggccccacccccgccggcagcccgcctccgaccgcctcaccatcctgcacttcaacgacgtgtacgagatatccccccgcgccatggagcccgtgggcggcgcggcgcgcttcgtgagcgccgttcgcgcccacgccgccgactcgcccctcgtcctcttcagcggcgactgcctgaacccgtccctggtgtcttccttcacccgcggcgagcacatggcgcccatcctgaacagcatcggcgtgcacgccgcctgcgtcggcaaccacggtgagtgggaggctgggggaggacggagggcaggggagggacattgtcagggtgtgggggaggatggggtttcagcggccccatcaccggctgccccaggcaccccctcttcctgggtctacagcctgggttccaggggcaaggcccccgccccacgccaggtaccgcacctctggtgcttgagctcgcctgccacctgcttcaacccaatcccccccgacaccagactttgactttggcatggaggtgctgcgtcgccatgtggcggcctgctccttcccctggctcctgtccaacgtgctggacccgcgcacggggcggccccccgccggcctgctcgagtcgcacctgctgacctggcgcggcgtacgcgtcgggctgctgggcatcgtggagcgcgagtggctggccacgctggcctgcgtggacttggcgcgcgacctgcgcttcctggacccggaggccgcagccgcgcggctggcggccgacctggtggcggccggcgcggagctggtgctggcgctgacgcacatgcgcgccgcgcgcgacgcgcggctggcggccgccgtgccgggcgtgcagctggtgctggcgggggatgannnnnnnnnnnnnnnnnnnnnnnnnnnnnnnnnnnnnnnnnnnnnnnnnnnnnnnnnnnnnnnnnnnnnnnnnnnnnnnnnnnnnnngccccccacggcacgctggtggtcaagtcggggaccgacttccgcgagttcacgcgcctggagctggccctgccgctgcgcccccaccccgcccgccccgacgtcgcctgggcgcgggtggaggtgggcgccagcacgcccccggacccgcccacccaggcgctggtcgcggggtttgaggccctggtcggtgcgcacctggaccaggcgctgggctggacccacgtggggctggacgcgcggggggaggccatgcgcgggcgcgagacggggctgggcaacctgctggcagacgccatgcgcgtggccatgggctgccaggtcgcgttcttcaacgggggcaccgtgcgctccgaccaggtcagcagaggggcgggggttgtcttggaggtggggttgtttgtgttttttgattgcggggaaggggtttcaggggggagtggatctgaggatatgggtcaaggacctctccaccgtcacccccgcgatgccagacgccttgcatcctcaggctccctagacagccggtgccagccccatgcatacgccgcctctcccccatccacccaaccccccctccccccctccgcnnnnnnnnnngtgtcttggaggtggggttgtttgtgttttgagtgcggggaaggggtttcaggggggagtgggtctgaggatatgggtcaaggacctctccaccgtcacgcctgcgatgccagacgccttgcattctcaggctccctagacagctggtgccagccccatggatacaccgcctctccctcatccacctacccaccccctccccccctcnnnnnnnnnnctgacacccaaggtgcacgccgcggggcagctgacgacgcgggacgtggtcaccatgcttcccttcaccgacgagctggtggcggtggagctgacgggcgccgacctgctgcgcgtcctggagactggcgtgggcgcctggcccgagccggagggccggttcctgcaggtgtcgggcctgcgcttcgccttcgacccnnnnnnnnnnnnnnnnnnnnnnnnnnnnnnnnnnnnnnnnnnnnaggcctgcgcttcgccttcgacccggcgcgcccgcccggcacgcgggtcgacgccgcctccgtgcacgtgggcggcgcggcgctcgaccccgctcggcgctactccgcggtgaccaaggcgtacctgcgcgacggccgcgacggctttgcatgcatgcgcgccgcgcggccgctgcgcgtggagctcaacgcgcccagcctggccaccctggtgcgccacctcttcttccgcatccaggccctgaatgagggcctggcgaggggggagggggggaagggtgccagcgcggcggcggcgggaaagcgtggcgacctcgtgggagcacgacaaggagtcagtgcagggccgcagcacggcacacggacctcgggcgacgtgggcagcggcggcgggccacgagcgcccgcagcgggcgctgcacacgtcgccgacccagcagacagccccccttccgaaccagtcagcccgacggggtggtcgccggaggtgctgatgcagccgtacgaggcagggctggagaagctgtactgcttcgaccccggcacggggaagtggggcgtgcgcccaaaggtggaggggcgcatccgctgtgtccccggctgcctgccggagcctggagtgtgagggctcgaggggaagtccccggcgggcacagtcctctgctgggatcacagcacggtgcctctcctgatgcccatatgccctgctgcatgaagcccctcccaggtnnnnnnnnnncagtccccggcgggcacagtcctctgctggaatcacagcacggtgcctctcctgacgcccaaatgccctgctgcatgaagcccctcccaggtgactgcaaaacttgattttcgttggcagcaatccatatggcacagccgggagtgacaaacacacagaggccagggaacgcagttccaatgccagggcgcactcctgggggtccaagatcatcaggttttcaggggcttgcgcttctcgcggtcggcaatcttgacatactcggctccagactgcttgaagcgtccccgcgcatcgtccgtgtccgacaccttcttcttcacgatctgcacgacatcctcgtcttccagcgtgtggcccagccccaccctgggagtggcggaagttgtggggttcaatggatggcatcgcatcagcagctggcaggcaggggaggccacaggtgcccaaaatgaaagtcatcaatcgatcctactggatgcactccgcagnnnnnnnnnncgagagcaccacaggctcgtcaaaatctggccgctcccccactttcttggtgnnnnnnnnnngatggatggcatcgcatcagcggctggcaggcaggggaggccacaggtgtccacaatgaaagtcgtcaatcgatcctactggatgcactccgcagcaaaacctagccggcgcacctctggggcatgtgcttggtggaggtgccccacaccagggcgtacttgaagtccgccagcaggctcttgtggatgtgggcacaaaagtcggagacggtgacgccgccacggtcgtcnnnnnnnnnntaggcacggacaaggccctgtggagttggttgaaagggggcaggccgtgagaacggcagtttatactgaccaccgagccggcagaaaccataccgcatggctagcaggagctgcccttggcccaagtatcagtcccccgcccccctcctcagcaaccactcgccatcatctcccagatctgggacaggaggccgtccatgttgaggcggtggtagcaggagatgggtatggagaagggccggcgggctatctcgtccacctcctccatgctgcacacgtcgaccttgttgtacacatacaggcctacataaagagtggttaaaggtaggtgggcatgtgagtgagcccttctggtgggacgtagtggcgccatacacattgttcacagggtagcaccgcctgagagcgttcatgtgtttcccctgcacggctcttggacgcccaggagaccctcgcagcaggccaattcctcatgcactctcactcacacttgatgtagcgccgattgccctcgatgacgtcgatgaggtcgtctaccgtggaatcctccnnnnnnnnnngcacattctttacagggcagcaccgcctgagaacgttcatgtgattcccctgcacggctcttggacgcccaagagaccctcccagcaggccaatccctaacgcacactcactcacatttgatgtagcgccgattgccctcgatgacatcgatgaggtcgtctaccgtggaatcctccttgaacagcaagtcggcgttgtgtatccgatactcctgccggtgaaaaagtgaggaaccttatgtgacatcctgcctgtcccatgccggcgacaaggcagacatgcatgtcatacagagatgcaacatatgatactgttgaccataaccctacctggaggatccgccagaccatcttctcgtccagatgggtcagggtacccatcgagttgatcgcgatcccgcccgttttcttctttttgaagaagatgtctggcggcttgcgatttagcctggccagggacacatggtggaagtggaaggtgggcatgagcgacagtgcattgccccaaggtccttgcaatacatgatgcaaatactcaccactgacccaggaatcagccagcagtcgctatcggttgtctgaggcctcaggtctctgtccttcccttgtacaaatgagccctccaaaggcccacctacgcccgccaacccacctcacgcccactgactctagctccctggtcaggatctcacgatggtagtgcggcttgcccgcatccaacaccatcagcaggaggtccgccgacttgcagacagcaatgacctggcgcccacggcctgtgtgggtgtgaattggggagtgaaggtggtgatgtttcaggctcaaggtgatcacgagcagtcgccataaagtatgacccatccaatatgcctcacttccacctcccccacttcatcacctttgccctccgccgccccttcgatgatccccggcagatccagcagctggatcttggcgtcgttgtagtggatgacgcccgggatgcaggtgagggtggtgaactcataggaggcagcctccgatttggttcctgtcagctccgtcagcagagtggacttccccaccgaggggaagccgattagggcaacgcgcccatccccaaacttctggacctcgaacccctccccggaggcaccccccttggcgggctcctggagcatggtccggagcttggccagtttggccttcagctggcccatgtgatactcggtggccttgtttttctgagtccgggacatctgcggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaggatccccatggcgtgtggaggcccgtgccaggtagacttgcaggcagcttgtgattattcagatgttgaatggtcttgttgaaggtgatcttgtatgccacaatcctacaagagggtcctggacggtagctgaatcccagtcagtcgtccttcccggcgcgcacgtcagggggatccgaccaggctcaagcacacccgtgtcctccaacacaaatatgccgagagagtcgtggctgcatatgatgcatggagcgattgagcgggcggtggatttgggcaagaagtgtccctgcgctctactccaaggtcgacgtggcacgatccagggcgccgggaggaggtgcgaaatgacagcctgagacgtcacaggggttgacgagcatcgctatcgtatcaaacaattcttttttcgaagaacaatctgctcaagaatatccccgcatgaggcccatgcaggctacaggtctcgcgaggggccacctctccccgcttcatgctgtccccccatgccggcgccatggcatcatctgcaaggggtacgcccgcacccagacaccgctgctcgagtccttgaagcccctgaacagggctctggagtcgggcacgaacgatgaggccgtggctgctgcacaggagctgaaggagagcggggtgctgtgcttgtttggggaggggcgccaggtccccaagcgcccctacaccctggaggaggtccgtctcaacaggatcgaccccgccgccctcctgtcccccgtggatgccaccatgaatggcgtgcgcaccggtctccaggtacgcaagagcttgtgccgacatgtggagggcagctggtagctgcgcagcgccgagtagcagcccaatcgcccatnnnnnnnnnnacaagagcttgtgctgacatggagagggcagctggtagctgggcagcgccgagtagcagcccaatcgcccatgcattcccccttgcccaggctgctgcggccagcggtctcctggccctattatatggtggagcggtggatgtgtccggggctgcggtgctcgtgctgttgggggccaccctggcggtggcagaccaggtaggcaccggcggcggggtcgaggccctgctgctggactcggcggcgcggaaggtgagcggaagctatgcgtcccgcgtggccacacacgaggccggccacttcctggtggcctacctgctgggcctgctgccccgcagctacacattgtcgtcctgggacgcctttcaagcgtgcgtttaggacttgtgaaaggggaatggttggccactcctaaacggacttcgatcatggtcgttcgtttggaaaggggcactcactgcgcagcaagcagcagactnnnnnnnnnncctgtcgtcctgggacgcctttcacgcgtgcgtttaggacttgtgaaaggggaaggattggccactcctgaacggacttcggtcatggtcgttcgtttggaagtgggcactcactgcgcagcaagcagcagactttgcacccttgagggcacctcaggcgcatgcgcatcccccaagtcctctgcaggcagggccggctgggtgtccaggcggggaccgagttctgtgatggcgacttccagcgagaggtagccagcgggaagctgtcctccaacagtctcgatgccttcacctgcctgggtctggccggcgtgtgcgctgagaccgtggtctacggccggtccgagggcgggctggccgacattgcccagctggactcgctgctgcggcggatcaacttcaaccaggccaaggctgatgaccaggtaaacaaagtggcggtgtgcagaattcagtgccaagctgagggaggaaggggggttgaggggtcgcatgacggtgtcaccaatgcgctcggtctcttccattgcnnnnnnnnnntaggggggtttgaggggtcgcacgacggcgtcaccaatgcgctcggtctcttccattgcgcaggtgcgatggtcggccatcaacgatgtcgtgctgctgaggcggcatgccgctgcccatgccgcactcacgaaagccatgcaagcaggaaagagcgttgctgagtgcatcgctgcgattgaggctgctgaggcgtagccaggacgtggacacactggttagggctgtgtctcgtggtgcatacagcgttgcatcatcactgctgcatctgagaccgcttctgaggtgccgacagtgttacagacatacagtgagcgcagcgggacacaggccatgcgtcgagggcactgatggagcactcctccctggatggnnnnnnnnnngtgtggtgccgacagtgttacagacatacaatgagcgcagcgggacacaggccatgcatcgacggcactgatggagcactcctccctggatggggcagcaatgcagcagcggaagggactgtgcgtcaagccgaggtgtccttctggatcacaagttggaactcccctaccacatctggggcacgatgggagtgggagagcatgaggttctgggcatgacggcacaagacattgctgggatatttgcaccgcaaagcctcccaagacatgtgaagctaccatgcccctccaagtgacacacgatcatcnnnnnnnnnnaagagcatgaggttctgtgcatgatggcacaagacatcgctgggatatttgcaacgcaaagcctcccaagacatgtgaaactgccatgcccctccaagtgacacacgatcatccttgcatcgtgccccagtggataacattgcaccactattacacccccccccttccctctcacctgggtgcagccggatggagaccgggtagctccccagggcagctatctcaggcaggttcacggccctcttgtccaggctccgccctgtctgctgctcgatcacggccaccacgtcggcggtggtgacggagccgaagagctggcctgaggtgcccactttcttcctgatcacaaacttgccgatggtgctcagggccagggccagggcccgcgccttgcccagcacctcctgcgcccgctttgcctccgcgtccctctcagactgcagcctggccaggatggcaggggaggcgggggaggcctggcgttgcgggatgaggtagttgcggacgtagccgacaggggcctcgcagagctcgccctgcttgcccaggccccgcacgtccttgagcaggatgacctgcttcttgtgcgtcacggccttggaggccgtgatcacgagggtgccgcgctgcgccgcacggctgcattggcgaccctggaagggggtgagccacggcctcgaggactgcacgggaaagggggggaggtcatgcatggacggcgcccttctatgcaggcattttgtaagcagcaatggtcgagtactgaaagccaatgtgcctggcccagcaattccacccctgttccaccaatacacctgcatggagggggtgcacccctggaaagccatcatgggctgcccggtcaccgagtgcgtgcggttcacggtgaacttaacagctttctagatgcactgtgtacttcaacgatgagctactcagggcccatgaggcgannnnnnnnnntttaacaggtttctcgatgcactgtgtacttccacgatgagctactcagggcccatgaggcgactctcgcattcgcgcgttgcgaggtggtgggagcggataagtttgcctggccgactcgcgcgctcgtgatgggcgcgaggtactcacagggacgagcgtcgcaacggtatactcgacgatgcttcgctaatcattggatataggctcagtggacccatcaataataaagcataagccacaccggccgttttggccctcgccatcgcggtccaccggcgccatggcggacgagcctgaagcgcagggggcgagagccaccagcgagcaggcaaaggctctagacaaggtcacagatcaggtgaggaggacctctaagtgtgcttgtgtgtcctgaaatacgactctgggtggtgctactggaggttgagaggcaggcacagttgccgcttctgtgcctcttgcccaccctgtgccccgctcttcactgacannnnnnnnnnagcacagttgccgcttctgtgccactcgcccaccctgtgccccgctcttcactgacaaacccatgacccagttccccgtccccttcgccaggtcgaggagcgggaggtgaagaatgtggaccagtccaagattcaggcagccatggcagagcttgctcagcagcagcgtgtgaagcatgaagccgcccggctcaggtaggatgtgctgtgcggctttggcttgtggggctatagggtctgctggctgggctcattgcaggactctgtgttcctttatgggactttgagcacccaaatactcggcacccgaaacctaaacagggaaaagacnnnnnnnnnnccattatggacctttgaccacccaagtatccggcacccgaaacctaaacagggaaaagacgctgtcggcggtcaagattcaggcctcggacgtggaggttctggtgcgggagtttgaggtggacaagaaggctgccgagctgcgcctgcgggagcatggcggggacgtgcgcgccgcgctggcctcctaccttgcttgactgcatgttgttcagaggaatggtcccaaacagacttgattttctactggtatgagtggcaatgacactgagctacacgagcggctgccgtggcagggatcgttcaaaatttggatgctaggcgaagcacgtacaggggccgggggcaggcggcagccagggcgggggcagcccggctgggcggaggcaggttggcgcagccgtcacccatgaacagaccactgtcgagaaaaggggcgcacaggaatggaccagaacgactcacccctgggccccctcagccggcaaactggcgggagannnnnnnnnngttgcctagcgcagccgtcacccatgaacaggcaactgttgaggaaaagggcgcacaggaaaggaccagaacgactcacccctggccccctcagccggcaaactggcgggagagcccggcatggaccccggtcgcagggcgcgcggagcgctcggcgtcgtcggagaagtcgcgctccagcaccgccgcggcgcccatgcccgacccaatgcacatggagatgacgccgaagcgtgcggccttgccgcggcgctgcatctcgttgatcagcgtggcggcctggcgcgcgccggtgcagcccagggggtgccccaacgcgatggcgccgccgttggggttcacgcgctccaggtccaggcccagcttcttcaccgtgtacagggcctggctggcaaaggcctcgttgatctcaaacacgtccacgtcatccaggcccagccccgcgcggcgcacggcctcagggatggcagccacggggccgatgcccatgatggcggggggcacgcccacagccgcaaaggagcggaagatggcgaggacggggaggccgcggcgccgcgcctcgcgccgcgtcatcatgagcaccgccgccgcgccgtcggtggtctggctgctggacccggcggtggtggagccgcccttcttgaaagccggcttcagcgccgccagtgtggccagcgtgacctcgggccggatgccgtcgtcctcggagatggtcacgcgccgctcctccccgtttgcatccttgagcaccgtctccacgggcacgatctcgttcttgaacttgcccgccgcgcgcgcggcggccgccagccggtgcgaccgcagcgcaaaggcgtcctgctccgcgcgggtcatgccgaactgggccgacacgttctcgctggtgatgcccatggggatgaggcagtcggcggcctcctggcaggtggccacacgagggttcacagtgccctcccagttcatggggttgctggtcatgtgctccacgccgccggcgatggccatcgtgtagtacccggccttgatggaggcggccaccgaggccatggcctgcaggccggacgagcactgcctgcgacgaggacaggccaggcttgcatgggtgtgtgttcagtcattgtaccgatcaagggtcgccaccatgccccgcaccaacattggtcagtcccccagctctccagaaactcacctgnnnnnnnnnnagtgtgtgttcagtcattgcaccgatcaagggtcgccaccatgcccggcaccaacattgggcagtcccccagctctccagaaactcacctgttcagggtgtggacagggacggtgtgggggaagccggcgaagagcatggccatgcgcagctcgttagcgcgctggctggaggggcccatgacggagccgaacacgatgtcgcccaccgcctcgggctcgatgccggtgcggcgcagggtgtccttcagcaccgcggcgatcaggtcgtccacgggggtgtccttgaaaccgccccgcctggcgcggcacagggccgtgcggcaggtggagacgatgaccacgtcgtccaggtcgcccgcacggcggtcgtgggactcggcggaggtgggctgaggggccacctcgggcgtgccgtgagcctgggaggggagggcgtggtgactggggtgagatcggggtgcacacgaccacggggagggcttcagacacaccgagatcgtgggacaggaagcatatcacaccgcccacgtaccgatgccaggtggctcagcaggaccttctgacgctgagcggccttctccatggtggggtgtggagtcgagggagtgaggtaggtttgacgagagtaatcgagcccctgcctcgagaaagcaggcgtagatgnnnnnnnnnnagggtgtggagtcgagggagggagtgaggtaggtttgacgggagtaatcgggcccctgcctcgagaaagcaggcgtagatgtgaaaaggaacaaaggttggaatgtatgcagctcccgtccttgctttcagggttatacttccctgtcggaactttgcataagcgttgcagtcacgcctgcggtccgagtcagccggtgtccccgaaacttttcccgcgcgggatcacctccatctccgatcacgcatcttaggcgtggtggtgatccccccgacggcaaactgagtcggaacccacatcataatgcaccttagggtnnnnnnnnnngtcacctccctcgccgatcacgcatcataggcattgtggtgatcccccgacagcaaattgagccggaacccacatcataatgcaccttagggttgcctcagccacttatctgcgacagtccgcttgctactaccactcctttagagcatcaggtgtgggccttacgcttcttgcgatgtattgtgtgcatgcgacccatgtgccgtgaggaggagctgatacccatattctcccaccgcagacccatattctatatccacagctccgctcaggagcgcaccccgcccggcgacccctcctcagcctcacaggaccacatttggcctgaacagtggggtccaggcacccgcttgctggcgnnnnnnnnnncagagcatcaggtgtgggcctcacgcttcttgcgatgtatcgtgtgcatgcgacccatgtgcggtgaggagagcttatacccatattctcacaccgcagacccatattctgtatccagagctccgctcaggagcgcaccccgcctggcgacgccccctcggcctcacaggaccacatttggcctgagcagtggggtccaggcacccgcttgctggcgtcgccgctgcgtgactgcagcagcctcaggcatggcatccctcacgatcgagcgtgtcccttgcctgtcggataactatggtaaggctgtgtgcgccatgctgcacatccctacctccccagttgcaagcgccttgagttccagactctcgcactcccctgccccacagcttggctcctgcatgagccggccagcaacgtggtcgccatcgtggacccctcagagtccaagcctgtggtggctgccctggagaggaggtgggtcgtgtgacaggctggcgggggggggaggtgtctatcccgacccatttttagacgcaatgcactgttgtctcaggtctgcagagtatgatggggtcgtcctgctttctcatgccatcccttcctgtgcagccttcgatgccccagggtgccgcctcatctcctgcccgcctgttccacccgccatcgtctgtcatcggccgcctgtcacacagtcacacactcccacgcgcccccccgcccagcggtctcaagctgacgcacatcctgaacacccaccaccattgggaccacacggggggtaacgaggagctcaaggcgcggttcggcgccacagtcatcggccccgccgcggaccgggaccgcatcccgggcattgacgtcgcgctgcgggacggggagcggtacagcctgggggccgcggagttcctgaccctggataccccgggccacacccgcgggcacgtgacctactacttccccggtgccaaggccatgttctccggggacaccctcttctccctgggctgcggccgcttcttcgagggcacccccgcccagatgcaggcgagcctggacaagctgcggggcctgccccaggacacctgcgtcttctgcgggcatgagtataccgccggcaacgccaggttcgccgtgagcgtggacccagacaacgagttcctgcgggaatggaaggggcgcatcgacgccgcgcgcgccaaggtatgatgccgaagggggggggggcggttgcaggccaggctggcagggatgatctgaagggcgctggagagggggcctgtttctttctgcagctgtagatctggggcatgcgtggctgggcagcctggtctgagcgtgccgcgtcttcaccacatattaggcatggcagatcacctgagaccgctgaaattaaaggcgacgcgtttcgtgcacagatttcctgacagattcatcctttctttccctgcacagggcctgcccaccgtgcccagcctgctcgaggacgagctggaggccaaccccttcctgcgcccaaacagccccgcgatccgcaagtctctgggcatccccgcgagtgccagctcggcagaggccctgggcgcgattcgcgccgccaaggacaaggcctgagcgggtgtgggtgcgccctggctgcccacaagcctggcgtggactcgtgcgtgcaggattgttgtccgtgtgatcacccacgagtgcgaggtttgctggctgccggtgttcagcagcagatgttcacatgtgtgtgtggaggcagggattggacctcccccnnnnnnnnnncccgtgtgatcacccacgagcgcgaggtttgctggctgccagtgttcagcagcagatgttcacatgagtgtgtggaggcagggattggacctccccctgcccactgtagaagcgagaagaatgcagcgatggcagggacagtgctgaggaaggtgttgggtcatggtgaagtcagagtcgacgcagagtagctccgtttccatgtgcgcttgataagcgggtgttcaccctcaacctgctcacccctgctgaggcactcagcctttgcactgcacggtccagatgagnnnnnnnnnnaaagaatgcagcgacggcagggacaagtgctgaggcaggtgttgggtcatggtgcagtcagagtcgacgcagagtagctccgtatccaggtgcgcctgacaagcgggtgttcaccctcaccctgctcacccctgttgaggcattcagcctttgcactgcacggtccagatgaggtcgctgtccgactccaccaccacctcctcagcttcaagaatgttgctggtgctcagcagcccccccatcctcatctcagtgtcatctgtggatcgagaggcagggagggtcagccgtgctgggtggcacaggcaggttcggtgcatgctctccctctttgcccgtgaagggacatactcaaaccatggcccagtctggacccagcctcctccccctccaccacccacccaccccccagactcacccatgtcccacttgagcccctgggtgctggcccgtgctggcccggccaggggaaccaggccgcaggccggaccctccaggtctgcatgcgggcgcacgacggaccggccacggggaacgagccgtgtgatgttcccctcccccaccagcaccaggttgaggtggcggtaacgatacaggcaccccaggttgctcaggatgtggtccagccgcccaccgtgcgcgcctggagggagggtggcgtgggggtttggagggctgttgatgggaaacagaaggtttgaccatgagcccaactcctgtatgaggatctgccgggggataggtccccatgtgtgacctgcaccccatgggactgtgggtgcctgaacaccaccaacacgatgccacccccttcccccctctcccccgcccgcctcgtttcccccccctcccgcaatagcagtacagccctgcaaacatgctggcagcgcctggnnnnnnnnnnggcttgggggttgttgatgggaaacagatggtttgaccatgagcccagctcctgtacgaggatctgccggggtgcaggtccccatgtgtgacctgcacccgtgggactgtgcgcgcacaaacctcaacaacacgccgcccctcccctccccaccctcctcctgcaaaagcactccagccctgcaaacatgctggcagcgcctgggatgcagcgatgcaccccatccaaccaccggcgctcaccaaaggcgacgatgtgctgtggcctggacccgtgggccgcggcgtagtccacgcacttttgcaggtcggtggagtcctggtcgtgggacaggtctgtgatggccactccggcgtcgcgatagtacgccgccacctccgggcggatgctgtccaggtcgccgatgatggcgtgggggagcggcatgggcgccgagtccgaggcgtggctggggccccgcagctcatcgtacaggcggttggcgccgccgtccgcgcagatgcgcaaggttgctgtgcagggagggtagcgtgggggatggcagtgctgtgggctgcagggacgccatgggcaggtgtgcatggaggagcacgggcatccgccatgcatggagctgggctgcagcctgcatcgatgctccagcgcacgaaacgctgtggcagcaacgacacaaggaaggaggtgtcgcacatcaatggtggcctgcgggcgcagccacggcatctgctggaacaggtgcaccacctcacctctctgccagaccctggcagccagggagggcagggtccagttcaagagcaccgcagcgagaggcctgtcgctggaggctgcatcttcctccagaaaggtgctggtcagcactcgcgtctgccctgctcccatcgcgcgtgcgaaggaggaacaggccgagcgcgctgacgcagccacctgtcggggggggaggccgcaggccgggcccgcccctggtctaacgcctttcaccgtcagcaacagtctgtatagtcctttgaagttgaatgtttacagtggtataagctatgtacctccttggcatggggtggacggcaatacatcaatcgctagtggccatgcgcgccctccggccatgacacattgtcggcgtgggcaactggtcggcccannnnnnnnnnaggcaatacatcaatcgctcgtggccatgcgccctccgacacgagtcggcgcgccaaacttctcgtcctcaccaccaccagtgctgccaaaatacgttacatgaagtgggagcatatgcccctgcattccgtgtgtttccaacagatcctcccaacaacaagtgtcaatnnnnnnnnnntacgcctcaccagtgtgctgcaaaatacgttacaggtgacatggggcagggtgccgaacagatccgcatgaagtggtagcatatgcccctgaatttcgtatgctttcaacagatcctcccaacaacaagtgtcaatgacctgacggaggagtattgggcaggcaggccaaggcccatccgcgctccctcatccatgcatgggcttccagtctccaagcacgatgttgcgcctctccgccaggcttcggcggaatgtgtccatcgttcgtggcggcacaggcaccacgttgtcagccacctcagcagccggcaccatggatggtcgtctggagtgtggtggaggaggttttgggcgtgagtgccatcggaccacacaatcagtgggcaggtacctcattgcaacagaatgcccatcctcatcctcttcgacataatcgacctgcaagtgctcggcacaatgcctaggcaatagctcccccttcagttccttgagaatacattatccaccaaaggaattgccagcacacaaaagcccacctgcggtnnnnnnnnnngggcgtgagtgacatcggaccacacaagcagtgggcaggtgcctcattgaaacagaatatccatcctcatactcttcggcataatcgacctgcaaatgctcggcacaatgcctaggcaatagcttcccattttgttccttgagaacacatcatccaccaaaggcattgccagcacacaaaagcccacctgcggtgtcctgacgccggggcctctgtttcagcttcctgcactgtctttcctgctggttcgcggtccttgatgaagaggggggtgctcatccgaacttggaatggaaactgcaatggtggaaagatgaggctgagcgcagttctttctgctcactaccagcagcaaattaaggctgtggacacataaccccaaagcaaattctctgaccagctggaaaatcctcgttcttgaccattctaagcaacttctcagaatcccatgcattgnnnnnnnnnncctctgaccaactggaatatcctcgtccttgaccattcctaagcaacttctcagaatcccatgcattgcaacacccacctcacggtagcactcctctgtggttttgccagcatgcgcctgctggtcatggctggtggtgtcatgctcctgtccgagctggaccggagtgtgcctgtgggatgacacgattgcattggggggaggatgttggcgggcactgaaacaaccgagaaggccgcagtgcctgcaaaaagacctgttctggcaaagccctccatcggcaccaggcatcggtgctccagcccgtgtgcccttgcagcagacaaaagtgctcccgtcctaagctttcggtgcatgnnnnnnnnnntctccagcccgtgtgcccttgtagtagacaatagtgctcccgtcctaagctttcggtgcatgacaagcgtgtcgcgagccgagaagcaacagctttgaccttcccaggcattgcccaacagcttcccaacctcacctgcgtcctgttcctggtccctccgtggacatggagcactctgcctgcacattgcggcgcacggatagatagtgcgttccccggaattgtcgcagggactgcgtccgggacnnnnnnnnnnggcctggacattgcggcgcacggataggtagtgtgttcctcggaattgtcgcagggactgcgtccgggacgtaaacgcgtgggcaggcgtcccggaagacactcccggcgtggcgagcactgctggggcccaggcagacatgctgaatgtgtgtttggtcgagatgggtgtggacaggatgccgtggactccgattgtggagttggcaccgagtgaggccggctttgtttccccaaggcttccacgccgcgcccacgatatcgccagcaaattttccgcgcggcgacgaaacgaaatcaccggctgataatccgggggattgacattgcccatcagcgacgacagatgcagaattggtacgattctgagaccttttgttcagatacagtaagaaaacgtaagagcgtgagtagtttatcgctcttagttgctccatgcccgtgactcttcaacgagcatgtggccccatgagcacttgcatgggtcgccccggcccctcaatgcaagctatgcacagctctcagtcaccatgcatggtgttattatgctcaaaaaggagtcctgtgtcctcttatcgtgcgaagagaatccctgcatcccccaggccgaccaggaacccggtggccacgggagccaccgagagggagagccccgatgcggatgaggagggccgtgctaaccccgaaacggacagcttgtccctcctagataccttgggtaagctgctgctggttgaaggaccagcagctgggtgaccttgagcgaatggagcacccagcagcgactgccctgcccagcagcctggctgtcatgcctcaggagcacctccccagccccagcctccacccggccgcccgtctttccagcagcaaggcccccccttctccctcccgccacagtggagagcatcgaccctgcgcaggcaaatccaacccctgccagcggccccacccccaagaagaccctggcggagcggctggagctggcgtacaatggggaggaggggtcggagctggcggccctgcgcaagcgccagaacgcgcgacagcagcgcatggacgaagagtcggggcgcagcaacctccccctcttcgcgggcctcctcctcctcttcatcctccccgccctcttcatcctggtggccgccagccagtctggctacttggaccacctggcaaacgggtggggggcacgcagctcctactgaccagcggggctggtggtcgagctgggaccgtgagagatgcctcatccctggacgtgcaaattgggcatgctcagcctccttccctcaaccctggcctgcctgcctggcaccgggagcccgcgagcctggatcnnnnnnnnnngtcctccccgccctcttcatcctggtggcagcaagccagtctggctacctggaccacctggcaaacgggtggggtgcacgcagctcctactgaccagcggggctggtggtcgagctgggactgtgagagatgcctcatccctggacgtgcagattgggcatgctcagcctccttccctcgaccctcgcctgcctccctggcaccgggagcccgcgagcctggatctcggagcctcttccccaaccgcccctgaacggcagtgtttaggtttacagaatagacagactgacctgggtgcaggtcgcnnnnnnnnnntcccaaccgcccctggacaacagtgtttaggtttacaaaatagacagactgacctgggtgcaggtcgctcagaggcatgacgtgcgcttgatatttcaagcaagggcaacttgcaaacattaagactggctggtgggacgatgtggacgagggggtgaggcgcagcggtgacgcacgtccccaaacatctccaggccgcgcaggaaggacagtgcacaacaatggctgtgatcgatgaaaaacatgggagggcgagtgggcgcgcgggagcgccgttcagccggggggtctcgcacggtatggtacacggggatgggctctctcgnnnnnnnnnncgggggcgcgccgttcagccggggggtctcgcgcggtatggtacacggggatgggctctctcggccaggggcactttggtatggcacaggatggggctggggtagatacggagggggagggggggggatgacttgcgcagccccctcccgcacagagctcgtgtggccgcggcccggccaacaagaccacatggcgcagtgtacggcgctcgccaggctcctgggtctcacgagcggcggcggtggcctcgtggtttgatctgtcgggaagaagggaaggtgctgttcctcccaaggccgggcggcccagaacagccagggctcgccaccacaggcaccacaccccgtccctccagtccacgcacctcacctccggcccctacgcggcaaacagggtcacgcccnnnnnnnnnntgaggccgggcggcccagaacagccaagccttgccgtcacaggcaccacacccagtccctccagtccacgcacctcacctcaggcccctacgcggcaaacagggtcacgcccgcgatgtgaccgccgggcagcgtctcgaagaccacgccgcagtaggcgtgcagcagcgtgggcgggcggggcggggcgtgcgggccgccgccgccgccc

SEQ ID NO: 42765 - DNA, 94 bp, Chlorella protothecoides
acctccctcgcccccaccttcaccaccacccctctcacctccgccctcaccaccacctccctctcccccacattcacccccaccttcaatctca

SEQ ID NO: 42766 - DNA, 3099 bp, Chlorella protothecoides
  modified_base (186)..(322): a, c, t, g, unknown or other
  modified_base (1416)..(1464): a, c, t, g, unknown or other
  modified_base (1819)..(1828): a, c, t, g, unknown or other
  modified_base (2010)..(2019): a, c, t, g, unknown or other
  modified_base (2659)..(2668): a, c, t, g, unknown or other
ccccccaacccccctcctcctgccgcagcatccccagccagctcaaggtgtgcagccaggccctgtacatcgtgccccgcgacgaggcggaggccatcctgcgcattcccctcgccgccatcgactctctgacggagctggagggcgagtcgacgcccaccggcgaggacctgttggccgtgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgacctctccctggtctacgtgtcgacggaggaggctctgcccctgctgcgcgagctgctagcgctggagtcgcgcgcgcgcggcggcgacgccgcggccgcgcgcgcggctggcgctggcctgcgcgacctgatcgcggcccacgaggccggcctgcccttcaacctgggctggctggaggaggacggcgaggaggtggcggccgaggcgctggccgccgcggtgacgccgctggtggagacgcggggacgcgtggtggtcacccaggcccgcctctacttccagcccttcaacctggcggcccaggccccggtgcagagccaccgcctggaccgggtgacggacgtgcagcgccgcgcctaccgcctggccgacctggggctggagctgttcctgtcggggcgcgagtcgctgtacctggccttcgacgacccgccctcgcgcgcgcgcttccaggccgcgctggagcgccagcccgcgctgcgcccgctgcgcccgcgcagcctgcgccgctggcagcgcgagtgggtggcggggcgcgtcagcaactttgactacctcatgcacttgaaccgcgaggcggggcgctccttcaacgacctcacccagtaccccattttcccctgggtgctggcagactacaccagccgcgagctggacctggacgacccggccgtcttccgcgacctggccaagccggtgggcgcgctgaaccccgcccgcctcgccgacttcaccgagcgccaccgcgagctcaagaagatgacgcagccggtgggcgggtgctggggggctggctgggttttggtagggaggagaaggggggagaggaggaggaggggagaagggggggaaaaggggggaagaaggggggaaaaggtggggtgaagtgtgtgtgtgtgtgtgtgtgtcagccggtagggagaggggttctcaacccgacttgccgcctgtgaggcgcaggtgacatgctgatgtcggggaccgagggcatcagaccttgcacacgccatctcttttggcaatgcgcagcagggcacgaccgagtcttctacctccatacccattattcccgagaacccccccccccnnnnnnnnnnnnnnnnnnnnnnnnnnnnnnnnnnnnnnnnnnnnnnnnngcaaacgcagggcaccgacagcaagggcaacccgctgcccggcctggacatgccgcccttcatgtacggctgccactactcctcccccggctacgtcgtcttctacctgctccgcgccgaccccaagctcatgctgcgcctccagaacgggcgctttgacgcgccggaccgcctcttctggtccgtggcggactcctggaagtcggtgctcacgcttcccaccgacgtcaaggagctgaccccggagttttactccaacgatcccaccttcctggtgagtttgcgggtgggggtgttggagtggtgcaggtggggggggggccgagcggggcctgtgatgctggtggccgggggnnnnnnnnnnccccaccttcctggtgggtttgcgggtgggggtgttggagcggtgctggtggtggggggcccaagcggggcctgtgatgctggtggccggggggtggcggggagatgcgtcacgtcccggggtgtcctctggatggggtgcaggagcacgtgctcatctccagcagagtgggacgatggcgnnnnnnnnnntttggggtgtcctctggatggggtgcagagcacgcgctcatctccagcagagtgggacgatggcgcgcacaccgtgacccctgaggcatgcgaaccgcagcgggtgctgccgtgacggctgggatccagcccgtcagggttctcgcgtgcaaggctggtgctgagctgcgacgcccgggcccgcccacaaccgccaatttcaggtgggccgcgaaggccagacctttggaaagcgcgccaacgggcaggaggtggggcccgtggtgctgccgccctgggcgcgggacggccaggatttcctgcacaagatggcgcaggcgctggagagccggcacgtgtcggcgcgcctgcacaagtggatcaacctggtgtttggctacaagtcgcggggccagagggctgaggaggcggacaacgtcttccactacctcacctacgacgagatgtacgactggtttgtttccgtgggagtggggagaaggggtttggaaagggtgggggggtggcgctcctgtatgttccgccccgacgcagcgggatcgaatgtgttgccgctggggaggtgtggagtgagcgggggggtagaccacggcggctaccgggggcctcgctggcttgacgcacctgccagccgtgatgnnnnnnnnnngattggaaagggtgggggggcggcgctcctgtatgttccgccccaatgcagcgggatcgaatgagtcgccgctggggcggtgtggagtgagcgggggggtggaccatggcggctgccggggacctggctggcttgacgcacctgccagccgtgatgtctgacggatgcctgggacggccaaagccgcagcaatccaacccccacccgaccgccttccacgcaaacccaacccgcagcgcggagcgcttcctggcgcgggaggaaaatgacaccctggccgccggactgcggatgcagatgatggagtttgggcgcacgccgcgccagctcttccaccagcgccatccgcgccggcgcctgggcggcacgcccgccctcctgcgctgcctctgcctggcgcgcccgccgccgccggtgctgcccaccgcgcc

SEQ ID NO: 42767 - DNA, 67 bp, Chlorella protothecoides
ccatccagcaggcgggacaatgatggcagggagagggtgcgcagctggtcctgcccggcctgcccca

SEQ ID NO: 42768 - DNA, 122 bp, Chlorella protothecoides
cgcctgccagctccccaacaagccagccatttcctcagcccataaggagccacccgtgttcgccccaactcacagcgtgggcgaatcggcgcgcctgtttctccttccaggctctttctttc

SEQ ID NO: 42769 - DNA, 66 bp, Chlorella protothecoides
gcgggctggcctccctgagtacgtctaccctctccgctccgcccaggcagcaggggcgggggctgg

SEQ ID NO: 42770 - DNA, 61 bp, Chlorella protothecoides
gatggcggcgtgctggccgacccaggagtccgcgccgccgccgcccgccgcccaaggcggg

SEQ ID NO: 42771 - DNA, 79 bp, Chlorella protothecoides
gcgccgccgccgcccgccgcccaaggcgggtacgggttgcgcctgacggcgccgtcgagggctgccagatctgcatgga

SEQ ID NO: 42772 - DNA, 173 bp, Chlorella protothecoides
cccccgcccccccgccccctcgaagccactcccccccccaaccccacccaggtcccacctcggcgtagatgcgcgcgccgcgcgcccgtgcatgccccagctcctccagcagcacgacccccgccccctcgcccagcacgaagccgtcgcggcgcgcgtcgaagggtctcgag

SEQ ID NO: 42773 - DNA, 101 bp, Chlorella protothecoides
tccccgtaccctgtggaccctgtccacccatccaagcccaagcccaagcccacacccagacccagacccaaacccacccgactccatgaggcaggtctcgt

SEQ ID NO: 42774 - DNA, 105 bp, Chlorella protothecoides
actgaccctggccctgaactggccggggccggccgacgccgcgcaggcgcgggaaagcggggcttcgagggacgcgggcgcggcgctcgtgcgcggggcctgcag

SEQ ID NO: 42775 - DNA, 63 bp, Chlorella protothecoides
gaacgtggcctggcggccgcaggtgtggccgccgaggaggtgacctacgtgaacgcgcatggc

SEQ ID NO: 42776 - DNA, 100 bp, Chlorella protothecoides
gaagaaggagcagggcaggtccagcaccacatagggcaccgcggccgagggcgggtctgaggagccgcgcgccgccagcaggcgctcccgcgccctgccc

SEQ ID NO: 42777 - DNA, 53511 bp, Chlorella protothecoides
  modified_base (891)..(900): a, c, t, g, unknown or other
  modified_base (1287)..(1334): a, c, t, g, unknown or other
  modified_base (1524)..(1533): a, c, t, g, unknown or other
  modified_base (1729)..(1738): a, c, t, g, unknown or other
  modified_base (2413)..(2422): a, c, t, g, unknown or other
  modified_base (2559)..(2568): a, c, t, g, unknown or other
  modified_base (2765)..(2774): a, c, t, g, unknown or other
  modified_base (2934)..(2943): a, c, t, g, unknown or other
  modified_base (3019)..(3028): a, c, t, g, unknown or other
  modified_base (3300)..(3309): a, c, t, g, unknown or other
  modified_base (4160)..(4169): a, c, t, g, unknown or other
  modified_base (5600)..(5609): a, c, t, g, unknown or other
  modified_base (5829)..(5953): a, c, t, g, unknown or other
  modified_base (6048)..(6057): a, c, t, g, unknown or other
  modified_base (6172)..(6272): a, c, t, g, unknown or other
  modified_base (6374)..(6383): a, c, t, g, unknown or other
  modified_base (7458)..(7467): a, c, t, g, unknown or other
  modified_base (7981)..(7990): a, c, t, g, unknown or other
  modified_base (8555)..(8564): a, c, t, g, unknown or other
  modified_base (9730)..(9739): a, c, t, g, unknown or other
  modified_base (10139)..(10148): a, c, t, g, unknown or other
  modified_base (10328)..(10510): a, c, t, g, unknown or other
  modified_base (10572)..(10798): a, c, t, g, unknown or other
  modified_base (10878)..(10887): a, c, t, g, unknown or other
  modified_base (12937)..(12946): a, c, t, g, unknown or other
  modified_base (13508)..(13517): a, c, t, g, unknown or other
  modified_base (13986)..(13995): a, c, t, g, unknown or other
  modified_base (14520)..(14529): a, c, t, g, unknown or other
  modified_base (15486)..(15495): a, c, t, g, unknown or other
  modified_base (17389)..(17398): a, c, t, g, unknown or other
  modified_base (17872)..(17881): a, c, t, g, unknown or other
  modified_base (18093)..(18102): a, c, t, g, unknown or other
  modified_base (18234)..(18243): a, c, t, g, unknown or other
  modified_base (18440)..(18449): a, c, t, g, unknown or other
  modified_base (18526)..(18535): a, c, t, g, unknown or other
  modified_base (19054)..(19063): a, c, t, g, unknown or other
  modified_base (20165)..(20174): a, c, t, g, unknown or other
  modified_base (20331)..(20340): a, c, t, g, unknown or other
  modified_base (20483)..(20492): a, c, t, g, unknown or other
  modified_base (21044)..(21053): a, c, t, g, unknown or other
  modified_base (21446)..(21455): a, c, t, g, unknown or other
  modified_base (22469)..(22478): a, c, t, g, unknown or other
  modified_base (23243)..(23252): a, c, t, g, unknown or other
  modified_base (23636)..(23645): a, c, t, g, unknown or other
  modified_base (23813)..(23822): a, c, t, g, unknown or other
  modified_base (23966)..(23975): a, c, t, g, unknown or other
  modified_base (24055)..(24064): a, c, t, g, unknown or other
  modified_base (25944)..(25953): a, c, t, g, unknown or other
  modified_base (27050)..(27059): a, c, t, g, unknown or other
  modified_base (28682)..(28691): a, c, t, g, unknown or other
  modified_base (28770)..(28779): a, c, t, g, unknown or other
  modified_base (29304)..(29313): a, c, t, g, unknown or other
  modified_base (30017)..(30026): a, c, t, g, unknown or other
  modified_base (30452)..(30461): a, c, t, g, unknown or other
  modified_base (31160)..(31169): a, c, t, g, unknown or other
  modified_base (31642)..(31651): a, c, t, g, unknown or other
  modified_base (32319)..(32328): a, c, t, g, unknown or other
  modified_base (32924)..(32933): a, c, t, g, unknown or other
  modified_base (33111)..(33120): a, c, t, g, unknown or other
  modified_base (33288)..(33297): a, c, t, g, unknown or other
  modified_base (34727)..(34973): a, c, t, g, unknown or other
  modified_base (35081)..(35090): a, c, t, g, unknown or other
  modified_base (35409)..(35418): a, c, t, g, unknown or other
  modified_base (35788)..(35797): a, c, t, g, unknown or other
  modified_base (38017)..(38026): a, c, t, g, unknown or other
  modified_base (39214)..(39223): a, c, t, g, unknown or other
  modified_base (39526)..(39535): a, c, t, g, unknown or other
  modified_base (39945)..(39954): a, c, t, g, unknown or other
  modified_base (40251)..(40382): a, c, t, g, unknown or other
  modified_base (41406)..(41415): a, c, t, g, unknown or other
  modified_base (42220)..(42229): a, c, t, g, unknown or other
  modified_base (43345)..(43354): a, c, t, g, unknown or other
  modified_base (44928)..(44937): a, c, t, g, unknown or other
  modified_base (45651)..(45660): a, c, t, g, unknown or other
  modified_base (46010)..(46019): a, c, t, g, unknown or other
  modified_base (46558)..(46567): a, c, t, g, unknown or other
  modified_base (46670)..(46789): a, c, t, g, unknown or other
  modified_base (48220)..(48229): a, c, t, g, unknown or other
  modified_base (49088)..(49097): a, c, t, g, unknown or other
  modified_base (50204)..(50213): a, c, t, g, unknown or other
  modified_base (50599)..(50608): a, c, t, g, unknown or other
  modified_base (50782)..(50791): a, c, t, g, unknown or other
  modified_base (51439)..(51448): a, c, t, g, unknown or other
  modified_base (51803)..(51812): a, c, t, g, unknown or other
  modified_base (52102)..(52111): a, c, t, g, unknown or other
  modified_base (52294)..(52303): a, c, t, g, unknown or other
  modified_base (52881)..(52890): a, c, t, g, unknown or other
gccccacagcttctggggggattgatccaggtactgcaggtggcctgacatgctaccccactctccccataggtgctggcccgctcatcgcccaccgacaagcacacactcgtgaggaccctgaagcggctgggggaggtggtggcggtcactggtgatggtaccaatgatgcccctgccctcaaggagtcggatgttggactggccatgggcattgcaggtgggcagactgtggggcggagaaggggttttgcatgtttgagtgatgcgtctatcggggcgtgacagtgcatgagacttgtttcgctccccttgtagttctgcatgcctgcagtcttcccacttcatccacctgcgtccaccaagtctaatatttcaccaccctgatttacctcgctccctccaggtactgaggttgccaaagaggccgctgacatcatcatcctggacgacaacttctcctccatcgtcaagtcggtgctgtgggggcgctctgtcttctccaacatccgcaagtttctccagttccagctcaccatcaacctggtggccctcacggtggccttcattgccgcggtgtccaagggcgagcagcccttgaatgtgctgcagcttctgtgggtcaacctgatcatggactctcttgccgccctgggtgaggccgggaggtcgaaaaggggggggaaagttctgtctgtgctgagcagtggcctggctgccctaatgcatgagatgccacatggtgtggcagggatgcagggtgcaaaaagactcctccaacccttgggccatcgcagaccaccaagccatccccagtacacagatatttgggtctgtgaggtatcacagctgcctcaatgttgcctcttctcccatccctcaccctccctnnnnnnnnnncggtgaggccgggaggttgaaggggggggaaagtcctgtctgtgctgagcagtggcctggctggcctggtgcatgagatgccacatggtgtggcagggatgcatggagcaaaaagactcctccagcccttgggccatcgcagacctccaagccatccccagtacacagatatttggtctgtgaggtatcacagctgcctcaattttgcctcttctcccatccctcaccctccctgcagccctggccactgagaacccgacccccgacctgctgctggagcggccccacggccgcaacgagtcgctcatcaacaagaccatggccaaacacatcgtggtccaggcgttgtaccagtgcttctggctcttcctcatcttctacggcatnnnnnnnnnnnnnnnnnnnnnnnnnnnnnnnnnnnnnnnnnnnnnnnngcccagctcccagccttcgccatacccagccagtgcgactactaccaggcgcagacgacgctgtgctgcgaggcaggcagcgccgcctgcctgcagtctggcggcggcatgtacctcccgggtaggtgggggggggagggggggtacataatgggttacgagagatgaaagaagaaagggagctttgcannnnnnnnnntgggtggtgggggggtacatggtgggttatgagagatgaaagaagaaagggagctttgcatggttcaagatgaggtgcaccttggctgaccaccgtgtaggtccttgataggcctggatgaacttcttgcggcgcttggtctgcatgcatcagcgtatataattaattgtgcagtgcttggtctataatgactctnnnnnnnnnngtgaagttcttgcggcgcttgctctgcatgcataagcgtatatgattgattgtgcagtgcttggtctataatgactctcattccttttggaacgccctcaccacacccccaccccacacatgtttacaggtgagacgcccatctgcgtcacgtatccagagggtggctgcaccatcaccgagccgagccagacggggttctgcagtggcgaggagacgggctgcagccgctacaccagcatgcagagtgcttacgacgccgcaggtagggtgatcatgccagtcgaggagtgggcggggagagaggctgggctgcaccgcctcagagtggagtgggcgcaagaccctgtgggattgtcagcgtcagtatatctgaatgtcacactccatgataaagccacctggcctcccctctacgtgcagagagtggcttcacctccactgaggagacagccaagcggctgacaaacagcatggtcttcaacaccttcatcttcctccaggtaagcgctgtgcatgggcatgcactggcggcggctgggctgtgcagggcggggcttgtttgcgagtggtgagcagccgccatgcatcgcgtctgcccctgtggctttatgagctcaactttcctggctcacatctaccgctttccccatcacgcacagctgttcaatgagannnnnnnnnntgcaaaaccctgtgggattgtcagcgtcagtacatctgaatgtcacttcccatgaaaaagctacttggcctcccctccacgtgcagagagtggcttcacctccaccgaggagacagccaagcggctgacaaacagcnnnnnnnnnncctcgccctcaccgtcgggttccaggtgactgcctgtggggggtgggcggggacgtgggtggggccagggggagaggttgccagccgaggggcttgagccactggggtattcgatcatcaggcgaaacaggatggatcttgaccctccagatggggtatcggtgcaaacggggagggatcagacggccttgaaaccnnnnnnnnnngcgcgtctgcccctgtggctttatgagctcagctttcctggctcacatccaccgccttccccatcacgcacagctgttcaatgagatcaactcgcgcaagatccgggacgagctcaacgtcttcaagggcttcctctcctccattgtattcaccgtggtnnnnnnnnnnttacgagggaactcaaaccctcgttcctcccggcataaagctgcattggccatggagaccctacccaagctcagtnnnnnnnnnngctcgcactcaccgtcgggttccaggtgcgtgcctgtgcggggtgggcggcgccgtgtgtggggccagggagagaggtggccagccgaggggcatgagccactgggggatttggtcatcaggcgaaatgggatggatctcgacccttcagatggggtattggtgcgaacggggagggatcagacggccttgaaacctttgtcccgtcaaggtgctccctacacacctcactccaccccaaacccacgtgcccatgcaggtaatcatcatgtnnnnnnnnnnatcccgtcaaggtgctcccctacactcctcaccccaccccaaccccacgtgcccatgcaggtaatcatcatgttcttcctcaacggcatcttcaagaccacgcggctgtcgggcctggaatgggccctgtccatcatcatcggctcgagcgtgctgctggtcagcctgctgaccaagctcatctccaggtgggtagttctggggtatcaacaaggggattcaacccctctttcctcctggcataaagctgcgttggccatggagaccctacccaagctcagtggcccaatgcaccaccctttgtcggtgcaggcgctttttcccgccccaagaaccaacagaggaggaggaggaggagaggcgccgctctttccacgcacccgaggatctgtaccgcctgcactggtggcagtggctgcgtcccccgccccccgcccacgtcaagagcgcctggaaggagcagaagcaggaggccaaggctgcgcggcgccggcagcgctctgggaatgcccaggtggcggtcatgaccgcctgagtgtggcctgtcgcctggaactgacgctctccgaattgctaaccttgctcgatgctgccatcaggccgtgcaaagccggtctgtgccttgtgtaccctgtaccactccttctttatgccacatcagcacaacaacatgtaaagcaggcatgcatatcagacagggtgtgcaaccatttgcaaggagccctaggcttgggaggagcctggggttcactaaggaagaatatttgccatggtccacaccaatccactgatgcaaaaagtgctcgtgacccatcagtctatagcatcatcgatcaggcggggcatccccnnnnnnnnnngagaatatttgccgtggtccacagcaatccactgatgcaaaaagtgctcgtaatccatcagtccatagcatcatcgatcaggcggggcatccccttcactcggtgtcctgggtggaagtggcagaggcctcgtccgcactctcctccaggctgaactttgccaggtagacgtcgccaaaggtcacctccccgcctggcaggacttccctctggaacagaagggatggaggggatgccaatcagatacaaaagacctttcaccccaaacgatcggcttgtgctgtcagattgggcaggcaacaggggtcagtgcgatctatctcgccaacattcccatcacatttactcacctcctcattcgcgggcagctccttgccgtctacaaacgttccattggtggagcccaggtcggtcaccaggatcttgctgctctccactgcaaggagatggatgcaaatgggatgtggtgcgtccaggagcttgcagggagtccaagctggtcatcgtgttgaaaggatgcaattgcatactgctcttcctatgggtcaccattcacagcttcatggcattatacataaatggtgggaaaaaacatgatctcacaaacaaaatctgtatcatgccctcggcatccacgtccagaacgttaccaagtcccaccacccacccttgatccgagcatgcttccccgacacggtggggatgtcgagtcggatgtcggcattactgctgcgacccagctccagcgtgccggacctcaacgagatgggcccaggctggaccagatcatcctcccccttcagatggtccttgctgccatcgccattgggaacgagtgtcagcttggcgctgatgcgggtggccttcggtcggctccgcaggggccctgcatggagacggggtttttggtacacctcggcactgggatctgggagttgggccccttacacggcccgatcagtgcatacctctactaaatggggccacagaggtgtggggaagagacctcagcatcgcctgtgtggagaaagggacacgggagtgtggagtatctccgaagatgaagcagatgcatggacggccgggtgcatttccgtggggccccgaaacaagcacagcatggcgcaccggcattgcaatgtccttggtcgactctcgatgaaatgggtgtcagctctgggtttgcagcatggatgcccatgatgtagcccgggaagcacgatggggcgtgcgaggcgcgcaggtcgccaaaaggaaagattcgggcggaagcaagcgcgagatcaaaacccactgtcgacatggcccaatcatgggtggcaagtctacctttactgcatacttctacattggatagttgcaagcattataatggtgacatgaatgccctttcaaaagaagcgtgggccgtcacggagccgtggcggtgannnnnnnnnntacgttctggacgtggatgccgatggcatgatacagatttttgtttgtgagatcatggttttttccaccatttatgtataatgccatgaagctgtgaatggtgacccataggaagagcagtatgcagttgcatccattcaacacgatgatcagcttggactccctgcaagctcctggatgcaccacattccatttgcatccatctccttgcagtggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagatgatcttttggggtgaaagatcttttgtatctgattggcatccccgtccatcccttctattccagagggaagtcctgccaggcggggagnnnnnnnnnngttcgctcccggccagagaaagcacacagcggtggcaaagcttaggctgggactgcaatgccgcaagatccatccagactcacacttcagcagcgcttgctgcagcgagagaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacggcttcttgcaaacgcttgcaccccctgtctgatgtgcatgcctgctttacatcttgttgtgctgacgtggcataaagaaggagtggtacagggtacnnnnnnnnnncttcgctcccggccagagaaaacacacagcggtggcaaagcttaggctgagactgcaatgccgcaggatccatccagaatcacgcttcagcagcgcttgctgcagcgagagacccagggcgcatcagtgagctgttacatggagctggtcggtctgcatgccatgaaaccctgctttgcatctgcttcatcgagcggtaaccccggcgatcatctgcccctccccgccgctcctcctcagaccagcgatctccgacagatgtacgagcacttcaacccctgcgatgcagcaagggtgctgactcagccccagggcctgcaccccgcggggtttacgccctgtggccgcttcctcaccgccttccagcatgcgccgctggcgccccacgcccacgaggtggcggtgctggccgtggagggacccggctcgagctgggtgggcgctgcgcctgtcgcggagagatcgtacccccgggcccctcgccgcctgccccctgcgccgctgctctcctacttcccgctgctctggagggcgcaggcggtcattccaggtcaggggtacatccgcttcacagacgcgccggtgagagcttggaggaggaaagtaaggacaaattgaagggtagatgtgctagatgtagtgcctggctcgtgggaggcaccacacctacatgggaaggcacagctctgtgtcattggactttcgcacttggagcaggtcacagaggacttctgtcctccacccaatcgatcccaaccccacccttggcttcctattctcctcagctggtgatcggcaagtacctgatggtcgtgtgcgcctcgttcgagcacagcaggggctctgccgcaggctcgcgcgactcctgccattcgtatcgctggctctccctcaaactggtgtggtttgtgggtgtggactgtgcgtgggacacaggcatggctgcgcagaagatcttgagcatgcaggaaaggagcgctgtgcctacagggcagcctactggcgtacccagctggttgctgcccagggtggcagagctgcaggaccccgagcatcccatccaatcactacccannnnnnnnnngtacagggcagcccactggcgtacccagctggttgctccccggggtggctgagctgcagtaccccgagcatcccatccaatcactacccagctgcaccctcctttcacacccccaaagtttgcgttggcgaccggggagccgcacggagtctgggacatccagaacgactacgtggatgacttcaatcttggggttcaggcctccagggaccgagttgtggtgaccctggtgggtcgagaatgtcggttggggtctggcaccagtggccaatgtttccggcccctgccgcagcaacagcccagatgaaggcgcaacggtcttttgaggctcctgtgcaagatgcaggatgaaagttccacccttcgcaatgtgcatgcattgcctgcatgctccagcggagagcctgagtgttgtcccggccgacaacatgccagacacgttccacccccccacacacacacttactcccctctttgccacctaacattccctgcagcaacggagccgcagcgnnnnnnnnnnatcgcaatgtgcacgcattgcctgcctgctccagcggagagcctgagtgttgttccggccgaccacacgccagacacgttccacccccccacacacacttactcccttctttgtcacccaacattccctgcagcaacggagccgcagcgtgctgatcctgcgcgtcctgccctgtggcgagtttgtcaaggagcgccacatcggcaggaattgctacgaggacgacgcgctcttcctgcacatgcacagtcagcagtccggggacgaagcgggcgcattggccaacggcgactcgcccatcctgccctccctcacccaccgcatgctggcctacgccttccatgcctgctgcggccgggcggtggtcggggcgggcgcggtgaaggcctgggggtgcggcgggccggagggcctgcccttccacgccgtcttccccgtcatcatgaggctgcagctgaaacgggtgggctggcactgcccgaaggggggtggaggggtggggaagtgtaggcaggtgtgtcgggtgctcaaggtaggatggagctggtggcatgcgcggccagannnnnnnnnnatggaggggtggggaggataggcaggtgtgtgtcgggtgctcaaggcaggatggagctggtggcatgcgcggccagaagccccaaggcccccagcccgccccacccacctcgtcggacccccaccctcccacccgcaggccatgccggtggaggacggcaggctggcgctgtgctggcaggacccgctggtccctgcctccgcgccgcgcggcagctggcccgcgcagcgctgggtgggcgtgtttgaccccggcagctctcagtttgaggcgctggagccggtgctggaccgcgagccgctgcacggctggtcagtgcccgggatgagggggcagggatggtcgtgtgtctggaatgtccatgccgctccgggtgtctcctcaccgggtgcatcgggagagtgcagggccccctcctatggccgacgcgtcgggtccccccgtcgaccatgcacagcctctgtcaccaatgtgccgccttgacgtcatgatccaggctcccgtggaccttgacgcctctgcatcgacctccccactcacccgcgatgttccccaagcttgtcaaccccaccctcacccctgcaaccaatcgcgcacaaggtttgccatggccccaggcaggtcgatgtggcccgaccccgtgaccgagtgggaccggcactcgaccccggcgctggcctcccggcgcgcgcagcgcggccgcagccggccgcccgccccggcgccggcccccgcgccgggacgcgaggcggtgggcaccggggtctgcgacacgctgcccctggcctgccagcggggcagcgccagcccctacatggactccaacctcttcatgtacgacgaaggcctgctctgggacagccacggcagcagctgctggcgcaccccaccctcacggtgggtttcttgggagggggggaagtggatggcggggggctgcggtgggagagcggcaaagaggctgctgggcctggccatgcgcgggcgctgacagggagggagcagatggggagcccatgacgccggacgcttgtcggcgtctcgtcggcgccctgtcagcgattcagccctatcacttcttgacactccccgctgccctccctccccacctcgcagcgtcatgaagtggatggccctgagcaggcagtaccgcctgaacttcgtgnnnnnnnnnngttcagccccatcacttcttgacactcctcgccgccctccctccccacctcgcagtgtcatgaagtggatggcgctgagcaggcagtaccgcctgaacttcgtgctggatccctccgacttcctcccgactcccgcagaaggtgtggggcccaggaggtctggtggtgtgtgtcgcaggatcagattggaatctccgtggcctgcgggctggcttggtcctctgcgcatacgagcatggatgcctgtggcctgcgggcactctctcccaacttgtcttgggaggaatgggtggaggggtccatttcctatgcgaaggacctttagtcgccattcatgaaatctagaccgcacatcccatctcatagaagtccttgccaagatgccatggcacgtcccacnnnnnnnnnnctttcctatgtggaggaccttatagtcgccattcatgaaatctataccgcacatcccatctcatagagatccttgccaagatgccatggcacgtcccacactcatgtctcaaacctgcgccccttcctccaccctctccttctccagcatctgctgcaacactccgcgtccgggggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccgcatttcccccatccaggacgaggcgtaccgcctcctgagcagcgcaatcacctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccaagctgcagcatcaaacggtctgaaagccttcgccggacaatcggtaggcccagcttctgtggcagcagggggannnnnnnnnnccgtgctcccgctcctgctggtggtctactgctacggcgtggctgacgtggactccaagatcaccgtcttccatcgctgatggcagggaggggtggtggcgcggcgtaagggtcgccccaccaccagccgcattttccccatccaggacgaggcataccgcctcctgagcagcgcaatcaccttttcacatgttttcccaacaatatcccacaaatctgaccagcggtgttgcgctatgttgccagcttgaccagcgatttcattttctttctaccctgtgccctgttgggtaaccactgtccatgcacggccagtctcagtctcatggcatcaggccttttccacctgtagatactcttcctaaatccaggctgcagcatcaaacggtctgaaagcgtttgccggacaatctgtaggcccagcttctgtggcagcagggggaagctgtcccccccggtctcggtgagttcgaagccccttcccacccgccacaggattccagcatcctcgtccaagaactcgagacaaggatcgccggttacatggaccagccaaatctcatgtacgattgtttcatttgttatctagtcaagtagcgagagcttaccttggccccggtgagcgtcggctgggctgtactgagggttgcgcggcctgggacggtatcttcctggtgttggaccacagataccgaactcccctgtttgaatgatccgatctcagaagcagaagtgacgattcgtggcgctgaggccaccttctcgacacccttgcagcagccatgggggtcgcgactcttgcggggtgccccttgcgccccgacatgacgagcgcgaggacggggctggattccgagctctcgaccacggggacctgttcggagtatgagtccccggagctggcccggactttgaccatgtgccagacggaggaggaggtgctccgggtgctgaccgacctggggctgagccgggagcaggcctccatggccctgcgcctggcactcctcacgcaggccgcggcggggaggcgggctacggaggccaccttgcacgccggccccgagcagcacggcgcaaggcagcagggcttcacgttccagactgggagcaaggcgcccacgggggtgtcggtggacacctccctgtgccacttctcccccgtctcggacggcctgcccccgcgctggaagcccgccggcccccaatctgcatttgcattccaggctgccgtgcacgacaccatcaatgagggagagaccccagggccgatcggcccaggcccgagctgcgaggtcagcgccaagcgcgaggcctcgctctccgattgggtaccaggcaagaaacgacggaacccccctcccggaccccggcgcgcacccgggcatggactggacatcgagcgcagcggcctcgggcgcgcctgctccctggacgagtggatggggtgaccccgggaacatccacgtccctggcccccaccccacacaatctgcagcactacggaactgagaggtaattcaagcatatattcacacgttttgccatcccaccagtcctttctccatacgaactgatcatcgacaagaagccttgcccacaggcgctccgcccccccacactcacctaactgtcccctcgcctcacaccacatctctttgcacccccacaaccctgggaccccgatccccccagcaccgaatttgtgcctgtcactgcaaagccgttttacccttcgagaccgtactactgtctgatatacatgcgcttctactagctgctgtgatgggggctcccgtcctctatgtatgatctgcggagccttttcaaataccgatagtgtgggaccaggtggaacactttcgcactggcggacgtatcatcctcctgcatttgcactaaggctcgatggaaatcgggaagtatcagcgcctactcgcgagtgtcacgctcccctcctccgcggaaccccacatcccggccttggcgagggcttttgccgtctcggaagacacagtacggtgcatctacgcccaagaagtgcagagtnnnnnnnnnngctcgcgagtgtcacgctcccctcctccgccgaaccccacatcccggccttggcgagggcctttgccgtctcggaagacacagtgcggtgcatctacgcccaagaagtgcagagtagagtaaaaaaacgtcatgctgctttgctggcgggcatcgaggcagcaatgacccgatttgataacggtgggtcgatggggcagccgggagggaatggcagtcccgtgtcaccgcagccggtccgtggccgcttcgcaggacgacagtccagtaccccagggttgcttttcccccgcctcaggcgatgacatggtccagattgcctacgccctggacctcccgccctgcatcgtcgcccggcgactgctagaggccctcaggctggggctgggcagggcgggcaccacccttgccctccgagacccggcggccctcccctccctcgtgaagacccccgggctggctgacaccctcctggcccgcctgcggcgcgagctggaggcctgcgtggccgtggacgcggtgtgctgcccccgcgccgacagcgcacgggcgcgggccggcannnnnnnnnncctggaggcctgcgtggccgcagacgcggtgtgctgcccctgcgccgacagcgcacgggcgcgggccggcagcgcgtacgaggagcggctgtatgccagtctgcacgaggccggcgtggctttctggacggaagggggcctcagggcgcgaggtttcttcaagacgccagatgccaagcttcaggtccctgtggcggtgggggggagggtggtccactggatagactccaaggcgacctttggggatgcccggatgcacaggtgggtggctggagtgggagtgcaacccttccggtccgggagattgatggcgattaggcccctgccaggttttaaattcgtgcctgaagccgacctgtgctgaggcacggaggcacgcatggtcaggtaggtgttacttgcatggccctcattgaaccggagctggaccccagcggccagctgcatgcacatggatgtctgtggcaannnnnnnnnntggtccgggggattggtggcagtttggcccccgccaggttataaaatacgtgcctgaagccgacctgtgctgaggcacggaggcacgcatggtcaggtaggtgttacttgcatggtcctcattgtaccggagctggatcccagtggtcagctgcatgcacatggatgtctgtggcaagccctctctcccatgctgtctcttgccgccgtaggactcagctcgccgagcagtatgagctgtatgtcaaccgctttgggcctggcatggtcatctactggcacggctatgtggagggcctcctggagcatcccggcgtgttggtcgtggatgacttccctgccaagtcaagcatcctgcaactgccctgcctctccgttgaacttgtgcgaccctctgaggcccccttccggccggccgtacaggccgcctgagtgccgccgccaccattccagcagagtcacacctattaatccgcagtattgtttttactccactttgttaactcccactgcacgttactggaannnnnnnnnnctgtgcgaccctctgaggcacccctccggccggccatacaggccgcctgagtggcgccgccaccatcccagcagagtcacacccattgatccgcagtattagttttactctattttgttaactcccactgcacgttactggaacccctcgcgatagcatttgtacagcctgcctttttctataggttgaagcaatgcggggcgagccccaggtacctcggatcgcccgccagtgtacacgcaagagccaaccgggggcctaccgaagcgccccgattggagtacgcggccacctctgggccctcgccataagagacactgtccttcctgaaggcgtgtatagaattctgcaagtcgaggtccgcaagtccgatacgtccggcggtcgatactcttcaaaccaaggtccgaagtggaatttgcaccaatgggtccccggctcgagactgaccacattcacttctccctgccacgccctctccggctcattgccacacataggagtgggctgcgatcagtattatgtttgtgcctgtgatccaggcaaccatatgtgtcggatagaaatgatgcccatgggcgtgagggacaaattaagccatgcgcagtgtcgttcttcaatattggctgcaaggatacgttcaccggcaagcagctgaagcgggacctagagaagacgattgcattctactcgacaacggagacgagtgccattgcgaagacgcctttcactgtcctcacttgcctaaattggcaagtggtctcatgagtctgtgctagccatcaaccctgccattccaatgcacacttgcttcatgcagtgcagacctctgcaacgatttgctcatgtgtgcaatggcaatgataggctggcatagactctatgacgattgttgcgcagtgaggcaggggatgaccccggaaagtgtctttgcaatggctctcatgcccatagtcnnnnnnnnnncaggcaggcatagactctatggcaattgttgcgcggtgagacagggaatgaccccgaaaggcgtctttgcaatggctctcatgcccatagtcagcatcctaaggcaagcgtgtgctgagagtcctgtctcatccgcttgacggtatatgtgtgcatgtagccaatgttcagagggtggcaccacgcatggcacctctgtccctcacgcaatcggaggtcagtattctccaacacatacaggtttacttgggccacaagcaaaaacatcacacccgaccgcatcccaaactcgagaatgactttgggatgggagtgggtgcggaggggaagtccgacatgaaatgatgtcgagccggctggtgggcgaaggccggtactcattcaaatgtgcgtagccatctgcccggtaggacggcgggcaatcgcacagacggacggccgcaagggactgaggtccccttgcagggagtcatccacgtgttacgtagatattagattctgtgttagtaaggcttcatgatggcagcaaattcgaacagcagcctcgacggcccccaggttggcctaggtttacgggtctccggacgtggcgaacagtgcaagcaaaccccggacggatggtgggctcaagctcaagtacatgaacagagccttgctattgcggggaatagttgtgaagctatcacaaacttattgaggttacagtctgctggtaactggggaacgagcgggaaactccagcgcgcgagcttcacgtaactgcacagtcacacactaccgaacaaaactccagcggtacgtggttttcaactctgaacaaaccgatttattatatgcaaatccctacaaacggggcgatgacatctctggggcccgcgatgggtcctggcagtcgtctcccaccctcgccacaacgagctcagcaacctcccatcctcgcaccacgtgcttcccagtgcgcgaactccagcactccagcccagctggatgggctacgagtgctcttctgtacccaggacatggactctgccttccagaggaccagggctgtgcttgcgagcacgctgcccggcgtcgaggtaagggagcattcgggtcctggtacttgttgtgggagggcagcccgacgtgcccacccctgacgaaacctacgatcagatatgccacaatgccctttgcaggtcaggcagtgccaccgcctggaggcgggggccgcgttgcagcacgtggacgtagtggtccccatcgccgtgcccatcacggccgggatgctgggggcatcaccccgcctcaagctggtcatccaattcggggtgggggtggacgccatcgacatccccgccgccacccgcctgggcatcaccgtggccaacatcccgtccctcggcaccggcaacgcgctcagcgtggcggagcacgccatcttcctcacgctggccagcctgaggcaccatggcgccatgcgccgcgctctggaggcccagaggctgggtgtgccagaggggctgaccctctggggcagcacggtgctcgtcgtgggctatggcaacatcgcccaggagctggtaaccaggtgggtcggtggttgggggtctggagggatgggctgggggaggggcccttggtggtcctggcggcgcacagtgcagggaggagcgtgggggaggaagccaacctgtggggtgtgtgaacgaggtagcctcatgatggttgacattatctggggaatctgtttcctggaagaacagtgtatccatggcagacttgacggggggtcctgggatgatcaaccgccatggttgccagcctaggttgacatccccaacgttccagaacctcctccttccccttccctttcaacaacccccccccccccccctcccccccccccccnnnnnnnnnnaagatgatcaatcgccatggttgccagcctaggatgacatccccaatgtccagaacctcctccttccccttcccttcaccccccctcaccctcccaaattccctgattccatcctcaggctgcaaccctttggctgccgcgtgctctgcctccgtcgcagcgcctggccagagcccagaaccggcgccgccgcggatctggaggatgtgggaaccttcccagacgacgtcccgcggctggcagcgcaggccgacgtcgtcatcctgacctgtgccctgaacccctccagcgtcggcctggtgggcgccagcttcctggcggcctgcaagccgggcgttcacatcatcaacatcgctcggggtgcgggaggggaagggagtggtgggagttcttgcatgtcgagcagggcgctgtggaatttgaggcagggcaccgtgcacgctcgcgggctggcctcaccattgctgccagtcnnnnnnnnnncattgcctgtcgagcagggcgctgtagaatttgaggcagggcaccgtgcacgcccgcgggctggcctcaccattgctgccagtctcatcaggactgtacctgagtggaactcttgacacgccgtctgctatggtgacaccagcccctccctccatcttcgcaactccacaccgagggatcatctccactgctgcagcgcaaactcatcggcnnnnnnnnnnggaccaccccagcgtctatctcacgccccatgtgggggggataaccagcgtgtcatgtgaggctgggctcagaggtgattgggggttagcctacccggagccacaccacttgaagggttctgatgccaatgnnnnnnnnnnaagcccctccccccctcttcgcaactccacaccgagggatcgtctccactgctgcagcgcaaactcatcgtggtgacccaacccccgctccccaggtggcctgctggaccgggcggccgtagcggcgggcctgcgagacggcaccatcggcggcatgggcttggatgtctactgggacgagccgctggggtcgcacnnnnnnnnnnagcaagtgcacgtgccgaggacacgttctggacgtgctttttgcaaatgcacaccgcaatggtccctgcctctgagnnnnnnnnnncgccgtagcggcgggcctgcgggacggcaccattggcggaatgggcctggacgtctactgggacgagccgctggggtcgcacccctcccacgagggcgacggcatcgcagaccaccccagcgtctatcttacaccccatgtgggggggattaccagcgtgtcatgtgaggccgggctcagaggcgattggggttggcctacctgggggcacaccacttgaagggttctgatgccaatgagcagggaccgatctgcacgccgcaagtgcacgcgccgaggacatgttctggacgtactttttgcgcatgcacaccgcaatggtccctgcctctgagttgtgctccagtttctccatgcaccctcctaccctgccctcctaactccccttcctccctccccagacaacaacatggctgagattctggctggggaggtgcagaggctgctgcagggcaaactgccctcccaccccctgaatcagccagtgaatgctcggctgccgcttgcctgccgggcgcnnnnnnnnnnaacccaccctgccctcccgactccccttcctccctcctcagaccaagacatggccgagattctggctggggaggtgcagaggctgctgcagggcaagctgccctcccaccccctgaaccagccggtggatgctcggctgccgcttgcctgccgggcgcatgcgatggcaggggtggagtgagcccgtcgggagggcgaccctcctcctgttgctctggtgccaagcgctggcgtcagcctggttgaatcgagagggcccttttgtaatccagcactgctacaggggtgccaggacatgcgatgcacagaaacctcgagatgccgagcagcgcatcgctgtgtgcgctccagcacccagacaggcatgcgctcttgcatgctgggtccagcagggccccgccggccggaccccattccgagtgtcagccgccgccccactgccacccctctccctggccgccaggctgtccggcggccaacctggcggcgatggcgcgtgccctctccatggccgcctggaccgccgtctggtcgacgcccgtcgccagggcgcggtgcgcaggcggctgggctggggccgggcccgccggcagccagggctggtgcgcagggagcgctgggaccagcggacgggcggtgacggggacgggcggcggcggcaggggccgggcccctgctgcccgcttgggcagcaggatctctggccgcgcctggaggtcgcctgcacgtttgggatgggtggaagtgcttggaggtggatcaccgctccgccctgagagccttgcacatgtatggtgtaaacaccatcagagacaaagaccaaggggggtatctcctgggttgaggatgcctgagagcaagccatgccaactctgtccatgaaggaacgcgcctgcccaagagttcctcccaccgcacttcctcaccctgtgtcgtgccagaggacgtgaaggagccacgaaatcgtgcctcatttgggtttgtggggccggggccaggcctggcaggctgagtggtcggcagcgggggaggggcgccggtgccggcaggagaggcgctacttggagcccgaggtgctggagggtggggcgggcctgctgcnnnnnnnnnntatgtatggtgtaaacaccatcagagacgaagaccaaggggggtctcccctgggttgaggatgcccgagagcaagccatgcccaactctgtccatgaacgaatgcgcctgcccaagatttctcccgccgcacttcctcaccctgtgtcgtgccagannnnnnnnnnctgctgcgccgcgcccgccggctgcagcggcggcgcgggcgggtgcggcggtggttgctggggggcttgctgcgtcgacctgctgaagtgagcgtccaccgagctgtgtgaggccgtgaagccagcgacagatgcggccgccnnnnnnnnnntggcaacgagggaggggcgccggtgccggcagaaaaggcgctacttggagcccaaggtgctggagggtggggcgggcctgctgcagcaggagggccctggtcgaatctacgtgggcgcggcgcaggtgggggagcagcgcctgcgccgctgggaatcgcttgctgcgccgcgcccgccggctgcagtggcggtgcgggcgggtgcggcggtgggtgcgggggggcttgctgcgttgccctgctaaagtgagcgtccaccgagctgtgtgaagccgtgaagccagcgacagatgcggccgccgcctgcgctgaggtggcggggacgctgggtgcatcaccaaagcccaagccggagccgcccgtctgtggaagaggagaagcgggggaggagtcatcctgaggtggcagcaaccccgcggtcatgagcggcttgcctcaatccaaatctcgagacatggaggaggaccacaatacgttggtgtcacagcccacaggcatacccagtctgtgcactaggtaaaagcacaggataccctcacaacctcccacaannnnnnnnnnaggtcatgagctgcccgcctcaatgcaaatctcgagacgtggaggaggaccacaatacattggtgtcacagcccacacgcatacccagtctgtgcactaggtaacagcacaggataccctcacaacctcccacaagcacgcaccgtcgagcggcggccgcccctgcctcccctgcctcctcggccgccagagcctttgcctcgacccgccccccgtctccagcgagggtctttggaggcgacggcacgcagctcagcggacaccggctgcccggcagcttccaaacaccccacgagctcgcctatttgattgtgaaggcatgggagtcagggtcgcgacgcttgtgatggtagatatgaggagcgttccaaccatatgtgttgtctagaagcnnnnnnnnnngtttgattgtgagggcatgggagtcagggtcgcaacgcttgtgatggtaggtatgaggggcgttccaaccatatgtgttgtctagaagcacggcaaaagcatgccagagaaaacagggaagggcacagccagggcactagccattggaccctcagaacaatctcccacaagccccacctgccatctgcccctcgctgggtaggagaagggtgtatgcgacaccctccttgtccccagccctgcctgtgcgcccaatccggtggatgtaggagtcaatgctcctccctgcatcgtagttcaccacctgagtgcgatgttcaggtggaagggtgggaagagcggtggtggtgagggttttggggccaggatggcctggttatagcacaacagcggggaacactacaggagactgtctggcctcaacaagccctcaccacaaaccccacgtctcaccgtcttcagggtcttgatgtccaggccccgcgctgcgacgtctgtggccaccaggacgtgggtggtacctgcccggaagctggccagcaccgcagcgcgtgagccggcgtccaggtcgccgtggatggcgccggcgcggacgccctgggcggcgagctcggccgccagctcgtccaccctggccttggtgccggcgaagaggaggacctcccctgcatccaccagggtggggaggtgctgacgcagccaggcgcgcttggccgcctcgtcggccaccacctccacgcgctgtgttatggatcgtgagaaaaggggggaaacggggtgaggctttgtgtttgggggatagatatcaatcgagggatgcggtgcagtgaatgccaggtcttgcccgaggctgccaccacgcatgctcaccatgcaactagaatacatgcacccacatcacacatcgagatctgttggacgctgcgaccccatgatgcgcgctgtctagtacattcgcttcttccgggatccgccccactctgcacccacctggctgatgtcttcgttggccannnnnnnnnnactcaccatgcaactagaatacacgcacccacatcacacattgagatctgtgggacgctgcgaccccatgatgcgcgatgtctagtacattggcttcttccgggagccgccccactctccacccacctggctgatgtcttcgttggccattcccgcctcgcccacgcggattcgaaccgggccagacaaggcatcgttggccagcctctccaccttcatcggcattgtggcgctgaagagcaggagctgtctatcgggcgtgggggtgggaagccggagcaatgttggtgtgagccctctgggatgggaaagtgtgtactaccatttgaccgccctgtccctagccaaatggttggccagcaagtcttcacccaatgttgctctgcatcttgtacagtcgaatctgaaagatgctccccctgcaagtctccacgaggcctcgccacaatcacctcgacctcctgccaatttcccccacttcccctatgcacctgtctggtcggatttgacccaggatggaccggatctggggttcaaagcccatgtcaaacatgcgatccgcctcgtccagcacctgcaggcagggcaggtaggtggccgtcggtcattcagtccatggaggagcaaggggattcgtcgccaggcatgtgctcgggcgtgcaacaatgccacagagcacgccagagcgcgggagactctcgccaaaacccgcatggctgccacttaccacatatgtcactcgctgcagattgcaggccttcatcnnnnnnnnnnatcagtccatggaggagcaagggcattcgtcgcctggcatgtgctcggacgtgcaacaatgccacagggcacgccagagcgcgggagactctcgctaaaacatgcatggctgccacttaccacatacgtcactcgctgcagattgcaggccttcatcctgacaaggtcgatgagacggccaggagtgcacaccgctatctacaaggagagaatgcatgagggtgtggggcttgagggggggggcgggatgggtcatggtgggtgctgggattcagggcgacgtgtgcttgggcacccgagctgggggcctgcggccaccgcacgccaggtttgtttggtctttggcgctgcaacccttgctagcctccaaccatccagaatctnnnnnnnnnnacgggcgcccgagctgggggcctgcggccacagcacgccaggttggtttggcctctggcgctgcagcccttgctagcctccaaccatccagaatctgggctgccatatcatcggtcatcaggcttcgtccccaaccccccccccacccacctccgcccccgccttcannnnnnnnnntaatgatgtagcggtggtcaacaggcaaacacctctccctgatcagtacgcaggcctggcacaagcatgattgcaacaccggccgcccccgtctttgccatccaggccagcattcctactacagcaagcctgcggacctttgannnnnnnnnncgcagcacacacccgcagcttatagcccttggcaaagcgatctgcggacggatgtggctcaaggagtgagatgcagccgnnnnnnnnnnggcagcacacacccgcagcttgtagcccttggcaaagcgatctgcgaatggatgtggctcaaggagtgagatgcagccgtccaatgaagtagcagtggtcaacaggcaaacacctccccctgatcagtgcacaggcatggcacaagcatgattgcaccaccggccatccccatctatgccacccaggccagcaatcctactacagcaagcctgcggacctttgagactggcaaaccaaacaaacctcccataccctacacaggagcaggcccgggactcacgggtttcgcggtggatctgctcggccagctcatgagtggggcccacaataatggcgatgggacccttccccttttctagctcccgctgatccatgatgtggaccatggctggcaggacaaaggccgccgtcttgccgctgccggtcttggcaatgccgaggacatccctgcaacgcttttttagggtgagggggaccatgctggacagggagagcaccctccggcggggactcaatgcatgttcctgcgggacgaggaattgggaactccagacccaggatccatgcatgcaccgtgccactggcagcccaggcaatgcaaactgcccagcccacctcccagacaggatggcagggagcgcctgggcctggatcgcggtgggctccttgtaccccgccctcacgatagccgtcaggaggggggcatcaaagccagcttgggtgaatgtggcgatgggccgtggggcgtcgaagcccgagacggtgaggcccagggacctccgtcgcgcactcacctggattattcttgggaggaggggtttggatgtaggtgaggtcgaagggagggacttgcacggtcaacatatacactcacagcacctccgggcacgcccctgactccccactgtcctgaaatgtcttgacccagccgctgtgctcccagcacccacctctgcctgggacatcgctgtcaacgcaggagcttctacataaaagtccttgtcaaaatcctcgtaggtcaggttggggtggtccaggggcgccagagagcccacagcctgcttgaagcctgcaacaggcaacggtggggacataagtaactgggctgtccatgcaggtactttggtacgattatccagacaccgggaagtgagtcaatcttcatgtcacagagagtccaaggcagaacttggacatgcctattgggatcacaatcctttgcaccttgcaaaatccacctacctgaagaattctccagcttgcccccacccacgccgacggcgtctgactctagggcggcggctgcagcggcatacacctcctcgtccgagccgtcagcgcctgccgcaccagactgcatggccgccgccgtgacggctgaggggggcagcgccccggccttctttgcctgcatgacacggagagcacacttggggccatggcaggaagatgcattgctcttcagaccttattcttattgcaataccaaggtagtcttgccgcctaacatccctgcagtgtatgtaatcactcatctaaccgtcagcccaccacacaaggctgtccccataccaacctccaggaaatcagcagcagggtcgagatcgtcgaaacgttctgcagcgggcttgccagctgctcgtgcacttggggcctgggcatcgctagccttctccagctccttcatctctgccatgaaggcatccagagggtccacctcctcctcgtctgcaggtgccatgctgttgcctgcaccacccttgcaatcggggcgcactgcatgcccagttgcttcctcgcagcgcacagccgctgtgacctgtacgagatagttaaatccagtgaagtagtatgctctgcttggtgatcccttcagcannnnnnnnnntcttgcaatcggggcgcactgcaggcccagttgcttcctcgcagcgcaccgccgctttgacctggacgagatagtaaaatccagtcaagcagtatgctctgcttggtgatcccttcagcagcttgcaagttctctccttcaagcaatccccctttcaatgccacccaccagcgccgccttgtcgtcggatgcctcgaaatcctctcctcgttgatccaggaaagcgcgaagctcttcttcagtccatccctggaagtctgtgcccaccggaccatcctgcacttggttcatgtagaggctggtggggtcctgcctgaggaaggaggtcgcccctctccaaccccaagcttgagcggccccatgcctctcaccacaaggccatcgtaatcaacaaaggctccaggctgcttggcctgaaacacacgaggctcctcgtactctctggtaggattgcttgttgggcgcgttcgacccacaacaaactccggaacgccagtggcataagggaatgggcgcttcgacatggtgctgctccccagctacgatcccatgataagcaggtggacacaatcaaccactgggggaacactgttggtcgtaaatcaggtagagcgctttactcagcctcatcgatcagcgtttcatcagggtgcgtgctgcgagcctgctgctcacttggcgcgcccaatcaaacaatgcgtatgtaaccaaccaagactggggcagtgccgaacacatacaataagaaattgatatcagttgtgcagcactccatcatgcgcgcaagtcgcgtgggctcgcgtgcattcgtcgagttccaaccgtgccagcagcaccgggcaacggtactccgggcaaccccgctcggattcagtaggcactggacctgcaggacccctgtggctttaataagagcacacggtggtcacagaagattcatgcaatctattcatgcaactcctgcacaacacacttcaggtgaggtgaggtgggtgacacacagccaaccatgggagtgcctcctctgccaatgtttgacaaacctctgcacaaaagttcagcatctctcctcgtggccgttcaatcttcagtgtcgnnnnnnnnnnacaggacccctatagctttaataagagcacacggtggtcacaagatatccatgcaatctattcatgtaactcctgcacagcacacttcaggtgaggtgaggtgggtgacacacagccatccatgggaatgcctcctctgccaatgcttgacaattctctgcaaaaaagttcagcgtcgctcctcgtggccgttcaatcttcagtgtcggctgcgagcggcgttccaccagaggttgccaccgtgttgaagaccgctgacgccatctgctttgatgtagacagcacattgtgagtgaccagttgtcgcttggcagccctggatctgagctcgcaggcccctgtcagccatgtgcagtgtgcagtggtattatccagccttgtgatgcttttcaaccctttcatcgccctgcagctgtgaggatgagtctatcgatgagctggccgccttcattggcgtcggggaggccattgccaccatgacagcccaggccatgggaggggtggtaacgtttcaggagtccttagcagcccgcctcggcatcatgagcccatctgcccagatcgtggaggagttcctgagcagccatcccccccggataagcccaggtactgcaagatttcaatatatccccaacatttctggggcctggaaaagggatgcctgacgtcagcctctgaccctgatgagcagggtaccccgcatatcgactgagacacaatgcattcacaggctcagtgaccggtgtctaggagatgccgttccatccaaccctccttccactctcattcaaccacaggcatcccggagattgtagcatactgtcaatcccagggcatccaggtcttccttgtgtcgggtggcttccaccagatcatagaccccatagctgccatgctgggcatcccctccaaccacgtctttgccaaccgaatactctacaacgtgagcatggcttggggcatggctggggatgcgaatcggcaagaaacatctggtgtctggccgcctcctcctgccaggacgatccatccgcaacccactctgcgtcacatgacccctcaaaccctcgttcttgcaggccgccggctcttacgccggcttcgacccgacctgcttcacctcccgctccggcggcaagcgggaggctgtccagcacctgcgcgccacccgcggcctccagcgcgtcgtcatggtgggggacggcgccaccgacgccgaggccaaggccccgggcggtgcagacgtgtttgtggggtgagcttgttctcgcgggtcggccggcatgccaaaggggctcagtgatcagattgacctgaggtttcggtggatgccatgcagggcgtggtatgatggggactgcagcccatttccactatccagtaatcccctttcctccaccacgacaggtatggcggcgtggtgcggcggccggccgtggaggcccgggccgactggtacatcaccgacctgcgggacttgcttgccgccctgcagcgtgcatagctcttcctgcaggtacctgtgcaagtgccttgtacatgcatcatcggcatggagtgacaacgttgaccagccgacacgcggcagatgagaggggaggacaggggaggacggggcggacnnnnnnnnnntggcatgccaaaggggcttagtgaccagattgacctgagtttttggtagatgccatgcagggcgtggtatgatggggannnnnnnnnncgtacatgcatcattggcatggagtgacaacgtagaccggccgacacgcggcagatgcgaggggaggacaggggaggacggggcggacggaaacacaccggtggaccccgctgcacgccggcttcaaaggcacaggagcaggttctgcaggccctccagcgcatcctgaaggttgctccctgggggccccgccacctccagcaccacccgcacagaggtggtgggcgccgccagcgccacgcgcgccagcacccccgcgccggtcgcgagctggaaagcgagggggggccccgcccccgcggcggggcgggccagggtctggaaccccgcctggccgatgtggtcggcaaagtctcggaaggcgttggcctgcacggccggaagcacgcccagcggcaggtccacctgcgcgctgtgcgcgctgtgcgccagctcagcccagcgcgccgcaaaggtctggggtggagcggcgtgggcgtgtgtggggttggcgggggcgccatggtcggcaagggtggcaccggnnnnnnnnnncgcgcgctgtgcgccagctcagcccagcgtgccgcaaaggtctggggtggagcggcgggggcgtgcgtggggttggcgagggcgccatggtcggcaagggtggcaccggcccagatgccgctgcaggccactaacagccccgtcttttcgttcccctctactcccacctcggccgtgacggggcgggcgggcgtggggtcgccaaaccccaggccacccagcaggtcggcaatgccgccgtccattggctggccggccccggcccccgaacctcccagactcgcgcccaggtgctgcgctggagcaggcgaggagccagcgacggcctccaggtcgcccagcaagtccaggcccgcgccagcaagagccggggccggcgggaagccaatgccgacgtgcaggtctggggggcccctgccggcacccgccgccggcccagaggagagcgagagcaggtccggtacgctggacccgggcgtggggctgggcgcggcggttccggcactggcctccgaccgcgtgtccacgtccaggagcatccccgtcgggtcggtgggcgcgccctggcctgccccgccctcctccgacccctcgccgtccgtgtcgtacgcccctggcatgggagaggggtgggggccgcgtgggtctttggcagggaccgggaattcgtggctgtgagacttgggcgctccgcaggcgtgaannnnnnnnnncccacgtgggtctttggcagggaccgggaattcttggttgtgagacttgggcgctccgcaggcgtgaagaggactcagggactcccgatgccgccgataccacacctcaccaccccccgccacccaccgacgctggtgatggtggggtcgatgaaggtgtaggccggtgcacggtaaagcaccgacagggtgttcatctcgtcgaagatgcggtcctgcggcgcgaggagggttccagggatggggagcagggacaatcgtggccgagccgagagtcgcgtgctcgccccatgcccacaaactcctggtcgccggcagcaatgagcacgggcacacccttgccaaggcagaacccccccttgatctacaacccccccacgaaacccagcggggcgcacctccacctccgcggcctgctcctccccnnnnnnnnnnagggatggggagcagggacgatcgttggccgagccgagagtggtgtgctcgccccatccccacaaactcctggtcgccggcggcaatgagcacgggcccacctttgccaaggcagaatcccccctcgatctaccccccccccacgaaacccagcggggctcacctccacctccgcggcctgctcctcccccggccgggagatgaggggcagcggcgcacccaggacctctcgcgcggcatgcacgtcgtggcgcagcaggcgcagcgcaaacagcgcgcggtcccggacctccacgtcggcgtcggcggcgccggcggccagtagcgcgcccagcgcgccgcggcactccggcgcgcggcggaagaagaggcggggcaccgccgccagcagtgccagcctcaccttggccgcctcgtccgcgaagccctccaccagggcctccaggaggtagggcgcggactgcacgcgctgcccgtgctcccccagcacccagatgtatgcagcccgctcgtccgggcccgccagcgtctgcatgcggggcagggagttttcaagggtcggggatcttgctggtccttgtgggtgggtgggtaggaggcatcacagtcgcggagggcgagggggagttcacaggcgatggagcaaagccggcgccttttaggagcacatcgctcgtgggaaggagaccgcccgagaannnnnnnnnnctcacaggctatggagcaaagccggcgtctttcaggagcgaatcgctcgtgggaaggagaccgcccgagaaggtggccgcgctgctataccctgcccagacacgctcccaccatcctcttcaaacatccacccacctcggggttgacttccacgatggagtcgacacaggcctccgccgcgtctgggtagcgccgcagtaccaccgccatctggaccaaggtctctgcagtgacgtaatctttttcgtaccccaggaagagcagcaaccgatccaggatgccattgacctccggcacctggcgaggagaatgtgtgcattggaaagagagagggggaggtggttgggatatggacgacgctcagcgtcgaccatggaagattgcagccgactcttgggcctgagccaagtctgcaacgcagtccttgagctctttcgccacagtgatagggtgcgtgctcgctggcgatcaannnnnnnnnntggacgacgctcagcgttgaccatggaagatcgcaggcgactcttgggcctgagccaagtctgcaatgcagtccttgagctctttcgccacggtgatagggtgcgtgctcgctggcgatcaagcggtcccagcatccacccccggcttgtccgccacctcccaccgcccagctctccttcccccccgccaaacagagccgacccaccttgagcgcaatggctgccacggcccggatggcctgccgcgccagctgctcatccacatcccggatgtactgactcagctcctcggcaatgtcgtaggcgttgctggcatcggtcactgccaccaacatgtcgatcttcagtgccttgaggtaggaggggtcctggtaccggcagtagaagtcggtgaagagctgcacagggtgggagggttggaggccggctttagggctagggctaagatgggagaggagcgggcaggagtattcatgtggagggcgatggcgcgatggcaaggagtggggatttgactgatcagagagggccaagtcataccacgctgtcagcacctccatgagggtccaggacgccagcactgatggtggaccctctacgacttgaggatccccaacgaggctcaaggtgaccatcggaatccctgccgacatcccaggacccaccgnnnnnnnnnnagaccctctactacttgaggatccctgacgaggctcaaggtgaccatccgaatccctgccgacatcccaggacccaccggcgcaaaggcgtcagggtggcgcttggcgagcaccagcgtgttagaaagcgcagcgtacaccacctcgtgctccctgccggacaccagggtcaagagggcgtcccgcacgcgacccaggacctgggactgctggtccgggaaggcggccgtgtggttgaggaagagcttgaccgtggccatgaccaccgcgctgttggtgtgggacagcccaaagtccagcacctggacaggggggatgaaaggtggtcttcagatttgggggagcaatttcaggcatggcccttggggagggttgtcaaagagagggcgacgagtcttgcgcggcatgcgcctggctgctgcagttgggtgcggccgctcgtcaccccccctcccaccttcccgccctccacactccctgccacacatcatccgacccccgcacctccaggatgtcgaagcgctcttcctcggaggcggggctgtaatcccccacgatgtccagcacaaagcattgcgcccagtcagagaaggaannnnnnnnnngccacacatcatccggccgccgcacctccaggatgtcgaagcgctcctcctcggaggcggggctgtaatcccccacaatgtccaggacaaagcattgcgcccagtcagagaaggaatggatgtgattgagcagcgagactacgaggtccctggtcaccttcagcgcgcccacctgggnnnnnnnnnncactgccttgctgcacactttgcttgacatgaaggctagcctcatgctcccatgggtgtcccccctcgcaggaatacctgccctgctcgcccctttccccccttcccctgattcagatcccccaaaaaatgttccggcccacctgctgcatgacgtagagacagttgnnnnnnnnnntactgccttgttgcacactttccgcgacatgaaggctagcctcatgctcccatgggtgttcccccgtgcaggaatacctgccctgctcgccccttccccccttcccctgattcagatccccccaaaaacgttccgacccacctgctgcatgacgtagagacagttggccacgacctgcgcgtcgccgtcagccgtgagtgccctttccacctcgcccaacaggccgcgcaggcggcagcccgccgcgtcggcgtgccagcacttgagcacgcccatgaccgccgcctcgcgcacgtaatggtgcgggtccctcaacccggcctccacggccatgaactgggcattaaagaaggggtgagaggcgggttgaggggaagacagggcgtggaatgggctggccggcagctggccgagggtggtgaggccctttcaagtgcccgcaatccagcgaccacccactccaccatctctcccagccatcacagacccctgatcccaacatcaggaaagcgctgcacgcaccacggtgtccatgagctccgggacgcggagggaggccatggagcgcagggccgcgccgcggatggtaggatccaggtccttgcagtcgttgagcagggtctgcaccaccagcagtgccaccgagctgttctggcgcgcggtggtgcgcaggtacaagtactgcatcttcttcagtggcaggtccgacttggacagcgccacgcacttggtgatggggacgaaggcggcagacatgtcgatgccctggaaagagagaaggacggagggtctggggtatacagaccagggattagatgtatctgggaccttcctagggcgacaggctcagcagcgcatgcgggaagggctaccagtaccctgaggggaccttctgcggcagcctggccctgcaccctgcattttgggggcctgcagcaagacgaatccaaaatttagtctcttgcccacctgtgtcatgtagcggagcagcttctggaagcagtccctcttcatctggatgacctcaggcttggcgccgttcatggaggtgaggtggtccaaggccttgcatatctccgcaacctccccgcgagcccgcccgctgcgaccccccctggccatggcggtgagcgcgggtgtctgggcggagtacgagtgaaggtctggcccctctcgagagtgatcgcagtggccgtgctacagggagcctcgcatctggccgaggtgcctgcttgctgaattgatttcactgaatcagcatgcaattggtaagaagttgtagcatcgcatgcagcagctcgatgttcgatatgtttgacccacgcgacacgatcgagcccgtgggcgcgctgggagcctgcatccgttccggaggccgtggggacagctcggagagcgaatgtgcctcccgcagtcgattcggggggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggctctaccttgacaccgcaggatacgggtcctgaccgcccaatcgcagcactacattgcgttgtacgagcacaaatgcctggagaatgctgagctgggccgcnnnnnnnnnntcggccgtggggacagctcggatagcgcatgtgcctcccgcagtcgattcggggggtacacagcagcagaacacatacatcaaacatgattcgaataatcccaaggcgctcgctggctaaagtgtgcagaacggggttggtacgactgccatcctcccttggggttgactccccatgtcgaccagggcatacttggtcgagggacaagctgtggcgcaggcagacgacagctcagagaggttatacagataaatcagtatcgcatgccgagtcccatctttgtgtttcccgtcagatcagttttgccgcacccgggcannnnnnnnnncatacagatgaatcactatctcatgccgagtcccatctttgtatttgccgtcagatcagttttgccgcacccgggcatgtgtgagatgggggctgggctctacccttgacaccgcaggatacgggtcctgaccacccaagcgcagcgctacattgagttgtacgagcaaaaatgcctggagaatgctgagctgggccgccgactggccgcgcaggaggcggacggcctgcaggtcgcagcagtgctgcagcagcggctctcctcctcggccaagcagctggagtctgcaaggcatgaggcagccgggctcaggcaggagatggaggacctgcgctccatcgccgcctccgtggaggtcgagcatgccgcnnnnnnnnnntgagtctgcaagacacgaggcaggcgggctcaggcaggaagtggaggacctgcgctccagcgccgcctccgtggaggtcgagcatgccgcggctctgcggggggccgaggatgggtggcggcgtcgagcggaggtcaccgagcgcgagctggcatgttgccgtgccctcctcgcggaccagtccctggagctccaggctcagcatgcagagcacgcccgcctcctgaccagcatcgacgtcctgcaggcggccctggactcggctgggaggcggccggccgagccagaggctggcgttcccggccgggagcagctgggccagctcgcggcgcgtatacacgacttggtgctggccaaccgaggcctggccgagagactgcaggcctgcggggaggtggggcgcgctgctgggctggcgtggtccagggtgtgctgaggggacgtgactggctgcgtgccagggtgtttgacactcgagcatgcatgagggccatggggcaggcgtggcacccgacagtctctgagcgggtctgaccaccagctgcaaacgccagcccattcccaggaacttctgttcaccggcaagcacacccagatgcaaacctgttgcactgaaccccctcccctcccttttcgaggcagggtgcgcaggatgtgcagcgcctgctggcgagccgagaagaaagcctggcctgcctggggcgggaggcgcaggaggcgcgggatgtcggcgagagggcagcccgccggtctggggctcaggtagggaggcttttggggggggggggagcagcgagctcccaagtagatgactgcacggcatgcgccgtcagccgccaagcctccgtatacccacccctcgattgccaggcgcgggagcttgagctctgtcgggccagcatgggagcgctgcatgccgacatagtcgccctggcggaagcttttgaggcagagaaggcgggtatagcagctgaggcggaagcatgtgtgagggccgcgcaggagagcgcggctcgcagcgagaggtgggaaggcgcttgtgcctgggtggcatgcttgtatggtgggcacggcatgcagaaagaccaaccctcatgactagttttgagaccgcaccggctcttttacctcatctgatagcaacaagtgaatcagtcccatttggcgtgcgtcttttagagggggggcccatcgcggtcctttgatctggctgagccttgaacttaatgatccccgcctaaaagtataccctgatctgctccctgaccccccctccccattcccactttccaggctgctcatgctgcgcaccaaggagctcaacaccgtcaggcgcttgctcaccaggcagcgcgcactgcagcatgctgcccagaccgcgccgcatggaaaagcctgacgtaccaggcaagcagcgttcctgaattaggcgcggcctttggccctctgccgcgcagcgaggatggcagcgtgcccttccctctcagtctcccccttctctccgcggatgaaggcgacgcgcttgggcgtcttcttgttgatctgcttgcgaggctctatgatgcctctttgctgcaggctcttgaatctggagggtttggagggtaggagccatcagccgagccaggggaaacatgactcttgcgtcagcagttgaaatatcctttcaagcgtgctacctggtgccagatccaacgccatagcatcagagcaaaaagcagggacatgatcagtgacatgaccggtttccaggaatcccaatggggcgtagacaggaaatctaagctttggctagccaccggcagtacaactgccatccagctctcaacccctgccagcgcggcagctcgacccacctgtccttggccagagacgctgtgggcttgagtttcctcaggctgccattcacctcgtctgtcgtcagcagctgcaggggcatgccctcaaacttggtcttgcccagccggggcgggagacccgctgtggtctccgccttgtccagcttcgtacaatgaaggtggggggggtgggtccagtcagcgtaagggataccaggcgcaggttgttctgcaccccgtctgggccccaacgggcagcatgcctcgagaatcctctccaactccccacccaccttgcgcctcagccggcggcttgcaagctcctcctgctctgcatcaatctccttcaagagggtgggcaggtttgcgagggcggcacgcnnnnnnnnnncccccatccaccttgcgcctcagctggcggctcgcaagctcctccttctctgcatcaatctccttcaacagggtgggcaggtttgcgagggcggcacgcttcgccttggcagcccgggctgccgcctgtgccacctcggccgccttccgcctggctgcgcgattcctgtccacctttgtcttcttcctctgcagggcagagagaagcatgcacaaggtccaggcccagcgagggtgggagtccagcagtgacggtttctcacgaaggctagctcgggtcacagaaacatctatacgaggaagggacagctcctactctctaaccccacctttattggcccggtcttcgatgccgccccaggctcccctgccccatctatgatgtcttcctcctctgactctggctcgtccacctggagcagcgccagctcatcctcctccacgtcataatccaccttcttgggcggcgccgtcggcatggcatcctgttgtcgttgcaagaggggaagagaggcaatggctgttggcccattgaagagccccatgccatggtacagggtgcactgggcagacagcccaggatctaggctgccccacctgctggtgaatcttcttcatctccgccgccacggccacggcgatggcctcctgctgctcctcggggtcggggttgaaggagcaccccggtgcgtcaacctctacagcacgcacggcgtccctgtgcaggctgcgtgtcgccgctttcttccgggcggcacgactgagcgcggagggcccgtcgtcccacaggtcgtacagccttgttgcgtctttctttccctggcgggcgagcccggtgttccctccggaggctgccaccacaccggcaatgccgttcttctgcgctttcttcacgccgccgcggatctggtgcaccggggtggcagtgtgggcagccgccaggatggcctgggagcggaggggtcgggcgcgggccgcctccttcttgctgagcttggcgggttcctcggcagcaggggcctccacgtcggaggtcgaggggccagcactcgcatcaccctgctgatggcatgcaggggctcaggaggcgaagatccacgtcgtgtgcactcgaatacttgaatcctcgccctctgtcccaagacccagcgcccctcagctcatcccgggagtcaccttgtcgacaaannnnnnnnnntgtcgtgtgcacttgaatacttgaattctagtcctctgtcccaagacccagcgcccctcggctcatcccgggagtcaccttgtcgacaaagaacaagtctgcatctgggacacggtcgaagtccagcccctgccgctcctgcctggatttttctgctgcagctgcagtgacctgcacatcatcatggatttggcagggtatgctaatacaacccatgcaccgtgagcaggaacccccaccatgcgcctctcctaaaacccacatcgtctgtatcgatgctgcgccaagccttctttccccgcnnnnnnnnnnagacttttctgccgcagctgcagtgacctacacatcgtcatggatttggcagggtatgttaatccaacccatgcaccgtgagcaggaatccccgccatgcgcccctcctaaaacccacgtcgtctgtgtcgatgctgcgccaagccttctttccccgcttgggggttcggcgtttcacggtcttccctttggcacccatgttgagtttgatatatgcttatgacctcgacaccccacccgaaccctcctttcgtgttcatgcctggcaccctttgccccgggcctacgatgagggcgccggcgccctcggccagtgggtgctcgacgtcccttgcagagtctcctgggaaggacacgtacatggtgtatttgtatttaccatgctacattgtttccaatgacggatgtannnnnnnnnnttcggccagtgggtgctcgacgtcccttgcaaagtcttctgggaaggacacgaacgtggtgtatttgtatttatcatgctacattgtttccaatgacggatgtaaagagctcgcctcccctccgagtcctcgtatcagatgagctaggccaagtgaagggtgagtgctgggctcgggtgccagcagcggctcgctagaggccgcaacgtaccgtcatccagggctagctagcatggtgcctttgtactgagtatcggctcaagcctcaccatcactcatgcagttgtcgatgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacacctggagcatcctcctactcctcacttcaccaccttcaccgtcaagggggactgtgagcgctgcgagggcgatcacaagcctggcgagcctgcccggcgatggcacccgccccgatgccctgctggtgggccatgcggacggcgaggtgtcgtgcctgcagggtctgaacggcgaggccgccgcccctctccagcctgccgccagcgggagcggggagggggtgcgaagcgtgcacctcgtgcccgggtcgggtgagcccacagtcgtgacggtgtcggccggcggctgtgtgcgcggctttgcccggcagcctgacgacggggcctgggcggaggcctggcggtggcaggcggcctgcaaggaggtggagtgctccggggttgaccccaccggccgcctgctggcggtcgggggcaggggttgcgaactgcgcctgcacgccctcgcagacggcggcgtcgcgtttgccgggcgggggggcaaacccagccgcgtaggcctcgtggaccggccctggaacaccgcactggcctttctgcccccctcccccgcgccggcgggcgaggaggaacccgccggcgcccggctggtggtgggcacgggccaccaccgggtgcggctgtacgacacggccgccggccggcgcccgcagctggacgtgggctggggcgaggcaaaaatcacggcactggcgtctgagcccagcggcgcgcgttgctgggtcgctaacggccaggggcagattgcggtgctggagctgcccagcggcctcgtggtggggggtatcaaaggggccgcaggtgcgatggtggggtttcctgggaggcgatgcaggagtgggtgttctcctcgcctggggcttttgctctctaggtctcgacttggagacgggcgataaggggtggggggacaaaggggtggcgcagtttcctggtggcatcgaggatggtattgccctcgcggtcggtgcgccaagccaggtgcagggtgccaggtgcccgaggcttcatgcgtggcnnnnnnnnnnccggccggtgcgctaggccaggtgcagagtgccaggtgcccgaggcttcatgcgtggcgtccgtgaaacctgttatatccccccgtccctgcgcaggctctgtgaaggctctgaccctccatcccaccctgccaatcctggcatcagccggcctggacaggacgctgcggctgcaccacactgcttccagaaagctcctggccaaggtgttcctgaagagccagctgacaggtgggaggagcacgagttctttgggggattagggccgaagtggcattgggcatgcggccctggcagggtgagagctcgcgtgtagttgcctggctccttaccagtcaaacagcaatctctgaggagaattcactactcgtgcccttcctccaggggctgcctttgccgctgcgccacctcccctgccggaggcgccaaccctaccactaccggcgagcggggggccagggttacccagcagcgcagccttagcacacgcggtgcaagagcctgcttccgagccagaggaggctcgcccggcggccaagcgtcccaagctcatcatgcctagcataaagaagaagccaagaaagggcacaggaccctcgtccagtgccagcttgggaaagaagcgtgtggttgtgagggcatgaagttatgtaacagtgttgcaccgtgtggaagcagttcacaggaagcactgcggcgatgccaagaggcacccccaggcggcaattgcttgaaacaatcagtgagtgcagggagggcagagtcaatactgagacatattctactgcaatgttctgttcgcgcnnnnnnnnnntaggaagcactgtggcgatgccaagtggcacccccaggcggcaatcgcttgaaataatcagtgagtgcagggagggtggagtcaatgccgagacatattgaactgcaatgttctgttcgcgcaccagccgcttccaacaggctgcctccctgccgctagagccgagaggagggctgcagaccctgtgcgctctcctggaagctgtcgagaacctgggcgtggcctgggcgcttgcgatccaggcgcatgaaggcgatgtcgtggcgagtggcgccgctggcggccaggtccttgagcacctcgccaatcacgctggcaaacttgaagccctggcccgagcacgcggagcagaggatgacctggggtggggtggaggacgggaggggtcgagtggcaggggcacccctgtgccgccgtgggccatgcccaggcagatgcagaggcggcctcctcctccagccctcgtcaatccccccacctggggatggttggggtgctggtcgaccaggaagtgctcatctggtgtgttggtgtacaggcagacggcggcatggttcagggcgcccgacgcgccggggaagtacttgtgcaccgcccggcgtagggtggcctcgtcgaggctagtgatgtgacgtgccaccctgtcagggtcgacaatctctcccagatggtggatcttaccaaacttgaaaccgcgggcgtctttgggaaaccctgcacaggcaggcagcgagcatggacctgggctctggcgaggtctgtgaccctgggacacatacactgtgcgccctcggaagtgtcgcgaagctttgttgacgcccgaatggctgccgaccctcagttggtcgcgatcacacactgcagtctgtcaatgatctggagcaccatcttaccatagtagcatctgcgctgctcgagaagattacggaggttgagaaataatcctcctaccccaagtaacccatcatacagtgccattgtgtgtcattcattgagtattcctgcaccagcctccctctctcaaccacccaacccacccacccgcctcacccgtccctgtcgtccatgacaaacatggggaatctgtcagcatcaaagtctgcagacccgttcaannnnnnnnnnccatacagtgccattgtatgtcattcattgagaattcctataccagcctccctctctcaaccaccaaacccacccacccgcctaacccgtccctgttgtccatgacaaacatggggaatcggtcagcatcaaagtctgcagacccgttcaagacctcaaaccagcccaccacctgccgttccacgctgagcaggctctgtgttggtggggtggaacatgggcatgtaaggggacgatgccatgccaggggaagcacagcgtggcaaagcatgcagccgacgcgcacctgcagctcggggaccagcttgggaagccatgccccaggcgccaggatgagcttcctgccctcgtactcccccttgctggtgtggacatggacagtcccctgatcgtccacccgccaccctgtcaccgctgccccgcagaccagctcagctcccgctgagagggcgagagtgagggaggcacgaatgcagccctctggctgcagcacagccgctgctggctcatacatgaactgttgggtggtgatgtataatgctggtgttgatcaaagagtccagaggcatggtgctgtgcaatagagcctgatgcgccaggctttacttcgcattctatcgcgggcgtaccaggggccccttgctgcctggatcccgcacctcttcctgtgcatgaagcttggcaggcaaagcgatccccagcccttcatcacctttgcatcctccgggaaagctcgatagcccgggaagagtttgacagcttcagccttcgccaaaatacggtgctccaaagcatgctcaccagcaacctgaatggcatgctgtgtgcatgagttttccagggtgccctccgatgaatagatgcaccctgtggtctccagcagaacctttgtgtgtggggagggggggggggaaagggggatagaggactctgaagcctggagtgccctttgagcctggacggcactcttgcatgtgcagaatgcgtcacaacaattacccacctgtctctgctccgtcgctcacctgccccgatgcctgctgcaactcctgccagagctggtgggcgcgaccaagaaggggcaaataggaaggatgttccacgtaggctgtacggatcacccgagtgtgcccatggtgggagccgtttgagtgaggcgcctcggcttgagcctccaaccccaagacctgtaagatggaaagccacaccaagtgatgcaattgtaccagacacacgtaagaatgattcaaacggggcaatgccaggcaaactgattcttgagaggccacacaggagcgatggcttgacacggacgagagttgaacaaacagcgagattgtccagcgccggtgtggatctcgccctggcccccggatccaaggtcgggaacccggtctcaccttcacaccagacttggccaagtgatgcagggcactggaccccatggtccctcccgccccaaccacaatcacatcgaacattggcccagttctctagcctgagctggggtcggagggtcgtagtgtacaggtcttatacaccagatctctcgatgtttgtgtcagatttgtaannnnnnnnnnagggtcggagggttgtagcgtacaggtcttacacacccgatctctcgatgtttgtgtcagatttgtaattgttcttcgtcaatcaagataccgccttccggacatctcgaagcatgcagacttgaccccgcgggtgcgccgcgtatcgattggctcgagtcggagcaacatggattagggtttcgtcgtgcgcatctgccatgtcgtcagattcagcagcactgcttctggtttaggagactgtgtgtgaaagatgattgcattactacttgatcatgcattcgtttccagtcgaagcttcagtgttttcaggacgcatagccatacccaggactgtagatgcacgatgtccttggtaagcaagcaatacaagtccatctcaagcacccacatcgacaggcggccagtggcccctgtgccttgatctctcacatcaagatcatgccgaggcgggctcctgcttgccaaactcctcgagcaccgcagcctggcccttccgaaggctgctcagcctcaggaagtctatgtccaggggtgtgccgcccatcagagcaagatccttgaggacctccccgatcacgctgccaaacttgaagccgtgacctgagcacgccgagcagatgaccacctgtgcggaattcagatttgggggaatggacatggtcttggtcgtgtatgggggcctagggcggcggcagcgcatgcctccccggnnnnnnnnnntcacctgtgcggaattcagatttggggaatggacatggtcttggtcgtgtgtgggggtctagggcggcggcagcgcatgcctccccggggctgcgagatctgatccccgtcacgtagaggaatcggcacaccgacctcccagcgacaccctctccccacctgggggtggcgggggtgcacgtctatcacaaagtcctcatctggggtgtttgtgaagaggcaggctgccgcgtggttcagcctccctgcggcgccggggaagtaccgctggactgcaactcgcagcgtggcctcgtcctctgggacgatggctcggtccagggcgtccggctcggtgacctgccgtcggnnnnnnnnnncgggaagtagcgctggactgcagatcgcagcgtggcctcgtcctctggagcaatggctcggtcaagggcgtccggctcggtgacctgccgtcggtggtgcatcttcccgatcttgaagccgtgcgcgtccgcggggaaggcgtagaacatcccggtctcgtcgtcgagcaccgccaccgggaagctgtctgggctgaagtgggaggcgtcgccctcgatgtcaaaccagccgaccacctggcgctccacggtcagcaagctctggggtggtaagtaaaggggagggggtgggagcgggggggattgtgagcccaggtcaggagctctggaagtggaacatgtgtgcacggcgctgtgcttaagagtcacccccaccgtgcagctatggcaggaggttggcccacttccagtccagacacccctaaatcgaaggctcggcaccgccctccagagatgcaccgctctcccaccccaaggctcgaggcaccgaggaacagaaggggccgcacagtaacacccgccttgccttgagctcaggnnnnnnnnnngaagtaaaggggagggggtgggggtggggggggattgtgagccctggttaggagctctggaagtggaacatttgtgcacggcgctgtgcttaagagtcacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccaccccaaggctcaaggcatcgagaaacagaaggggccgcgcagtaacacccgccttgccttgagctcagggacgagcctgggaagccaggcgccgggggccaggatgagcctgtcggccgtgtgggtctgagcgtcgggccctgcctggacgctgacctggccgccgggttctacaccccatcgcgtgacggcggcgccgtacagcacctccgccccggcggccgcggcgcccgcgaggtgggctgcgatgcatcgctcgggacagagcacgccgcccaccggctccaagatgatctggatatttggaagggggatcgagtggggacaggctgagagtgcatgccagcgacacaaggcaagcaggcaggcagaggatgtgggagcaagcatgcgtgacaaaggttgtgaatccaaaccccaggggactcctcacctggaagtcctcgggcggcgcgtacccagggcatcttccttgcagctcggcaggcgtcaggacctcgtgcgtcaggccgtgcagttgggctgaggcctgcgcccccttgaaacaagagtctggcagcgacttgggtgacatgtttatgcaccccgtctccttgagcaggtcctgggggcaggaggggggttgggggaggtgcaacgccatgctagggatgtacgtaaggcagatgcaggggggcccaaggtttggtgcgcccccccttgcagggcaagtcccaatccccttcccagcaaacccacctgcccactctccacctccagctggcgccagagctcgaaggcacgcttcaggagggggacgtagcaagggtgctccgcgtaggccaggcggatgatccgtgtcagcccatggtgtgagccggcggtgtgaggagcctgtggctgggcctccagacccagcacctgttgaatgggaggatcatcagagcacagctgctgaagggaacaccacgtggccaggcctggcctacaggaattttgtaaagtccagtgcttcaactagacttgttgagggccacatgcaatggcctctatagcttcaaaatcacgggaagccgtcagcctcttggaaactctcagccctaacccctcgaatgccgctcgctgatcaatgcgaccgtttcgtgcatgcgccacacccacccttgactccccagcctgcttgccttggacccagactttgccaggtggtacatggcactcgaacccatcgtgcctcccgcgccaaccacgatgacgtcgtagtggcccatctcggaaagcgacctcctaggcgggactcggctcgcgcgagatctcgagcccgtcgcaccgagcaatgcggagtctgtatagttttccagccgatggttgatgtgcaatcctcaacggagctaaaattattctcatggccttgttgcgccgacgagtcgggccgcggcatgcannnnnnnnnnagagcaaaccatcctcatggccttcttgcgccgacgagtcgggccgcggcatgcaagaaataccgacaataaagcttacgagagctgccgaacactttaaccacgagtcgacgtaagtggctgggtcttagcattgcgaaattggatgtggcttggatacgggggggaatcgtcaatggcggaggacaacgttggcgcctgccgccaagctgaaaccctaggcagggcaaaacgattgctaatgccttccaaggcttcacgctgtgagtgaatccactagacacagcttcaaatacatacttgtcacccactcattgttactgaatgacatcagatatggcctaggcccctgtcaaggaaatgagcctctaagttggatgtgaagcatcaaaagtagggcaccaaaggtagggagttatttatagcgatgtccctgtgccacattgtgcatgtatccgaatcagcgatgctgctcccgactggcttcaccatgctgcagcaatgcatgctttgagaaccaaggtgtgggtgcaaggcaaggagatttgtagtcatatatttcacgttcttgaatgtgcgtgagtgtgatggtgaggcgtattatacagcttgaggcaattgtatgatgattgactagaagttgaaaggggaatcgtgaggggaccgtccagcagcagccgcatgtaccgtcctaccacctccgcgcgcttacagaaccgccagcagagtcacggagatgacaccaggttggtaagcttgccagaatcatcctctgaacttcttcaaaacagatttggctcgtctactgacgacaccgtgcatcgaccagcccaggtgcgcactgatggcaggattggannnnnnnnnngttggtgagcttgccagaatcatcctctgaactcgttcaaaacagatttggctcgtttactgacgacaccgtgtatcgaccggcccaggtgcgcactgatggcagggttggagggggcacgcgcttgctcaaggatcccatctcccgccgcgcctccctcgggacacttgcatgatggtatggtttggtgcttggcatgatagttccagtgtctgtgccctctcggaagttgatcgactgaacggtggtggcttcttccggcagtgctgggctcagcccctccatcccgcccctcctcgatgacgtaaagggccccgatcaggtcttccttaacggcccctcccctgcaggagtatcgtagaccctcagtttggtggcgtacccctgactctgaggtgggaccccctgcatgctaacaagggcgggggggcaactccatgtgcccgatcattgtgatcctgagccgtgtcatcagagtcagcatcagtcctttctcagccacatcaacttccattttccgcctgcctctcccaggtgcggcaggcagcgacagcgcagcaggctgcctctgccgccctgcgcctctgcgagctgcaaccttggaccaaggcgccgcgcccggagccgagcaaccggcccgggccctgagacctaacctccgcccttccctggtgggagccagctccagtcgaaggtccccggaccgcccccgccgcgtcgtggcctttgagaccacggtcgtcgactcctcgggcgagacgcagccgcttaacaccgcagagccgtcgtcgcgagccatggacccctgggcatactccgcgccctggggacacaggctgctggaaaaggtcgccggcgggcggggcttctccctcaaggtgagggggtgctggggggggtctgcgctcgtgtaggtgagtaggggcgacgggacgcctttgtggctcgtgcacggcacggtccggtcggctccaagcactgggctgctggagcaaccgagacttggccttgtcatggtatcgcgcttcttcttggactcccctggtctgagttccaaccatcgctctcccctatcacgccgctgctcaccaggcaaacaggttcctnnnnnnnnnntgccggcgggcggggcttttctctcaaggtgagggggtgctgggggggtctgcgctcgtgtaggtcagtaggggcgacgggatgcctttgtggctcgtccacgggacggtccagtcggccccatgcactgggctgctggagcaaccgagacttggccttgtcatggtatcgcgcttctttttggattcccctagtctgagttccaaccatcgctctcccctattgcgccgctgctcaccaggcaaacaggttcctggtgctgggcctcacctttctgtgctacacctcgtaccatgcctcccgcaaaccgccatctattgtcaaggcggtcctgcacggcagcggtggaaacccaaaacccaccgacgccctggcagcaggtgggnnnnnnnnnntaaaccaccgtctattgtcaaggcggtcctgcacggtagcggtggaaacccgaaacccaccgacgccctggcagcaggtggggtggggtctgcttatcaggctccaatgcatgattttaccaggctgtttgtggataagcagatttggtgcgcttttcagtcttcttatgcaannnnnnnnnntccaggatttttgtgggtaagtaggtttggtgcgcttttcagtcttcttatgcaaggtcttaacaagtgggaatctgttcattctgttacccccacccaagagcggtccgcccctcactcccaatgcccattgcctcgtaggctttctcgggagggccgaggacgcaggggggtgggctccattcaacgaccccaagcagggcaatgcgctgctgggggccctggacctctccttcctcgcagcctatgccagtgcgctgggggatggaacgggggttggaggatggatggggtcgcagggtggggcctgcgtgcatcgaccctcaactgctcaatgcatggggcaggtcactgggatgcggtgtgcatcgatggcgtggggcgtgggcagtgagcctcccctcctccgactccctgcacagtcagcatgtttggtgctgggcacattggagaccgcgtggacctgcgatacttcctcaccggtagggtggtcggcgcgtgcatggcgcaactgcggctgcagaggctctttgtgtgcgtccgaggcggctggcacagggtggcgcaagccctgcatgcccgaccctgcccccctcccatccatgcccacagggggaatgatcggcagcggcacctgcgtcatcctcnnnnnnnnnncgcatggcgcaacggcggctgcagaggctcgctgtgtgcgtccgaggcggctggcacagggtggcgcaggccctgcatgcccgaccccgccccccccccacccatgcccacaggggggatgatcggcagcggcacctgcgtcatcctcatgggcgcagcctacttcctcaacatccacacgctcggctacttcatcgccgtgcagatcgtgggaggtgagccggcgtgacggggggtcacttggggccgtttccggtgtgtggtggtttcttctgggagggagagctgtcgctcagcctgcgcccagctcagcacgcgtctggggcgcaagctcaccaaaagcgcgtggcgcccnnnnnnnnnnagggggacacttggggccctttccagtgtgtggtggtgtcttctgggagggagagctgtcactcagcatgcgcccagctcagcacgcgtctggagcgcaagctcaccaaaagcgcgtggcgccccatccgacacaggcttgctgcaggccaccggctggcccagcgtggtcagcgtcatggccaactggtttgggaaaggaaagcgtggcctcatcatgggcctctggaacgcgcacacctccgtgggtgggtccctttgggggggggggggcggggggggggggggggnnnnnnnnnnaggagggagggttgcactggggagggggtgggagaagtggactttccctgggccatgtgaggttgctgctgccttgggagacaggcgaggcatgtctggcgccgcagggaacccaaccccaggtctcccctcaccctccaggaaacatccttggctcgctgctggcggcatacatgctgcagnnnnnnnnnnaggggacccaaacccaggactcccctcaccctccaggaaacatcctgggctcgctgctggcggcatacatgctgcagtacggctggggctggtccttcatcgtccccggcatcgtcatagtcgtgatgggtgcgctgggccagcgctgggagcatgcgggatgccgtgcgggcgccctgctcgcatgtgaatagtgggcccgcggttcactgtgcggcggtgggcttgccggtgacgctcctcccccccacacccctcctgcactatccaccctcgccaggcctcgtcatcttctccttcctggtggtggagccccaggacatcggcttcctgccccagagcggctcggtcgtgggcagcatagtgcgttcctgagcggctggcttgatgggggggttgtgactggtgggtgtgtgcagcggggctgcacccacgcaggggtgcacatatgcagctggccccctcacctgcctcgtgtggggctgccggtgtattccagctcccccttgtctccccccaaccgcccgcccctcgtcccccattcctgcctcccatgaactccgcactccgcgctctgnnnnnnnnnnttgtgactggtgggtgtatgtagcggggctgcacgtacgcaggggtgcacatacgcagctggccccctcacctgcctcgtgtgaggctgccggtgtattccagcaaaccctcgtctccccccaaccgcccgccccccgtcacccattcctccctcccatgaactccgcactccgcgctctgcatcctattcacaggaccacttcacccagcccccctcctctctgagcccccccctcctcccccccaaccacaccaggccgcgtcggaggtggacaccccccgctccgaggcctccttcggctcggacctgggcgacgatgcgcgcgactacctgcagcgccacctgtcggtgatggccgaccgccagcgcggcggcctggtccccgcccacgtcgccgccaagctggcggcgcaccacaccgtgcgccccgcgccgcgccacggcatgtttggcatgggctccacgctggtcctggtggaccaggcgcgcgaggtccccgagcccggcgccgaggacgagctgggcagcctggggccacgcccggccaaggtgcgtgagggtggtggtgtcctgggttatggggatggagggcggggatgtgccggggggggaggggggg

SEQ ID NO: 42778 - DNA, 61 bp, Chlorella protothecoides
tgcccggcaagctggactttctttctcgttaccctgccactgcgagcccggtgtgccccct

SEQ ID NO: 42779 - DNA, 63 bp, Chlorella protothecoides
ctcagtctagtccatcaggccatccctgtgtcaccagcgcctccctgcacaccacaggccagg

SEQ ID NO: 42780 - DNA, 61 bp, Chlorella protothecoides
cggtggcgggcttggtggtagtggcgaggggggtgtgtgcatgcgaaggcgcatgagagtg

SEQ ID NO: 42781 - DNA, 720 bp, Chlorella protothecoides
  modified_base (98)..(107): a, c, t, g, unknown or other
  modified_base (253)..(262): a, c, t, g, unknown or other
gggggtggggtggagcgtgggtgtcgaggaatgcagggggactgcggtccaggcgtctcatgcccttaggcacgagaacaaggacacaggacatggannnnnnnnnncgacggggcggcacttggcaaaggccgtctcgtccgcgtccgactccgcgctttccaggccgccggaggccgccgagccggcctgagcgcgattgttggggtgtagggtgggggtgggggtggggtggagcgtgggtgtcgaggannnnnnnnnnaattgttggggtgtagggtgtgtgtgtgtgggggagggggtggggtggagcgtgggtgtcgaggaacgcaggggaactgcggtccaggcatctcatgccctcaggcacgagaacaaggacacaggacatggaagacgcgccaggtggggatcgcgcagtgcctcgtcctgcgtgacgccaggggcgggccgcatcgatgcccgggaggccccgctgccgacaacccgcagcgctgaggatcctggatgctaccgatgcccatgtgttcgtccctccccttcccccctgcctacacacacactcaaccccccgcacctcctccatgctggtggccacctgctcgctctcctcctcctcttcctcctcctcctcctcctcctcctcctccagctcggtggcggtgtcgccgtcggcctcgtcgcgcgtgggggcgtggccgccgccggcgcgcgcggcca

SEQ ID NO: 42782 - DNA, 83 bp, Chlorella protothecoides
ttggaaacatggacaaggggcccccttcccagccaaatcgataaaacaaaacccaaatgaacaaacatgccttgggcgtgcgc

SEQ ID NO: 42783 - DNA, 61 bp, Chlorella protothecoides
gccggagacgctggaaattgatggtggggggggtgggaccgctggcggtgggggtggttgg

SEQ ID NO: 42784 - DNA, 61 bp, Chlorella protothecoides
gaccgcgacttcgtggcggagaccatcttccccgccagcctgcacctggtgcacctctcac

SEQ ID NO: 42785 - DNA, 2457 bp, Chlorella protothecoides
  modified_base (131)..(278): a, c, t, g, unknown or other
  modified_base (405)..(455): a, c, t, g, unknown or other
  modified_base (896)..(905): a, c, t, g, unknown or other
  modified_base (1962)..(1991): a, c, t, g, unknown or other
  modified_base (2131)..(2140): a, c, t, g, unknown or other
  modified_base (2196)..(2218): a, c, t, g, unknown or other
  modified_base (2288)..(2297): a, c, t, g, unknown or other
cgaggcccggcgcgggcggcggcccgtcccggaagctgctcctcctggcggcgcagctgcaggggccgggcgccgcggccgagcaggccgcggagccggaggccggcagggcgcagcatggcgccaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcggtcgttgtatgaatgcgatgcggtgcgcaggtggtgttcttgggggagcgcggctgtgagctccacattccgcgcctcagccagagctcatcaaacccccccacccccccaccccgccctnnnnnnnnnnnnnnnnnnnnnnnnnnnnnnnnnnnnnnnnnnnnnnnnnnntctaacacgctctgtcagtcagtcagacacgcagcagctcactcatcggcctcttcggaccgtggctgccgcgatcgccgcacacgcgcccgttttgcgccgctgccgggcggcgctgctgccggctcgggggccgccgccgccgccccggccttcttcgtcttcttgggtttgcacgccagggggttgggcccctttgccttgttcctcctgctcgtggtgttgtcgtgacagggtggtagatgtgaggccggggtgggggggcaggtacacaggggagggatgctggccatgctgcaagcacacatcctggcacatcaacgtgaggcaagaaccgctcgagcagccaggctcaactaggccagcatcccaccctcctcccaacgacccatgcacgcagcccagctccacgcacttgaagggcgtcttggggcctcgccnnnnnnnnnntacccatgcacgcattctagctccgcgcacttgaagggcgtcttggggcctcgccgctcgccgtcgtcctcccccgccggccttcccaccccctccagcgtcctcttctctgctgcagagggccgcaggcgggccgacccctgctcggccgccccttccttctgcagggtggagggcatggccatgccgacgccgtgcacagaggtgaagagcacggcgccgccaggctggctcatgatgcgctgctgcaggtcgcggtcctgtgtcgccaccaggaagtggttggggttgccgccacctgccagaggggccgaaggttggaagcagagtggggtgaggggtaccacttgatgcagtgggatgcagcgcactgcgcaattcccagcatgagaagggggcaatggccaggaacggccacggaggtctaggtggcaagggactagtgcactcacccagtcatccatcatgaggatcgacttcctctcactcctcagacctcacctatttgctgcgcaaggcactctgctgcaggcagctttgtggtttcctcgtggccgcagtgatgcagcgccagccgccggcaggcgtcgcgagccttggacagctcattccccatcttgcgaacctcatgcatgatgcagggggtggtgaagacacggaccttgtcaccgagcagctcagaaagtagctctgtggggtcctcgttcctgcagggggctagggctgccgtgagtgcacaatgtgggggccaagcgtgcaactcggatatgcaggtggccgcagaaaaccattcagcacctgttcgcacacgcacctgagaaccgacaccgcattgatgaagttaccatcggccagcactttgaagggagccctgaatccgtgttggattcggtagaagcgcaaggctcggcgcacttgcttgtgcttccttcgccgcatggcggggtagtctggcgaccgaaaaaatgcgaggctctactactgctgacttttgggctaagattcggccggatttgtgattatcaagtaccagtcagcgcgtatacgtctgctgggnnnnnnnnnnnnnnnnnnnnnnnnnnnnnnagggcatgcccgcatgcaacgtattcatttatattgttagatggcatgcaaaacggtgcggctgagaggcgtgtctcggagtgacctgctggaagaggaaggaagttctcgacatggtcctcggccatgcggtgcgtgcnnnnnnnnnncgggcatgcacgcatgcaacgtatacatttatattgttagatggcatgcaaaacgnnnnnnnnnnnnnnnnnnnnnnnctgccatcacaaaggattctctgcactcttcccaacattgttttccaagaagggtggtgttgaataacannnnnnnnnncaccagtgctaagcgaggacatcaatgcaggtgagaccataaacgtcgaagggtcaacgcatccttgggtgtaaggtttgcttatcttgccatcccaaagaattctctgcactcttcccaacattgtttcccaataagggtggtgttgaataacaccagg

SEQ ID NO: 42786 - DNA, 61 bp, Chlorella protothecoides
cacctggcgccgaccgccgggtcccggggccagcttggggatgcccaggacctggctggcg

SEQ ID NO: 42787 - DNA, 66 bp, Chlorella protothecoides
ttctcctgaggagtctcccagcccctcccccgaggagtcccccagcccctcccccgtgccagcccc

SEQ ID NO: 42788 - DNA, 15689 bp, Chlorella protothecoides
  modified_base (95)..(104): a, c, t, g, unknown or other
  modified_base (381)..(390): a, c, t, g, unknown or other
  modified_base (884)..(893): a, c, t, g, unknown or other
  modified_base (1258)..(1267): a, c, t, g, unknown or other
  modified_base (1498)..(1507): a, c, t, g, unknown or other
  modified_base (1714)..(1723): a, c, t, g, unknown or other
  modified_base (1896)..(1905): a, c, t, g, unknown or other
  modified_base (2086)..(2095): a, c, t, g, unknown or other
  modified_base (2486)..(2495): a, c, t, g, unknown or other
  modified_base (3182)..(3191): a, c, t, g, unknown or other
  modified_base (5341)..(5350): a, c, t, g, unknown or other
  modified_base (5732)..(5741): a, c, t, g, unknown or other
  modified_base (6365)..(6374): a, c, t, g, unknown or other
  modified_base (8645)..(8654): a, c, t, g, unknown or other
  modified_base (9432)..(9441): a, c, t, g, unknown or other
  modified_base (9628)..(9637): a, c, t, g, unknown or other
  modified_base (10515)..(10524): a, c, t, g, unknown or other
  modified_base (13570)..(13579): a, c, t, g, unknown or other
  modified_base (13783)..(13792): a, c, t, g, unknown or other
  modified_base (13877)..(13886): a, c, t, g, unknown or other
  modified_base (15005)..(15014): a, c, t, g, unknown or other
  modified_base (15342)..(15351): a, c, t, g, unknown or other
gtggggggggcagctggtcttctctgtgtgtgctgagggaggggcgttgggggttgtatgcctcatagccgcagggtgtgagctggcgagggggnnnnnnnnnnggcagatggtcttctctgtgtgcgctgagggaggggcgtcgggggttgtatgccttatagccgcagggtgtgagctggcgaggggggggggcgtgtccgtgcttgcatatgccagtgacagaaagcctggactatgaggagcccgtgtcacctacctcctggaggccaccgtgccagagcacgaacggtgcaagcgagccagggcaaccacgctcgaatggaatgcacctcctcccggtgccgcgtgctctcacagctgcctgacgggtgcagccannnnnnnnnnatgccagagcacagacggtgcaaacgagccagggcaaccatgctcgaacggaatgcacctcctcccagtgccgcgagctctcacagctgcctgacgggtgcagccagccagaccccccacctcaccccttctttccccccttcccctcgcagctgacgtgcctgtgcgacagcggctgggacaagctggagaactgccgcagccccggcgcacccctcaccccgctgcccttcacctgcccctgggaccaggtgttcctcgtggagcgcctgaccgagccgcacgagaagaaggtcaacatgacgtaccgggagtactccttcctggagaaccccaggacccccaacgaaacggaggtggggctggggacattccgtgtgtgtgtatgtgttgggaggtggggagctgtgggaattgggcatctgcttccgcggtgggagcatgccatccactgcctgcagcaactggcaacacctgcagcagggtttacgagnnnnnnnnnngatgtgttgggtggtggggagctatgggaatgaggcatctgcttccgcggtaggagcatgccatccactgcctgcagcgactggcaacacctgcagcagggtttacgagcttgagggacagccagatgatgtgatctgcagccgcggtcctcggagccctgcgatgcaccgctcccaagccttgcccggcggcgcaggcggggccacgctcacagcagaaatacacagccagcgcctcgcccccctccccccccaccccgcgctcccacctcctcacccccccccctcctcttttccttccttccagcacgaccttatcctgctgtcaatggacggcacggccaacacggccttccgcacacacnnnnnnnnnncccccccttgtcctttccttccttccagcacgacctcatcctgctgtcaatggagggcacggccaacacggccttccgcacacacgaccccaccatcgtctggctcccccccaagaccggcctggcagacctgcgcgaccgtgtggcccgccactcgggcgtgcgccggctgcatgtgcgagatcctcaggcggcctggtcggactgggagcggccggaggacggcaagtnnnnnnnnnncgtgcgcgaccctcaggcggcctgggcggactgggagcggccggaggacggcaagtccttcgacctgcgcttcatcggcgcgctggcgccctgggcggggccctttgatgatgaggagaagaccaagcgctggcttgatggtgtgctgcggcggaaaaggaagcgtgaaaagtggacctgaggccctttgggtgtcacggcgggggnnnnnnnnnnggatggcgtgctgcggcggaaaaggaagcgtgaaaagggggcctgaggccctttgggtgtcacggcgggggaggcgcgggcaccgccggtcggtgcaggagcgatacttgcgggcggccggttggcggcgccctggagcgacgacagcttgcggtgaggtcgggcctggtgtnnnnnnnnnngatacttgcgagcggccggttggcggcgccctggagcgatgacagcttgcggtgaggtcgggcctggtgtgggcgcgatgccatcattctgtcccaagccaaggcccaagccggagcggcggggtcgatcagcagcagtctccccatcccggcccttcctcgtcaaattcacacatctgtnnnnnnnnnnaccaagccaaagcccaagccggagtggcaggttcgataagcagcagtctcccccccgtggcccttcctcgtcaaattcacacatctgtcccatcaaggcttgcacccaggaatacgcagccgatcaccagcgtcgatgcacctcgccaacgccacagcgtgctgcaaatcaagctccattgcccgatttctcatgaatctcatcctcggattgctcactggtacacagcgcgccacatgcactatttgtaaagcagccttgtgcaagcagagaggggattcgttcagcggtgcgtcgcttcgaggactgcccagtggatcacgtgcatgtgcaatgggccgccctcgcctcgcaccaccgcgcctcacgcccggccctcctccgccgctcnnnnnnnnnntgccacatgcagtatttgtaaagcagcgttgtgcaagcagagagggaattcgttcagcggtgcgtcgcttcgggggctgcccagtagatcacgtgcatgtgcgatgggctgccctcgcctcgcaccaccacgcctcacgcccggccctcctccgccgctccgtcctccgccgccctctcctctccgcgcggctcggcctcggcgcgcacggtgacgtagagggccttggccacggcgtagagcgtgcctcccggcctgtcccgcagctccgcctcggtccagatcttgcgcccctcggtgttcagcaggcgcgcggtgcacacgatctcggtgtccacgggcatgggcttgcggtagtccacctccagccgcgcggtgaaggcgcggccggggcccaggctgccgtccttcttcccctcgaataccaggccgcccgtggtctcgtccagcacggcggccgagaagccgccgtgcgtgatgcgcgggtgccctgccacgtccagaccgagggcgatgatggtgtggaactcgcgccggtccgcgttccagatgaagtggatgtcgcggatgaggtcctggcgcagcatggacaggaactgtgtgtgtaggtggggtgggtgggggtgggggttagcgtggggtcccaggcttgggggtctcaggtgcctgaggcgagcttatgaaggnnnnnnnnnncggggggtagtggggggtcccaggcttggggatctcaggtgcctgaggcgagcttatgaagggaaagcaaggacggggagcggcatggaacacgaactcaatgatagaatcccaggagaggaacgtacttgtgatactcaaaccagtgcaggacttcatagtctgtcctcgaccgcccatccctccaaccaaggtacaacgcagatacgcaccatgtggtcggggtcgatgtcgccaccggaggacgacatggccccgacgctcagcacggtggtggcgccgggggcttcttgcaactcctggacccagtccagagcggccaggccgcccgagctcaagtattcggacgtacgagggtggtaggagggcccggaggacagggccttgtcggagcgcacgcggtgcaggatgccgtcggtggtcgacatcgcgactgcttcgagtccgtgacgatgggatttatcgagcgttgcacactacagcttgggtgtgacacaggatgaatatctcccaacgtcaatcaccgagggtaggtgtggtggaccctgcaaagggagggtcacgcgcgcccctagcagctgtgatgaatactcacaacgggcaaggtggacacgttatgacaatagaaacccgttcctctcgatgggaaccccgtgatcgatcactgcaaagtatgaaataggagggcagccacttacgaaatgatcgccgctcgatgacaaaccactggtgcccacgtgcaaattctttggcgacgtacccactatagcggttctaccacgcgcgaaaagactgcataactaattgcaatcatttgattagtatcacattctggtgctcccaaaaccactcttgttatcgaagccatgactgaggcagcgtccgcccccgtcgccggcgtgttcgaccgctcgttggactggatcgtggcaaacaagctcagggtatgtttcaacagagtatgcgagagcaattttggtgcatgggttgtgcagacacgttgctgtccatggcggtcttgccttacgtaccctgggcgcgaatccccgcaggccaccttctacacctgggccgtcggcgtcggtggctcccttgtgagttgttcgtatttgggtatattgagcagtcgtcagtagcgggacggagtggaggttgctgcccgttatgaaggcgttgcaagcatcgtaccagttcgactcagcggcgccccttcctcaccaccacaggcctaccagtggacccgtcccatccccaccagccttaagatcattcactcgtaagtcttgaaggtctttatgacagtgttctggctgcattcagtatcaatctctcctctagcatgcactcttttataagaccctgccccacttgcatcccctcacaggcgtgtgtatgctcaggcgatcaccttgggcgccctggctgcagtggctggcatcgagacataccaccgcagcgacagtgcagagacagaggacaaggcgtgaggcgcccaggctctccccgggcttcccaggaacctaaagaacctttcccattgtgtacactcccttccaccgccctcttgatcgagcactggccccctagcactgccccaccattgtcacaggatcagacgccttcctcagcgcggccccttctgaaagcagccgcaccatgcttcttcccaagcatctgctccctgcctcgtcactggattgagtttcaccgtgtaacattaccaggatcgagtgcgaggacaggagccgcaaaggcgcagactgggcggcggaccggcgctcgacacaggggggtccactgggactcaccggatcggccagctctcaggcgcagcgctgcctccggcccatcgcatcgagccatgcgctgcttgatgtttgggggtcacaagaagtaatcgggcgtgcgacgagtgacctccggctcgcctcgccgtggtgcagggtcaaactgcgagaaggttttcaccatggtctcgtccacctccatgattgccgccatgttgccgcacctggggatgaggaggtggcatggtaagggtggttcctgatcctcacagatcgcaccgttgggtgggaagaccgcatgtgctcggcagcccttcccacacatcttttgtctcccctcatgaccacgaccgccactccacnnnnnnnnnntctcacagatctcaccgttgggtgggaagaccgcatgtgttcggcagcccttcccacgcatcttttgcctcccctcatgaccacgaccgccactccaccgacctgtagcagtagttcggcgccgagaagatcgtgaccacgttttgatcgtggcaccagttgtacccctccatcacgagctgtgcaaggaacagaggtaagaaggggggagtagaagggggggggaacacaaaaaaactgccaacacagcgggaggctccttcccaggcttccaaaccacgccttggatacagggacgccctgcacgccacaggcatgttctcgagacctctcctcccagatcccagcaatatctgtcccacctgatgagcgcgtgccaccnnnnnnnnnnacacaaaaaactgccaacacagcgggaggctcctccccagccttccaaaccatgccttggatacagggacgccctgcatgccacaggcatgttctcgaggcctctcctcccagatcccagcaaaatctgtcccacctgatgagcgcgtgccaccaggctcagtccattggcctggttgaagtgctcactgatgtcctggccaaaggtgtaccctgcgccgcgcggcgagatgccccacccgcaccggtcgtcggggtcggaccagagcaggtcgcacatgggcccctcgtgggggacttcctgcacccggtccaggccgcggatgtggtccagggtgtccagggtggggctcagcccaccatggaggcagaaaatctgttccgagggggagtgggggtagggcaaggttacaggagactcatggagagcagaggatgtagcgcttcacaggaggacaggggctggcgcaaacccaaagaaggattcatggatgctaaatcgcagacctctcggtgatctgagactggctcataggggagtgaccccccggtgtgccggctctaaaagcaggaccccatgaaggccactcccggcctccaaaccaccagcattccacgaccgcannnnnnnnnngttcatgggtgctaaatcgcagacctctcggtggtctgagactggctcacaggggagtgaccccccggtgtgccggctctaaaagcagggccccatgaaaaccactcctggccctccaaaccaccagcattccacgaccgcagcaataattgtacctggttctccacgagcgcagtcaggggaaggtagtcaaagaggtcggtgaagtacttccagacgttggcagtgccatactttcgcaggcactcgtcgtagaagccgtagacctgggtgatctgcctgctctcgtggttgccgcgcaggatggtgatccggtccctgtaccgcacctgcgtcgtggaacccatgcagagggcgatgggtgagtgcctgaagaagatgttgcgatgacaatggaccccaccaagccctagatgatggataggctccccacgccaagggcaggagctggcccctattgccagccaccgccgacaccccatcccacacgacaaccttaagtgcgactaggagcgaggccgtctccacagagtgatagccgcggtccacatagtcgcccatgaagaggtagttagtatctgggcagttcccaccgatccggaacagctccaccaggtcctggaactggccatgaatgtcgccgcaaacctagggtgcgaagggcggacgtttcggcggtggtttccatgggatagggctggacatgcaaccacacacccggcaagtgtgagtgatcgcaagtggaggaaggtgcgtgtgacttgtgcatctcgcggcatatcgtcgcccaatgtacgcttgccatcagaaaataaaagctgccttattattcgcaccgtcacggggcatttcacgggctggacgttggactcctcgacgaaaattccctgagccttcacgcacagagcctggacctccgcctccgacagcggtttgcactgcaggagctgatctatttgtgcatcgatgtccttgtaatgatccaatggcggcgtcgccatcgtgggtggccgcctcggccagatattcgacacaaaggagggcaaccaggaccgcctgagtacaccgcggttggcgctggcgaggtcagggggatgcctgcaatctcctgcgacgaggtatcggcctccgagtgccgctctgtgccgtgtgtcgaaaagtctgacatgctgggcccttgcacctctcttccgcagggtcaccctccccatcaatgtttccgtgtttccagttggatcttcgactgctccggcagggaggggttctgagtgaatgctgggagcatagcacgctgagcacctccgccaatccccccttagaagtgtattccatacgctcaagtgacgaagggagggactcgcaccactgcaaggcgccagactcggtcacaccgcaaagtgggtgattgtcgtggtagggggagactggtcgtggccctgtgactcttctgacagccccaaatcctcatttggagcttgaattgtgacagggcgcgacatggaagaggaagcggggtgagtgcgggcagcaaggggtttgggcgctgggtgcccgcgatggtagtgcctgaccctgtcagcgccaggctgggagcccagtgggtacattccccgtcatgtgtttgtagctcgaagagtacttgcacccgttgtaccagccggcgcacgcactggacggacggaggggcgcgctgtcgcccgcgtctggcagtcctcttccctggcacctgccgctccctcgcccaccctctgccctcccaacacacacacacacagtccccgctcgggcggcggcgtgatccagggcgatgccagcctggagttcgagacgagcaagggcgtgagggtggtgtccacctttgacgccatgaacctgaagcaggacctcctgcgcggcgtctacacctacggcttcgagaagccgtccgccatccagcagcgtgccatcctgcccatcatctcgggccgggacgtgatcgcccaggcgcagtccggcacggggaagaccagcctgatcgccatcaccctctgtcagatgctggacatcaacacgcgagagtgggttggggaacttggttgtgggggtggttgtgcatggctagaattggggagggcgtgggggcttgggggagaagggggggagtaaaggcgacgaggaggggagtggggtgcaggcccgacgtgcatgaggaagctgagggcagagtgcgtgtaggtccctccctcgggtcagcgattgctgagcccccgttcacgccccgcccgagcaccnnnnnnnnnnagcagagtgcgtgctggccctccctcggatcagcgattgccgagcccccgttcacgccccgcccgagcaccattcaccgacctctttcagcatgtgcacacactctcctctgcacacacacataaaacacacattcaagccccccacacgctcctccctgcagggtgcaggcgctggtggtgtcgccaacacgcgagctggccacacagacggagaagaacatcctggccatcggcgacttcatgaatgtgcaggcacacgcctgcatcgggggcaagtccgtgggcgaggacatccggcggctggaggcgggggtgcacatcgtgtctggcaccccgggccgcgtgtacgacatgatcaagcgacgcagcctgcgcacgcgcgccatccgcacgctggtgctggacgaggcggacgagatgctgtccaaggggttcaaggagcagatctacgacgtgtaccgctacctgccccccgagacccaggtggtgctggtgtcggccacactgccgcacgaggtgctggagatgacgcacaagttcatgacagacccggtgcgcatcctggtcaagcgcgacgagctgacgctggagggcatcaagcagttcttcgtggccgtggagcgggaggagtggaagttcgacaccctctgcgacctctacgacaccctcaccatcacccaggccgtcattttctgcaacaccaagcgcaaggtgtgggtgggtggtgggtgtgttggagtttggtcagggtgttcccggctgtggccgccgcgccnnnnnnnnnnttgggtggtgagtgggttggggtttgggcagggtgttcccggctgtggccgccgcgcctggtcccgccaccagtctagggaggctcggcactgtttacccaccatgtccatgctcctcccttccgggcttggctctcctaaccctaaccctacaccacatgacagctcccaacgcactcaaatcccnnnnnnnnnngactgtttacccaccatttccatgctcctcccttccgtgcttagctctcctaaccctaagcctacacaacatgacagctcccaacgcactcaaatccccccccttccccccaaaggtggattggctgacggacaagatgcgacagaacaacttcactgtttcggccatgcatggcgacatgccccagaaggagcgcgacgccatcatggacgagtttcgctccggcgccacgcgcgtgctcatcaccaccgacgtctgggcgcggggtctggacgtgcagcaggtttcgctggtgatcaactacgacctgcccaacaaccgcgagctctacatccaccgcatcgggcgcagcgggcggttcgggcgcaagggcgtcgccatcaacttcgtgaagaatgatgacatcaagatcctgcgcgacatcgagcagtactacgccacgcaggtggacgagatgcccatgaacgttgcagacctgatctgagatggcgggaattagattgctgggggggagggagaaggggcgcctcctccctgtccaccccttctcggcatgcaaatgtctggcatcaatcaccaccctgacccactcgcgagggacaagggccttacagggcagggaaagccaggcaggggttcaagggatgcaagcagtgcggtttgggcatgatacaactggctcgaataacagggcaggatcgaggagggccggtgaagggtgccctgcgaggggcgggtgccctggagcgggcacccgacggcatcgcacggcgaggctggggcattcctcatgaaggggtgaggggcagcacattgtcatgcggtcatcgaggcagtgccgccagcctcatagaagggaggggcataaagggagttannnnnnnnnnttgcgaggggcgggtgcactggagcgggcacccggcggcatcgcacggcgaggctggggcatttttcttgaaggggtgaggggcagcaccattaccatgcggtaatcgaggcagtgccgccagcttcatagaagggaggggcataaagggagttactacgatggcccctcgctcctctccttgtggcaccggtgccgtgggggaatacttcattgacgcaggcctccagtgtgggccttgttggggagtcgttcaggagctgcagcagctggccacagtaaactctggtgcactctttacctggtcttccagggtttagcgacactaccaaaagggctggccgcgccgccacagcgagtggggctagtgtgcacgggggggctagtgtgcacggggcaccagctctgcagagagctgtcaccaggggggaccatgcgtgtgctggtcggcatgccgcgccgacagccccccataccgtcactccccctgagatgaggagctcagcgcggcgcggcgcgcgcggcaagcgcccccccggcgccgcccatgatcgcgcccgagaactctgcggtgctgggcagcgccgcctccaggcccatggtgggccggcgctccatgtaggccagggtgccctcccggatgcgtacgcccgcatcccggaactcctgcaccacggtgcgcgccaggtcgggcctgccccagtccacgcagcccttgaccaggacatagcagacatcggggccaggatggcgcccccgccgcttcatcacctcatacagctcgaacatggccagcaggtcgccctgcttggagtagtagatgagcaggggggtggcctccttggccgagtcagcgggcaggccgaactcggctgagtgctccagcgcacgtgccgccacctcgggcacgcccagctgcatggcctgggacaccagggccttggaggtgcggtgggagaagggcgcgtgctgctccagcgcgccacgtgccaagtagttgagccgcgtcagcttcagggcacggtccagctcgtctccggttcggcagcgctgatacagctcctgcaggtggtgctgcttcaccggcccggaggcctggatgcgcgccaccagcagcttcagcgcgtcctgtgcgctcagcgattcgtcgttgtaccactcggtggtggagcgggagggctctgaggaaggagagggtggggggggggggggggggtcctgggataagaagtggggagcatgaccaggagaggggtgacggttcaccgtgagactcacaacaggccaggggcctaccagtcctggccaatgccggcgcgagggcaggtgggatgccaacacatcaaggcctgagtagcaccctctccctgctcttataaacacaacagcacagacagtaccagagcagtgccccattcacacacaccacacactctgcgcacagtacccccccacaccccaggctcttcccccaccttccgcctgatcctggacagccgtggagctgtactgctgctggggcagggcattgtaagtcacgcgccagatgttctgggcctcgagccggcgcaggaaggtgagcaggggcgactgcatggcggagcctcagggggtgccgatcaaggaagagaaagtgtagatcacagaagcgtggcgctgaagtgtctcgagccggggtctacggcgagggcgcgagatgccggatgggcagggtcccccccgagcgaggttgtgccccacccctgctggcgtagagcgaacagccgcggtgctgctggacgagcagcgggcgtgggatggatggcagatgggggaagagaggggccggcgaggtaagttgccgggtcccagcaacatgacgtcagtgtgtagacattcgtgggtgtctttgggggcgggagcgcatcgacccaggcaggctggccagctcgacagggccggcgagcttggaacatagtggcctggacgggacctggagccctgcaagcgaacgccatccacgtcccccccatcttcgcttctgcttgccaaggtgggactaccatggagacccagatcggggagcaatggatggcgctgggtgctgggctgccgacctgctcgttgtgaatgccatgtgtcaccgatcccctcccatgcatgcacccccgcagatgaatgcggagaagctgcagaagatggccggcgccgtccgggtgggcggcaagggctctgtgcgccggtgagacctgggggcctggactcggtgatggtgccgagaggctgccggcggggcccgggagcatgcccctccgaggcgtacctctcatcatgaacccctgatcagccggaatgtggtcgctccacatgcgcaccagggagaacacgtctcaacacccgtcccccacccccttgcccatccccccaggaagaagaaggccgtgcacaagaacacctccaccgacgacaagcggttgcaaggcaccctgaagcgcctgggcgtgaacaccatccccggcatcgaggaggtgctgctgatcaacaacgacggcagcgcgctgcagttcctgaaccccaaggtgcaggcctccatcgccgccaacacctacgttgtgtccggcccctcccagcagaagcgtacgtttcagtcgtgattctgtacgttgcatgcatgaccagggaacatgagggtggcggcggcgccgtgcacggcatcggtcaggcggcgtggcgctgggcatcttaacagcatggccgtcagcgcactgtggagcttgactccgtgcagtcctccccatgttcatccattccacccctccctccccccccgcaggcgcccaggacgtgctggcctccatgctggccggcatgggcggcgtgcccaacatgcagtccctggcccagctcatgggcggcggcggagccggcctgccctccttcaacccggagggcgcggccgacgagcctgagggcgacgacgacgtgcccgagcttgtcggcgacttcgagcaggcagcagcagccaaggccgagtagggggtgcgcaatagtgctgagggatcggcggnnnnnnnnnntgtgattctgtacattgcatgcatgaccagggaacatgggggtggcggcggcgccgtgcacgacattggtcaggcggcgtggcgctgggcatctcaacagcatggccgtgagcgcactgtggagctcgactccgtgcagtcctccccatattcattcattccacccctcccttccccccgcaggcgcccaggacgtgctggccnnnnnnnnnntgccgggctcggcccgatatgccccgccccgccagccgttatccccctgccctacacccctcctcggttcctgaccctgtagtannnnnnnnnnggcctggctcggcccgacatgccccgccccgccagccgtcatccccctgctctgcacccctcctcggttcctgaccctgtagtatcttgtttgcagcttcccaatcccaatccccctctccttatccctacctgcctggtctccgaatgctgtcgacatgacccgtccaagcgtatggaaacctcgatttatgccgagcgcttgtgccagtcaggggagtttgagcgacagatcacggttgcgcgcgcgaaacgctcaaatgatcaatcaaggggggccaccctgtgcatgcattgaatgcgaatataatctaagctttcgtgaaatccgtctgacgatccacaggcaatgcggtgacacgtagatagacgagtcaaggagcacgggagcccaacctgctcccgaccatggccctcctgccggagtgcctggcggttgatgtgctgcgctggaggttggtagccgctggaatctggcatctggtgctggtactgtcagtctcgtgcacaacacgggcggtgctgggcagccatgtgccccccatctccctcaccctcctctcccaagcattggccttcctgggccagatcgcgctgttcaagccccacccaccgatatcgagccccatcctgataccatgggtgcctctgggactgaggatcgcactatcgcgtgccctgggccccctctcgagcctggcgagcctggccagcagcgtcacagcggcggccagcctctggctctccgccctgctctccctcagcctgaccctggacctgaaactcgctggtgagcgcatggcttagatcaagcttgcttgacttctttttcgagctcccatgtggatcccttgcagctgccgcatggaggctgtggtacctcgatgcgctgccaaggtggcagcaaagcccaaactgagagtctgcctggggtgatgccctcgactgggcattcatgggacttttgaggaagtgtgcatgcaacgcctcatgccagctgttcagcacatgcacacacgcctcttgtcacccccatccgctgacccccttctctgcacagtcctctactcggcctgcttggccgctgcatacctgcaccatgcccgagtctggtgagggnnnnnnnnnnaggacttttgaggaagtgtgcatgcaatgcctcgtgtcagctgttcagcacatgcgcgcaggcctcttgtcacccccttccgctgacccccttctctgcacagtcctatactcggcctgcttggccgctgcgtacctgcaccatgcccgagtctggtgagggactgcggggctgccttgatgaccatgcagcacctcaaagaactcaccatatctgaggaccttgttccaaggattatggatctgtatttccagtgtgccgtggcgcctgccggcctgcaaaccaggggaccaccttcattacaagggcgccatcaaccccccccccnnnnnnnnnncctgaggatcttgttccaagggttatggatcggtatttccagtgtgccgtggcgcctaccggcctgcaaacctggggaccaccttcattacaagggcggcatcaacacacacacacacacacacacccctccgcccaatctaacctctgccaccacccttaccctgcagccagatgtatgtggtgaccccccttgcggtccaccgcccacgtgctgcacgggtgaggaaagcggtgccgcgggccgcgacggcgctcgccgggcgggccggcgcctcagccctcgcggcgaccgcactgctcgcagcccccgtcctgggcgctggcgccctggccgcc

SEQ ID NO: 42789 - DNA, 72 bp, Chlorella protothecoides
gccacctccgcgctcagggaggtgatcggcaacgcgccggtcgcctgcacggtcaagaccaaggacatgtac

SEQ ID NO: 42790 - DNA, 136 bp, Chlorella protothecoides
gcacaagctggagggcgagcaggcgtggctctgagcgcggtcgggccgggcgcgagcgccccaccgaacggtggccccaccctgtgagcctgggtgcgaggtgggccgactgcccaccgatcttccctgcataccc

SEQ ID NO: 42791 - DNA, 74 bp, Chlorella protothecoides
ggtgggaggaaggttctggtgggtggaatgccggggcctgcagggctggccctggccgggcggcaggccgagga

SEQ ID NO: 42792 - DNA, 85 bp, Chlorella protothecoides
tcctcctcggtgacgcagcggaagcccgtgagggtggcgccacccgacccctggtcgccgccctctggctgcacgatgtcttccc

SEQ ID NO: 42793 - DNA, 130 bp, Chlorella protothecoides
cagggggagctgctggcgcgctgcctcgaggcacaggtgcgcgggggggcagggccggtgggcggtgggttggggccagggccggtgggcgtgaaggggatggcgggtgcggcgggggggggggggcccc

SEQ ID NO: 42794 - DNA, 62 bp, Chlorella protothecoides
aacatggactctgcagcccttgttgacacattgcttggtgtcccacacgtccaccagcttct

SEQ ID NO: 42795 - DNA, 61 bp, Chlorella protothecoides
tgctgcggtaccagggggtcgactggcagggccacgccaattgggcctgcaacgcacagtg

SEQ ID NO: 42796 - DNA, 61 bp, Chlorella protothecoides
tggagcacggcttcacgctggctcccctccgtgccatataacgaccaggcatagtctgtgc

SEQ ID NO: 42797 - DNA, 97 bp, Chlorella protothecoides
ttcgaagctgtactcgaaatccacatcacagatggagatctgggccaagaccctctcctccagccaataaaacctggcctgcttctgccactcaaag

SEQ ID NO: 42798 - DNA, 61 bp, Chlorella protothecoides
cgacgggtggtgccatggccacggaggaggtcattctagccagcctcgaggcgcgtactgc

SEQ ID NO: 42799 - DNA, 117 bp, Chlorella protothecoides
ggccaccagctcctttggcatgagtggcgtgaacgctgccgccctgctctccgccccgaccggcggggacttggaaggcgccgggtccccggctgcacagccctggcagctccaagc

SEQ ID NO: 42800 - DNA, 72 bp, Chlorella protothecoides
actcctcctcgccccccacactcctcctcgaccccccgcacccctcctcgctccccacacccctccaccact

SEQ ID NO: 42801 - DNA, 107 bp, Chlorella protothecoides
gttcatttgtcggctgcatctcgacagccacgaagccgtgcccaactcgggaccgagttgcccaggcccctccaaggcccctcgactgtccacccctcaccgccccg

SEQ ID NO: 42802 - DNA, 61 bp, Chlorella protothecoides
cgcagggcgtggatgggagcatgaaggaggggtccagcaagtatgcttcgggcatggtgac

SEQ ID NO: 42803 - DNA, 611 bp, Chlorella protothecoides
  modified_base (179)..(188): a, c, t, g, unknown or other
gggcggcgcgacgcagcgctggcccggcgccgcctcgcccatgcgctccgacctgggcgcctccgcgccctcgggcgtggtcatgagtaacggcgcgccagtgctcctgcgcggcgccggcgcgggcggcgcgggcggcatgatgccattgggcatgctgcccggccccggtggcgggnnnnnnnnnnggcccagcgccgcctcgcccatgcgctccgacttgggcgcctccgcgccttcgggtgtggtcatgagtaacggtgcgccagtgctcctgcgcggcgccggcgccggcggcgcgggcggcatgatgccgttgggcatgctgcccggccccggtggcgggcccggggcggggccccccggcggcagcatgctgggcggcatgatgcccatgggccccgggccgccctccttcgtgtccgggcccaagcaggaggacgggtaccacgccgcggtgcagcagtaccagggcatgtacccgggatcgtacgcgctgccgtccatgcaggcgccgccggccttcatgggcatggcctccgcgcctgggggcatgtacgcggtgccctcggggccaggctccggcagggccccgccccagtcggcgccgg

SEQ ID NO: 42804 - DNA, 16895 bp, Chlorella protothecoides
  modified_base (159)..(168): a, c, t, g, unknown or other
  modified_base (658)..(747): a, c, t, g, unknown or other
  modified_base (834)..(843): a, c, t, g, unknown or other
  modified_base (929)..(938): a, c, t, g, unknown or other
  modified_base (1124)..(1184): a, c, t, g, unknown or other
  modified_base (2233)..(2242): a, c, t, g, unknown or other
  modified_base (2472)..(2481): a, c, t, g, unknown or other
  modified_base (3041)..(3050): a, c, t, g, unknown or other
  modified_base (3197)..(3206): a, c, t, g, unknown or other
  modified_base (3443)..(3452): a, c, t, g, unknown or other
  modified_base (3851)..(3860): a, c, t, g, unknown or other
  modified_base (4613)..(4622): a, c, t, g, unknown or other
  modified_base (4772)..(4781): a, c, t, g, unknown or other
  modified_base (4860)..(4885): a, c, t, g, unknown or other
  modified_base (4948)..(4957): a, c, t, g, unknown or other
  modified_base (5855)..(5864): a, c, t, g, unknown or other
  modified_base (6685)..(6694): a, c, t, g, unknown or other
  modified_base (6936)..(6945): a, c, t, g, unknown or other
  modified_base (7279)..(7288): a, c, t, g, unknown or other
  modified_base (7726)..(7735): a, c, t, g, unknown or other
  modified_base (7820)..(7829): a, c, t, g, unknown or other
  modified_base (7882)..(7891): a, c, t, g, unknown or other
  modified_base (8021)..(8030): a, c, t, g, unknown or other
  modified_base (8352)..(8361): a, c, t, g, unknown or other
  modified_base (8464)..(8473): a, c, t, g, unknown or other
  modified_base (10208)..(10217): a, c, t, g, unknown or other
  modified_base (10851)..(10860): a, c, t, g, unknown or other
  modified_base (11265)..(11274): a, c, t, g, unknown or other
  modified_base (11735)..(11744): a, c, t, g, unknown or other
  modified_base (12164)..(12173): a, c, t, g, unknown or other
  modified_base (12827)..(12999): a, c, t, g, unknown or other
  modified_base (13085)..(13094): a, c, t, g, unknown or other
  modified_base (13180)..(13189): a, c, t, g, unknown or other
  modified_base (13424)..(13439): a, c, t, g, unknown or other
  modified_base (14334)..(14343): a, c, t, g, unknown or other
  modified_base (14658)..(14667): a, c, t, g, unknown or other
  modified_base (14805)..(14814): a, c, t, g, unknown or other
  modified_base (15057)..(15066): a, c, t, g, unknown or other
  modified_base (16650)..(16659): a, c, t, g, unknown or other
cgtccgccgccgccagccactcgccgcccgcggcgtcgggcggcagcacgtccgcgcgccaccggccgcgcgcgtcccaggccgagggccgtgccggggcaacgccggccaacagtaggcgagggggggcctcctggtacgcctcaccgctcagcaccnnnnnnnnnnggcgccggccaacagcaggcgggggggtgcctcctggtacgcctcaccgctcagcaccgtgacctcggccacggtggggccctcggccgcgtgcaggggccgcagcaggcggccctcgtgcaggaaagggcggccgccgaggggggcggggaggggcgcgtcggcgtgacgctcccagggacccagcggggagtgcgcccagtgcaggtccaggccgcgagccgcgtcgcggcggtgggcaaacagccaccagcggtccacgtgctggaacacgtggaccgcagagacggggaagggcagcgcctccgcctcccgttcccaggcgtgcgggaaggaggtggcccgatacagccaggtgacctccttcccgagagaggggaccagcatataaacctggtatggggcgaggttgatgagggggggggacaaagggattgaggaagagggagtgctgagctttcggagtcgcaagtaggtgtgcggcttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggctaagggagacgacgtcgcaaggggctcggcgccactgtcgcgatggcatttgtcgggcccacctgatcccaaccccgccatnnnnnnnnnncaggcaaagggagacgacgtcgtacgggttcggcaccaccgtcgcgatggcattggtcgggcccacctgatcccaaccccgccatnnnnnnnnnngtcccgagggaggggaccagcatatagacctggtatggggcgaggttaattgggggggcaaacaaatgggttgaggaagagggagtgctgagctctcggagtcgcaagtaggtgtgcggcttgggactccagggaagccgagagggatgcaaaagcgtggatgcctaagaccaggacggaggtgcnnnnnnnnnnnnnnnnnnnnnnnnnnnnnnnnnnnnnnnnnnnnnnnnnnnnnnnnnnnnnggaccagatgtccttctaccaatgtgcatgcggttcctccgagcccacaaacctgcccagcgtgctggaagagggagggcgtccccagggcccagggctcctgcagcaccggctgggcatactggaaagagcggcctccgtcgacgctggtggccgccccgacggcgtctcgcccccagcctcgatactgcagggtgtaaaacatggtgatcgcgcccgtggagtttcgccagagcaccggggacgccactgcgggggggtgtgggggctgtggggatcagcagatggcgcgctcaggagtgctcgtcctgtggctgcctgaacggcgacgaagggcatctgcgtggcaccaaacccatccagcgcatgcgggacggggaccgtgagcacatagcctgacgatcaccaggcctcacccccagcaacttcgtcgtcaaggaacagggattcgcatgtcaatacagggttggccactggccaggccgtcagggtgtcttgccgcggggagtactcctccaccggctggagatcgaaggggccgctgcctttgaaaatgccgatggaccaaagaccctgggctcgggagggcggggggaagggtgccgtcacggttggatcgtgggcgacggcttggaagtgccgcaactcgcgggggacctcattgcggtgcttcgccataccttggacccagaaagacactggacgaaccccccacgctgcttcacgctccagtgcgcccagaaacattgaaggagggtgagggtgagcaggcagtaccgtgtcgcactgaggttccggatggggccccattgcgacatggcgtcgggacacgatcgaattatcctcacaaagtcaagtctgatgagaacaggatcgcgccatgggccgggaccacgcccttgcagtccgtcccatacgactgttcgactgtgctgacttgaagccgccgggaaatgaggccccgcagctgtaggatacgatacaactagggggaagggaaatggttgttgaattgtacgataggtgagctcctggctgatggggctggnnnnnnnnnnaggtgacttgaacccgccgagaaatcaggccccgcagctgtaggatacgatacagctagggggaagggaaatacttgttgaattgtatgataggtgagctcctggctgatggggctggggtctccagcagtccttgccaaacgcagatatacacagcaggcgctctgcacacgtggcaaggggggtgaacttcccctgaagaccgtccgggaaatcggcactctcaattnnnnnnnnnngttcacagcaggcgctctgcacacgtggcgggggggtaaacttcccctggagaccgtccgggaaatcggcactctcaatttcgcgggatcagagggttcacctcagccaacagattccggtgggggacccaagtattcgcccttcctaagagacaaaggaatatgcacgccctgagaggtgcgcctttccgagcctctgtcatctcacgacaccttgctcctgctttgcaagcacggccagagtcaggtaaaccctatgagcgggatacagtgcactttgggttgctcttagacatcttcatccacattccctactgcaaatcctgcagtcgctgcaatggccaccgctgcacggagctccctgggtcggatcgctctcggcgacaccgcccttttcgtgtgtgacatccaggaacgcttccgggaggccattcaggggttccccgcggttgtggacgtttcccgacgcatggtaaggcgtttgcttcgtcacagtggaggctgcattgttgagttgacgtcatccctagcagcacaacccgggggcatcaggccttccnnnnnnnnnngcagtggaggatgcattgttgaattgacgtcatccctggcagcacaacccgggggcatcaggccttccgatcccttgcacttgtcgtaccctaaatttccaatccctttgacctacagatccgtgccgcggaggtgtttcagatccnnnnnnnnnngaccccatatttccaatccctttgacctgtagatccgtgccgcggaggtgtttcagatccccgtcatcgtgacagagcagtaccctaaggctctgggcaagacggtttctgagctgacagaggtgctccccaaagatgcccaaggtggaagtcgcacttctgtcgccatggatggcaatgagcaggtcgatgtacggtcttaacaaccccactgtatcccagccagtcaccgcccannnnnnnnnnaaagtcgcacttctgtcgccctggatggcaatgagcaggtccatgtacggtcttaacccccacactgtatcccagccagtcaccgcccacccctccataccatgtcccttgcagtgtttgagaagaccaagttcagcatgctcatcgacgaggtctcggagttcctgacgcgcagggacgacatcaagcgcatcttgattgttgggattgaggcccacgtctgtgtgctgcagacgaccctggaactccttggtgagtttggctgcgttgactgacagactgcactctccttcctgagtgccgaactagggacacctttggtggtgacaccatgtttggcttggcactggcctcggctcaactcccccgccccataccaccctcatctctatcagatcnnnnnnnnnnttccttcctgagtgccgaactagggatacctttggtggtgacaccatgtttgacttggcactggcctcggctcaactcccctgccccataccaccctcatctctatcagatcctcctcttgcatgcaccaattttgtatccctacacccatatatatgtacccttggcgccaccacccgccctcccagatcgcggttatgaggtacacatcctgacagatgccgtctccagccggtatgccctcgaccgctcgacagcactgcacaggctctccaaggccggcgctattctgacgacttcaggtgattgccggatttgtgttgcaagtgtcgcattcttgatgtttacacccgggagggattgctcggaaggctttcacccatttgcacaccctctgcccactgctgcagagactgccagtttccagctgatgggcaacacgacctaccccaacttcaaggccatctctgccctcttcaaggagaagaaggcagactccctgcctggcctctgatgtgtggagcgcgagcgtgcgatttttgtcacggcatactcgggattttttcggtgcatgggagctcatagtatatgagtaataaggcctgcatccaactcggatatcagcctgttcaagtcacctctgcagttccatggttcctgacttagatgctaatggtctgttccaggtgctccggggggcgagaatcgcatgacaggctgcgaaggtacagttgtgctccatctgcatgtgcnnnnnnnnnnctgctgatggtctcttccaggtgctcctggtaacgaacattgcatgacaggctgcaaaggtacagttgtgctccatctgcatgtgcacagtgcccaaagaaagggctcacgttcttccgatgggccaagtggcgacacgagcacatatannnnnnnnnnttcacggcatactcgggatttttttgttgcatgggagctcatagtatttgagtaataaggcctgcatccaactcggatnnnnnnnnnnnnnnnnnnnnnnnnnntggcttcgggatatcgtcaacacaccggcttgccaatgggtgttggttcgggactctgtgtcnnnnnnnnnnaggattcgggatatcgccaacaaaccggctttccaatgggtgttggttcgggactctgtgtccaatactatgcgcgggtattgccgtaacaaacatcaaaacgcgcgcgccctgtcactccgaaatgatgtggaccccacccaatccgtcatgaaagcgctacccagctgacagcaggcggtgttctcgcaatcaacgtaacaaatgcctgtgatcttgtgtacgagtgggttgccagtggcctccgctcccatcctcgctgcaccccgtcccggagcctggggacccaacagacgcaagtcccggcgccctgcgccctcctcagcatggcgccccgggacactgggcggtgactcggtgccccccggggcggagtatggcgaggtgggtcgggagcctcccggagcggttgctggggcaggctgccaccgggatttgctgctgctgccaggtaggttccagggcccaccccttcacccacgcccacgcagggcctgctccaattcctcactcccggcggcaccacccgtctggacgtcgaccgcctgaatgagaagctgcggccggagggcgcagcccggtgtcggcagagcatgttccctgacgaggcgcatggcctgatctttgactgggacgatgtgattgccgacacggccggcctccagctggccgcctggcacgacctggcggcgcaggagggcctgagcctggaggccggcatgcggaggcggggggccctgctggacctccgacccgagcgagccatccttgaggtcggactggagtatgaaagggttgtggtttctttgtgttccgggggtgctcctggcactctgcctgccctgctgacacgtccatgcctggcgcggtcctgcatactggtccgtgacagagccgnnnnnnnnnncccgggggtgctcctggcacgctgcctgccctgctgacacgcccatgcctggcggggtcctgcatactggtccgtgacagagccgcgcctgccctgtgtgcacccagcgccgtttgcatgaccaggcttgggcatgaacgtaggtaccgttcccacatagatgcatgccccgcccccccccccacatacaggttctgggctggacgagggactgggtgcgcgcgcaggcgctggcccgccagctggcggccctgtacctggcgcgagtggaggcctcgcccgcccccctccccggcgcggcggcctggctggctgccgccgcgcgccaccgcatgccctgcgcgctggtgacgtggctggaggagggctgcgcggcgcgcctgctggaggcctggggcctgacctccgccttccaggccgtgatcggcgcgcgcatgggtgcggagacccaggccgagcgcctgctgtgcgcggcctgcgcgctgcgccgcccgcccgagcgctgcgtcgccttctccgcctgcccgggcgccgtcaccgccgcccacaactgctccatgcgtgcggcggccgtggcggggaagcacccggcctacgcgcttgcggcggccgacgtgaccgtggcctccctggccgacctctccgtcgtcaacgtgcgccgcctgtttgccgacgcgggcacccagcgcatggacctgtgcaagcaggaggcgcgggcggagggccggtcacgcccgcggagagcgaccacgggggagacccctacctgagtggcaatgggctcggcggggcctgcatgccctcggttgcctcgcagcttnnnnnnnnnnacggagagtgaccacgggggagacccctacctgagagtggcaatgggctcggcaaagcctgcatgccctcggttgcctcgcagcttgtatctcgtgctgtaccatatcccaggcgagcccctgtgcctggccaatcgcctgtcctgcgctgccggaatcccctgcattacaaggggaatgtccacgcagcaagacatgtgctcatgtaccggcctcataccgtttgcctgtaaaacacagcnnnnnnnnnnctatcccaggggagcccctgtgcctggccaattgcctgtcctgcgccgccggaatcccctgcattacaagggaatgtccacgcagcgagacatgtgctcatgtagcagcctcataccgtttgcctgtaaaacacagcctgaatgctgtatgcctcggggaagcgagattggcgccattatcgagtggtagtggggccctcgtggtggctacctctttgaaggcaccctggggccggcagccacgcaggccaagggtgcagcacctgtggtgctccccagactcgtctaaagttcaaatgtgcttggcgcccgctccaaaggcgtcccatccctnnnnnnnnnnggctgtggtgctcccagactcgtctaaacttcaaatgtgcctggcgcccgctccaaaggcgtcccatccctttggtaaagccctcctgcctacttgaccaccaccttgcgcgggttggcctcgcgataggaaatgtaggagtaggcggtggagccaagcaggcccagcgccaggcccagggcgttgagagggcggagggggacgtcggagaagagcgtggctcccagggcggtggtcaggatgtccttcacctgcccggagacgttggttgccagcgcggagttgaccagggtgcagcggaagatgcagacgttgagcaggaaggcctgagagcagctgaccaggaggaaaaccaggaaacgggggtcggcaagtcgggggtaggcagccacgcccgccagctcattggtgcccagcagcagcatgcccagcatgagnnnnnnnnnngaggaagcaggggtcggcaagtcgggggtaggcggccacgcccgccagctcatcggtgcccagcagcagcatgcccagcatgagnnnnnnnnnnagggttggcctcgcggtaggagatgtaggagtaggcggtggagccaagcaggnnnnnnnnnngtcccccgaagccggtcccaggggcaggcgtgggcgcagcaagggaggagcaaggagggcgtcgccgcacggatacctgtgtccttgagcttgcgaatgaggagcaggtaggtggcggtgctgaaaacgnnnnnnnnnngggcagggccaggacgttgttgtacagcagcaaggtgtgctggttcatgcctggcgttcgaagggggtggaggatggtggtggtggtgagagggagggaagatttggaaggcagaatggggttcccctgaagccggtcccaggagcaggcgtgggcgccgcaagggaggagcgagaagggcgtcgccccatggatacctgtgtccttgagcttgcggatcaggagcaggtaggtggcggtgctgaaaacgcacaccgccacccagaggtagccggcgaggttgaacgtgacatcagacagccccgctacgatagcgccgccnnnnnnnnnnggacactggcgtggaaagaaaggggagaggtgcatggcttgatcgcgcatgatctgcacaagtccacctgcctgctgcccttgaaaaccggcccccacctgtnnnnnnnnnntgtcatgaggcccagccccgtctgcaaagttcaagggggaggttgagtgaggctctcgatccgactcaagagagaattccgcataggaagataggtcaggtcatacatgaaggtgccactcacactcgggtgacgtcatatcacacgtgcccgatggggcagcacatgatactctgcacacccaccaaataatgtcctcctgtttgcatccacaccaccatccccactcaccagcgataacccagtggggaccttgtggaaggccaagtactcgcccgccaccaccaccagggtggtgctccgccgcaagacactggggtggaaagaaaggggagaggtgtatggcttgatcgcgcatgatctgtacaagtctacctgcgtgctgcccttgaaaaccggcccccacctgtacatcgggacattgaggaagcgaagcgccgtcacaccagacaccacatagagccaccagaacagagcaaggggtgcaacctggtgatggggtgggtgggagggggcctcctggtcagtttggacccggcacagagaggcttgctcaaagccggcatgcaaaaccaatcttgagcacgagcccggcgtcacccacgcacccgtcgtgcaccctcgatggtcagggcacccactcgtaggcgaccagagtacttgagtgtataaatataaagaatggagaccaggagctggatgagggttacgaaggccgggaaattgaactggtaaacgctgaataccgctcggttgaagagggtaatgctgacggacaccaccccatactggatgcagatgatggccctctgggagggtgtgggttccatcagcatgctccccccgttcgaggattggggtccaggcagcaaggactggggggtcttggtcctcgccatgcgggctggggtgtcaccgcccccgcattctatgtgcacagggaagccgtgctcagaggtctcttggtgaccggctttggacactgtgcgcgacaggggagatttgtcgcattggggctgttcgatcctcgacattgcttcgcagggggcgtgcttcaccccaccctcggacgaggctggcaggcatacgcctagattcgcatgggcggaatacttgctcccgacttctcatcacaactttgccatgttgcccaagtaatgaggtacgcaagacatatcctcggattacagcccaaacttgcgttgtcctgtgccaggtcgtgcggacccgggcgtggcgatggacttccgttgcttctcccggatggccgcttcccgctcagcctgggcagcctgcagcaccctggcctccgcctgcgacttctccagctccccctccatcacagccctggccgtccgctcctgcatgatcatggagatgttagcatgcctgaatctgggtgcaggcaactggcattcttgaaagggggggcagggggtgcccttgggccgtccacgcaccttctgacgctgctccaggcgtgaggagtgcgtctccttgacggagaagaacatggggcccatctccgccagccactccggatccacagccgtgacgcactgggtgggtgggtggatgggtgtgcgggcggtcgggccgcggttctgccaggtgtttgagagcacatcgataccgtgtctcagacatcagccgccccctctatccccccctgccccaaaatgcgtcgcccttcaacctccttcccctacagcacacctgcatgtactccttgctnnnnnnnnnnagtctcggacatcagccgccctctctacccccccctcccctaaaatgcgtcgcccttcaacctccttcctacagcacacctgcatgtactccttgctggtgaacaccagttcgtgataggtgatgtagtctggggtgtaccccagtccatacagcgccgacgtcgggtgcagaaagcacggcatgccggtccggcagttgacgtactccccgatgcccttgagcttggcggcttggtggaagtaggaggagcatatggcctgcagggcggccgaaaggggtgtgggaggatggggactccgaatgacgatccgagctagggtgccggcaggtgcaatggtttctgcccatgctgccttccccaccttgcgcacgacgtcccagtcgttgccgcagctggtgatggggatgcgctgctgctgcatgatgtcaagcagctgtgtcctgacttccttggccttcttcaggcccttggactgcattgagatttgaggatttgaagcgacggatgaggagtgagtgagagcgaggctgccagctctgagcgtcacgcttttctggcagactagcaaatcccacatccgggccccctcctccagcgcatgcgcggcacctgcaggaagtgggccgagcannnnnnnnnncagcgtctcgcttttctggcagactagcaaatcccacacccggcccccctcctccagcgcgcgcgcggcacctgcaggaagtgggccgagcaccagtcgccgcggtagccgttgctcttccactgctggtagacgtgcaggagggtgaggtggtccgactctggaacgaagaacttttcacgcgcggcgtcgctctcctccgccctgcgagggttggcaggtggccatggggcgtacttggttcagcctgacgctcgatatcatgccaggggctgctccctccatgcaaagcgcctgggttccaacagcactgtgtccccggtctccggccttcactgcccctctcttctgcatcggcacaagatccccctcccttccgctcattcccagcccaccaacctgtcnnnnnnnnnnttccctccatgcaacgctcctgggttccaacagcactgtgttcccggtctccggccttcactgcccctctcttctgcctcggcccaagatcccctcctttccgctcattcccagcccaccaacctgtctggcgggcggaaaaagacggagggtacggagagcatggagacgacggtgagcacctcgttgctgcaccccatctgcgcgcccgccaacagcatcttggccagaggcgggtccagcgggaactcgcccatcttgcgccccagggccgtcaagccgccggtgttgtcaagggcacccagcacccacagctggtacatgctgtgcatgatgttttcctgcgaaggagcgatgagagggagggggggggagtcagggcagggctgagcacctatttctcagtgctcgccggcaaatgagaagcacaaagtgccaggtccaaatgaggctggaccctnnnnnnnnnntgctggcatatgagaagcatgaagtgccaggtccaaatgaggctggaccctccaccacccgcctccgccacacccgcccgcctgccactagcctgggggggcgggtccatgaagtcaaactccaacaggttgtcgatgttcagggacttgagcaggagcacggtgtttgagaggttggtgcgctggatctcgggcacggtggctagcagcatctctgcaggagcgtgaggggggaatggggagtggggcacacattgggtgggaagcaggacagactgggctgctacagtcgccggcagtcaccacacagcaaaccgagttcagcccttgggaggtgcagccggcccggtctgccggtccaaggaacacatctgtgactcagacgccgcctgggaaccctgtgcaagctcaccgtggcgnnnnnnnnnnaggcagccggcccgatctgtcggtccgaggaacacatctgtgactcagacgccggctgggaaccctgtgcaagctcaccgtggcgaaaggcgctctctgtgaacaggcgccagcaggtgcccggcccggtccgtcccgcacgcccagacctctgattggccgccgcctgggactcggggaagacctgcggcgacgtgtgtcagggggtgacaagaatgagggaatgggtcgcaagggatcacagatgtaaggccagtcaccaatgctgtatgtggctgagccctgtccttctacagtaaccgcatccttctgccaggcctgcagccattgtctcaatcccactcgcctcctcacccagccggtcttgaccccacctcccccgctctccctgctcaccgtgagggcatccatacccatcttggggttgtacactttcatcttagcatacccggtgtctatgacatagatgatgccatccacggtcagacttgtctccgcaatgttggtggacaccttcaagcacggtgggagggaggtgagaatttgtggggcaggacgggatcgtgcgtgtgcgcagtaggagactcgaccgtcagcacacaatgcctggacagcgactgccccactgatcgtcccgacctctgcgcaccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggatgtggaagtttgaggggagggtggtcggtgaggaggctcggatgcatccccgacagacccttccggagcccctcagacgtnnnnnnnnnnaaggatgtggaagtgtgaggggagggtggtcgatgaggaggctcggatgcatcctcgacagacccttccggagcccctcagacgtnnnnnnnnnnatggagcaggacgggatcgtgcaagtgcgcaataggagactcgaccatcagcacacaatgcctggccagcgactgccacactgatcgtcccgacctctgcgcaccactatcttgcgggtgccctcaggcgcgcgctcgaagatcttggcctgcaggtccgagggcagctgggagtagatgggcagtatgagggcatccggcacaccctcccccagctgttcgagccgctcctgcnnnnnnnnnnnnnnnngcacccacgcgggaaagccagaaaacacaccgcgatggagaagcaggtggcctcgatctcctcctgccccgtcatgaagatgaggatgtcccccggaggatggccaaggtgcacggcaatggcctgcttcacggcagcttccacataatcctcctgcagcagtggggtcgggtgggggttggtccacaggagacagggtcccaccttggtgtggtggggagggggccctgtagctggtgcacctcggcgctcaacgtacccataccaagagcagctgccgcgctgctggggacgacatggcctcgcctcccacctacctggggcgtcttggagaagaggacatcgacggggaaggtccgcccggggatcttgaagatggggacggagccgaagaagtcggagaacttctgggagtcaagggtggccgaggtgacgattaggcggaagtcacggcggcgagccacaacctgctcaggttggttggtggagaaacgtgaggggctgacagggagtacagaggggtcggtctcatcggctcctttacaggtgcgtgacaatggcgcatcagggtgtcaacattcttcgggagcatggaggtcggggccctcctcgctgatgccagattctcccgcctccaagtgagcaggaaggggcatcccgggcagcatcctgcctcaaccgctctacgaccctcccccagcgccccatcaccttcttcagaatgccaaagaggacgtcagtgttcagggatcgctcatgggcctcatccataatgatggcagagtacctgtgacacgggcagcgcatggattggcttcatgacagtcggctccaagcaggcgcgcctgggacaggaaatcattcttctagcctcctctggtggctgaaccacagnnnnnnnnnngaggcggaagtcacggcgccgagccacgacctgcacaggttggttggtggagagacgtgaggggctgacagggagtgcagagtggtcggtctcatcggctccttcacaggtgcgtgacaatggcgcatcagggtatcaacattcttcgggagcatgtaggtcggagccctcctcgccgatgccaggttctctcgcctccaagtgagcagggaggggcatcccgggcagcattctgcccccaccgctctacgaccctaccccagcgccccatcaccttcttcaggatgccaaagaggacgtcagtgttcagggatnnnnnnnnnngcttactagtcggagtgacgcacactatccccttgacgatgctgccaacatccatgtttgcagccaccccccaactattcaaattaatccccccccccccttgctcaaccctcctgttcctccgcccacctgtcaagnnnnnnnnnnccttacgagttggagtgacccacactatccctttgacgatgctgccaacatcaatgtttgcaaccacccccgaacttttcaaattaaatcaccctcccccttgctctaccctcctgttcctccgcccacctgtcaagatcgggctccaccagtgtctcacgcagaagcacgccgtccgtcatgtacttgatcaccgtgtctgcggaggtcacgtcctcgaagcggatggagtagcccacctcnnnnnnnnnnccccaccaagccaaaggtggtgtacccgtcctcggccaggtactgggtcatctgcgtggtcttcccactccccgtctcgcccaccacaaccacgacctggttctcgcggatgacctggcatgagacaagaggggaatgagggggttgggggaggtttgtgtgagtggggttgagagtggagtgggggctgcttgggtggctgttctgacacggcagccatggtgcaaggctcgacctctcgtcgagacggcctgttcaaagacagggacgctgatcctcatcgaaacctgctattcccctgccagtccctcgcagactcatgcacagcagggccaggaggaggcgtcccctcccatccagctgggatctcgcagcaaaacagagtccccagctcctagctccccctcctccttgaaccctttagcacaagtacctgcagcatctcctcccgcacgctgtagacggggagaaagcggcgctgctgggccagggtcttggtccgcgcgaactcggacgccgcctcgttggtcttcatgtgcgtccggaactgcaggtgtggatgaggaaaagcgggggcgatcatgctgccgcaccactcgggtgtgtcaaaaagagccatgcttgcccggccccttgcctcatgcatgcagcaccctcccccttcatgtctggcgggcacttggggcagccaaagccagtcgccctctgccctggagctttcaattcctcccttcccctttccccctaaggacccccccgcttgctacaaggaccagaaacaccagccacgcacctggctcttgccgcggtagtcaccctcgtcgtcgctgccctgctccaggcgcatgagctcctcctggcgcgccttctcctcgcgctcgccgcccgtcagccccgtgatgctgcccatcttggagccggccacctcccagaaccgggcccggctcttccccgcctccttcttctcgcgcacctccttgaccaggcgcgacccggcgcgcgcgatcaccgccaggtcggaggtcgggtccttcagcggcagcaccggcccgcgctggcgcgtgaacagaaagcgcccgtccaggaacggcggccgggtgtcgtgcaccagcagcacggtgcgcaggtcggcggcgtcgtcaaactcggtggccacctctcgcaggcgcaccaccccgctctgcaccagccggttctcctcccaggcgttcatgtccttctgcagctcccccgcgcgcttgctctgggccagcgtcatgagcgagccgtcgcggcgcgtgagccggcgctgcgccgcctccgcgcgccggcgcagcgccgggtcgacctctgcgtcgcccaggaaggggttgtgcgtctcgtccaccgtgcccccggcgtcgtcctggtcgtaccagtcgcggtccagctgcgcgtcctcgctacctcgcgccgtgccctggaggaaggagggggggaaggggttgagggggcccgcgtctccagcgtgcccagcgcatcaacctccccgccacacacccgcacacacacaacagcacatcatgaagaaaggacgcccagcacacccacctcgccgccgtgcannnnnnnnnntctccacacccgcacacacacaacggcacatcatgaagaaagggcgcccagcacacccacctcgccgccgtgcaggtccggggagcggtccagggtgggctggccgccgggcgcccggttccaggcggcgctgcgccagctgggcgtcgtggcgggcgaggcggcgggccccgcggcgaagcgcacgctgctgcgcggccgcagaggctggccggggccgtcccctgcggcggacc

SEQ ID NO: 42805 - DNA, 118 bp, Chlorella protothecoides
ggtgtgggtggcacgtcattgcggcccccctacttagccgggaagtacttgaattgatcagtatgccgtccgtgagcagcgcgtttgaagcccaaacctggtcagtcaaacctgcctc

SEQ ID NO: 42806 - DNA, 75 bp, Chlorella protothecoides
ctcgtggtgggtcattgagcgtgggcactcgctggccgcgttgtttcagcacagatatgaaagctgtggtgcccc

SEQ ID NO: 42807 - DNA, 123 bp, Chlorella protothecoides
catggcggtcatcccagtacatccaggtccattgctatgcgcttgtatgtgcatcacaccgcatccaccaccaccgtgcatgcaggcgtcgggcgtgaggggtggcacatcgacggctccttc

SEQ ID NO: 42808 - DNA, 76 bp, Chlorella protothecoides
gtgcggagctgaagcaaaccctcgcattgattccctgcctattgcacatccggtcacccaccaagagacagcggct

SEQ ID NO: 42809 - DNA, 61 bp, Chlorella protothecoides
gcatgacgtcctggacaggtacggcggaggggggcgggatcacagactctgaatcaggttc

SEQ ID NO: 42810 - DNA, 61 bp, Chlorella protothecoides
agatgtgaataatcagtcttgggggggggggcggcgatctgttgtcgggattttactagtt

SEQ ID NO: 42811 - DNA, 90 bp, Chlorella protothecoides
cgtgcggtactgcgggcagctgccggtgctactgcagtaccagctgcgcgacggccagaccctgcgggcccctgccgctctaagcaggca

SEQ ID NO: 42812 - DNA, 76 bp, Chlorella protothecoides
ttggggctgggggaggcggcggccttggggctgggggaggcggcgaccttgggggaggccacgggcttggcggccg

SEQ ID NO: 42813 - DNA, 61 bp, Chlorella protothecoides
gatcggcggcaagttcgtggatgctgctgggggagagaccttcacgtctgtggacccccgc

SEQ ID NO: 42814 - DNA, 80 bp, Chlorella protothecoides
ccttgctcaggtcctgacgctgcagcgggccccagtgccacagctggggatcctggtgatgatagagcggggatgcccgc

SEQ ID NO: 42815 - DNA, 61 bp, Chlorella protothecoides
ccccaaactactgccggctcgtgtggcaggggcggggcatgagtgctgaggctttgttgtt

SEQ ID NO: 42816 - DNA, 87 bp, Chlorella protothecoides
ctactgcccggtgcatgaaaccggtccgccagagcctccccgccatagcgatgccgtggccgattcggcccctgcagcaggcggcaa

SEQ ID NO: 42817 - DNA, 395 bp, Chlorella protothecoides
  modified_base (160)..(307): a, c, t, g, unknown or other
gcggcggccatgcgctccggcacggggcgctgccctgcagcgacggccgccagcagggccagggggaagcccagcgaccagagcgcggccaggagcggcgcagcgggccaggccgtgggggcgccgctgctctcgtcgcccgccagaaacgccccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccagggccaggaaggacagcacgatgattgcctggagcaggggcgcgctgggcgcgtgctccgccgccacatagacaccgagggc

SEQ ID NO: 42818 - DNA, 61 bp, Chlorella protothecoides
ccgcatcgcctgggtgaacgaccacgcggcggaggccttccaggacgcccccagccacaag

SEQ ID NO: 42819 - DNA, 71 bp, Chlorella protothecoides
ctgagcgagcggacgggcgagggcgcgcgggtgagaggcgcttttgggggggggggggggggggggggggg

SEQ ID NO: 42820 - DNA, 66 bp, Chlorella protothecoides
ctccgcggccgcgctcgcctgggcgtggggaggggtgacgggcgggagggggttgagtatcgagtg

SEQ ID NO: 42821 - DNA, 78 bp, Chlorella protothecoides
ggtgcagggcggcaggaccagtgaatggcacatcgtatggcgtgatcgagtgtgagggacggagaatttacaagtggg

SEQ ID NO: 42822 - DNA, 61 bp, Chlorella protothecoides
gactggcgccgccagcgcggcgactcgcccccgcagcccccgtacgggggagggcccggcg

SEQ ID NO: 42823 - DNA, 61 bp, Chlorella protothecoides
caggggcgcagcggcgggccaagcggggggtgaaacgctgcactggctccaagatggtgca

SEQ ID NO: 42824 - DNA, 65 bp, Chlorella protothecoides
gaaacgctgcactggctccaagatggtgcaggccgtgctgctcaacatcccaccagcagaacgct

SEQ ID NO: 42825 - DNA, 74 bp, Chlorella protothecoides
tccgggttgtcccggaacgcctgcgcggggtaggggggacgcactctcgctctctgaagctgacagcggcccgg

SEQ ID NO: 42826 - DNA, 61 bp, Chlorella protothecoides
cgggcaagcagcgttgtcaagtatggaagggctagcgggaagtataggcacagagcaatag

SEQ ID NO: 42827 - DNA, 80 bp, Chlorella protothecoides
cctctccaggctgtcgccggcagcccaccccacggcgcagcgaccgtgctcctgcgccctcggcacaccgccctcctctc

SEQ ID NO: 42828 - DNA, 62 bp, Chlorella protothecoides
gccgagggcaaagtcggaggcgtcgcaccatatgacaaggtttctggtcaagtctgggcagg

SEQ ID NO: 42829 - DNA, 116 bp, Chlorella protothecoides
cgaggccattcccttccgcagcgccatcgcagacggctgcacgcacgcgctggtgctctgcacgcgccccagaccccggccgcgcaccggacccatggacggcgcgctggagggcg

SEQ ID NO: 42830 - DNA, 79 bp, Chlorella protothecoides
ggggacgccctccatgtccctagggttgtgggggggggtgttttggggtgtgttcagaacagggaggagaggaggtggt

SEQ ID NO: 42831 - DNA, 4276 bp, Chlorella protothecoides
  modified_base (499)..(508): a, c, t, g, unknown or other
  modified_base (581)..(590): a, c, t, g, unknown or other
  modified_base (706)..(715): a, c, t, g, unknown or other
  modified_base (3530)..(3539): a, c, t, g, unknown or other
  modified_base (3669)..(3678): a, c, t, g, unknown or other
  modified_base (3790)..(3799): a, c, t, g, unknown or other
  modified_base (3941)..(4045): a, c, t, g, unknown or other
aggccccggcgcccgcctttgccagcggcagtggcctcgcccccccgcccgacgccggccccgccagcaaccccttcttcagcgacagcgcgtgggggccgccggccgcaccccccgccgcgcccccctccgcccaaatgcctcccccgccgcagcaggccgccagcaacccctttggcggcggcggcggcgtgcaggcgccggcgcccagcaacccctttgcctcggcgaacgacgccggcacgagcaacggcaacggcccctccatgcacgcgcccgcccctgcgggcggcacagacgcgtttggcgagtcctggggcgtgcccgcgcccgcacccccggcggcgctgtaccccgccctgtactcgccgcccgggggcgaccaggccccggccagctcggctggggtgtccgacgctttcagggacctcctgagcctgcagaagaaggcggaggaggcgccgcccccacccaagtgagcggggagcgtgcagtggcnnnnnnnnnntaacacacacacaaacacacacccaacaaaaaaacatgcctcccctcccaagcaggggttcgccgatgcgcannnnnnnnnnagcgggggccggggccggtgggggatcggcatggacggggtgaggacgacgcgagctggcttacctttcttctgcaccacctccgccgctccaccggacgggagtgcggcgcagtnnnnnnnnnnggcgggggccggggccggtgggggatcagcatggacggggtgagggcgacgcgagctggcttgcctttcttctgcaccacctcctccgctccaccggacgggagtgcggcgcagtagtccaacctctcaacacacacacacccacacccaacaaaaaaacatgcctccctcccaagcaggggttcgccgatgcgcaggaaccagaacgtgcacgcggcgacctcccccacctccaacggcgcagatgccttcagtgcctttgactccgtgccgcagatggggcaggctccgcccaagatctgacgttcgctcctccttggaatcgcatggagcctgtcccctactccggccactgcccgcttgcccaggccttgcttcccttgatgctacacgtgaggttgactgacgacgtttgatcggctgtggtgcgctgtgcagcagctctgaatcggggagcaggcaatgacatggggatgcggggggggtccggggggggaatccgccacacgctttcgagaaaggtacacagagacgcaccaagagctcgcctctcctcagactctagcgaggcaggcaaggtaccatgtatgaaggatcatgctgatctcgaatctcatcttggttgacatgacccggaatagctctcaagctgcagcacagaagaagatgggcaaccccctcgacacactgtccattcagagccggctgccgagcgtcgtggcatggcttgccaggaactcggtgatgtgccggttgaccagctcgggtctggcaaggggttgaagatgatgtgaggaggggtccagaaaaacattgaagaattgaacacacccaaagatgttctgaaggcaagtgcttctctgtgagcaatgcagcctgccttgcgggggaagtggcctccaccctcggcacagtcaaatccacccatccaaccgatactctgtcccccaacagccgtgctcccttccacgctgtcggtaacacacctgtcctgctgagcccagtgactgcagtcggacaggccgatagtggtcaggtcctctacatgcgcctcggtgtcttcaaagaccttgggtgtgaatgcgccgtcgtcctccgcccacatcagcagggtgggaaccttcagcttgcccttcttgggcctgcagtgaggatgtgcggggggtgcgtcctcctccgaccccataggagagcctgcgcaaaggagcacgagtcacggctctcccccccgcccccccccccccccccccccccccctgccttacttggggtatctagggtcgtagcggtacaatgccctgtagtagttgatcatggaggtgagggctcctgggcggctggctgccaccttgtagcgcgcgatctcctgtttgggaatggggtgtggggtgggcagggtgagggcctgccggccagagcctgaggcggggtcaagggccgacctccatatctcatactggtaaccctgcatacctctgggctgatgcgatcgcggtttctcaaccccatcttcctggaggtgaacatcttttggatgaagacaaaattgtcgtcagacaggacggcctcggggatccagggaacctggttgttggggaagatggcagggttacaagggaagggatttggagtgacgcatgaacagggcatggatccccatcaggcgcgtgcaagcaagcagagagggcgtgcatgccattgttcaaacgcagcaaacagtcgacatgccccacatcccctgcttctgaccgcctcactcccaacccaatcacacacctggaagaagaagatgtaccaggacttgagcatttgcgccgtggtcatcttctcgaggaagttggacgggtgtggcgcacacaggacgacgaggtgactcagcagctcggggtgagccctggccaacacccaggcgactggaaagggggagtgtggagggaagtgggtggatgggctgggatgtggtggcagatgctttgagcaagcagtgagggtatcccaccgtcacgccaggccccaaaccccctcccagaagttgggaggcacctcggcaagccttgcatgctgccatgcaagcgacacgtgtgaaaaatcaacacattcggcagagcacaatctgtccgcccgcactcgactcactcacgccgccccaatcatgagcaaccagggtcacttgacggtcggggctcacgctcttgatgatggtgacgacatcagacaccagcagcctcatgagatacgagtcgatgccctgcaggggccgggcagggcagcacctttcagcaggtggtgtgcagagaagcagtcagccctgccttgacaaatacgccccattcgacagccaagggctgagcattgtgttttcatcttcttggacgatgcaaagatcctagcatcaaccaaagagatagagagctatggctggctggaagcccaatgcttgccctcgcctcccagcccctcgtgcgcaccaggggcttgtcgctctcattgtatccccgcatgtcaaaagccaccacatcatactcctgcttgaagtgctcgagctggtgcctccacgagaaccaggcctctgggaagccatggatgaagaccatgacgggcttgggaggaatggaggtggatggacctgcacgaaccgtgtgcagccggatgccatttgccaccagccagctgtgatgcaggccggggacgaaatccctggcggaggcatctgacgcttggatcgcaagtggaggacgtcgttctcccttgatgaacctgagtgtcgcacaaggggacagtgggaggtggttcaggtgtgagtttacaccatcannnnnnnnnnccgctgatgcaggctgcgacggcagggccgtgccagctgcccacaggtactgctcggtgattgcttgccgggcctccctgcaagggacgggcgaatcagcgaggtcaggcgcttgcaagtaggctcctcnnnnnnnnnnggcgcgaggtggcacacaccttgtaaccttggaaatggcaagggcaccagagataggtacagccaataggtaacccgtgagataaaatgctgcctgccgcaggtatgcttgnnnnnnnnnncggacgtcgttctcccttgatgatcctgagtgtcgcacaaggggtcagtgaaaggtggttcaggtgtgagtttacaccatcactcgacggggtatcaaggtgtggcttcacaagggcacatacgcacgccagggtgccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgctacgcccgacatccggtgagtgtgtgtgtccttgacgccggaagagctaataaccccaaacgtcctccctgcaaaagtacgagtactcaatatttgacttttgaaaagtatggtgccgggggcaatgtcttcagttttgagggtatcgcagattttgcaatccccgatcttcgttcacatcttttcttgaaccaggcgcccaccccaagacaatgtcatacctta

SEQ ID NO: 42832 - DNA, 136 bp, Chlorella protothecoides
ggcctcctggcagcgcggcgccgctgtgcgcctgctcctccgcctgcagcggcccgaggaaagcgaggcggcgctcgaggaggccgcggccgcgctggaacgggatgtggccgtgcgcgacgccgagcgccaggcc

SEQ ID NO: 42833 - DNA, 97 bp, Chlorella protothecoides
ggggtgcggcatcggcgccgccctgctggcgcgcagccatggttaccgaaggtgtccctcgcaccgcgacttccccccccacacactgccgtcagtt

SEQ ID NO: 42834 - DNA, 5515 bp, Chlorella protothecoides
  modified_base (324)..(333): a, c, t, g, unknown or other
  modified_base (775)..(784): a, c, t, g, unknown or other
  modified_base (969)..(978): a, c, t, g, unknown or other
  modified_base (1192)..(1201): a, c, t, g, unknown or other
  modified_base (1345)..(1354): a, c, t, g, unknown or other
  modified_base (1507)..(1516): a, c, t, g, unknown or other
  modified_base (1969)..(1978): a, c, t, g, unknown or other
  modified_base (3850)..(3859): a, c, t, g, unknown or other
  modified_base (4185)..(4292): a, c, t, g, unknown or other
  modified_base (4474)..(4483): a, c, t, g, unknown or other
  modified_base (4777)..(4786): a, c, t, g, unknown or other
  modified_base (5000)..(5009): a, c, t, g, unknown or other
gcgctggtgcgcagccaccgcgcgctgcgcatcgagaccgcccggcgggagctggcccagcgcgccgacgcggcggcgcggcgggcgcgggacgccaaggcgctcaagggcgaggtgctgggggagcggggcggcgcgctgcgcgacgcgctgtccatgaggaacaagggtgcgtggcggagtggtcgaggcccgagggggtgggtccgagagggttgcgaacctgcgactgggacctcgggcccggcggtgcctggtcgcagcgctcgcgtgctgccctcaacctgggcaactccacccgacaccgcctcacggactcgagcnnnnnnnnnnttgtccatgaggaacaagggtacgtggcggagtggtcgaggccccagggggtgggtcgagagggttgcgaacctgcgactgggaccctcgggcccggcggtgcctggccgcagcgctcgcgtgccgccctcaacctgggcaagtccacccgacaccgcctcacggactcgagcacagggctgctgcgggcgcacgagcgcctggcgcgggagaggaacaagctcaagggcgacgaccgacagctgcgcctggaggccctcaaggcgcacgacttcgaggcgtaccaggagatgctgcgcgcccagtccacgggcgccgcctcggcgggggagaagtacgttgccatctccaagttcctcaagggtgagggctggagagtttgcaaggttcggcagcccagagggtcgtctcactccccgcatgtgctgctttggtgccctgnnnnnnnnnngtgcaaggttaggcagcccagagggtgcgtcttactccccgcatgtgctgctttggtgccctgcgaacggaaccctccaacatcgtccctgcctctgagtgcccctcttgagaacacccctcctctcccagacacggaggagtacctcattcgcctggccagcaagatcgccggggtcaagctgnnnnnnnnnngccctgcctctgagtgccccccttgagaacacccctcctcccccagacacggaggagtacctcattcgtctggccagcaagatcgccggggtcaagctgtccgccgaggtgtccaaggccactgccgacgccatagtcaaggcccgggcgcaggtgcggccggagggggcggtggggcccgcaagggtagcaggctgtggagctggaactttannnnnnnnnntgtcaaggcccgggcgcaggtgcggcccgcgagggtagcaggctgtggagctggaactttacagccacatagcggacgacagaagatgtcgcaaggttctcacttgacatttttgccttccctgcgtgatcctcgccgtgcccnnnnnnnnnnggatgttgcaaggtcctcagttgacattctgccttccctgcgtgatcctcgccgtgcccatcaacgcttcttccgcacccccaccttcccccgaatcccaacagggcctgagcgaggaggacgtccaggcggcggcgcacgcggccgcccagnnnnnnnnnnctccgcacccccaccttcccccaccttccccccaatcccaacagggcctgagcgaggaggatgtccaggcggcggcgcacgcggccgcccaggacgccgcctccaacagcgccgtgctgcgggcggcggggggcggcggcggcccctccgacgcccagtcgcactactatgagctggcgcacagcaaccgggaggccatcgccgagcagccatcgctgctccgcccgccgggcgacgccaggctgcgcgagtaccagctggtgggcctgcagtggatggtcagcctgtacaacaaccatctcaacggcattctggccgacgagatggggctgggcaagacggtgcaggcgagtgaggccgtgcaggactgtgatcgtgggtgagggggcgcggtggcgagcgggcccagggtgggtcgtggccgtgaggccaccacccctctcaccccccccnnnnnnnnnngggcgggcaggactgtgatcctgggtgagggggcgcgctggcgagtgggcccagggtgggtcgttgctgtgagggcaccacccctcccacacacacacacccggacccctgatcccataggtgatggcgctgatcgcgtacctgatggagcacaagtccaactacggcccccacctgatcatcgtccccaacgcggtgctggtgaactggaagagcgagctgacgcagtggctccccggcgcgcgctgcgtctactacgtcggcacgcgggacgagcgcgcgcggcgctacgcgtcggaggtgcagagcctgcagttcaacgtcctggtcaccacctacgagttcatcatgcgcgaccgcgccaagctggccaagatcgactggcagtacatcgtcatcgacgaggcgcagcgcatgaaggaccgccagtccaagctggccaaggacctggaccgcttcacggccgcacggcgcctgctgctctccggcacccccctccagaacgacctgctggagctctggtccctgctgaacctgctgctccccgaggtgtttgacgaccgcaagatgtttgccgagtggtttggggacggcggcgcgggcgcgggcgcgggcgccggctccgaggccgactggctggagaaggagaagcgcgtggtggtcatccaccgcctgcaccagatcctggagcccttcatgctgcggcgccaggtggaggacgtggagagcaagctgccagccaaggtggcgatgacggtgcgcgtgcccatgacgccctaccagtccgccatctacgactgggtcaaggcgacggggacgctacggctggaccccagcgcgcctcaggagtacaagatgaagcggcagttcgcctcgctgaacaacaagtgcatggagctgcgcaaggtgggcgatgcctttttgctttggcgtgcttggagggtgggggtgggggttgggtgcggggtcgaccgaggcctccagcccgtggctgcccctgcctgcgcagcccatgtgtctgcgatctggcttgccatcgacatccccatgcacaccgagcccctgatcccccccccctttttgtctgcgcagctgtgcaaccacccgctgctcagctacccgccgctggactggggcctgggcgacgccatcgtgcgccagtgcggcaagctggtggtgctggaccggctgctggtcaagctggtggccacagggcaccgcgtgctgctcttcagcaccatgacccgcctgctggacctgctggaggtgtacctgcggtggcgcacgctgccgcccgcggcctgccagttgctggaggaccggcggcgtgcttcggcggcggcggtcaagcgagagggggcccaatcgggcgccggcggcgatgtgacggcgggtgctgggaccgcaggagagccggccggggccggcgcaggggcgggcggggatgctggacagccggacggtcctgcaggggccgaggagaccacaggagcccccgcctcgccgaatcccccgccaccaccgaggcggaccatgggctacctgcgcatcgacggcaccacagcgctggaggaccgggagcgcgccatccaggccttcaacgcccccgactccgacgcctttgtgttcctgctgtccatccgcgccgcggggcgcgggctcaacctgcagagcgccgacacggtggtcatctacgaccccgaccccaatcccaagaacgaggagcaggccatcgccaggtgtgtgggtgggggtggggggaagggggtcttcgaaagcgcaggaatcagaatggatggaggggtttggtggggctcacgcccgttttccctgccgcctctgacacgcctgccattcacagtccacacgatnnnnnnnnnncatggaggggtttaatggggctcacgcctgtttcccctgatgcctccgacacgcctgccattcacagtccacacgatgcctcgccttccctctccatcccctccacccccccctccctctccatcccctccaccccccctccctctccatcccctcacccaccccttcctcacccaataataaaacactactgtgaaggtctcaccgcatcgggcagaagaaggaggtgcgtgtgattcatctggaggcggtggccgaccccatcccgggccaggtcttttcagatcaggattttgggggcgggagcggagcgggcgaggcgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacggcggctgtggccgggaaggagctggcgagcggcggggcacccacgggggggccgccgctcgacgccgcgccggcgggatgcgcaccaggtggcggcgcggtgcccgccgccgccgcgccgcttgtgggcgccctgccggccgccacgccgcccacacctgcgccccggctgtatgnnnnnnnnnncggcggcgcagtgcccgccgccgccgcgccgcccacacctgcgccccggctgtatgccgacagcatcgagtcgctggtgcgcaaccagatccagcgcgtgaagatcgacatggccaacgaggtgatcgacgcggggcgctttgaccagcagaccaccaacgacgagcggcggcagaccctggaggccctgctcaaggtgaggggggtggggcccgtggtgggtgtgcctatggggtgggtgggcggcatgtggtggaagcctagccgcagggtgtggggtgccgcccatgggcnnnnnnnnnngccgagatgtgtgtgcctatggggtgggtgggcggcatgcggtggaagccttgccgcagggtgtggggtgccgcccatgggctcacctcgacgctcgcgatacccccttgcagctcgcattctcgaaccccccgcagctccctccccccctcccacccccaaacgttaccgaacaaacccacgactcctccccaggacgaggcgcggacgagcnnnnnnnnnncacccccttgcagctcgcacctcgatacccccgcacctccctccctccctcccacccccaaatgttaccgaacaaacccacaactcctccccaggacgaggcgcggacgagccaggcgcaaaacacggtgcccacgtggcgggagctgaacgagcagctggcgcgcgggcccgacgagctggcgcagttcgaggcgctggacgcggcggtggactggatggagcccgcgcccgtgagtcacatccccccctggatggcctggacgcccgaggacctggcggccgcgcagcgagccgccgcggaccgtggccgccccaagaacgtggcggcggagctggcggcgctaacggggacggtgctgcaccaccaccacacgacgggcggcggtgcgggcgcgcacggggagggggcggccgcggcggcacagcacgccgtcgacccggggtcgctgacggcgggccgagagcggcgcatctcctttgtcgcgccgcgagccgcggaggccg

SEQ ID NO: 42835 - DNA, 66 bp, Chlorella protothecoides
cactccctcaccctcagccacgcccccaccaagcgccactccctccccgtcgagcacaccctcacc

SEQ ID NO: 42836 - DNA, 79 bp, Chlorella protothecoides
cacggtggctgagcgccatccctggtacccacattccacactcccccaccccccaccccccctcccctctcctctgctc

SEQ ID NO: 42837 - DNA, 133 bp, Chlorella protothecoides
gaggctgggggcgggggctcctgtgcgcgacgcggcaccattggctacccctccctccccccgacgcctccgcgcaggcctgccccctgggagcgcggcgcagtcctaccgccgcgtccaccccgacctcccg

SEQ ID NO: 42838 - DNA, 61 bp, Chlorella protothecoides
gcccgacctacaagacagcgagcacagcggcgctcctgtcgcgggtcgtaaagatcgtccc

SEQ ID NO: 42839 - DNA, 28002 bp, Chlorella protothecoides
  modified_base (174)..(349): a, c, t, g, unknown or other
  modified_base (724)..(733): a, c, t, g, unknown or other
  modified_base (2880)..(2889): a, c, t, g, unknown or other
  modified_base (3858)..(3867): a, c, t, g, unknown or other
  modified_base (4045)..(4054): a, c, t, g, unknown or other
  modified_base (4124)..(4133): a, c, t, g, unknown or other
  modified_base (4499)..(4508): a, c, t, g, unknown or other
  modified_base (4640)..(4649): a, c, t, g, unknown or other
  modified_base (4911)..(4920): a, c, t, g, unknown or other
  modified_base (5149)..(5158): a, c, t, g, unknown or other
  modified_base (5649)..(5658): a, c, t, g, unknown or other
  modified_base (6180)..(6189): a, c, t, g, unknown or other
  modified_base (6617)..(6626): a, c, t, g, unknown or other
  modified_base (7248)..(7296): a, c, t, g, unknown or other
  modified_base (8251)..(8261): a, c, t, g, unknown or other
  modified_base (8335)..(8344): a, c, t, g, unknown or other
  modified_base (9714)..(9723): a, c, t, g, unknown or other
  modified_base (10004)..(10013): a, c, t, g, unknown or other
  modified_base (10186)..(10195): a, c, t, g, unknown or other
  modified_base (10772)..(10781): a, c, t, g, unknown or other
  modified_base (11553)..(11562): a, c, t, g, unknown or other
  modified_base (11618)..(11627): a, c, t, g, unknown or other
  modified_base (12167)..(12176): a, c, t, g, unknown or other
  modified_base (13101)..(13110): a, c, t, g, unknown or other
  modified_base (13643)..(13652): a, c, t, g, unknown or other
  modified_base (14028)..(14037): a, c, t, g, unknown or other
  modified_base (14557)..(14566): a, c, t, g, unknown or other
  modified_base (15025)..(15034): a, c, t, g, unknown or other
  modified_base (16528)..(16537): a, c, t, g, unknown or other
  modified_base (16915)..(16924): a, c, t, g, unknown or other
  modified_base (17605)..(17614): a, c, t, g, unknown or other
  modified_base (18075)..(18084): a, c, t, g, unknown or other
  modified_base (18313)..(18322): a, c, t, g, unknown or other
  modified_base (18582)..(18591): a, c, t, g, unknown or other
  modified_base (19197)..(19206): a, c, t, g, unknown or other
  modified_base (20374)..(20383): a, c, t, g, unknown or other
  modified_base (20589)..(20598): a, c, t, g, unknown or other
  modified_base (20802)..(20811): a, c, t, g, unknown or other
  modified_base (21219)..(21228): a, c, t, g, unknown or other
  modified_base (21565)..(21574): a, c, t, g, unknown or other
  modified_base (21648)..(21832): a, c, t, g, unknown or other
  modified_base (22028)..(22037): a, c, t, g, unknown or other
  modified_base (22110)..(22270): a, c, t, g, unknown or other
  modified_base (22689)..(22698): a, c, t, g, unknown or other
  modified_base (22900)..(22909): a, c, t, g, unknown or other
  modified_base (23080)..(23089): a, c, t, g, unknown or other
  modified_base (23217)..(23226): a, c, t, g, unknown or other
  modified_base (23631)..(23761): a, c, t, g, unknown or other
  modified_base (23900)..(23909): a, c, t, g, unknown or other
  modified_base (24521)..(24530): a, c, t, g, unknown or other
  modified_base (24638)..(24647): a, c, t, g, unknown or other
  modified_base (25262)..(25271): a, c, t, g, unknown or other
  modified_base (26128)..(26137): a, c, t, g, unknown or other
  modified_base (26531)..(26540): a, c, t, g, unknown or other
  modified_base (27169)..(27178): a, c, t, g, unknown or other
  modified_base (27677)..(27686): a, c, t, g, unknown or other
cctggacccggcccggcgccggcacatgaggaccgtgcgcgccgaggcctcggccgtgctgcgcgcgctgtgcgaggccgcacggggctccgggcgagtgctgcgcgagctggatccccaggcattctcgttgacggtcgaggtgggcggcggcggcggcggcggcttgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggcgcgagcgtgggcggggactttgcggaactggtgtcggccatgtgggcggccctggacgggctgtgatggagtgttttttgtgcccggccggcgacagttctggaccggcgccgaccaggctgccgcacctggtctcctcgcagccgggcggcatgcaccgctggagtgcttggcacccaccactggtgctgctgcaacatggagcccaggacacagaggagggcatccaatgctccagaggctcaaccagaggtattggatgcaagaggtccttgccagcgtggaactttttactgaacgtcaagatcgacatgaatcttctgataagaagtcgttcttgtgcctgatcacctgttgacaaggtgaccnnnnnnnnnngacccaccattggtgctgctgcaacatggaacccaggacacagaggagggcatccaatgccccggaggctcacccagaggtattgaatgcaaggggcccttgccagcgtggaacattttactaagcatcgagatcgacatgaatcttatggtaagaagtcgttcgtgtgcctgatcacctgttgacaaggtgacctccagggacgggctccgttcccctctgttgaggtgccggacaggaagcctgccacccgaatgccacgcacacacattggagacccacaccatgctctggccgaatccctgctaggtgaatgcgtgacttggcatactcgacacaccatgcactgttcgtgggacctcgagctgtggcaatgactccagggcgacaagttgacagcagagtccggcctcagcgcagaaccctcacacctccgactgagggtatcgatgcggtgatctgtcattcctagcatatgccatggcgtcagggtcacccataagccctgctcagctgtcttccaggctgcagcgggccatcagcccccagctctgcgagcatctgaccaggaagggctgggcggtggccgacggggtgttcggcagtgacgtgacctcagccttgcggaccgagcttgcgtccctggcgccctccatgcagcacaacagcacggttcttgtgcatcccgggtcggggaccagcctcctccccaagctggccatcaatgaagccgagctccgagacccggtatgtgtcagagagggtggggagggtggggaggggtcgcactccactcccgtacagcctgccatgccacccccagatggtccaaccggtattgattccaaccaaatagccgcaatgccccacaagaatcatcctccctgatccatccctggcaggccacatgcgccgccgctcccttgtgctcggcgctgcaggaggacgccaccctccgggtcatgctgtcgctcttcctccccggtttgcgcctcgagtcccaggccatcaaggcacagcacaacacggggggctgcttccccatccacactgacagcgactttggggtggacgggcggtgcattactgcgatcgcatacctgaaccctgggtggcaaccctggcagggaggggagctgaggctctacccctggccctcggaggcggtggacatcgcacccctggacgacaggctgggcctgttcagctccaagaccatgctgcacaggtgcagctgggggctggcgagtggaaggagtggggtgagaggatttgttgctctgggactcacactttcagcctgccacacggagcttggaggtcagcaagggctctctcttgggtgcgaactccatcatcacaacgtctgctcccacttctggcaccccctccagggtcttgccatcacgggcagcagaccgctactgcttcaccatgtggctgtcagaggggcggagccaggcccgacccccgaccccactccagcccgaggtggggacgagcgaggaggcatggaggcgcctcgtccacccatcgctgaggaagcacgcggcacggtggtggctgagggacgagtgggccgccagcctggagcaggcgcacccaccctcccctgcccgcgatgccttgctggaggggttctggggggaagtgggcattattgagcgcgtgatcaaacccctggtggaccgggcacagccgcctggaccgcccgtgacggagtggctgtgaggagggctcagtgttggaattacccagaccactccagagggtcgggaggtgcactatgtggaggtaccctgcagttcactgacctccaatttcgagcattaaagtctggttgagtttgaatgaagcatgctgcttgaaaagaaccatgttgtatcagttttgtgagggacatgggcattggacccttgccactccttcttccagcccacgacctagtgtcggggctcgacgtgggcgagggtgcgccagagcaggcctcgagacaaaatctcatacatagtcgtgacaaaggatgtccacccgggtgtctcgtccttgcccggcatcataagggcccctctgggtgcctccacatcccgctgcaattggaggcccagcgccttcagggagattcgcagatctacggcagattgcgnnnnnnnnnnggtgggcgagggtgcgccagaacagacctcgagacaaaatctcatacaaagtcgtaacaaaggatgtccaccccggtgtctcgtccttgcccggcatcataggggcccctctgggtgcctccacatctcgctgcaattggaggcccagcgccttcggggagattcgcagatctacggcagattgcgccagggacaagcacccaggttgcttccatcccgagcctgccccccttccccacccgactccgtgacgggcaccataacttgcatgtggtatgcattccatgtatggagagaaacgggtgactcgccttgaccacgtcccccagtgaggcccagtagctccttcgggtcgggacctcggggcaagaggcgctccgtagtcgcgtgtccgtcattacgcccccgaatgagctcgacaccctcctccgccgagaggaaaggcatgacgactgtcgcacaggcgtccacgacggggccggagccggcagccgaggacgagaatgcgacctacaagtcggacgcctttcgcatgcagtgtatgaaggtgcgggactccaccagtcattccatgatatttttgccctgccatgtccccgtggatcacccgcgtggtcctgccggctcgtttaggcgacgtgcgcggtggcgttaacacagcctccctctgctcctgtccccccccaccaggtgctgccatgttccaagcggtacgtgcacgactggacggagtgcccttttgcgcacccgcaagaaaaggctcgacgccgggacccgcgggtattctcgtacacaggcatagcctgccctaacatgaagaaggtgggcctgccggatgtgatctctgttctatttgggctcgacctgcagcatgtggtccttgttctgtgtctgcctcacttgagttgcctaatgcacgtccctgtggcatcagctgacctacccactggcctgtgccagcggctgctnnnnnnnnnntacaggcatagcctgccccaacatgaagaaggtgggcctgttgggtgtgatctctgttctatttgggctcgacctgcagcaggtgctccttgttctgtgtctgacacgcttgagttgcccaatgcacgtccctgtggcatcagctggcctacccactggcctgtgccagcggctgctnnnnnnnnnncgtgcatgttcctcctttccaacctcccccccccccttcccgtccatcgcaggacgggcagtgccccatnnnnnnnnnncggggcaaggggtcccggctcccatgcctgtcctttgcagcccgctagcagcgctgccccgccacctggcccccgcactgtgcatgttcctcctttccaacctctcagcccccccctttccgtccatcgcaggacgggcagtgccccatgcgggaccactgcccttatgcccacaacgtttttgagtactggctgcaccccacccgctaccgcacccagctgtgcaacgatggcgggagctgccggcgcaagatctgcttcttcgctcactccctggacgagctgcgcgtgccggccgtgaagcccttcgtctcgcccgaggcgttggccgccgccgcctccgcggccgggccgggcgacagccgnnnnnnnnnnacagcaggccggccgggccgggacgcccagggcggcgtcatggggaggcgaggaggcgggcggcggtgcgggcaggcaaccccgcgctgaccctgggctcgccgcggcgctgggcgcgctgcagggcagccnnnnnnnnnnacagcagcgggcgcccctccctggactccgccgccagcgtcgccagcggccagcaggcgggcggcagcgcgggccctgcgggcgcgcagtcgctgccgtcgctggtagccgtgctggacgccgcgcggggccagcaggccggccggggtgggacgcctagggcggcgtcatggggaggcgaggaggcgggcggcggcgcgggcaggcaaccccgcgctgaccccgggctctccgcggcgctgggcgcgctgcagggcagccnnnnnnnnnncaagggtttagattcgctgaaaggccgaccaaccgacgtgccaccgctcgcgtggcactgccagtgggtgagccacttcctcccaaaccttgctgactcccatgcgcaccatcacgatggtgcctgcctgttccacccccctcctctacccaaacaaatcctgcacaggcccgcggcgtggtggaggtggtggcgtcgctcctggcgcaggatcgcctggcccccgccnnnnnnnnnnacatgggggagagggggggggcgcgcgcgcgcgtgcgcaagggtttagtttcgctgcaaggccgaccaaccgacgtgccactgctcccgtggcactgctagtgggagagccacttcctccccaaccttgctgcctcccatgcacaccatcacgatggtgcccgcctgttccaccccccacctccacccaaacgaatcctgcacaggcccgcggcgtggttgaagtggtggcgtcactcctggcgcaggatcgcctggcccccgcccaggcctccatcatcctgcagcagatgctgccctcatcaacgctggagctgctgcacaacgcgctggcggccacaggcgcggcggccgtgcaggcgccggcctacgcgccgcgcgccgccagcctgggtagctaccaggctgcgcaggaggcgcaggcgcgggccgctgcgggcggcgccgcggagcaggcgcgaagatccatggaggactcgcgctatgccagcnnnnnnnnnntgctgggggcggcgcctcggagcaggcgcggagatccatggaggactcgcgctatgccagcctgctgcaggcctacaactccgtggagcgcgcctaccaggtgggtggaatgggcatggagaggggtggaggggtgtgtattctgaggagtatgccctgcccgcagcgtaggtgcgttctccagcgtcatctgccccgtcgatctcacgctcgctcccggcccccccccctcttacacagccctcccaggtcacggcagagcagctgtccaggctgcagatgatgcagagcctctctgccttgcagcagcagcagcagcagcagcagcagcaacaacaacaacagcagcagcggatgggtgagatatgatgctgggggagggtggtgcttgcccctccctcactggccatcttgtcaatgcggagctgacgcactctgggggtgtcgggacggatgtgtggacgcttgtgcttgccgtcgctgtgccaatgttgcagacttgcagcactgtccaccctgcgnnnnnnnnnngcagcagcagcgaatgggtgagatacgatgctgtgggagggggtgcttgcccctccctcgctggccgccttgtcaatgtggagctgacgaactctgggggtgtcgggacggacttgtggacggttgtgcctgccgtcgccgtgccaatcttgcagacttgcagcactgtccaccctgcgttgcgtgctcttgcccaaggtcaccccaccacggctccatgcccttgggccccccccctcccctcccctttgttcccagaatactccaccgcccacccctctctaacacacacacacacgcaccaccaccaccagggtacgcgccattcctgtaccagcagcagggctcagatgcggtgcccatggaccgtgactcctgggagtcatcacgcacctcttacgaccaggcgcgcgcgcgcatgagcctgnnnnnnnnnnaaatcacaccaccaccaccagggtacgcgccgttcctgtaccagcagcagggctcggatgcggtgcccatggaccgcgactcctgggagtcatcacgcacctcctacgaccaggcgcgcgcgcgcatgagcctggacgagctggacgtggtggggcagctgaactacggcgccgcgctgagcatgctgcagcagcagaacgcggccgccgcggccgcgctggctgccgcgcagtttggcggcggcggtgcgtccgtgccgccgctgtcgcccgtgccggagggctaccccattgtgacgcgcgagtcggaccccggcgcgtttgcaggcgcgcgtggcgatggcgtggagcgtctgagcgctgagatgcagggcctggacttcgggtgagcatgctgggtggctgggctggcgggctgacgcgtggtgacccgccaccccactggccgaccagaaacacgcccccatccccagcgccttccatcccccatagaaggcccccggcgccgcagctggtcaatgcctttagctcatcgctgttttccgggcagaccgaggacttgcacaacaagggcagggacctcaaggtgagggtccttttttgaaagggggggggggggggnnnnnnnnnnnnnnnnnnnnnnnnnnnnnnnnnnnnnnnnnnnnnnnnnacccaagcgtgatgtggggggcagagggaggggaaagaagagaggggtatgacatagagaatgatggttggtatgctcccatgcacgcatgcttgcaccggccgggtctgttcgactgcgtccggcatggtgctcaccgctcgtcaccctgaccaacccaccccccgcagccggggtccaaccccgcggcggcggccgcggtctgggcgcacctgagcagcttgcagggtgggggcatgggcccgccgtccatgcaccactgagcggcggcgcagcggcgactggctgcgccggaggcggcgggggcggtgcctcgcaccgccatgtttcttgatagctttcttccattattttttctattcaacctatgtttcactcccaagccccaccaagggggtggagcgctctcggcccaggggctccccgctggggcctgaggcgccccgccacagccgcttgggctgggaggtgctgccccccctcccactgcacccttgatgcaatacacacatccgcacgaaatgttcagcccccccgccgcaccccgtctccctgccatccctggcggtgcgggcgtctgcctgcctgccacgcgcaggcaggacctagaatgcagaaccgcaaacgtcgcggcggaaggagcttgccttgtgcggtgaggagggggggggcgctcgagcacatgctcggcacggcccctccgcctcactcccccacacccacccaccatgaggccgcaatgcagggctggcctgttttgattgaggaaaatgcaagcaatcccatccccttcattttatcataggattgaccccccaatcttttgccggtatctgtgccttagtgcgcgcactgcttatttcataccttgccccctcaggaagccgggtgcctgcgtgacgccccggtctgaaccacactcttttcggtgattgtggggcccctacaggaaaannnnnnnnnnnagatttgacccaggagatgttcaaactctccatccatgcatcgcagccccgctgcagggacgggtcagcacgtnnnnnnnnnntgttctgtaagcggaaactctgcacaggcttctatgaccaaattggtagacctgggattcgacccaggagatgttcaaaccctccatccatgcatcgccagccccgctgcagggacgggtcagcacgtggatggcgcgctgcgcatgcctgccagggcctggggcagggcgtggtcaacattccggcctggactcgacactgctcccgtgaccggcacgccctgacgggacggaggctgctgaccggcatgctcacggccgtgtcggtgcaggccccgggatctgccgagcatggcatagggggtcatgcacttccgccacaggctaggcatcgtcgtgctgtgccttgcgctccttgcgaaggcaatattggcatcacgcgacgccccagcatccggagttgccgagccctgtagtccaggggataccctctgcctcgccctctcctcccaccccggcgacctccgcaagccgacactgtccagcaggaaagccagggcccaggaggtgacgataccaaatgagcgtccgtgttggacacggcgtggacagcagcgtgcaaacaccccgggtttaaaccatgacccgcccacatcttcatgcacaccccctccgcacccctgccccccaaaacgaggctaccctgtgtcccttctgcaggtgcggccccggcccctctggccatccatgtccgggtgggtgccggcactccaggcaccaggagtgggtcctgtgctcgcctcgcagcgcatggcccctggtcctgctggggtgcgccgtctggacggcggcgctcttccatgcaatggcactgatcgcgtccaccttcctgtgccccgccattgaggtgtggcgtttttgggcttaaccaggacatgcatgcagctggtttgtggcaagcaggcgggtaatgtggcaggcaccagcttgccggtaggggcgcaaaggggatgaaagaatggggcgtgcccctgtgtgcagtccccttgccgcaactccaccaagtggcgccccagggagccaatccatgccgaccaccacccattccaaccaccacgcgcagtgcctggcggccgtcctgggcatggacgcggggctggcgggcatcacgctcttcgccctggccaatggggcgccagacctgctgacccaggtggcggccctgctgtccagcaaccaggtcgatgtcggcctggccgccaggtgaggcgcggggtgggtgggcggctcggtgcgagaccgttgaccacccccctgaagctcagtagtctgacggaggatttgacggtggtcgtgcgttctctcaacacttctcgccctcgtcttccccgcttcaccgcatcagtgcggccttgggcagcggcctcttnnnnnnnnnnttgggtgggcggctcagtgcgagacccttgaccacccccctgaagctcagcagtctgacggaggatttgacggcagtcgtgctttctctcaacacctctcgccctcgtcttccccgcttcaccacatcagtgcggccttgggcagcggcctcttcgtgctgggggtggtatttcccaccgtcatctgcctggataccacccaggccccctcggtgaggggcacggcgggggcaatcaggggtctaactttgctccctgtgcctactgcaggagtttgtgtnnnnnnnnnntacccaggcccccttggtgaggggaacggcgggggcactcaggggtctaacttagctccctgtgcctactgcaggagtttgtgtgttgcatcgggcgcttgccagggccaccttttcatccattttgtctgcctcaggagcagacagcacgagcaggacagcagacaaccccnnnnnnnnnnttaccccagcccaaccacccccaacctcttctgcagcatcccggcagcttcctgcgtgacgcgcttgcctacctcgccgccgtcgccctggccttcctgaccctggggccaggccccatccgaccctggcagcccgcgctcatgctctgcgcttactgcctctacatcggagtgtgcgtcgcggggtctggccgcggtccagccaggaagctctccctcacctcggccctgcaggagggcggccacgccccggcgtgggccacccccttcgctgacctggcgggcgtgcgtgggaagaaagggtggggcctggccgccgccctcctgcgctgccccttccgccttgtcctgcatggcaccacaccagcgctgggcctgggtgcgtggctggactgggggttgggtgtatgggcgttggagttgctttgggatcggcctgggccgggaggagtcctgcatcttcacaccctggcactgcatggctgcggcactccccgccttctgtcttctcttccagcccagcaccagcaaacaacccctccaaaacgtctcctgaaggcctcccctcgccggcgcnnnnnnnnnntgctccccgcctttcgtcttctcttccagcccagcaccagcatgccacccctccaaaccgtctcctgaaggcctcccctcgccggcgcacgccgcgctgctcacgctggccggccccgctttcttcctcgtcggtgtggacctgggcccccccaccctgggtctagggcggtgggccaccctctccgccggcctctccggcctgtgcctcgccctgggcgtcgcctgcgcggcgcgcgagggccggcccgcacccagccgcctgccggccctcctggcgtgcatgggcttcctccagtccatcgtgtggatgcgcatcgtcgctggtgggcgtcttgatgggtatgggtgggtagcagtactttcctgcgctggcgggagagaaaaatgcaccggcgcccctccagcaggcctggcctgccgccggggcatcgtcggcacatgccggttggaggcgcgccggcgtgttcacccatggaccccccagacagccctgatgcactttccccccggcaggggagctggtggcgctgctgcaggccgtgggtcgcgccgtttcgctgccagaggacctgctgggggccacggtcttggcgtggggccagggcatccctgacctggtggccgccgtcagcgtcgctcagtcaggtgcctgggcgggagggggggaaaggaacatgaaggaacagaggtgggggtgggaaggaatggagagggttgaggtagagaggggctggcgttcggaggcctggagggggtgatggacgggttgnnnnnnnnnncggcgtgttcacccatggatccccaagacagccctgatgcactttccccccggcannnnnnnnnnaggatcggcgccgggcctgcggcagagagcaagcaggatgaggggttggaacgggggtgtttgaatgtgctgcctggacaagtgtgccctgtcatccaagatgcacccccttgcacagcgaggaacccccctcacccacccaccccccggccctgcagggaacgggcccatggcgctgtcggcctgcttcgggggcccggtgttcaacatcctggtggccttcggggcccccaccctgctggccacgctgagggggggcgccctgacctacgccctggcgccgggcgtaggcctgctgttcgtgacctcggccctgctggccctcttcatgctcgcctccgtaccgctggcgtaccgctggaggctggatgtccgggctgcggcctccctcttcctcgtgtacctggcctgccagctcaccttcctggcagtggagcaggggtggctgtgaggtttgcaggcgaaatgcagcgcccccagggcgcgacgtggccgtgtggcacgcaaggacccttgcttgtgcacccgggtgctggtccnnnnnnnnnncttgcaggcgaaatgcagcgccccctgggcgcgacgcggccgtgtggcacgcaaacacccttgcttgtgcacccgggtgctggtcctcagattattacatgttgagtggggggagatcaagaatgggtcgtcgctgctctcaagcacctcaagtgaagggtgcatcactgggagttatccagggggaaatgtatcaaacatcgcgatgaggcatgttcgcgctgatgaaaggctagggaaggggtagaagaggcatggatggggccttagattctgaggtctgcgatcacccagccgccgaggacggcgggctgcgctcgagtacatacaactccatgatgggaggggaggatggtacacggggcttcagtggcccatgcagatgtcgcggaggtcctcgtacccgctgtcgcggtcgcgctgcatcacggccaagcggttcagaggcgccgagcccatgcactcgatctgcaggtcgtccagatcctccaggcagtggctcaggtcgaagtcgaagccctccacgagcgtcgcgttcaggctctgcacgagcctcgcgactcctgctgtgtgggaaggaacgggcggaggctggcgctttgacggatcactttgcttcacggccgcgaccaaacgagcccggaatggattgtatctttagaagcacaccgacaacggcgactgtctcacacatgcgcgttgaataccgcacgtactgggcctcgcaccttgcaccatggaaggcatgcctgcctctgttcttgttagtttatggtcacagaagatccgcggttgtgctcttagagctgtgtggaaaaagtttaatctccgaagagtcaaatgccctcgcatatagggtgacaattggaaatcgatgtatacatcattggtaaggcctcgacgctcgcacggagatgctttcggnnnnnnnnnnagttatgcgcttagagctgtgtggaaagagtttactctccgaagagtcaaatgccctcgtatatagggtgacgattggaaatcgatgtataaaccattggtaaagcctcgacgctcgcacggagatgctttcggatggtttgaaatccccgccgggccactacggagcccggatctgtcaggttccggaagcgtcgggtaagcttccatcggtcaggaaaatcttctcctttacactatcctctacatagatatcttatgtaccgtctattactatcttccgtcataatacatgtcatcatcggatgtccaggtcaacatctaaggaactgcttaataaacatacttgtggaattgaccactgtacagcagcccggcctacttggtctggctaacagtttgcttgatagatcatccgtcaaagattctcagcagccttcatctttaccagcgtcctccctgcaaacattgcacagaaatcttttgccaaggagctcattcacatgtatgaggctgtcagcgtggttgcagggnnnnnnnnnngtttaccagcgtcccccctgcaaacattacacagaaatctttcgtcaaggagctcactcaaatgtatgaggctgtcagcgtggttgcagggcttgtcccacagcgcaccagggcataacactgtatcttccccagtttcacacctgggcggcgtgacgagcgctgttctcggcattccgggcttcctgcacggcaggctctgcgcccttggcgagtgccgcttggacctgaggggcgaggtggggacgaggaagtgagcaacgttacagcacgcgattgctccatggcttccgaccaccacttatcgaccatggcaggcactcgtatacctcggcagacttccgagcgatctgggtgtcatggccccatcttccannnnnnnnnncatcgaccatggcaggcactcgcatacctcgccagacttccgtgcgatctgggtgtcatggccccatcttccaccctgaataggataagatagaggagagactgtcgatcggggtctgcaacgtgctcaatcgcgaatcctgtcgcacgcccgggagccctaccgtggcagtcttcacggcggagtcgtgggcagacgtatcaccctcctttgtcgccgcaccggtgctggaatgcttgcggaagacttgacccatatctgcttgagaacacgttacggaagaggtgcttaggccttgcacacatacaaaaacgtgactctgtcggacccagggatgcaggaccagcaagggttaaactttaccgtgaggtggaaatttagcagaccccaagcagatatttggacgtatggtccagttggacgctgtaacgtgatttttttggtctttttgaagtgagattcaggcttgcagcgaatggccggcatgaatatctccgccaggtgcgaggggcggggcagnnnnnnnnnnattctgatatttttgaagtgggattcaggcttgcagcgatggccggtataagtatctccgccaggtgcgaggggcggggcagctgctcgcttacccattctcccctttcctctcacgccacgagggagacacgtcgtcaggcgagacgtagacgtcctgtgcacccctccaaaaagcatgcagcgcggtctgattcccactggcatcacacacatacaatgttggccatacgtcagattttaagagctgcagtgacctcgtcatccgggcccgcagccgtgcgcggtctcgtagtgtcgggggcgtcatgcggcgtattgatgaagccctcgagcagacaggagcaggcatgttgcgttgtatacctgaaaatgtttgtatgtggcatgatctctcactccagtctgatatttaatgctcttcgcatcccctcggccggcgcaggagcctaaacctgcnnnnnnnnnncggaatgttctctcactctgatctgatatttaatgctcttcgcattccctcggccggcgcaggagcctaaacctgcatcactccattgtcacatcacctactccaccgcggtcgcggccgtaatggaggatcacaacttcgacagtgttgcagacagaacactgaaccatatcgcgcaccgtctgaagcacatcttctcgcaggtgagccattgcgtcccacactttgcgttcgggtttcggtcagggttttgtagttttccgacacatggacactttgacgacagaggggagtccttagggtcccccacggtatcccttcgcagaaccctggattctccaccagccttaaggatgacatcctggctgtcagcatggcggatgggggccacctcgtcatctccaagcaggctggaaaaaactccctcaaagtatgttggttgggatcgtcgacaatgccatggagattggatgcatacatggatcatggggaggaccatggtgaagcacatcccctcaatccaacacgcaggtggacacaaaattcaccgacctgtgcgagcctgcccacccgcaagacgtcgtccacttcaagtgcgcagggtcaccttcttgatggtttgcagggttgtgaggtcgatatgaccccccgtgatctacagcacatcccatccttgctgcctccttcaccctctgcaatgcaggctggatgaccacggtcgatggatctctggcaaggaggagctcatctgctacctggaggatggtttttcaagatacttgcaggcgagtcagtcagtggtgggttgcagaagtggagtaaggaaatgggtgcagctttggaaagagaggaggtctctgcgctcctcattcctggcatccaacaggatctggactttagcataaggatctgccatgcttatgaagactggtgtctcctctgctgtcccttcgcagatgctggtggatctggaagaggaaaccgaccactgaatgtgcagcagcacatgccgaacatgcccagccatggctgctcccaagactcatggaggcatttttaccaaaagttttcttagagtggcagagtcctgccacctgcccccacgcatccacagctttcattacacactgccttgatatgtagccatcagttacaacagccgcggcctgcccgcttatccctttggttttttggcctttgtactccgtggttttgtcctgggcttgggcttgagcttggaagtggactgcttggtcaatgccaggccaagtcccttgtttttcctggacccagatccaacacctgtgaggaaccacgtggcaggcccgcctgtaattcatgtatttctcgttgccctctgcgtccctacagtagataaaatgcacaaaggtagcgcccacgcagcaggcttctccccacctggctgcttgccgcctgctgggtcctctcctgccgctggggctgcacccccagcggcatgatgcccgtcctcgnnnnnnnnnnacagcaggcttctccccacctggcagcttgccgcctgctggatcctctcctgccgccggggccgcacccccagcggcatgatgcccgtcctcgtcctcgaacagggagcttgtcccagccacctcaccagtctggcgtgggtcctctctgaggaaagaggatcagatcgatgctctgaagaagagtgactggaccctggacctccatgcctcttcctgctcgacgaacagcttgccacgagattcccacacgataccggccaaccctgccacatgaagccgacccccagggcactgcagacatggttcccttcaccttgtcccctctcccatcacacccacacacaaatccacacccacactgcccctcatgattcannnnnnnnnnagttccctgcgccgtgtcccctctcccatcacacccacacacatatccacacccacactgcccctcatgattcaggtcgcctcaccgcatctggatgcactcctggaacaggcactccagcctggcgtcggcgctgccaacattcagcacggccagcgtcatggggcaggccacgaccccggcatcgtacagcacccccttgaggtcgatctggaggcggggctcgtccttggggccgaccgcgttcagccgcccaatggcgccggagtcgcccgacaggtcggtggcgcggaggttgccggcacggcccttcacggggcccagctccagcaggaacttgtttgtgggcgggcggtcggggaggaggaggggtaggtgggcggggatggcggcgccaccgccggggctggggcaggaggaggggcctggctcctgggaggcctgggtggaggggtccaaggaggcctgggtgatgggcacggcaggctccgccgcgcattgggaggtggggtctgaatcagcgcgctgatggggtggaacctccccttgcgacgcatccatggctgcggccctcggatcgcctgctggggggtggggtgccgcaccgggcgccgtgaccccctgcgcagaactgcgccgacggcctcccggagatcctcgaggactcctggtggaccgaannnnnnnnnnagctggggggtggggtgccgcaccgggcaccgtgaccccatgcgcagaactgcgccgacggcctcccagagatcctcgaggactcctggtggaccgaaaggcagtgtccagcgccaaggacttgcggatcagccgggctgcacctggacgggcggccagaggctgctcatcgtcactgctgctcatgggcgaccgtggagggtcgtgcacagccctcctcactgggagtccaacacgagctatgtcgctgtcacaggaatcaacgtggatatatcattgagttgcttgccaaagacatgccgtggaacacatctcgtgactgcctccggaatgcgacacgaaatcaaaattgcgcgccgtcatattataaggcaatggtgtaaaggggagtgtgaccaccagtagaatgcccaggtgggtgccatgaataagctatactcttgctagctatgtcctggctnnnnnnnnnnataaaggggagtgtgaccaccagcagaatgcccagttgggtgacatgaatgagctatactcttgctagctatgtcctggcttgctgagagcggttgggccccgcgatatcgaccatgacggtgcacaccgtcggtggggcgttagcccccgacccagctcacccagttccgttgccacgcgctcgtggccagtgaatctgagcctttggacctctcagaatatttgtannnnnnnnnncagcccccgacccagctcacccagttccattgccacgcgctcgttgccagtgaatttgagcctttggacctctcagaatatttgtaggcatcatgtggatagccaaggtgagcgtggtgtgctccgtgatggtgccggcgcagctccggtagctgctgtgaggcccagctgctcagtgtgtgtgggggtctttccccctcgttgggtccgttcgtggacgcagggaaggcccctgcggcaagctctgccaccgttccccnnnnnnnnnnggggggtcctttccccctcgttggatccgttcgtggacgcagggaagacccctgcggcaagctctgccaccgttcccccgccctccccgcctctggcagtcgtggtacttcatctacttcagcgcggggggttgcctgaaccccttcctgacgctcctctaccgcgagaaagggctgtcagaggcccggatcggggagctcgccgcgctgcgccccctggtctccctccccgccggctacgcctggtcggcgctggccgaccgccggggctggcaccggcgcatcatgctgggcacgctgtgcgccgcgacgctcttcaagctgtcgcagtggggcctgggagggttgtggcccctggccctggcgatcgccctgggccaggcgttcgacgcccccgtgacggccctggtggacgccagcgtcgtggcggcctgcgcggtggaggaggtgcggccatcatcggttgaggccgtgtacgtgctgttgcggggcaacctgtggtccccccactgcccggaccatctgctccaagccagaacagcacatcccttccatctgcttcccctcttgatcagctcccccgtcacatgccctgcttcctctccnnnnnnnnnncgcacggaccatctgctgcaagccagaacagcacatcccttccgtctgcttcccctcttgatcaactcccccgtcacatgccctgcttcctctccaagcacattgcctcacgtccccggtcctgccctccccctcccgacaggatggcgactacagccgcgtgaggctgtttggggccgtgggctggggcatctgggcggcggcggggggcggcctgctgggcacgctgggctggccctcgctcttcctctgccacgcgctcctcacctgcctcctggcctggcccagcgctcacctctccttcgacctgctgcggggggggcccgggcacgttggaggtgcgctgaaaggctcaggcacgggagcagggcgggggggagatcaggagagaggcggcgcgagtgctgtcgggacgcggcgacaggtgttcgtgctggcagatgtggaggaggcggtgtccctcgtcggcaaggccagcgagggcggcgagggcggtgtggatgacggaggctcccagtgcgcaagcatcgcctgcgatacccagccggccggcgccggccagtccgcgcccgtgggtcagccctcgccctctggccgcctcacgggtgccccggaccccccctcgcccgggcagccgccggcctggcgcctgttgatccacccccccatcctcgccttcctggccagtgtggcggtgatgggctatgccatgggcgccattgagagcttcctcttcctggccctgcgcgacctgggcggcccgcctgccctggcggggctgacgctgacggtgacgtgcgtggcggagcccatcgtgttctggcacgcgcggcgcctgcaggccgcgctggggcggcgcggctgcctgcacctcgtcttcgccgccttcctggcgcgcctggcgtgctatgccacgctgcggggctggccctcgccctggctggtcctgcccgtggagctcctgcacggcttcacctttgggctggcctgggcgacggggacggcctgggcggcggccgaggcaccgccggggaggaaggccggcatgcaggcggccttccagggcagctacatgggtgagggggccaaggggaggggggaaaagggtgggacaatggaggggagagggagacaggatggagagtgaaggtggagagtggcggtgggnnnnnnnnnnagcaaggggaggggggaaaggggtgggatgatggaggggagagggagacagggtggagagtgaaggtggagagtggcggtgggggagggcggcctgcagggtggcagcaggcggcgcgggaggggtgtttggggcggtgggcgctggcagcatgggggccggcaggcacgaccagtccttcaccactccaggaagcgcacgcatgnnnnnnnnnngggcctgcagggtggcagcaggcgtcacgggaggggtgttcgagggagtgggcgctggaagcatgggggccggcagccacaaccactccttcaccactccaggaagcgcacgcatgcatccccctgtttttctgatctgaagcaatgttccggcatccccaccctcgcaaacccctgcccctgcagggctgggctacggcctcnnnnnnnnnngtgaaggaatgttccggcatccccaccctcgcaagctcctgcccctgcagggctgggctacggcctcggcagcctgatcagcggcgccatctacagccgcagcggcgccacctcggtctttgcctgggcgtttgcggtggtggcctgcggctggggggcaagcaccgtcgcctttaccgcgctggatgcggtcgcggcgcggcgcggtggcggcagcgtggcataccgaggggtcgagctggcgcccagggaagggctaggggtcgaggacccttgtgggcgtgctgacacgctgcgaacccccagtcccgtgcctattgctgttgagaggggcgggcggcatgcacgccactctgtacgctgagcgctcttgtacactgatcgtgcagtcccttcccctgtagattnnnnnnnnnnggaggacccttgtgggcgtgctgacacgctgtgaacccccagtcccgtgcctatcgctgttgagaggggcgggcggtatgcacaccactctgtatgctgagcgctcttgtgtgctgatcgtgcagtcccttcccctgtagattgcgggtgtaagcccgggaggttaccttgggtgcacagccaccgggctcaggttcgaacaggcctccgcgcatgaccttcagttggcactcagtctgacactccactcctgaagcaacaggctgaagttgtggccggcaaaagcaaaactgaatgcgatgtggatactaaagtcgcgctactaccactgagctannnnnnnnnnaggctcaagctctaacaggcctccgcgcatgaccttcagttgacactcagtctgacactccactcctgaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcgttgagatatccatatatgaatgcgtgctcgccatcacgtacgacacatcccgccaccgctctctccgtcactgagttgcttccaatgcaggcatactgtctgatccaccacgtttaaacatcccagcacacaggtgcaccagtgtggatgcgcggcctgggatttatcagactcaggaaaggtcatggannnnnnnnnntttgcactgagatacccatatatgaatgcgtgctcgccatctcgtacgacacatcccgccaccgctctctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggcaaaggccttgcccttccaagagctgcgagtcggggaccacatcctctgccggcgggtggtaaagtatgcctgggcgctgaggtctcaggccccttgggatgagcccatcattgtcgatgccggctattggtgtgccatggattggaagggagtcacagaggcacccacctgatccctggattgaggttctcaaatgcttgcgggagttttgcagggtggtggtgataaagcagtgtcgcacgtccaacctgtgcgatgtttgctataccatcctacagccccacaagtactggagggaggggagggatggagtgctggtgctgaagagtcgatggggggtgcaagcggtgtctcagttccctctgcaatgtatgggtaatcgaccgaggtctacgcagcacccactgtactcnnnnnnnnnnacaattcccactgcaatgtatgggtagtcaaccgaggtctacgcagcacccactgtactcctgcctggcctgatcatggccatgaagccccgccctttaccctttggtggccaccctccctcccctgctcctgtgttatccatggcccccctcctcctcttcccgttgtagccccatttggggctacactgcgcttgtccannnnnnnnnnacagaggcacccacgtgatccctggattgagattctcaagtgcttgcgagagttttgcagggtggcggtgataaaagagtatcgcacgtccaagctgtgcgatgtttgctataccatcctactgccccacaagtactggggggaggggagggatggagtgctggtgctgannnnnnnnnngcatccagaggtggcaagtgggtgcagccgatttcaaacttccagggattcatctcgtccaatgagatgatgtctgtatcaccaagaatcaggagcagctgcatacactgttcaggtttggatgaggnnnnnnnnnntcattcggaggtggcaagtgggtgcagccgatttcgaacttccagggattcatcttttccaatgagaggatgtctgtatcaccaagaatcaggagcggctgcatacactgttcaggtttggatgaggtgggtttgcgcagtgtagcccacaagggatcaccaaaggggtggggtgagtgtggggtagcacaggagaggggggggggtgggggcccactatgggcagggctcccagtggtaatcaggcagggcagcagtatgctgagtgctgcgttcacgtctcaatcaaccacacatgcattgttgtgggacttcaagcaccccttattccccattcgttcttcaatgccatctcaccatccttcccctcctgccaatgcttgtggggctgcagggcggtgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaagctcaacccagggaccaggcgggtgcccgtgtttaacctcccctgctaggagatcacaccaaatacctgcatcgacaatgctggtcccgcctgctgggctcagaacatctgcgccagggaatcgaaacctcannnnnnnnnntaccacccatgcgtcgtggtgggatttcaagcaccccttactccccattcgttcttcagtgccatttcaccatccttccccttctgacaatgcttgtggggctgcagggcggtgtggcagacaccgcacagtctggaagtgcaacattcgcttaccaacaccaccctgcagactcggcgcaagcacctgaaagctcaaaccagggaccaggcgggtgaccgtgtttgacctcacctgctaggagatcacgccaatcacctgcattgacaatactggtcccgccctgctgggctccgaacatctgcgccagggaatcgaaacctcacaggcgagcagtgtgtcatgaaacaagaggagcgaagacaactggtgggtgaaagcgtcagaaccccagacggtcagcacggagctgagtcgaaagagaagcgtgaaatttagggctccagagtgcatctgtgcatggccaatgcaatctacacggaaacagaaaagaaaatgcgaaaatttatgaatggactgtgaccaggatttaaaccatccagaaactcttcagattccgggggagacatgcgttaacgcgtagtcagaccgagaagaaggaacaactgccannnnnnnnnnagaatgaatggactgtgaccaggatttagaccatccagaaactcttcagattccgggggggacatgcgttgacgcgcagtcagaccgagaagaaggaacaactgccannnnnnnnnnaaccttgtcattcaaggtccctcacatgggcactctggggagaatttttaggattaaagctgtcttgggatcctcattacatccgccaagcccgtatcccgagcactcaccatcgtcatcatacagctccacaatgctcaacatactatgtcaggctcatgctgacccatctgggagggaccggggctttgagggatgcaactgtgtgctgaagagttgctgcaatcacttgtgattgcatgggcatcgtttcagcataccccaatgcgcccacctggcaggtggggtcgtaaaaccatcccaccgcagacctccacagggtggaggctagtatggtatgtggctgcttggtcttcagccttttctagaccagacaacagctcctgttgcacaaagtgcccgtaccttgctaacacccacgtgcggatctcccgggggcacgagatcggctcctcagatgaaggcctcgcctgcatgcatgcagctacgcaagaggcaataggggagtgcaccgaaatggagtgagctgtgcatcgtagagacacttgcaataggctgccctcggtgtccacaaatcatggttgaagactgacatcgtcatcgctaacccatacnnnnnnnnnngaccttgtcattcgaggtccctcacatgggcaatccggggagaattttagggttaaagctgtcttgggatcctcattacatccgccaagcccgtatcccgagcactcaccatcgtcatcatacagctccacaatgctcaacatactatgtcaggctcatgctgacccatctgggagggaccggggctttgagggatgcaactgtgtgctgaagagttgctgcaatcacttgtgattgcatgggcatcgtttcagcataccccaatgcccccacctggcaggtggggtcgtagaaccatcccatcgcagagctccacagggtggatgctagtatgatatgtggctgcttggtcctcagccttgtctagacaaggcaacagctcctgttgcacaaagttcccgtaccttgctgacacccacgtgcggatctcccggggacacgagatcggctcctcagatgaaggccttgcctgcatgcgtgcagctatgcaagaggcaatagggagtgcaccgaaatgaagtgagctgcgcatcgtagagacacttgcaataggctgccatcggtgtccacgaatcatgattaaagactgacatcgtcatcgctaacccataccgatctgtggttgtgcccaaccttccacgcacagagctcagcgtggcatacaaggccagctctaccaagagccgcagctggacaccggtgttacatgtcaaacttatcacaccaccttgcctcctagaccacgtcaagcatataaaatcgagacccagatcctggaccgtgccaccgccctgcaactcattgacgacgccgtgacaccactgttgccgctgagcatccctggcggcccgcccctnnnnnnnnnnccatagaaaatcgagacccagatcctggacagtgccaccgccctgcaaatcattgacgacgccgtgacaccactgtcgccgctgagcatccctggcggcccgcccctacctctcgagggcgccccagagatcgacgagcagctccaaaggctggcggcgagaatctgaccaaaaataggatataggagtgcttgaggagggatgtgcatcgtgcaaagtcctggcggaagctgtgcttccagtgctacctgcacggttggctgagaccatccttttacagttggaaatgtcgagcgaagagcatgccgcatctacacatgtcttaagggggaggtggcaaaaggtgctggattgatctacttaggagttacatgccaaagtgaccgtgtacctnnnnnnnnnnagcaaaaggtgctggactaatttactagggagttacatgccaaagtgaccgtgtacctgctatgtattcatactcatatctgcaaggcggaccagcgttcgggcggcgacggttgtcgggagtgcacctgtatgctgagaagggatgtttcttcggcctcctagggccggatgatgtccaggaggcagcactcgatgtgcgccgactgcggactgtcgcctctgaagtcggcatcgcgacgggtgtcttatgttttacagaagagtatgtaacgtgctgatagatggcatgcccattcagccatgaaaagcaaatgctgttggcggaatgatggccgccccctccgccgtggccactgaagcggcgaatagtagcatttgcttggtttatgggaagtttgcgtcatgtggcggggtcctgagctccgtgaatctcccggtctcggagaacattgcctgaactaaggtgacctcagtccggttgatcattctaagacccgcaccggtctccggtctccggaggggtattggcaccctcgtgcacacaagtgggaggggtcatgacaccctgtatacgatttttaagtcaaaaggtccaaaacatcatctcacacgctcagcggaacctcnnnnnnnnnnatggcaccctcgtgcacgcaagtggagggggtcatgacaccctgtacacgacttaaaagtcacatgttccaacatcatctcacacgctcagcggaacctcgcctcttcaggtcacaggatatagctgcgcgtcgtccccccccgccagcggcagcgctatgcggacttccgggctgtcgtcctgtgtgggtatagctctctgccttctaagcctcgctgttgcaagcaaggtaattatttcaccttgtggtatgtgggtcactcgagagtaagggtcaaatgcacgtccgcgaggcccacccttcaccatccatcgaccccacctctcatatgccaggggccatgcacgtccacgttctactgccttccagccgccatgtgagtacttaaacatgtttttctcacattcagtgtgaacctatccatcgagttgcgattgctgtgcactacacgggggcagctccgcctgcagcttccagtccggatcgcttgctcactnnnnnnnnnncatcatatgccagggggcatgcacgtccacgttctactcccttccagccgccatgtgagtattcaaacatgttttcctcacatacagtgtgaacctatccatcgagctgcgattgctgtgcagtacacgggggcagctccgccggcagcttccagtccggatcgcttgctcactgagcaccgtttctaatgtcaacaccgcagatacggagcgcatgtctccgttctcactgccacgagcgcgggaccgttctgtaggtgagatcctgggcggtacaacgggcaaggcctgtggctgtgggctggtgtcctgcaaa

SEQ ID NO: 42840 - DNA, 436 bp, Chlorella protothecoides
  modified_base (131)..(359): a, c, t, g, unknown or other
cgccgagggcgtgcccctgttcggagcgggggacggcggcggagcgagcgaggacgagctggactgcgcgaccacgctggccgtgccctacgaggcctatgtcgccggcgcggaggccgccgatgcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccggtggagcggcgtgcagcgtggacgccgccggcgcgccgtcgcccgccgctctcgatgcgctgggcgccgcc

SEQ ID NO: 42841 - DNA, 64 bp, Chlorella protothecoides
caaggccaccgagcgacgaggtgagggcggttggggggaggggagcatggtgtgctggacaccg

SEQ ID NO: 42842 - DNA, 61 bp, Chlorella protothecoides
gctggccccgcccagcgtgtagaccgggaagccgtgcaccgcacgcacgtcggccacgccc

SEQ ID NO: 42843 - DNA, 88 bp, Chlorella protothecoides
acctccccaccttcttcccaacccccctccaaatccccaccgaccctgttaccccgctccccggccccacctccgtgccggcaacctc

SEQ ID NO: 42844 - DNA, 61 bp, Chlorella protothecoides
aggacatgtgacttgcgctcactggcggagggaggaccctgtgtgccatggcgagcctgca

SEQ ID NO: 42845 - DNA, 67 bp, Chlorella protothecoides
gtccttgtttcgactgcttgaggtgtgtctgtgtgccaggaaaacggggggcggggtggtcgtgctc

SEQ ID NO: 42846 - DNA, 73 bp, Chlorella protothecoides
cgagagcttggcgccccgcgacccgccgccaagcccgaaccacccgccgccgccgccggccagctgcgagacc

SEQ ID NO: 42847 - DNA, 2531 bp, Chlorella protothecoides
  modified_base (310)..(319): a, c, t, g, unknown or other
  modified_base (464)..(473): a, c, t, g, unknown or other
  modified_base (657)..(666): a, c, t, g, unknown or other
  modified_base (2458)..(2467): a, c, t, g, unknown or other
gcgcgctgcgcgccctgctccagctcgccggcggcgagcggcgggagccaggcggcgctggggccctgtgctgagtgccgggcctcttggtccatgtgctgagtgccgggcctcttggtccatgggctccgccgccgagtgcggtactgccagtttgtgaccccttatcctgcatgccaggcctgtcctagagttccagtcggtgctgaggtcgcaacctttccctacccttgtgattcatcccctcccaccaccgcacacaagggcccctcatgtgaccccttgtcccctccattctttcactcccctnnnnnnnnnnttacaagggcccctcatgggatcccttgtcccctccattctttcactcccctgctcagtgatgtgaagaacctcactgcccccgcaaaggcttgctggagattacaggggggggtggcaatgcatatgggagtgtccagacatcnnnnnnnnnnggtgaagaacctcactgcccctcaaaggcttgctggagattacagggggggtgggcaatgcatatgggagtgtccagacatcattgggtgggaaaagaggcgacgagcggcaagatgcggcatgcggggggttgttgacaagccttggctccgacgcatgcggacgctgcatccgagatcggcnnnnnnnnnnaagttgacgagccttggctccaacgcatgcggacgctgcatccgagatcggcgctgcgacgcttcactgcgcgcggttgatgtgggtggcgtgggagacctcggcccccaggcccttggccgccagcagcgactgggtgtcagaggggacctcgccgcgcgcgacgcgagcctcggactcggtcgtgggcgtcagctccgcctgccagtcgtccgccttcttctgcacctgctccttggtgtgctccaccgcccagcgcgcgttgtcgctcgccgccgacagcgagtcggtgacgctgtgcgcggcgccggccacgcggtcggccacggcctgcgccgcgcccgccgtcttgtccttggccgtctccaaccccgacaccaggctgtccttggcgtccaaggtgcggtccttggcggcgcccagccccgaggccacgccctcgcgggcaccggccagcgcgtcccgggtctcggcggccaccgggctgcgcgcggagcgcaggcgcgcagagtcgtaggcatccacggcggtgtcgctcagggagatggagtcgcccgtcgcgtagcgcgccgcgcgctgcgactcggtctctgcgagtgagtaggagggtggagtgtgagtgggtagggctgttatggctggtggtgacaggggtacacgaaagggggaggctgttggtgcagccccaggcgagaagcaagtgccgagcagagtcctgaaaggatgcctgcatatcacgacaagcatctgcaaaactgtccagaggtgagaaacaacattgccaacccccgcacctgtgggacggttcaggcgtgcctcgcgcagtttgtcctcagcctcatggaccttggcccctgcggtgtcggcggcaccgcccagcttgtccctgcaaacagtggcgaaggaggtgtttgagagggtggggaacggcggggatgtgggttgcgacctgcaacgacagccacacttgccacggagggcacggcgggggctgattccggtcaggatgggtgctaaaagacacacctcacagcctgtgagaactgtgcgtagtggaagtcgcccggaccggcgcggtactcgcggacgtatggctgcttggggctgccaccctggccaggcaggtgctccctaccgaggcatgtggggcaggcagtcgccagcatgtccaaaccccctagggcccgtcgccgatccccactcgagaaatctgcgctgcaccgccccatccgcacccccccaccccagacctccaacaccgctcatctcctgcagtacctgacgaatccggcggcgcccttgacggcgccaaacagcccgcccagcgtgcccggctgctcgccgtcggccagagcctcgcggtcgccacgccggaccagctcctctggtgcggcgtcgcgcgccttgctggccgctgcgtcgcccagcccctgctcgccatccttggccctggcaaggaacgaatgggaagtggtttggtgtatgatttacccccacaagggtgacagcagagaccttgggattgtcagctcacagtcccaccccaccccaccctccccccaacaacccacacgcatacccgacgtagctggcagcgcccttggcggcgccaaacagcccgcccacggtgcccggcttctcgccgtccgccagcgcctcgcggtctccgcgtctgcgcaggtcctcaggcgccatctcgcgcgccttgctggccgccgcgtcgcccagcccctgtgcgccatccttggcgtcgcggcccgcacggcgcgcggcgccggccgcgcgctccgcnnnnnnnnnngttgtcagctcacagtcccaccctgccccaccctccccaacaacccacacgcatacccgacgta

SEQ ID NO: 42848 - DNA, 70 bp, Chlorella protothecoides
cgaggtggcttttggagccagggccatgccctgtggctccattcagtaacttcctgtcctctcttgggga

SEQ ID NO: 42849 - DNA, 61 bp, Chlorella protothecoides
taacatgcgagtcgaattattctatggcgggcgtccaagagaagaagcggcgcagtatatt

SEQ ID NO: 42850 - DNA, 70 bp, Chlorella protothecoides
gtgacccccttcctccttctgctcacctctggggaccccccccccctttccccgcctccactcacgcagc

SEQ ID NO: 42851 - DNA, 92 bp, Chlorella protothecoides
tcggccggcagcaaaccctgcccgctgctggagggcaggtaggagtcgcgccatctgggacaggctatcgacactcgccgaggtactgcatg

SEQ ID NO: 42852 - DNA, 61 bp, Chlorella protothecoides
tctctgccaccgcctccagcgcggcgtcgttggtggcggaggagggatcgccggtcgcctc

SEQ ID NO: 42853 - DNA, 61 bp, Chlorella protothecoides
ttgtgtcggaatgctgctcgtgtggcaggggatcacagggaaagtttgcgcggcaaaattt

SEQ ID NO: 42854 - DNA, 1216 bp, Chlorella protothecoides
  modified_base (173)..(217): a, c, t, g, unknown or other
  modified_base (973)..(1019): a, c, t, g, unknown or other
ggcgccgccgccgctcgccgcgctggcgctggacaggcgcgccgccaggctggcgcggggggaggagtgggcggagccctcgcccgacccggacccggcctccgtgccgcccgaggcgtctcgatccatgtcggggacacgggggtgggggtcggtgcggtcgatcacgccgnnnnnnnnnnnnnnnnnnnnnnnnnnnnnnnnnnnnnnnnnnnnngcctgggtgggtggggggagaaaggggggagaaagggggaggctggcttggaggcggaacggaaggagtggacagggggcaagataaggagtcaagggctctgtcggcccacagggggcacgggggtgttccatgaatttgtcgaagcaccgcgtgccacaacaaatccccctcgccaactacaacccgaacaccacaatcacaccacagcatgcatcccgcctcccccaccctgtcccaccaaagtcggcgagcttgatgtggccgtccgcggcgatgagcaggttgtcgggcttgaggtcgcggtgaatgatgccctgcgcgtggcagtactccagcgccagcaccgtctccgcggcgtactgccgcgccacaccctcgctcaacccgccgagcgcgcggaggagggagaagaggtcgccccccgccgcgtactccatgaccaggtagagattggcgtgggaggtgaaggaggtgtggaagcggatgacaaaggggttgcgcgccgccgccaggatgttgcgctcgttgcgcacgctctgcaccatgttcttccggatcaggtccgccttgcgcatgacctggattgggttgttgttttggaagggggtgggaggggcttggtgagacagccgcgcagggcagcagcggttgatggtgaggtgagtgggagggcagccctgctcttgctcatgaacatgtgacccggtggccctcacagaacgctgcgcctggtccccgccccccccccccagnnnnnnnnnnnnnnnnnnnnnnnnnnnnnnnnnnnnnnnnnnnnnnncaaccttgatggcgtagaggtcgtcccccgcccgcttgcgcgcaaggtagactcggccgaacgcgccgcgggagatgggcttcagcacctcgaactcgtcgatgctggtggccgcgcccacgcccccccgcggcgaggacgcgcccgacccggggtcgcgggcgcccagccctcccgccccgcccagccccgcgcgc

SEQ ID NO: 42855 - DNA, 8729 bp, Chlorella protothecoides
  modified_base (257)..(266): a, c, t, g, unknown or other
  modified_base (623)..(632): a, c, t, g, unknown or other
  modified_base (2718)..(2727): a, c, t, g, unknown or other
  modified_base (3373)..(3382): a, c, t, g, unknown or other
  modified_base (3735)..(3744): a, c, t, g, unknown or other
  modified_base (4289)..(4298): a, c, t, g, unknown or other
  modified_base (5202)..(5211): a, c, t, g, unknown or other
  modified_base (7025)..(7034): a, c, t, g, unknown or other
  modified_base (7360)..(7369): a, c, t, g, unknown or other
  modified_base (7823)..(7832): a, c, t, g, unknown or other
  modified_base (8199)..(8208): a, c, t, g, unknown or other
ggctggccgggggccgcgccgagcgcggccgcgaggcgggggccgaggcgcggcccgaggacgcggtgcgcgctctggacgcgctgctggcggccgcgcagcagctgcacgacctggcggcggagctgggcgggagcgtgggcgagaccatcatggacgacgccgctgcgatggtgggaggtggtgtgttggggggggttgtctggttggcaaatgtggacttgatgaaggcggggaagcggtgggggggagtgcannnnnnnnnnagaggtggtgtgttggggggggggggtctggtttgcaaacgtggaattgacgaaggcggggaagcggtgggggggagtgcaaggatggggggccacagggctcctgggccagatttgtggtcctcgaatggcttgcagtgtgactggcgggtttgaccaatggtggtgctgccctcttttgcctcaccccgtactcaccccttctacctgcagacggcgggcttccaggcgcagaggtctgcggcggtggcacacatcttgctggccgccaggagctggagggaggccgcctccctctttgcacgcgcaggagagctggcgggtcatgctgtcgaaagacaccaggtgtgctggggnnnnnnnnnnccgcgcaggagagctggcgggtcgtgctgtcgaaagacaccaggtgtgctggggtgtttgagaagtagtatagaaacgctcctgcagggcttgcacatcacagcaactagcccaaagacaggtctagcctaaacgtcacccccccacaccccaaaacacgtcaatggccgccaggagtgcgagcgggtggatgaggaggcagtgcggggcctcgtctctctgcagtcctccacggccgccttcagggccgtggctgccgcggaggctgccgccgaggccgcagccctcggcgacagagccgcctctgatgtggaagcgctggccctggatcccaatgccccaactgagtcagcagcggggcatgcgtacctgtgcgacgactgggacgctccccaggcattcgtgggcgagggcaagagcaccgctcgcatcgcacggtaggcccgggtgttgtgcgagacgctgagggaggttctctgtgctttgatgcactgtatgaggaggtacatgcactcccgaatgagcaatgctggtgtcctgataaggtagtatcgatgcgcctttcccccctcgtttgcccgcaggatcccgccgcggctggagcccatccccgtgcggccgatcgtgctcgacgccgctctgaactacatcaccatgccctccctggcgcacagggtggcaaagaaagcgggcacgggcgtggtgtcccggctctttggctggggggagcgatgagtgtgagggggggccatgtcagcatcgggcgtggcagcgcctgtacagccctgccacctgctcgttgctgtgtaaccagacaggatcgagtctcccagggatgagtgctcgcacagtggatgatgaggactggcagcttgggacgcgcagcggccatagaaaagggtgaccaagctgcccctcatgtgcttcactgtttatctcttgccccacccccacaagcgtctggggacagtctcgcctgtctgtgtcatgatcatgtttgctccaatgggaccaatgcatcccccacacacagagcaatgcagggcggccgtgatcgcacgtgccgtcctcgcatgggcactctgtctccgcgccgctcctcaggcatagaggtcgtcgtcgtccacggccccagcggaggccagggcggcatcgcctgccgcggcgctgccgccggtccctgcctcggtccccggggcgtcggggaacctgaagtcggacccaaacccgcgcgactgctgcagggtctgcgcaaaggcctggtacttgcggatgtccccgtccgacaccgagcgccgcgcgtacttcatggcctcctcgaagtgcgccctggaggttgtggagggggcgggtggaggggtgggccgtccggaaacactggcccgaaggacgtgccaccatatctgccacagcgcatggtattcctgaaagtccgggacccacaaaaacaatgcaggccacattccacacactgcgccacactcccgagccagtgcgcgacccagagccacacccagcacttcccgcccacacacacctggtgagggcagggaccgggtccggcatgtcctcgtccatcagctcgccggcggcctcgctggcgccatgctccgcctcgcggcggatgtcctgctcgatgctttcgcggatggcatacttgcacgccctctggcagatctccgtgatgtctgcccccgagaaaccattggtcacctggcgagtgagaggagggggggggtggaggggtcctctggatccaaggcacttctagggggctgctcaaagggacgccagagcaacacctccgcaggctcggcagacagtgcgctgtgcacggtgagagtctcgggttccctggtcgctgcaggagcccccacaccactcagcagtctccacattccatcctcctgggcctcaatctccctgccaagcccagagtgcgggctcacctcccaccctcccaccactctacacctccctctgcctcacccctaagccccccccccaaaaaaccctgatgtctgaacaccagcccctccttcctgcccaaacaccaccaccccgcacaacacccaccttggacagnnnnnnnnnncgagtgcaggctcacatcccacccctcccaccactctacacctccctctgcctcacccctagggccccccccaaaaaaacctgatgtctaagcaccagcccctccttcctgcccaaacactaccaccccgcacaacacccaccttggacaggaggtccaggtcgacgtcgggcgccacggggctcttgcgcaggcaggccttgaagatctggcggcgcgacgcgtcgtccggcagcgggatgtagatgagctggtccaggcgccccgggcgcagcagcgccgggtcgatgatgtccgggcggttggtggccccgatgatgaacaccgtcttcttgctgttcatgccgtccatctccgtcagcagctggttgagcacgcggtcccccgcgccgccggcgtcgcccaccgacccgccgcgctgcaccgcgatggagtccagctcgtcaaagaagaggacgcagggcgcggactggcgcgccttgtcgaagatctcgcgcacgttggcctccgactcgccaaaccacatggtgagcagctcggggcccttgatggagatgaagttggcctggcactcgttggcgatggccttggccagcagcgtcttaccgcagcctgcagagaggggggggggggggggggggggggnnnnnnnnnngctgtgacactccaggacatcgagcatgggaggacaggcagatgccctgctcctttctagagccagaccaagccatgggaagtatcgttgctctcgctacagtcgaccagccagcgcatgcatccagaggcacccgccagaatcacagggaggcatgccgctttctccagcaccaacccgtggcaatctccccttttgtcgaagtcgcatgcacatcagcccgcataccccaggcggccaccctccaccttctcccctctcccaccttcctttcccacctcccaatcgcgcccccccccctcaaccccctccccccacacaaacacacctggcgggccgtagaagagcacgcnnnnnnnnnnagccaccctccaccttctccccccgcccaccttcttttcccacctcccaatcgcggccccccccttcaaacccctccaccccccccacacacacctggcgggccgtagaagagcacgccctttgagggcgccatgccaaacttctcaaacttgtctgggtgctccaccgggtactgcaccgtctcctgcagctcgcgcttgacgccctccagcccgcccacgtcctcccaggtgacgttgggcacctccaccaccgtctcgcgcagcgcggagggattgctcagccccagagcggtcttgaagttgtccatggtcaccgccatggagttgagcacctccgcatcgatactgtcatcctccaggtcgatcacatccatcttctcgcggatgcactgcgaagttattgtttgggtggggggggtaggaggggggtgcctggaatcaccacgtggcagcaaatggaatggtgtgctgccacagaccctgcaaccgcacggtcctcggggcacgcgaatcccaagcaggcgggagatgcatcccagcgnnnnnnnnnngggtgtgtctggaatcaccacgtggcagcaaatggaatagtgtgctgccaaagaccctgcaaccgcacggtcctcgtggcacgcaattcccaagcaggcgggagatgcatcccagcgcccagcgcctgaggcaatcatcctccccgccctcaacacccccccataaaaaaatcacctgcagcgcggcctccgtgcacagggcggccaggtcggcgccgacgtagccgtgggtgtcgcgcgccacggcctccaggtccacgtcctcccccagcttcatgttgcgggagtggatgcgtaggacctccaggcggcccacctcgtccggcacgccgatgtcgatctcccggtcaaaccggccaaagcggcgcagcgcggcgtcgatggagttggggcggttggtggcgcccatgacgatgacgtggctccgcgacttcagcccatccatcagggtcagcagctggctgacgatgcggcgctccacctcgccctgcgtcttgtcgcgcttgggcgcgatggagtcgatctcatcgatgaagatgatggcgggcgcgttcttctccgcctcctcgaacgccttgcgcaggttggactcggactcccctgccagcttgctcatgatctcggggccattgatgaggaaaaagaaggcgcccgtctcgttggccaccgcgcgcgcgatcaaggtcttgcccgacccggggggaccgtacagcaggatgcccttgggcggcttcaccccgatggtcttgaacagctgcgggtggcgcagcggcagctccaccagctcccggatctgggccatctgcttgcgcacgccgcccacgtcgtcgtaccctacctggaagagattaggggaagagggcatcgtgagatagtgggtgacgaagtcgacagaaaatgttcnnnnnnnnnncacctggaagagattaggggaagagggcaccatgagagagtgggtgacgaagtcgacagaaaatgttctccaattgaatggagacaggtgagcacccctgcggaatctgggcctcagaaatgggcttgggacacttgccatgtcagaccggtccgggcgaataaaccccaaaccttccggctggtatgcccagcttctccaccaccccttctggcctgtcacgaccccaccctcacatccatgccttgatcgtccacgcacctccatcccaccccactccaccaagctctcagatgccccagggccgccccccccacacacaccctctcctaaacacacgccaaacctcccacctcatccaggcgctcctcgtcctcgcgcttgatgctctcgccctcgcagtagatctcggtgtccggcgcgacgatgcagtactcggcggggtcggtctccacgaccttgaactccacggtgcgcatgccgccgcggacgaggaaggtgtcgcccttgcgcacggggcggtaagcctccacgaagtagggcttgaggaaggcgtcgaacaggttccccgtgatgccctccaccgtgtcctcgaagggcagcacgtgcacgcgctggccgtacttgacgtcggggcactggtgcaccgacacgatgtcgcccaggcgcacgcgcaggttcttgcgcaccaccttgttcagccggatcttggcctcctcgcaggtgtcgtcggagaggacgatgcacaccgtgtccttgcgcttcttgcccttcagcagcaccgtgtcgccgcggaacaggtccagcgtctccatggtcttggggtgcagggtaaccacggagttgtcgtcgttcacggcctgggagggtgaaggaaaggggtgtgagcaggggagcggtggtgagtgggagggctgcgtcaggtgccaggggtctgacagccacgaagaacactggaagtgcatggacagtggagcatgggcacgccgccctgacgtcaaggactagcacccctcgcgccgtggggagacaacagggcatgcaggatcacaaacaacctcctcacacaggcgctgtggcctcgcacatccaggcagggcatctgacccacaatacaccatgccacacttggccaacccccctcccctgcccaacgcacatcatcgaccagcaggcgattggggctcttctttcgctccaggattgccgtgctaaagtcctttctcacttccctgtcgcataaaagcagggcgaggattggaaggcagcgcgcaggcccgaagggtgcggaggtatgcgcaggggaacggcacctcgtgaggacgactcctcacgcacagccctctcgtcgagccctgtgccaaaactcacccctccgccacagcctcagatttgaccggagtgtccggcattgccttgggtggtctatgcctcggcgatcagatagcaaccaggcgagcggtgatcgttcactccggcaatatcccagcggcaggagtgctgtatcagaccactggaattcacaagaatatatggccctgcatcatccgcgatgcactggtatcgagccttggccgggcgtggatggttcggggccctggaagggaaaggatgtttcccgcgatcacgactctcgcaagtggaggggtgggagttcaccgcttatgcacggagagctccatgcatctgcatccctctccatccatctcaggccttactggccgtacaactcacccaacaatagatgaagcgctgctagagtaacattggatgctcctaattcatccatccctcctgctgggcaatcctcgctnnnnnnnnnnaaacttacccaaacaaaagatgaagcgctgctagagtaacactggatgctcctaatttatccatccctcctgctgggcaatcctcgctttgcacactgccttgctcagcagcaacctcccacaaccttgtcatcttatgttctacagagcattggggcaacaaagcattgggttttcatctcagcagagggggatgaggagcggcaggggagggggtcggggggaaacatgggtgtactgtggctgtacagcttcacccccccgccaccggcacaaggtgtcgtgggtgctcttttgttgtatggtaggcagaagggacagagacnnnnnnnnnnaccccccgccacctgcacaaggtgtcgtgggtgctcgggtgttgtatggtaggcagaagggacagagacggtagtggcattctcgaggagcatagcgggcaggaggccgacacactcctgcctgacaagcacacagcgctacggggtgggaggaggacggcatgtcgctccatcaaaaattgcaataggggggcaggggggcagacagcgcggcgcccgcggccccaattcctcaaggagactggaacaggctacaactgctaggcacatgggggggggaagagaggacgaatatagtaaaagagtagagaggagggcgtgtaggtggggctgggtggcgacaactgcccttgtggcgctgcctggacgggctgagagctcctgcgacttgaaaggggggcaggcaccgcggccgccccctcggcaggctggctggcgccatcagggctcgcgnnnnnnnnnnagcgacttgaagggggggcaggcaccacggccgccccctcagcaggctggctggcgccatcagggctcgcgggcaaaggccgcctccagggccgcacggctcgcctccaggatgcgcgggtcggccaggcagtaggggcgcaggaagagttgcagctcgctcgggccctgcgcgtcctggccctcgccccagtcggccgcgccgggctcgccctcggtggggacgtagtaccccgccgcgggcgactccggcggcggcacaaagaagccctccaggcacgccccagggccggccaggtcctcgtcggcaaccccgcgctgccgcggctcacccacacggggctcatccggcagcacggcgtactggnnnnnnnnnnttccggcggcggcacgaagaagccctccaggcacgccccggggccggccaggtcctcgtcggcgaccccgcgctgccgcggctcacccacgcggggctcatccggcagcacggcgtactggccctggcgcaggcgcaggctcttctcccagtcggtcacgccgacgttgacctcgggcgggatgaggagggagtcgggcgcctccaggcggcagcgatagcccgaggaggagcagaagtcctgcaggtcgccccaggccagcgggtacaccgtgggctcgtgctccatggtcgcctccagcagcgtggcgtagcgcgctgcgtcgtcccgcgccgcgaacgccacgatggtgtccacgggcagaccgccgtcgcgggcgctggcgcgcaggctgtagatgccctccagctctgactgccccacgccaaacaggatgacgtggacctcggtggacggggcgggggcggggggggcgggcgcggcggttgggggcacgccctccagcgaccaggtcaggttgc

SEQ ID NO: 42856 - DNA, 382 bp, Chlorella protothecoides
  modified_base (128)..(308): a, c, t, g, unknown or other
gggggggggggggagggggggagggttcaaggcagcggggctgcatgccgggcgggccggtggatcacgcagggcattgcctgctgcgctcgtcgtggttggagcaggctcgccacctggcactggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctgcccgacatgctggcgtgagtgactcccatgcgatggggaaggctcgacacggggccctgctgccttac

SEQ ID NO: 42857 - DNA, 61 bp, Chlorella protothecoides
ccttcttgtcattagggagaatgtggcgggggcatcgttaggtctcgagtcccagcccgag

SEQ ID NO: 42858 - DNA, 61 bp, Chlorella protothecoides
aggaggtgttctcctgaggcttgatgcgaggggcaatctccaggtcccactcgcctgcaaa

SEQ ID NO: 42859 - DNA, 67 bp, Chlorella protothecoides
cctgaggcaggcctgcatagctgcgctgggcctgggggtacgaatggtgagcgctgctttggatatg

SEQ ID NO: 42860 - DNA, 61 bp, Chlorella protothecoides
tcgatgatcttggacatggtgggtggagggggtggcacggagatccctggaggtcgttcgg

SEQ ID NO: 42861 - DNA, 79 bp, Chlorella protothecoides
cgtcgctgccaccttgctgcgacacaagcattaggggggagtccgggacaggcgatgacctgacaccagccgatgcact

SEQ ID NO: 42862 - DNA, 61 bp, Chlorella protothecoides
ggtgcgcttccggctgagcggcgaggagattgcggcggcgctggcggaggcggggggcgcc

SEQ ID NO: 42863 - DNA, 64 bp, Chlorella protothecoides
ggaggtcaggcgtgcgggcaggcgggtgggaaccagcacggaccctgtgcagccgggggtgaag

SEQ ID NO: 42864 - DNA, 61 bp, Chlorella protothecoides
aacccagccaagccgagcggctggcagaggggagtgtggctgaaggaaagtcactcgagca

SEQ ID NO: 42865 - DNA, 61 bp, Chlorella protothecoides
aaggtcaagaacctgacggggctggcggaggggtacgccggcagcgagcgcctgcagggcc

SEQ ID NO: 42866 - DNA, 108 bp, Chlorella protothecoides
ccccaacacaccctccctgcccttttccccaacacacacacaaaaacacaccaggcacagcaccgctccaccccctacccccccacccgctggtcttgggcatcatga

SEQ ID NO: 42867 - DNA, 191 bp, Chlorella protothecoides
gtgggggaggggtctgtgtgggatgaggaaagcaggggccagatggagtgaaacaaatgaattgcagagaggaggggcacgccaagttctttcagcgattgtctgcctcatcacagccctggcagcatagcctgcacatttcagcccacccccctcagtgttgcccaggccccccctccaactccccccac

SEQ ID NO: 42868 - DNA, 62 bp, Chlorella protothecoides
ttgggccggaagtgatcaagccaggcgggtttccatgacgaccgccgatgtcgaggccgcag

SEQ ID NO: 42869 - DNA, 66 bp, Chlorella protothecoides
tccccggggtggtagatcacggccgaggggtgggagatgtgggggctcttggcgtgctcggtccag

SEQ ID NO: 42870 - DNA, 87 bp, Chlorella protothecoides
ctccgagcgcatccaacccccctttccttttcactcacggcgcccctccacccccacaatgaacctcaatgcctgtaggacccgttg

SEQ ID NO: 42871 - DNA, 61 bp, Chlorella protothecoides
aaatggctcccgtcgccagcaagaagcccgggtcggccaagaagcccgtcgcggcgaagaa

SEQ ID NO: 42872 - DNA, 61 bp, Chlorella protothecoides
ggacgtggtgctcaacaccctcacctcgcctggcatggtggcggcctccctggccggcctg

SEQ ID NO: 42873 - DNA, 77 bp, Chlorella protothecoides
gggactccacctgggaggtattgagggggaaagtgtgtgcgatgcacgggtcaaagggctggttagagtagcaatgc

SEQ ID NO: 42874 - DNA, 371 bp, Chlorella protothecoides
  modified_base (118)..(273): a, c, t, g, unknown or other
cacgcaggggggtgccatccctgcgtacatggtgagagggaggcgcttgatgctctggaggcttgtagaagctaaatgtgatggactacggggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgatgacagcatgcgcaccgccctctgctagacaccaatggctggcctactggatgaggtgccccttgaggtccacataccaaggccaaccagct

SEQ ID NO: 42875 - DNA, 61 bp, Chlorella protothecoides
cagccctccaccaacacgcacttgcctgccacccccccctgactcaatcacacaaatccaa

SEQ ID NO: 42876 - DNA, 80 bp, Chlorella protothecoides
agcaacctcatcccaccaaaggcaaaccccgccgcaaaggctgccctcaagtcgcacctcctgcacgttggcggcgacgc

SEQ ID NO: 42877 - DNA, 6684 bp, Chlorella protothecoides
  modified_base (161)..(170): a, c, t, g, unknown or other
  modified_base (633)..(642): a, c, t, g, unknown or other
  modified_base (1193)..(1202): a, c, t, g, unknown or other
  modified_base (2160)..(2169): a, c, t, g, unknown or other
  modified_base (6572)..(6581): a, c, t, g, unknown or other
gcgaggcgctggcgctggcgtgggaggcggcggggatcacgaggccgctgctggcggccgcggagcgcgaggcggcggaggcgccgggcctatggcgccggctatgggcgcgggagacggagcttgaggacctggcgcgctggcgcagggtgtggaccacnnnnnnnnnnctctggcgccggctgtgggcgcgggagacggagcttgagggcctggcgcgctggcgcagggtgtggaccacgcgcatcgccgccctctccgccagcgtggcgctgggcagggcgcagctggccgcggaggggggcgctggcgcgcaggccggagaggcgcaggccggagaggcgcaggccacgctgcagggcgcgctgcgcaccgcccagcggtggctcggggaggactcaggggccactgtgctgggtaccgatgctttgctggagaaggagagggcggccatccgaggcctgcgcgccgcggtgctggacctgctccagggtgactccaccctcgacgaacggccggcaactgcctgacaaaggggtgagcggattcggcgggctggctggcgatgtgaccttgacccccagggggcaatgctcaccgacgcaggccaagcctccgcatgctttggtgccnnnnnnnnnnggcggacgcggcaggctggctggcgatgtgaccttgacccccggggggcaatgctcaccgatgcaggccaagcctccgcatgctttggtgccagtctctggaactctgcctggacataggttgagctcgccagcgctcaccaggcctgggacattgttgcgccgggagccggcaaacagcgatggccgaggtggccctgcccccgcatgagcccctggatcctcaaatgattcactttgcagcaacgagcagtcctccaccccacttgggtcacttgctgctcacagtggcattggctccacctgcagctatgcacaggtcatgggagaaatgcaggaagcaccttgcaagaaaaatgcagccgacttttgtagccatgtggaacgaagcgcaagcgcttgctggctcagagggcgatgtttgggtgccgatagtgtttgatgagagaaggctttccaggcagcagccgaggccatgagaccctgctgcgccctggaagagcgctccagggagcaaaactgtcgacagatggttcgaacacccctcagttnnnnnnnnnnaaggccatgagaccctgctccgccctggaagagcgctccagggagcacaaccgtcgacagatggttcgaacacccctcagttcatgccccctcccccatgagacactgggccatgctctcctcgccctcaagatcctctgcctccttggaccccgaatccacgtgccaggacagcgccagcaccaggagggtggaggagatgagggcggggttccccgccacccagcccatgatgggcagggacagcaccaacatgcgcagcccggcagagaagtagagggtgcaggagtgcatcgaggtctggatgtcgctgcgcagggcgttggagtgccgtcgcctgctcttcagcggtatcataaagccctggggggcggggtggggtgggggcccaggatgactgcacgtgacaaacgacagcgagcaggatgtgtcttgacttcacaggaggaggtggggtggcaccaggattgcagcatgggccagtcgcagagtccaagccagcttgcaccgagagctggccggtgtgttggcaggttgtggggcgccacagattcatgagcccgcagcagggcccaacacacccggcgagtgtgacatcgcacatgcaggcggcccacggcggcgccctccctaccaggtgcactgccaatcggacgctgagggagagcatgaccagggccaggaagaggacggctagcgccagcgtcagcttggtctgtgtgctaacccactcatggcctctgggctccggagcgctgtccttggtgatgattgcaaccaagcgccccaagatctgggccagccccgtgaccatgagggtggctggaacaagggggtgggcgagaggaggagtgtgggacggcaggggcattcacgcggggtgaggcttgacgtggtgacagctgccgcctcctccctcatcctacgcacctgctatgatcaggtttcgcagtgtctnnnnnnnnnnggggggtggaagagatgaggagtgtgggacggcaggggcattcacggagggtgtggcctgacctagtgacagctgccgcctcctccctcaccctactcacctgctatgatcaggtttcgcagtgtctgcacgaccaacaggctgtcgtcaggggagttcatggtttcctccacccaggctctccggatgtgggtggtctggtgcacgcccgccagcacccgcctcccgaaataccacccattgtagaggagcaggctgccgaaacacgccgccgcgaccccgatgtccgtccatggccccgagaaatccttcatcgcagtccttacatgcgatggcctgatttactttgcgacgtgcgcctccacgttcccgtttgtgtgatgagagctatatggttcaactcgaagcagccagctgcgtatcagattccaagggaggtagcccggcagcgcgacattccataattgaagttcgacagttgctataggtgctagtatggcaaatcagtgccggtaacatagctgtcgccgcccgttgagtctgccaatgaattcatcaagcatctgaatatggcttgcacagtctggcgtattcctgtgtgtcatgaacatcatcaatactgcactacagcatcagtcaggatgccactgaatgctgcctggaagcaggcaaggaatacagcatccacatgatgtgctggcgcagcttccatcacccctgcgggctgtgggacagtccttgccacgccaggtcatgaaccaaatctcctgcctaccaggtgcctcatatccgaatgtgtcaggcccagaactccgtcttttttccagacttggcaaccgtctccttcaccgtgtttggatccgcgctgcccagcacggtcaccttttgctttgccaggtcgatgtccaccttttccacaccctccagattgcccaggacacgccgcaccgctcccgcacatccctgagtgcatattgggatgtcaaacataatccacagaacgatcgctatcactcgcaggccgcacccggacgtgtaccagcacgaaacctcacctcgcaggccatggccacccgcagctgcgtctcgggcatggctactgagtcaaaatatgaagacttctacctacatattggagtatggtagattgagcgtttgaatgctccgaacattagagtcgtacgagcagtggtgctggctatcagccaacctgtgaagggtctcgtgccactccctttagggattcctcaccgtgcggaggggcaaggactccacgccagcttcctcggtcgctcctctgatcctcgaaaatcctgttggaagagcaccggcctaatgctcggacgagataatctcggaacccgcaaccgtgcgatgcgtgagtcgcgccacgaagacgtccacatgcatggtgacgacgttcccacggctccctcttactgtcgcattgccagcctgcagtcgatacacgctcgatactggcacattactttgtacatttggacacagctgtcttggacctgagggggggctgactttcgtgcaccacccctcttccggggatgtgtgagggacagcctgccaccaagagggccaaaagggactgcagagccgagggtctgggcagcctagcggttctgaatgatgagtgcattattgatgtattgcacctcctctcgggtcgctacctcgcgcaattggcggcagtaagccggtgcctctacttctacactgctcacaacgagctctggaagggcctagtgctagaggtgggtggagggcgtcgctgagggtgctctcgtggtggtcaggatcatgttcatgccactgttcggtcgtcggcgtctgtcgcttgtcactgcctgtggctttgaactacccacctcctgtagacgctgggcgatgcatggaccttccgcgacagctggaaggaaacatacgcctggcatgtctgccctgggcacaggccttacgcgccgccgcggaccctgaaccccaggggctttcactccgagttcctgtaccgctcctggctctgcgcccacatggtgatcgacagcgcctggctggaaacggagaacgtgccgcgcaggtctggcctcaccctgcagcagttccgggaggagtacgagctgcccaaccgcccggtcatcctcacagatgtggtgagcgccgtatcgtggggaggggtgtggaggaccgccgtgtgcctggggtgggaccaggccctgcctctgacgccaccccatgtcccagggcacggagcgatggcacccgacctccaccctcctcactctcaaccccttgtacatgttcaggtcaccaagtggccggccatgcagaagtggggcagggagtatttggcggagaagttggccgggcacagcgtgctcgtcggggacgcgcccatgtcgttcgaggggtactgcgcctacgccgacgcccagagcgacgagctgccgctctacctctttgacaaggggtttgcggagcgctgccccgacctgggtgccgactaccaggtgctggcatgtgcacatgggggagggtgtctgccagggctggcggcggctgcagcccagcacaggcactgctgctgccactgcagatgctggggcttacgcgcctcttcgatacccatcctcctcccggcctcaaatccctgcccaccaccacacacatccatccaggtgcccgaggtattcagcgaggacctctttgcggtcctgggccccggccggccggaccaccgctggctgatcgtcggccctgcccgcagcgggtccaccttccaccaggaccccaacgcgacctgcgcctggaacgccgtggtgcggggctccaagaagtgggtcatgtacccgccccacgccaccccgccgggcgtgcggccctccgccgacggcgccgatgtggcctcgcccgtgtccctgaccgagtggtttctctccttctacgaacaccgcgcggcgggggggcgggcgccggcggagtgcgtggtccgccccggcgaggtgctcttcgttccccgccagtggtggcacctggccatcaaccttgaggtgggaagccgggcggaatgtgctgagtgtgtggggtcccatgctgtgtgactgggctgatactgcactgggcaccacctgcagtggatgcggggcaaccccaaggtcaaaccacatggccttcagcaccaggcccaggcctcaacaccccgtgcccttgcatgccatgaccgcaggagagcatagccgtcacccaaaactacgtgagcactgcgaatctgcggcacgtcctggccttcctttcctcccgtaaccccgccctggtgtctgggctggagggcgacgagcggcgggcctccctgcacgacgacttcctcgccgcgctgaaggaagtgaggccccaagcgctggccgactctgccgcactggaggcagaggagctgagtcgagcacaggtgcgtgcgcagctgaatgggctttgggcagggcttttgctggagcgatgggtggtgaagggagcacctatcgacctcacggctcagtcccggccgccccctgggctcttccctgttgtcctgtcggctccttggctggataacaaagaaccagatgctaattacaaatgcgctgtagtggagtttctttggggggtgggaggtgtatctgacaaatgtgggttaggcaggctgctggaagcgctggggcctgccgaggcagtgcttgcgaaggggtcctatcatgagtcctctggccaaacacactcctgcaggccacacacaagctttcttcactgttccgggaggggagaacgggagaatcgtcaaacctcacctccccagaccagggtgccacgccggccatcaggttcggctttgcgtagcggtgtggcaaaaaaagggacgaaagagcggagaactacaagcagtgacgaatggggggagggaggaggggtgacagcgtcaggacgacaggagtcgatggggtatgtgggtgcttactaaaccgtcccgatggggagggccggccgtgtatcggccaacttcaacgtgcacagcagttttggtccgacagagttgggtggtgaggagtgattgggagggggggcttggggaagggagggcgtggtggacccaggctgccagtgcgccctcacgccagggggctcgtgtgtcgtcgctccgccagccgcgtccggatgggtgggagcgatgggtgcatgcaggacagcgacgcggtgtgcacggtggcatgtgatgccagctgctgggctgctgctgccaaggctgcgttggtggggggcgcccccacacaccggctgctgggcgtgggcatggaggtctccgccgccaggtcagacaactcacccatgctcgtcatctgagcgagggaggaggggggggnnnnnnnnnncagcgatgggtgcatgcatgacagcgacgtggtgtgcacggtggcatgcgatgccagctgctgggctgctgcggccaaggctgcgttggtggggggcgccccc

SEQ ID NO: 42878 - DNA, 492 bp, Chlorella protothecoides
  modified_base (139)..(148): a, c, t, g, unknown or other
  modified_base (252)..(390): a, c, t, g, unknown or other
ggggcgcccggctgcggcccgcgcgccgcgctccccgcccccgtcggtcagcgtggtctcgctgtcggcgccccgctccccctccgcctcgctgctcgacggcggcggtggtccggtggagggcggcattccagagtcnnnnnnnnnncccgcctcgcccgatcctgcctcccccgcaccccgcgtccgctttcgtgcggggctgggcggggcagaggactgcgcctcgctctcgcccgcggcgtcgggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcctcgaccactccctcgccctgcgccctcctggccccagaactcctcgtcgctgccgtccgcgaggaagacggccagggccgccgccttggccgcccg

SEQ ID NO: 42879 - DNA, 91 bp, Chlorella protothecoides
gccagggggcggaggcggccggggacgtggatgggctggcggggcacactggcggagaggcagcagcggcagtggcatccatccccatgcc

SEQ ID NO: 42880 - DNA, 61 bp, Chlorella protothecoides
ccaatgccctgcagagtaccaaccgcagccttcgaagcggcggaagttaaacaggagagcg

SEQ ID NO: 42881 - DNA, 61 bp, Chlorella protothecoides
tggcgccggctttggcggagggctgggcacggggggagccgccggagcaggcacggtggcc

SEQ ID NO: 42882 - DNA, 61 bp, Chlorella protothecoides
ggggccacttgctggtgtccagggcggggggggttttctggggcaggatgaggtctgcgaa

SEQ ID NO: 42883 - DNA, 61 bp, Chlorella protothecoides
ctgtgcgcgatgcaggacgctgtcgagtgccggagagcacccaccctcccgcacctgcttc

SEQ ID NO: 42884 - DNA, 1284 bp, Chlorella protothecoides
  modified_base (85)..(94): a, c, t, g, unknown or other
  modified_base (495)..(504): a, c, t, g, unknown or other
  modified_base (837)..(846): a, c, t, g, unknown or other
  modified_base (1083)..(1169): a, c, t, g, unknown or other
tcctcctcctcctcctcctcctcctcctccacgccttccccgccctcctttcctcggcgcagcaggcgcacaaacgcctccagcnnnnnnnnnnaccgtccccaccctcctttccccggcgcagcaggcgcacaaacgcctccagcacggcgtccacctccaggcgctcgaggtccaggaagtgtgactggcggcagacggggcaggccgcggccacagtgccgggggggccgccggcgtcctgcgcgtgcatgggggtttgggggccgtccgtgccgggggctgcggcgcgcttcttgccgtttgtgagatccggggcccagatgccccctggagcatcagctcctgggctggcagccgtgccagcgccctgcgcggcgtctgtacggcccgcgccgcccgcatcactgcaggtgatcgccgccctttcctcgacgtcgccgtggcgcgcggcgtgctgggcgtgggagagcaggcaggcccagcagaagcggnnnnnnnnnnggatccggggtccagatgccacctggagcatcagctcctgggctggcagccgtgccagccccccccgcggcatctgtacggcccgcgccgcccgcatcgctgcagatgatcgccgccctttcctcgacgtcgccgtagcgcgcggcgtgctgggcatgggagagcaggcaggcccagcagaagcggtgcgcgcagttgagcaccacgggcgagcgcaggaggtccaggcagacggggcagacgaagtccgcgggctcccgcgccgcggcgcgggagcgcggcagggcgccgtggccggggttggcggggctgggccccccgcgcgccgcgcgnnnnnnnnnntggggcagacaaagtccgcgggctcacgcgccgcggcgcgggaccgcggcagggcgccgtagccggggtcggcggggctgggccccccgcgcgccgcgcgcacctccagccgcgtgagcaggtgggcgaggcgcgcggaggcaaagaagggctgggaggcgaggatgacgccggcgtccaggcccgcgcccgcgccgccgggcagcctgcgccgagccttcttcaccgccttggtcnnnnnnnnnnnnnnnnnnnnnnnnnnnnnnnnnnnnnnnnnnnnnnnnnnnnnnnnnnnnnnnnnnnnnnnnnnnnnnnnnnnnnnncggcccgcagcgggcctagtgcctgggggttgggctgcgacaggccctccgacacctcggcgcgagactgcatggggatttgggaagcaggtgggtgggtggggggtgggtgggg

SEQ ID NO: 42885 - DNA, 61 bp, Chlorella protothecoides
gccgcgctcccccgccacgccctccaccagacccagggcaagggcctgcggcgactggcgc

SEQ ID NO: 42886 - DNA, 1089 bp, Chlorella protothecoides
  modified_base (135)..(144): a, c, t, g, unknown or other
  modified_base (334)..(415): a, c, t, g, unknown or other
  modified_base (798)..(897): a, c, t, g, unknown or other
gaggctggtgggggggggagggcggggtaaggcgtgtgtgtgtgtctgagcaggcgcgggtgtgccaccacatgcgacctgcgtggatgaacgtcaccacagctctgcggggtggggcaggctgatcaggctcannnnnnnnnncgcgtgtgtgtgtgtctgagcaggcgcaggtgtgccaccacatgtgacctgcgtggatgaacgtcaccacagccctgcggggtggggcaggctgatcaggctcacagatgcagctgccagccccgaccggcaccctccagctctgcgaagaccctcccccctggtccccggtccatcagccttccacctnnnnnnnnnnnnnnnnnnnnnnnnnnnnnnnnnnnnnnnnnnnnnnnnnnnnnnnnnnnnnnnnnnnnnnnnnnnnnnnnnnaggcgtccaacctgctgcgcgcgctgcgccagtcgccgcaggcccttgccctgggcctggtggagggcgtggcgggggagcgcggcgcgggcgacatcgaggtggaggccaccaaggagcggtccctggcacgcagggtgcaggcgctgtcgcgcttcctcctcgaggccctgcaccgcgagctgggcggcggcgcgccggcgggcccccgcgccagcgccggcacggccccgaggcccgaggccaccccgggccggggcccaggccccgggccggcgcccgcctcgcccgtgcaggccgtgttcggcatgcgcgtcgcctcccagctggcctgcctggacccgccgggccggccgccgcagtcgcgtgagtcgctcagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgcggtgcaggcctcgctcagcgtcaccgccgacatgcgtgcctggttcgacccggaggtgcagtacacggcggtgcgccagcgcaggacggtcaccgtgccgccccgcgtcctcatcatcagctgcggggacgtggtgagtgggacggggtgagggtggttgggtggggcaggggcggcggggtgggtg

SEQ ID NO: 42887 - DNA, 79 bp, Chlorella protothecoides
cgctggagggcctgagggcggtgcggggggcgttgcacgccgcgcacgccgccaggcgggaggccgccccattcccggc

SEQ ID NO: 42888 - DNA, 66 bp, Chlorella protothecoides
gagccagggcagcgtgcacgacgcgctggcacaagggagccagggcagcgtgcacgacgcgctggc

SEQ ID NO: 42889 - DNA, 19118 bp, Chlorella protothecoides
  modified_base (503)..(512): a, c, t, g, unknown or other
  modified_base (1616)..(1625): a, c, t, g, unknown or other
  modified_base (2125)..(2134): a, c, t, g, unknown or other
  modified_base (2495)..(2504): a, c, t, g, unknown or other
  modified_base (4219)..(4228): a, c, t, g, unknown or other
  modified_base (4674)..(4683): a, c, t, g, unknown or other
  modified_base (8446)..(8455): a, c, t, g, unknown or other
  modified_base (10068)..(10077): a, c, t, g, unknown or other
  modified_base (10443)..(10452): a, c, t, g, unknown or other
  modified_base (10624)..(10633): a, c, t, g, unknown or other
  modified_base (12545)..(12554): a, c, t, g, unknown or other
  modified_base (12778)..(12787): a, c, t, g, unknown or other
  modified_base (13105)..(13247): a, c, t, g, unknown or other
  modified_base (13339)..(13348): a, c, t, g, unknown or other
  modified_base (13988)..(13997): a, c, t, g, unknown or other
  modified_base (14225)..(14234): a, c, t, g, unknown or other
  modified_base (14391)..(14400): a, c, t, g, unknown or other
  modified_base (14455)..(14464): a, c, t, g, unknown or other
  modified_base (14633)..(14642): a, c, t, g, unknown or other
  modified_base (15332)..(15341): a, c, t, g, unknown or other
  modified_base (16747)..(16756): a, c, t, g, unknown or other
  modified_base (17833)..(17842): a, c, t, g, unknown or other
cgggagctggacagcgcgggcagcgcggggcccgtctcctcgccgggaaagcgggaagaggccgccgcgccagcgggcgcggcgacagccgccgcctcctcacgcgcggtggccgccgccagggcggcctccaggcggctggcgtggctggccagcgccgcgcgctcccccgtcacccggtccagctgcagggtcagggtcgctacctgctcctccagctctgccacctgaaagggggggggtcgatgcgtcagaggaatgggttgggggccggaaggcgaggcacgcgggctccttgggcagcgaggcgagcgagtcccggcaaacaaggggcatgcgcggccaaggaaacaggcacggcatgcccaaggcgtgaggctggatgccagtggctggtcgtgccaggccccccaacccagctggttccgccatgctggctgccacccccagcaccccacaccgcccgctccattaccttcatcttctggcgctcgcggaagcgnnnnnnnnnngccaggggcttgcacggccaaggaaacaggcacggcatgaccaaggcatggggctggatgccagcggctggtcgtgccaggccccacaacccagctggttccgccatggtggctgccacccccagcaccccacaccgctccactaccttcatcttctggcgctcgcggaagcggcgctgggcccgcctgttcttctcctgcagggcggtctgttttcgtaccccctgtgcctttccggcgcggggtgggggggagggggtcccccgacagtctgctcccgactgggggtccagcgtctgcttggccagccgatccgacaggccctccgaggaggagggatcggcctcggacttcacaccgggctcttgggttggaatggggagggagccggggtacgtcccgaaggggtccgggggccccgcgtccacgtccttgaggtctgcacagtgagcgtaccgatgcacgttgctcggccgtgcatgtgcagaacgccgcgacaaggagaatgtgtcggatcaaacggcgctccagcgcccccttcaaagcactcacaatcgtccaggaaggcgtccacgtcgagatcccatgccatccccgtgagttccaaggggtcgggagccaggggtggaggggccccgccctcaacgaaatcctggttcatatccggtcgcgcgccgacgtcggcatggagggcttgatgtgggatatcgaacaccgagcaatggggcggggtgtggccgtgagtatgctctggaggaggcgcggagttgcttgcggtgggatgtcgagactagaaagaaagagcacggacttacgttaccgcagcggaaacacagagtaccagagaccaccgaccttgacgccattcatctgcccttaaactttatggaatatccctcgtcagtgccagtggccggtggacatgccgcccatgctgtggtatttaagactcggatcggtgtcggagtaggcacggccccgatatcgccattttcgatgactcattagtcgactttgaagattgtgaactgaagagagttctcgtatcttggatcctgtagcaatgataggcgaagtctagcatgttcgagatccgtcgagagnnnnnnnnnnctgaagattgtgaactgaagagatttctcgtatcttggatcctggagcaatgataggcaaagtctagcatgttcgagatccgtcgagagcctgcgcggaagtttatcatattgtgttcgggggtctttttagaatggcaggctctcgctgtgcaggactcccgactcccacaatacaccatgagacccgtccagctacctccatgactgttccaagggcgtcactatcgaggacagatgatgtctgacgggagggagtgaacatgtttggggcaaaggggaatgcttgtgattttcacagacctatgggaaaggagggtgaccaatcatggcgcgtaagggtcccaccagatggggcagacagaataccaaggtaaggccctcaaggatgacagagtgatcgcaactcagcatgtgcacgaggcctgggtgtgtcagaatctggtccaggacgagtgtgcaggaatgctaaccatgctgctgctcatcagcagcagagcnnnnnnnnnntagaatctggtccaggacgagtgtgcaggaaagccaaccatgctgctgctcatcatcagcagagccacagatctgatgtgaccaatctacggtagacatattcatgtctcacaggcgtaatgtgtatagccatcggatccaagctcttgctgcatgagaagcttctgaatgacccgctgggtgccacaagcaatcaccgtccaagtaggggcacaggaggctgaacagtaattttgtgcacacttggatgccctcatcatgccctgccgagtacgggcttagacaaatgtcggaatcggcttgtaatgctatccggcgctggttgatggtcggaaagggactccaatgatgtgcctgctgnnnnnnnnnnggacaaatgtcggaatcggcttgcaatgctatccggctctggttgatggccggaaagggactccaatgatgtgcctgctgccctgctgcgcgcgactgtcccctcgtcgcgacactcataaattcaaaatcacgggggccattcgaggtccccgcaacccctccctgaaggaaaaacgattggttgtcaacaaggtgcacagagaaggttgataatttactgcgtacgaggccccttgtcggcaggatggagctcgcgacggggcatctcggggacgccctccccatcatgaacaccatgaacgcccccgtggagctctgtgaacgcatcaaggagcgcttcctgaacttcttgaacgatttcatcttgcaagatcggggggagccggagctcagtcagctgagcggagcctctggtgcgctgggggtgggcacaaaggggcttctgagagagatttctcatcgggcgcctcgacgccgcgacgaatgagacacatacacgcatgacggcctactcgatgctcagattccattgctcccacaagcccgtacgttcaacgcccttgagcaggcagcaactccacacctcactacgtcgaccagctgggggtgctgagggagcgggacctcaccaccctcagtgtggattttgagcatctcagtttgtacgaccaggtaaggttgctgagaaggaggggggtttgggagttgcaggttttgtgtaagagctgcaggccatcactgtcgctcagtcgatttgcttgtgaggaggatgcttgcacatgctgctgacctgggcagaaacagcttgtgagggttccaacctcccaacccgtgagaaagcgtgctatcacttgataaccctgtttgctcttgtgctcactacagtgggatcgctgaaggacacgcagttccaaggtccatctcaccatcaagcacccaccctgtctctcccctctatcacttgcacacctcccaacccttgcatccacagacactggctgtgaacgtggcagaggcatactaccgccttgagcccttcctcaagaccgccctcgcggcctttgtgcgccagcacctggacacctatgcggagcaggaggatggctcccccaaggagttctgggtgtcgttctacaacctggaggtgcgaggaggggatggcatggagcactccattgtctcgccctaccagtacacggcaatcggccctctgcatgctcccttcaggcatgcgtgcgctcacatcctgtgcccgcccgccccgcagcaaggggacaggctgcgcgagctgcggtccaacaagatcgggaagctgagccagtttgtgggaaccgtcacaaggacaacggaggtccgccctgagctgtacaagggcaccttcaggtgcatgcagtgcatgcgcgaaggtgcgcgtcggacgagggcctgccagagtattttgtgtgatgtgatgaggactgggacatggtctacatggtgtggcagtgggtggtgggtgtaatgcctggccccagcgtctcagtggtgagcgcacacttgctgaactctgggagctcgcagctgatctggcgtggcagcctgaggcctgtctgacagcttcgtcctgttctggaacaaactttactcctcctccttgccggcactcccttcctgatgcactccccatcatttgcatggctgaacaaattcgctcatgtgccccctgctcccccnnnnnnnnnntagcctgaggcctgtctgacagcttcatcctgttctggaacaaacttcactcctcctccttgctggcactcctttcctgatgcacttcccatcatttgcatggctgagcaaattcgctcatgtgccccctgctcccccattcctccctccattgcatgcagtggtgagaggtgtggagcagcagttcaagtacacccagcccctgatctgtcctgatgccacctgtggaaacaggtaggcacatgctcggagagcgtgtgaaggcggatggattgctgtgtcgcaaccgcagaagggccttctgcggggcaaccccagcctgccagggctgcctgtcctgcactgcctgggaagaagtccggggctgaaacccagccaccaccctgcccgccacctcactcccctacctctgcgcgcaggattgcctggtccctgctcatggacgnnnnnnnnnnctcctgcactgcctgggaaaaggtccggggctggaacccacccaccacccttcccgccacctcactcccctacctctgcgtgcaggattgcctggtccctgctcatggacgagtcgcagtttgtcgactggcagaaggtcaaagtgcaggagaacccggacgaggtgagcatgggctcgggtgtggggattttccccacaccacctggcgcacatggggcggttgcagtctgtcctccctgcagcagggaagcagcgtgctcttcccccgcaccgaggaaccaggggcgtcaccttggatgcagcgagaatgctgttcgccactgcgtcacctccaagaaccagtaacacccacttttgcccgccgcccctcctcacacccacccccaaccgtccttccccccccaggtccctgccggctctctccctcgcaccatggaggtcatcctgcgcaacgaccaggtggagagcgtgcgccctggcgacaaggcctgcttcaccggctgcctggtggtggtgcccgacgtcgccgccctcacgtgagcgctcagggtggtggcggcatttggggtggtggaggtcggtgctgcaagcatgccctccggagcagggctgccagcgtgcgggccgccgtggatgctcgagactgtgcttgtggtggcggtgggtgtcacccctccgcactctacaaagcaccatcacgacacacccccctcttcttcctttctcaacgtcccgcgcagtgcgccgggggagcgcgtccaggcccggcccagcggcggcgagcgcggcggcgcggcgcccgagggcggcgtcaccggcctgaccgcgggccccgcgcgcacaggcgtgcgcgagctgagttaccgcctggccttcctggcctgcgccacgcgcccgctggacgtcgggtccggcgtggtgaacatccggggcggggaggaggaggacggccccgcggccgtcctggcggggctgacccaggagcaggcggagtcgctggaggccatgcggcgcgacgcctcgctgtacgaccgcctggcggacagcgtggcgccccacgtctggggccaccgcgacgtgaagcgcgcgctcctgctcatgctgctgggcggcgtgcggaagagcacgcgcgagggcatcgcgctgcgcggcgacatcaacgtggccatcgtgggcgaccccgcctgcgccaagagccagctgctcaagtgggtggcggggttcctgccgcgcgccgtgtacacctcgggcaaggccagcagcgcggcggggctgacggccaccgtcgtgcgcgaggccgactccggcgagttctgcatcgaggccggagcgctgatgctggcggacaacggcatctgctgcatcgacgagttcgacaagatggatgtgaaggaccaggtggccatccacgaggccatggagcagcagaccatctccatcgccaaggcgggcatccaggccacgctgaacgcgcggaccagcgtgctggcagcggccaaccccgcgggcgggcgctacgaccgctccaagccgctcaagtacaacgtggcgctgccccccgccatcctctcccgcttcgacctgctgcatgtcatgctggacgagcccgacgcggcgctggaccgcgccatcgcggggcacatcctggacgcgcaccgcgggcgcggcgcggtgctgaccccgccctacgcccaggccgacatgcaggtgtacatcaagtacgcgcggtcggtgcggccgcgcctgggcgcgcccgcgcgcgccgcgctggtggccgcctaccaagcactgcgcggggccgacgcggcgccggggacctccgccgcctaccgcatcaccgtgcgccagctggaggcgctggtgcggctgagcgaggcgctggcgcgcctgcacctgcgcgccgaggtgcgcgccgcagacgtgcgcgaggcgcaccgcctggtcaagaacagcatcgtgtcggtcgacgcgccagaccaggagctggtggggggcgggggggaggaggaggaggaggaggaggtcgcggcccaggtcatgggcctgccgggcagcgggggagagcgcggggaggcgggtgctggggcgggcggcgctgcgccggaaggggagactagtgctgccgacggcggggccgccccgcgcgccgccgcggaagaccgggcggcccggcggcgggtgcccaccgccaagtacaacaacgtcaaggtgtgtcgcggggatgggggggcaggggccgggagcgcgcaaccttcttggactcggtgtgcgctcgagtgggtccgtcaccttcctggacgcctgggggccgctcccttgcccgacccactccctgactcccaaatcaccgcagaacctgctggtgctgcggctgcgccaggcggacgacgaggccggcgaggcggtggacgaggagggcgcgcccgaggcgggcctcacccagcgcgacctcctgcgctggtacttcgagtacatggtggagcgcggcgcggtggcggggcaggagcaggggctggaggagctggtgctggccgagaaggtgctgggcacgctcatccggcgcgagcacgtggtcatggtggtgcagaccccggcccaggccgagggcgagtcgcccgccgagtacggccgccgtgcgcagctggagcgggtgctggccctcaaccccaactactccctggactgatgaagagttgtttgtgggggaggagggacgcgggcccctccgggagagctgacatgagacacccaacctccaacccagggccttggaaccccacacccagaaagccccagctttgcacgcccaggctggccttgacccttatctgacatcctgtaaagattgaaagagacaaagaaatgtggacgagaatgtagtgtagcagacacggtttgagatacccctgggcaagggcccgctccccattcagtcatcccgaaaatggcacccagtgctgcttcttggctatcaagcctggcgaatcgagcaatcagcaattcgcttggaattcatgggcagtgtgcaagccctcccacgctgtgcagctgttgtcacttgaaatcggagggaatcgcgtccagtttagatgcgctggcatcgtccgcgggatcatccagattgcgcccccgacccccgctcacttaaaaccgggcagctgtgtccaggccccaccctgtacaccgcggcgccaccgggttgcaggataccttggagtataaccacggccagcttggagacggcacggccgcttgcttcactccgatcccgtggcatccggcagttggcggttgaaagctgaagctcgcgggcctgtgctcgatctgagagcccacggcacggcatggagaccaccagcctgcagaacagcaacggagtcctggatcgcggagagaattcctccctgaggccggcggggaagcgtgcgccccaagccgaggtgaagtcctgggaggcccctcgcggcagggtcaatactcggatagccagtgcagcgagactgcctgcagctcctcttgaattaatggaaaccgtgttcattctaatcttggctcccaggagacggagaagaaccgtaagagggcagccttcgaggacatcacaaacgccaagaatggcggggtgagtgcggaccaaagtactcggtggaatccggcctcgatacccgcattgttcatgataagcgtctcgaagccgaccttggctgatccggacccctcccctctgtgtactgccgtccgcaggtcgaggcctcgtgtannnnnnnnnnggcctcgatacccgcattgttcatgacgagcgtctcggagctgaccttggctgatccgggcccctcccttctgcgcactgccgtccgcaggtcgaggcctcgtgtaatggacaggtggggttcgcccagtcctacaaaaacccggtctacagctcaggctcccaggtgcgtcctctcttgactcgacagcattgctgatggccatgagtggcagtagaggtgtgtttgagtcgccgcatccgcccagtccttggagcaggttgttaccgggatgtaccctccagcccaccaccccgcccctcttcctgccccaggacgccctggcccagcgcatgggctccgtcggcctggagacctcgtacacgctgccgacccaggtgtacggcggcggcccctgcgacatcgacgtccccgagctcggagaccacctggcctgcgccgaggtggccaacgacatctttgccaacctgcgcaaggcggaggtgggtgcctgcctgcttggcggatgctgcttggggcagcacgcacagagcaccccggcagctcctgtcgattgcccagtgcccggcctgtcctgaccctgggcccctgaatcctctcccacccaccccacacctcgtgccccttgcctcccacgacagacgcggcgccgcccagccaccaactacatggaggtcgtccaggccgacatcaacccgctgatgcgcagcatcctggtggactggctggtggaggtggggcaggagtaccgcatgtgctccgacacgctctacctggcggtggcctacgtggaccgctacctgtcggtgcgcgcggtgccgcgcagccagctgcagctggtgggcgtggcggccatgtgggtggcctccaagtacgaggagatctacccgccctccgtggacgactacgcgtacatcaccgaccacacctacagccgcgggcagctggcgggcgcggagcgcgacctgctggccgcgctgcgcttcgacctcacccagcccacggccaagaccttcctgcggcgctacgtcaaggccgcggctgccgagctggacctggcctacgcgtttgagccgctggcctcctacctggcggagctgagcctgctggactactcggcgctgggctacctgccctccatgctggccgcctccgccgtgctcctgggcctggtcacgctggagcaccggccctggactgccacgctggcgcactacacggggtacgcgcccaaggacctgcgccactgcgtgcaggcgctgcacgagctggcgctggccgcgcccgccagccaactccccgccacgcgcgagaagtactcctccaccaagcagatgggcgtggcgcgcatcgcgctgcccgccaccctcccggactggatcttccagtgatgccactggagcggggctgggggaggggcggaggggggctgtgtgcccccccgcgcagcgcctgcccctgtcccgtgggacggccccgtggcgcgacgcagtgccctcggggagagggctctgtggacggcatccccgcgcccaccattctgtcgagggctctgtggacggcgtccccgcgccaccactttgtcgaggcaatggccgccgccgccgccggtnnnnnnnnnngtcccgcgcccaccatgctgtcgagggctctgtggatggcgtcccagcgccatcacttggtcgaggcaatggccgccgccgccgccggtggatctggtggcgccccgccacctcgacgctgccgccatcgttcccagactccaattccccatctttcccagactccatttccccatctttccagacccccgccccgacacgcccgcccatctcagaccctccttcccaacacccactgctaggctggaacagtatgtcttctcccccctcccatatattcatcctttcttatagatagcctgtgtggtaggtaggtgtaccgtccttttcccatacacctgccccccccccccccccccccccccnnnnnnnnnncacacacgcccgccccatcccagaccctcctttcccacacccactgctaggctggaacagtacgtcttctccccccctcccatctattcatcctttgttttagatagcctgtgtggtaggtaggtacaccgtccttttcccatacacctgtccctccccccccccccccccnnnnnnnnnngggggtgttcttctgctgcggggtcgtgcgcgccgctcctccccttccgagcagggccccggcctctcccctgaactttgaatttttccatcaccaaccatccatccatccaccatgtgcccaactcgggctcccgcctgctcctcgcgggctgcgggctctggaacaagcgccgccgcagcccgcgagccgagaccgataccggcaggaaacattgtacagcagccgatggcacccctccgcccgtctcaatcctcacggggcgccttgtgtctccgtcccggcgcgagggtacgttgtaatcatggctgtcaaattctgttcaggcatgggcgcgggggtagggcactgctcgggcaatgagggggggccggttggaaaatacaatggaggagaagggcaatggcgcgtcctcgagaaaagggtccggctaggcgccaggcggcgcggcgtccgggaaggtcagggctcgcggggctgtcgagcgtgggccacagacgttcagcgccctgcgagtgcgaggatttagaatcggtcaggggtgaaaggggggttggagactgtcgttgggatgtgggtgtgcaggtcttgagacccgtctcagacatgcatggccaggtcaaaatgtgggcgactcaccctggggcaaggtggcggttgttcctccccaaccgcgccagcaccactgccaggttcgtggccgaacgcttgcgagtgcggacggggggccggggctggccggggaggctctcctcgttgctgggccggtacggggtcgtgaaattgaagtggaacaccacggcatccttgaactgcgcatggggcaggtgtatgtggggccacatgggtctttgtgaattgggaggattgcatcttccccccagtctcaagcacagaatggcacacatggacgggtcgctcatgccgagtttcagcctgttgctcattgctccatccccacacccgtgatccagcaagccttcatccactttatgaaccctcccgccatcgcaccgtcttccgtagctgggtgcagacggccatgagggggcgcagctcgtcatgcttgaggaagcaaaggatcttgagctgtaagggaacatgggagagcaggtgtgggtactgagggcattgttggacttcagaagttatgagatcgttgtgcatacacatgcgacgtgctactcctgtgcctgcttcatctgcaggtgcttgagcatggcagcatgctttcattcgtcgtactctacaacaccgctcctccagcatgaagtaacatgctcatggaggcccaccctgaggccagcaagctgccacatccgtaccactcaccaacacgtcttctggtagggacaagaacccaacaggctttccttgatgttggcagtagggctgctgatcggggttggcccggcgctgggctcgcaggtagtgcttgcgatgggcaaagagggatggcaacgttgtggccgggacgaagggcgcggcgcgctggccagcggcggaggggcccaggacgctggtcctggtgctgcagccggctgggccgctggagctggctctgccgtggccctctggcgcggccgggccgagtccgacgctggccatgctcgcccgcgcctgcatgtagttccctaggaagccgggaggcatggcccgcctcttggctgccgcctgctgaggaatccgctcctgggtctgttgagacgatgacgaggcatctgccgagctgccgctgacggcgctcttcaatgacatgtcgggggtggccgcgtgcgaggcgaggtatccttgcacgccctcacgcccatcaccgagtcggaatcgcagcggagatgcccaacgcagtccgcacaaacgagtggaagttggatttccggaggctggaccactttgcgcgtcatgttctccnnnnnnnnnnacagtccgcacaaacgagtgaaagttggttttccgggggctggaccactttgcgcgtcatgttctcccagggcgcaagcccgcaattcgaatggcgctggtatctgccgcacctaaccacccggaggttcaaatttcgaccttggtccgactagaaaggaggaatgtattgacagaatgtgtcgggaaaaaacactcttctgcgcggtgcatcagtccatctcnnnnnnnnnntgacagaatgtgtcggaaaaaaacatactcttctgcgcggtgcatcagtccatctcaacagcagcctcctgactctgccactcccccttcccctggacggagcagaccttgccgaggcgcgtgaacgggttgaaggagcagtaggtcccttgcaccagcgaaccctgcagtggcgtgtgagtgtgagcttgctgcctggctctcctgcggggggcaggcggagaagaagggccaggcccagcgagcacccccaggaaggtatgctcaccgggttcaggctgacacatgaatcgtagacgtggtgccccgccggggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgggaatcatcccagcagcgcccggcctttccaggaggtgtccgtgttcccgacggttcagcctgcatgtctggagctcctcccgtccnnnnnnnnnnccaggcggagaaaaagggccaggcccagcgagcagccccagggaggtatgctcaccgggttcaggctgacacaggaatcgtagacgtggtgccccgccggggctgagtctgccaggaagagcgcgtgtggcagcgggtacagccacagggccctgtcgtgctcccagtgtataggctgcggcgcgtggtcgagaggaggggggtggctgaaaggcaggaatcatcccagcagcgccccccctttccaggaggtgaccgtgttgccgacggtccagcctgcatgtctggagctcctcccgtccccaacctcggcatggctagccgcactccacacccacctgcaccccccccacctcatttcctcacctgcacctccaggggcactgggcagagatggctctgctgggccacgctggccacggcatgctggaaaggggtactgccgggcatggggggtaccactgcggtgccccgcagcaggcactgcaggttcgagcgcagcaccaccagctcgcagctgccatgcctcagcctgcgggcgggggtggtgatgggcatgcgagggcggcacgagatgccatgctcctcgtaagccttcccagggtcagctgctgggggaggcacgatgcgtgcaaccctnnnnnnnnnnggagctactgatatgagccagccaccaagatcagctgcaagagaacccactcccccccccaccttccactcgccccacctgcacgggttgctccccactatcgtgtttggggcggctgacagcagaccctggagcacggctcggggcaggccggggtgtggcagggcacgccccagccccacatcctcgggcccagggaccaagaccagggtggacttttcctgcagnnnnnnnnnntgcaggggtcaggtcatgcaccctagtctgaaccctcctgcctgaccctgaacaaataacccacgagctactgatacgagccagccaccaagatcagctgcacgaacacccccccaccttccacttgccccacctgcacgggttgctccccactatnnnnnnnnnncgcaggggtcaagtcacacaccccagtctgaaccctcctgcctgaccctgaacannnnnnnnnngaaagggggaaaaggggggggtgttatgcatgggcaggctctgtggagacaatcagagcgaggtactgccgagttttggcggctgggggtcgagcgtgtcgagcccggtggttcccagctggccatggtttctgagttctcctctccatcccctcgttccgtggccctnnnnnnnnnntaaagggggaaagggggggggtcatgcatgggcaggctctgtggaggcaattagagcgaggtactgccgagttttggcggctggggggcgagcgtgtcgagcccggtggctcccagcttgccatgttttctgagtcctcctctccatcccctcgttccgtggccctccacccacctggaccgcgggaaactgggccagcagccggcccaggccgtcaaacgctcgccggcactcgcccatcagcccgcccccggcgccccccgcggcacttgtcttggcagctcctccccccacgaccgccctgcgccctgcgggggacaggaagtcgccgcagaggacgatgaggctgggcgggggctggctcgaggcgtctgcctcggccagcgtcgccagcagggcctccagattcgccatggcgcaggcatcgtccagccacacgtctgagaggaggagcgtggcatcgtcagggtggctggcgtcccaggcggcggcctccttggcatccggctcgctgccaccaaaggtgaccaggccctgcagaggagtgatgaggtggtgcttggaggccgggcgcaggagcgcagaggcacgtcgggcagtgtgctggttcgaaggcagcgccccacacggtgtcagcccctctcttccttctcccacagcagccttgcctgcagtgcctcgatggaggcnnnnnnnnnnaaggggtgatgagatggtgtttggaggctgggcgcaggagcgcaaaggcttgtcgggcagtgtgctggttcgaaggcagcgtcccacacggtgtcaagcccctctcctccttctcccacaacagccttgcctgcagtgcctcgatggaggcggccctggactccggggggggcatgcccagcgccacggccttgaagcggccgctgggctggagctggccctctgccaccacgatcgagttttctgcatggtcgaggagacgggcaaaatgggcggtcggtgaggtcctcagagcaggaatgcagggagcgggagggaacatgggattcagaacacggagcaccctcacgagcctccgtttcctgggtcccaagagtcagggggttgtggcccgccagccagtaaggagcagacatttggccaaaccctccaaacccctccctcacccgtgaagagcccgggcgtgcgctctgcgtcctgtatgtcaagggggaggcgggcggagaggtcctccagcgcatactccccctcccgtggctggctgaggaagcccagcacatacttggactggcccaccagccccaggagcgccttgagctcggtcagctgtcgggttgaggaaggaggaggagggggggcatgctgagcgcccgggcaggcccgagaagaacacggcgatcctggctcgcgccgggagctccaagggctggcacgcccgcgcgtgcacaccccagcacatgctgccccccagcatgtctggaccccacccgctccgaccagcccacctcgcactcctggccctggacccccgccacacccgcccagtgcgtcggcctgaacagccggttgcgtctcaggcgctgatgcacgaggtggtatcggttcacgtacagcgcgatcttggactggggaggtgtgatgatgcacgacggtaaggctggggggaagggccctggcggccgacctggcgagcaggtccagcatcaagggcgcaccgcggcagccctgtcgcgcatgcacaacagcctcgccaggggcggggcgcaactgcaacgcaccttggcctccggaaacaagcgcggcggggcggggctggcgtgaaactgtttgcggatgggatcgtactccagcacgggcgtctggaaagcaggaatgacctgcgtcccgctggtctgggccctggcgccgtccaggcggcggacgaggcactccagggactccagggtcaggcgccgctgggcccctgtgtggagtgggaggctgtgcagcatggggcatgcaggcagccagtggcagcagtgggaggcaattcaggcgtcccagtagccagattgggaccttccttgacattgttagcaagtaggaggtagcctgaatcgtggtgcagtccctcccagaatgcatgnnnnnnnnnngatttgggactttccttgacgttgttagcaagtaagaggtagctgcaagccctgatcgtggtgcagtccctcccagaatgcatgccggacagagtggggaaccctaccagcagatgcctcgtccatgatgcggtggatgtactcctcaggatcatggagcccctgcacggcctccaccaggtatgagagggctcccggatccagctgcaggccactcgtgcgaaattgcttctgcagccagacgcgagtggcccgggactcgtcccctgaagccatggcggagctaggggacgggcaggggcgatgtttcgcctactatacgaggtatacttcaggttcctcaattgcgcacataagtttcttgtgttgacatgaagtgattggacgctacactcctgtcgacatctgctctggttggtggagcacggatgttcgaacagtgcatgcggtgcacgctgtgatcaccaagtgcgtcggccccaatcacaagcgtcagatggcgacaagaaccatgcatgttctgccgtttatggctgtgccatgacttcgttattcagtatctgtgagtgagatgcaagctgtcaagggaagaaccggagttgcgctcagggcaccgtgcacgccgaacatgccctgtatcctgagctggaaagggctgtccagcaggcaggccaggggttgaaagatgggctgaggaattgcattgaaaggcacccattcccagccttggcacttgtctggctccagatttgcaggctcgcagtcctgcaggtgcaggaggtcattgaagactgccttgtgtggcaccaggattcatgcagagagggcaccagaaacacccactcagcaactccccgccacagcagtttccctgccaagttcacctatgcaatgccaacgccaaaacaacctctgtcgcacctggggacagtcggcctccataaatatcgtcacccagtgaccccctccatctcggagcacgctgttcacagcatatgcaaatgtgaattttgttgcaacaacgcccgtctcctcttccaactgggcggtgtggcaggaagttttggattgagcgcnnnnnnnnnncttcgttgcaacaatgcccgtctcctcttccaactggacggtgtggcaggaagttttggattgagcgcaactggatgggagggtaattttcaccaaaaaccaggttgtctacatacaagacgcaacaccatcagctgctacaccagccctcattccagagggctcagcgggctcacctctcgcgcagcacaagcctcaaatgactcctggtactccagcttccccccaggcaaggcccatgtgccgctgcctgtggagcccagcctgtggaccaggaggcatgaagggcaggacgataaagggaccggaaagcagtgactcaggctcttggcatggtcaatccacactgcgccgcgcttggctaggtgcctccaactggcacctttcctcacctcttcccgacgagaatcctgccatcgcgatgcagaaggaccccgactcccactcgtggttgctcctgacccattggttgaggggctgcggggcctaggcccagtgtcgggatgtggtgcaaaattagagtcctggggcacacactgtgcacgacgacctcggcagcgactgatacgtgatcaattctgggtcactatctctttcgccagtgacgaggattgcttgcacggcctgccagggatcagccagccttgctccgatcggtccggagatgggactctgattcaccggagggaggttcgccacacggtgaccatgtatgccccaacccctgccccttccccgtcttacactccctaaggggaaagtgaactgaccttgaatttgaacgctatacatggagtccagggcagtgatgcagtgcgagctaactacaagcagcggcagaggtttgaacacaataaaaggggcagcggggatcgctacgccgccgccctgtgtggttctaggaacatggttcaaaactccgcaggtccatcctattgatgagatggaaggggcatgcgcagcgcccagtccaggatccaagcactgctttcgcacccccgctccttcaagccttccccgggtacttgaaggccgtggtccagtcgcgggcgatgggcgcccacatgaggtggtccgggcagccaaagccggcgcagagcgtgcgcgccgcggccccccggtcctcgcccaggcggcggcacaggtcgttgaccaggccgcgcagcgactcggcgcccgcccgcgtcagcaccccgcccagcgccagctcggcggcggcgccctccaggcagctcagcgcgtgcagcgcgctgagcgtgcgcagcagcggcgcggc

SEQ ID NO: 42890 - DNA, 119 bp, Chlorella protothecoides
gcgatcaagcggctgaacgagctccagctgagcggtgcacgggaggcggccccctcggggaccccccccgccttcatccccggcgaccacccgacgcccgggcaggagcagcaggggca

SEQ ID NO: 42891 - DNA, 107 bp, Chlorella protothecoides
ccaccgtcttgcacgctgggcactgccgcaatgacatcagcccatgcagaccacaatccgtgttgaggctgtgtccccttgtgtccctgtggagccccgagccatgt

SEQ ID NO: 42892 - DNA, 80 bp, Chlorella protothecoides
ggacgccacggtgttccctgtggacggcccgcgtacgcgcgaggtcatggcggcggcggggcggctggtggcggccgcgc

SEQ ID NO: 42893 - DNA, 75 bp, Chlorella protothecoides
gaagctgccacctccgccgcctgtcaagaaaccgccacctccgcggcctgtcaagaagccgccacctccatctcg

SEQ ID NO: 42894 - DNA, 63 bp, Chlorella protothecoides
ataggtgggtcccctcccaccctgtccgctaacacccttcccataatggtacccccaccaccc

SEQ ID NO: 42895 - DNA, 4439 bp, Chlorella protothecoides
  modified_base (174)..(183): a, c, t, g, unknown or other
  modified_base (1009)..(1018): a, c, t, g, unknown or other
  modified_base (1541)..(1550): a, c, t, g, unknown or other
  modified_base (2339)..(2405): a, c, t, g, unknown or other
  modified_base (3425)..(3434): a, c, t, g, unknown or other
  modified_base (4026)..(4130): a, c, t, g, unknown or other
cccccccctctgcagctggtcaaatatggcgtgatccgcgagtcggagctggagcgcgacctgacccagtggaacagcctctactgcgccggtcgcctgcagaagccggtcgcctgggtcaccgcccccccgcccgggctgcacgcggcggccgcccggaacctggccagcgcnnnnnnnnnnacgcctgcagaagccggtcgcctgggtcactgcccccccacccaggctgcgcgcggcggccgcccggaacctggccagcgccctgctggtctgccgcctcctcctgccgcccacctttggccagcccgacctgctgcatgcactgtgcgcgctgagctaccgcggcgacgtgcgcatgggctgggccgaggacggggccaagctggagcgcctcgtggcggggcaggggccggcgctgggcaggctgtacgcgccggcgctgcggcgagccatagaagaggagggcacgctgcgtgcgctgggccctggggtctggaccagcgagcggtgcgagcccctgggcgcccgccacctccaggccctgccagaggtcagggggcccggccggagggcggggggaggaatgatcatgcgtgcccttttgactgcatatgggctgtgtcgggccaatgctcgccagatggaattatggcatgcacacgggctgtggcgtggcaaacttgggtctcagtgctaataattcaaagcgtggacattcctctccacttcacatcgagactacaagctggggcactcatcaggtgcaccccccttccgtcatcgcaggcactcctgcagcgcctgcaggcggcggcggcaggccaccccagcccgcaagaaactgcggcccagctggcgaggcagctggaatccgcccctcaccttgccaggcacagcgtgcagagcgccctggccagcatcgtgcgggcctccagcctccgacagacggccctgggcctcttgagcgggggggtggtcaagtcggcgcggtatggactggccaaannnnnnnnnnccagacagcccttggcctcttgagcgggggggtcgtcaagtcggcgcggtatggactggccaaagtcagcaaggcatgggccagacggcaggccctgtgagagcgcggttgatgatggagggcctggctggggaggccttcactcttaggccccgccccagcccttgcccttaggcacctggtggacctggggcgccgggccgccgcctccgggcctctgttgaatgccggctgggttgaggcaacgtcgcacatccccacggcgttgtaaacgcctggagcaaccgccaattttctgtgcaaagctagcaggggcagtccaacggcacacgcctagtgtggggctcgtgtgttcataggttggagtattccagggaaaactcgggacagctctcttgcgagaggatgccacgtagccgctgctcctcccgagcttcttctgctcatcgtctgccatccctcaatcgcacgccattgaggaattcagtgcgggacaagaggccaggcactgtgggacaaaagnnnnnnnnnnactgccccttccgagtttcctctgctcatcgtctgccatccctcaaccgcacgccattgaggaattcagtgcgtgacaagaggccaggcactgtgggacaaaaggggccaaggacgatttaggcaagcaccacggcgcagctcccaggcctgagcaggtggcatgtgcgcgacagcccagcatcgacatgagcaagcatccctagccctaaccctctcccttcacctagtattgcccgcctgaccctgctcaccatccatcagcgcctgcatgacctcgtctgtgaaacctgggtttccttggatgtccaggcattccagctggtgtcgagggagctctggggtttggtggatcagtgatcacgcgtgatttgtgaatcgctgggctggagtgcaggactcaatgtgtttgcagagcgttgctgggcctcgagcacttgtcaaggtgaaccgcatactgcacaaactcaccactcagcatgagtagctccctctctggcagctcattgtggtccaggtacaggaacctcacattgcacagcagctccaggccctggaggctgcgcagagcgccattgctggcatacaatttggtgacgccggcccaaagctctggggaacctcccagctcagaaaggctgtgggcctgcgccccattgaggtccaggtagtggacgggctccgacacatgactgagtacccccccgggaagtcctgcagggtcgacctattgggaaatgatgagatcctcctgtccaccgaacgcgggcatatgcatgcgatccgttcnnnnnnnnnnnnnnnnnnnnnnnnnnnnnnnnnnnnnnnnnnnnnnnnnnnnnnnnnnnnnnnnnnnaggtcccggacctgacctggggcagaccccgcggcagcttggtcgaccccgtctgcacatcgcggacgaattctggccagccagacatgtccacggcgccgtcggcgcgactccagggggcccggggagagcccgagacggttcttgcccggcaaggcctcccagctgcgccgttctgattcaagcaaactacgttcgagctggcttatacttgcatgtttgcatcatgatctgagccattgtgatgtcctagtaatgggcttgacccataagtgggtcacaggcgggggagcacgcatcatatggcgattcaaacgccccctcccactcggtataccttgccccggcgccacgccctccccgccccgacacggccgtccaagtacggtctggtaaccctaagttcacagtgatcgcccgtaccctgaggcgttcatcccccccccacgccgggctttctacaggggtcttccccggctgcgcccaagcaaaccccgaagtggggagggaggggccgggtgccgggttgggggcggatccccccctccccggcgctgcctgcaccaggggtagcagagcttggggtcggtcctgcgtggcctcaccctatgaatggtttgtccatgccctctgctcgttccggtatggtcggcaagacacatgccccaatcttttggctttgcaattgggtacaagcacacatgtacacaaatagtacagcagcagcagggagcgacagcagacagggcatgcccagccgctgggagtacaaggagagggtctttcaaaggaactctgcgggcgtggaagggaaaagtgctcggcaacgcgccgggcacggcaatggcaaaggtaggggcgtaaagagcaggcactgcactggaccatgcgacagggtgtgtttggtatgattcggtaggaacgatcaggagcttggcagggcttctagcaagttgatggttggatggaggggtgtctgagcacaccgctcaagggcgctggccaggggtctatggaggnnnnnnnnnnccggcaacgcgccgggcacggcaatggtaaaggtaggggcgtgaagagcaggcactgcactagaccaagcgacagggtgtgtttggtatgactcggttggaacgatcaggagcttgacggggcttcgagcaagttgatggttggatggaggggtgtttgagcacaccgttcaagggcgctggccaggggtctatggaggccgagcctgccagctcgatggcgccaagcccctgccggcggctcgcgtagggtgctcctgcccccgccggcgccggggcgcctcgccgcctgccttcccaacccagcctccccccccttccaaagcggcgcctcacgcctccaggatgaccggcatcttggagcgcgacccgctgctccccagcgcggcgtccagcgccacgtccggggtgcagggcgaggcgtcccgcccctgctcccaggcgccgccgctgggcgcgatgtcgcgcggcgagctcgtgcccggcgccgccagctggggcgagggcgcgggctccaacgtcagcgtgcccgactggcgccggacgacgcgcacaggcctcaggcccgccagcggcggcgaggagggtccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccccccgccggcctcctgcagcgagtcctggcgaccgaagtgcacgcgcgggttgtcgcgcgacgactcgcgcgccaccagcagggccagcccctccgactcctcgtcgccgtgcgcgccagggcccgatagcgggctacccacgcgcactgaggggtcctgcgacccgggtggcgtgccctcgccgatggagctggaggcgctgcgctcaagcggggagccccgcgcgacgccggcgcgcgccccggcgcgcgcggcgcccacgtgcacgctggggttgctggcgctgggcgagggcggcggcgg

SEQ ID NO: 42896 - DNA, 61 bp, Chlorella protothecoides
catcaccattgacttcagatgccagccaccaccagatccctcccaattccccaccacaaat

SEQ ID NO: 42897 - DNA, 64 bp, Chlorella protothecoides
tgacttcctccgcatcccccgtgtctcagtataccccccctccacacagagacacgcccagaac

SEQ ID NO: 42898 - DNA, 61 bp, Chlorella protothecoides
cgacctcccggcactgaggccccgccgcccgcctcagccggtcaccagcaggtccagcccc

SEQ ID NO: 42899 - DNA, 22878 bp, Chlorella protothecoides
  modified_base (1963)..(1972): a, c, t, g, unknown or other
  modified_base (2658)..(2667): a, c, t, g, unknown or other
  modified_base (3162)..(3171): a, c, t, g, unknown or other
  modified_base (4503)..(4512): a, c, t, g, unknown or other
  modified_base (4710)..(4801): a, c, t, g, unknown or other
  modified_base (5165)..(5174): a, c, t, g, unknown or other
  modified_base (5459)..(5468): a, c, t, g, unknown or other
  modified_base (5839)..(5848): a, c, t, g, unknown or other
  modified_base (6142)..(6151): a, c, t, g, unknown or other
  modified_base (7114)..(7123): a, c, t, g, unknown or other
  modified_base (8243)..(8314): a, c, t, g, unknown or other
  modified_base (8981)..(8990): a, c, t, g, unknown or other
  modified_base (9093)..(9102): a, c, t, g, unknown or other
  modified_base (10754)..(10763): a, c, t, g, unknown or other
  modified_base (11420)..(11429): a, c, t, g, unknown or other
  modified_base (12002)..(12011): a, c, t, g, unknown or other
  modified_base (12440)..(12449): a, c, t, g, unknown or other
  modified_base (12876)..(12885): a, c, t, g, unknown or other
  modified_base (12956)..(12965): a, c, t, g, unknown or other
  modified_base (14461)..(14470): a, c, t, g, unknown or other
  modified_base (16018)..(16027): a, c, t, g, unknown or other
  modified_base (16751)..(16760): a, c, t, g, unknown or other
  modified_base (17172)..(17181): a, c, t, g, unknown or other
  modified_base (19049)..(19058): a, c, t, g, unknown or other
  modified_base (19176)..(19185): a, c, t, g, unknown or other
  modified_base (19247)..(19256): a, c, t, g, unknown or other
  modified_base (20686)..(20695): a, c, t, g, unknown or other
  modified_base (20874)..(20895): a, c, t, g, unknown or other
  modified_base (21220)..(21229): a, c, t, g, unknown or other
  modified_base (21567)..(21576): a, c, t, g, unknown or other
  modified_base (21993)..(22002): a, c, t, g, unknown or other
  modified_base (22359)..(22372): a, c, t, g, unknown or other
  modified_base (22458)..(22467): a, c, t, g, unknown or other
ccctcgccgccgctcgcagaggagacggacggcgagatggagctgcgcgcggcgctggtggccaaggccgagtacctggccgacacgggggacgcggccggcgcggccgccgccttcgacgccgcggagcggaagacggcgggggcgggccccaagctggacctcgtcctggcccgggccaggctggagctggggctcgaactgagggcggagctgcggcggacgctggaccgggcacgcgcgctgagcgcggcggggggcgactgggagcgccggaacaagctcaaggtgtacgaggccgtggaggccatggccacgcgcagattcgacgtggcggccaagctcctgctcgactgcatcgccaccttctctgcgtgagtgggcacgtggtggggcactgcttgattggtaggctcgtgggtggggtcaggatgcactcagcgtggggtgcgggcaccctacatacacacacattgggggttgcgggcacgctggtgggccgaggggtgatgcaaggcagtctggggtgggcagggcaccggctcgtggatttgagggccgaagcaaggggagcgcaggccactcccctgcacgtgcccgctctcgccatgccctgcggctgatgtgctgctggcctcgccatgcacatgggcgtccggatgcattccctccccccagcagcggggctcttcgctccgccccccctcccatcctcaaaccccgacgggcgcccccccccctcctccccccaggacggaggtgatgagctacgagcagtgcgtcttctacaccgtcctcaccgccgtgctcaccctggaccggcccagcctgaaggccaaggtgtgtgtgtgtgggagggggtgtggtgcgcttgatccagggagtacccgttccagggcggagcattggcgccccgcccaggtcatgtggctcagcgggcttgccgtggtatgcatgctcctggccatcctgtcgcacacacgtggacactcccccagtgcaggtctctctcaccgcagccctatgccctgttcctccccctccctgtgtgcaggtcatctcctcccccgaggtcctgtctgtaatcgacaccatcccgcacctgagctccttcctcaatgccctgcacgactgcaagtatgccgaattcttccgggtacgtgatggaggatagtacggaaggaagcaggggcggacggagggcattgctctgagcagtggggagtgcacacctgcagctcatcgcaggcacaggcacagtcctgggagggggagcaatgcctcctggtggcttggcagcatgcatcatccctcccgtaccacctcgaaccgcttccctcgcaggcgttctcggggctgctggaatcggtccgcaccgacccgtacctgcaccctcactaccgcttcttcatgcgcgaggtccgggccaaggcctacagccaggtatggagatggagggggagcgggagtccagggcggtgcagtcattgcggctgctggcggggcatgctcagcagtgcatgcctgccatgctcagggggctgttttggggttgcttctaggtgcccaatgcaggtgggcgagccatgaggctcctcctctcccccatcttggcccgtgaggctccccccttgtgaacccacattccattctaccccacccctcccgccggcagttcctggagtcctacaagtcggtgaccctggacagcatggcgcgtgcctttggagtttcgtcagagttcatcgacgaggagctggcaaacttcattgtgaggggccaggtggcggcccgcatcgaccgcgtcgctggcgtcgtgcagaccacacggtgaggcgaagggggcctcatctggagcgccgctcatggatgggggggcttgggtttgggatgttggggtgcagtgcttccagaggtggtgctcaagacaccaaggagcaccccactcacgattgcattttcnnnnnnnnnntatctggagcggtgcacatgtatgggggggcttgggtttgggatgttggggtgcagtgggtccagaggtggtgctcaagaatcaaaggagcaccccactcacgattgcattttcactgaggtgctgtgcccactaccccccatgcaacagacccctctttgccctccgccccactccacgcaggccggatgccaagaatggactgtaccagcagaccatcaagcgtggcgacgctgtgctgagccgcatgcagaacctgagcaagatcatcgatgtggactaggagagggggcattgggggcgtcctggggatacctctgctggcaaagaggctggagaggagcggtggggcgccagcaaccatccttgctgcctcgcctgacccccaggcccactgctgcctgactgccatggcctccaccatgtgcatgctgaacaggtgtacatgcttgcacgggcgggcaagattgggcaagccagggatgaggctgaagtgggacaggtggtatgacgaggttgtgacgggcagtgaacagcggcgaagggctgcacccatactcaggtgttaatgcatacagggtacacacagagctgcctgacgagaagaatggggccacagattgcatgctccctctgcaaggagcacggattgccgagagggtcctgtaatggggacgtcgtgggcnnnnnnnnnngcacacagagctgccctgacaagaagaatggggccacagattgcatgctccgactgcaaggagcacggattgccaagagggtcctgtaatggggacgtcgtgggccgacgacatactcgcaacctgctgggcaggcaggccggtccaggccagcgctctgcgcctgcctgcctgcctttcatttgagcagatcttcagggtaaactatggcagcttgcgggcagcattcccacggctggcagaccgtggtgtcggtatgccacccagccagtgcagcccacatcggccgtcagcgggcggccgccacgcctgcggccccaatcacaaagccggcgccggcggcgggcggggcatggctggagcccagcaacgctgcctcgtgcctccggcaccccggcacggcgacgcctccgcagcgccctgcatcccccaggcgcaggcgcaggcgcaggcgggcgtgcggtgccgcgcgccacgcctcgctcagcgctggcnnnnnnnnnnagcaccccggcacggccacgcccccgcagcgccctgcatccccgaggcgcaggcgcaggcgggcgtgcggcgccgcgcgccacgcctcgctcagcgctggccggccgcctccccccccgccgcccgaccccacccagccgttggcggcgaggacgggaacgcgccgcgcggcggccagcgccctcagcgccgccgccagccgggccaggagcgcaggcccttgggcctggcgggccacgcccagcagcggccccgcgatgcccggcagcgcatccagcacgaccaggcccagccgagggttctgcggcggcagcggcttgatcgccgccgcgatggcgtcgccgctggcgaggaggccgccgaggacgtccagcacagcgtgcacgtcgcgcgccggggccaccaccacccggtccagtgccgcctccagctgggcgtggtcggcctgcaggggcgggcgcagcgcgcacaggacgtcgatcagccgagccgcggagaagctggcaccggtgtcgatccaggcgacgcgctccccgcgcaggagggtctgcgccgcggcggtcaggcacagctgggtcttgccggaggctgcgtgggagggttgggggaaagggatgctggctcgaggccggccggcaggtgcccatgctggaaaccatgtgtcaagcgtgagcactcacaccactgcatggcctcacctggctcgccgcatatctcgatgaggtggccttcccgtagaccgccgcggaggagctcggcgtcgatgctgtggaacagggaggggaggggcgagccatcggcgatgcaggtcatgtgatgccgggcccgctcccatcaatgagcccatgtcttgctggatgtccagcaccgtacgccaccgaccacctgctgcaccccgtcggaagcaggcgactcgctcggagctccgcgaaaaggtctgtgccggtgcgcaaggtcatttcggcgatgaaataagtcgattactcagtgaacgggagaaccacatcccagcatacccagctgtcacctctggcgttgaaagtgagtgttggccacctggatgccggagaatcagctgcatgccggggcacacccagctaaccatgcctcacaacagattggatcatcttgaacccttcttattttcattcagatctgcgaataagtcgcgtacggtgcgcaactggcgtattctacaagtgggtacccgtgtactctacttgccagcttcctgcgagccgggtcaaggtcatccctaggtttcctttgcttccagaacatagaccgggaagtccaaaccgtgattggactcagtatgggcgcatgcgccannnnnnnnnncgcttccagaacatagaccgggagccccaaaccttgattggactcagtatgggcgcatgcgccagcagccctgcagagatagcagagaagcaggagccgggtgcccagcactgtgcagaagctcccgtggaacaggtgtgtcgggctggacgggcagccctgaatgtttcaccgtccggcagtcgcgaccctgacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagcctggaacgactgaagtggacgaaagatgagaagcagtggtgtcacaggtcatgtctcgaaaaatcagagcaggattatcagcagtatatagtcgtgagtagtgctgcgagctctcaccgtccactccctgcacccccacctgtctggcatgtggtcaccctcaagaacctggatccccttggcacaaagctgcgtgttgaacagatgcacccagcaaaacgtgcaaatcccccacacgcatcggcaggagcggtatcatttttccaaggcgaagcaggctctgttcccccgtcttaaagggaacatgtcggacttaaagcccatcttatcccagaggagctggagagacacgctgtcnnnnnnnnnntgaacatctcggatttgaagcccatcgcatcccagaggagctggagagacacgctgtcctttcagctggtgccatccaggtgagttggccttggggggatgcccaggaaaccctgtggacattcaaggagagcccaggagggccgaatctccctggtggcgtcgaggcagccacatgcgttgtgtatggccggccacggggaggagtcggtggcgccataccttttgagaggagcactgcctggattggctttaatgggacactgcctcggcagacggcaggtcnnnnnnnnnncgtgtatggccggccacggggaggggtcggtggcgccatacctcctgagaggagcactgcccggattggctttgatgggacactgcctcggcagacggcaggtcagccgctccatgcgcgctcacctcactcgccgctgccctcatgcccccaccacagcatcccaagactcagctacccagagggagccaagtgctagagctgctggttccccatgactgctcctcctggcgcgagggtggcatgcatgcggctcaacctccctgttcaagaaggagccctccccacacagtgtttccaagaccttttattacttaatgaatcccctgtgacgaatttgtcttatcgtcacattgtctgccggccctgcnnnnnnnnnnctaatgaagcccctgtgacgagtttatcttatcgtcacattgtctgccggccctgccaacacacaaacccccgtgcatgtaatgctaaacctgacaccacacgcaagcaggaggggcaaggtcgggcgcctgcctggtctgagccaccacagcctcctctcacccagcctccatgcccaccattttcgccctccggtaccgccactccaagtgggcgacctccttggcgaactgcagtcccgaggggtgggcgagggtgggggttggggtcgctgcatggcatgcaagcccttnnnnnnnnnntcctccatgcccaccattttcgccgtcaggtaccgccgctccaagtgggcgacctccttggcaaactgcagtcccgaggggtgggcgagggtgaggtttggggtcgctgcatggcatgcaagcccttgcccccttttcattccatacaacatccaggcagccccacccatcctgcaaccacacacatcctctctgtgccccgtgccctgcctgctgagcgccggggcctggctccatacgctccagccgctgcgccgcccggaacaggtcctgcctgagctccttgatcgggcgcggaacctcgccaggccccagcgctgcaggcggcgctgcaggcggcggcatccaggtgttggaaccacaatgtcccgacggccgcctggagatttcttcctcgagttccagggcatcagccaactcatggagtcccttgcctccagggccgatcaagcgtccagcacccaccgcgcccgcggcgtctggctggccgtgcggcgaggggatggcgtggtcgaggtgcaggtgtcccatcacctcgtaacccggccgcagcggcgcgtctggctggccaccgcagcgtctggcaggtcccatccccgccccagggttcttgatcttgccccagccggggggaggccatggaccccgaagtctcaggctgggtctgatctcctgttccccagggaagcggccgtgacccaaccccaacctcgggccaatgaggaaggtgggcgccggggccgcatcggtggcctcggctgcggcctttggaggccatctcggggcagactgccgcgtgctcacttccgctggcgctctatttgaggcaggttgctgcttcgtgtcggcggagaccggcggcccgccggacgctgcgttccctctgacgccggactgtgggagcccaaacgggatggaccgcaccgcagaaatcgcctctggagccacgctggagctcttgtnnnnnnnnnngggccgggcaccgcagcgtctggcaggtcccaggagcagccccgccccagggttcttgatcttgccccggctggccgggggccatgcctcccgaattctcaggctgggtctgatctcctgttccccagggaagtggccatgaccaaactccaacttcgggccagtgacgacggtgggcgcccgggccgcatcggtggcctcggctgcggcctctggaggccatctcggggcaggctgccgcgtgctcacttccgctggcgctctgtttgaggcaggttgctgtttcgtgtcggcggagaccggcggcccgctggacgctgcgttctctctgacgccggactgtggaagcccaaatgggatggaccgcaccgcagaagtcgcctctggagccacgctggagctcttgtcttctgtgcttgcatccgtaagggccccgctcggaggtgcatgccgcgccagggcggcctctgcctgcgcgacctccgcctcgagctcggccacccgccttcgcacccgggcccccccatccgccagcccgctcagcaatgccgcgttggtgagcagctggcgctgcttcgcgagggcctgcctcagcccggccagggccaccgccgcggcctcggccgcggagctctccgcccggcgcggcggctggaacggtgcccggctctcgcccgacccgcggtgcaggtccatcgccctcgcaaacttctcgctcagctcaccctcacccacccagcctgggaccagggcgcttgtgaagaggtgggggaggaattctccagcggagcccttcacccgacaaaactggcgacagcagatgcaccgggttgctcaggcccctggcatgagctgccaaaccagaggcatgcagacggcatgcatgcctgaatctcctttttcaaccatctcccccctcatcgcaccctttgctgcagccttcttggtggcggagccacccgccctgcccttgatggaggctggggcggaaacggtgcccgggggtgcggcggcggctttacggtagtcctcctccacgcgctgagtcagcttcaccgggttggcctccttctcggtgtacagcaggtcgtggtcggacacgcctgggtagaatggggannnnnnnnnnnnnnnnnnnnnnnnnnnnnnnnnnnnnnnnnnnnnnnnnnnnnnnnnnnnnnnnnnnnnnnngtgggctggctgggtgatggctgtcctccgtagagtggagtcacgtagcgcctggacccctcccagcctcgtggctttgcttgccccccgaccaagccttacgacattcttcatctctccctgccctgtgacccccaccccatcaccctcacagtcacaatacctgcaaaccccgccagggtctccaggaactgcaggtgctccgacagctggggggtgagccgcctctggccggcgtgcatctcgttgaggatgcgcagggtgggagaggcatgcacctccgccaggtccagcttcaacaggtctcggagctcctgcaggggttggggtggggcatcgcagtggtacgcaagggccacgtaggcggtacatgggctcaatccccaccacaacaacctggcagccctgctgcagcgcttcaacccaagcaatgtcagctctacccaatgcatcaacccacctgctgggcaaagtacttgtgctgctcgccatcctcggtgcccgtcctcgacaggccggccttgaacacctgagggatgcgtcgcaaggggccagtgtgtggccaggcgttgaagcacagcgcagtgcaccatgtcaaatgcgcccatgcccagcccctagcttgctctctgggggcagggcaccccaaaaagggtagtctcttccnnnnnnnnnngtgtcaaatgcgcccatgcccagcccctggcttgctctctgggggcagggcaccccagaaagggtagtctcttccaccccccccccccccccccccccccccnnnnnnnnnnccagagtaccgcaggagatgaggcggtacacaaccacgtcccgctgctggccgatgcggtaggcccggtccactgcctggttgtctaccgccgggttccaggcaggatccactctgagggaagcggtgtggtctgtctaatgagcctagctgcggggctgtgcaagtgggcacaacaggtcggtgttctggggctcttccaccccccaccccacccctctatacttcttggtctcccatcctacccaggcacgcacatgatcacccggtcggcagcggtcagggtgaggcccagcccccccaccgcgctggaaagcaggaatacgaggatgtctgggcaggtttggaaggcatgcacgcgcgccgcacgctcatccacgctggccacctggccgtcgatgcgcaccatgcgcacgccctcctttcttatggccgtctccaggatggtgagcctgtggaggggggcgcgcgatacgatgggactgtttggcaaaagtaccctcaaacagtcaagcagcggcagcctgggccaggttcggagggcgggcaccggatgcctcgttgccacagggtcgctgcggtgggtcagccggggacctgcatgccagggcacagccgacctggcggcatgccaagccacttcttcgacctggcggcatgccaagccacttcttcgacctggcctctgccggacccttctcgcccgtccccttgcccaaactctaccccacaacctatcactccctctcctcacatcttggtggactgcgagaagaccagggtcttgtggcctgagcctacgagatgcctcaggaggcccagcacaaactcggtcttgcaggaggccaggaacgtgctctcgtccactgcagccagcaggcggcgcaggccctcctcctccctggcgcccagccacgtcgggcagtcctctgtcagcgccgcgacttcctcactggtttccacatctgcatcggccgcctgcccggcttcatctgtcgctgacgcggccatcatctcccgctgtgctcgttccgagaccagcgccgggtggtcacagatcttcttcagcacggtgagggcgcctagggcagagcgagagctgtttagcaccgacttgatcaggggggagctgaggaaggcctggggagggatgaggtggggtggcggtggggtgagggagatgctgagcaggcatcgtgttgtctgctgtttgatcccagagcacaccccgccatggttgaaggggattgatgcagggcatggagggccaaggccctccccccccctcttacccagccacccacacacctggtacaggcttagctggagaggcttcagctgcagccatatgataaagtcagacttgtgtgtccattggggaagggcacgctctgtctcggcaggaatggttgctgcccccggcgcagcgttctccccctctttggccgcatgcatcgccctgtcagtcagggacaggaggcactgagaccatggtgtgcatgccatggtaattcattggtccgtcggctatgcatggaccgttgcccttctgattcaactgcgagcgccagcaggggcatgaatctgcaactgggctgccttggcccctccacctttcggcgaaccaatcaaccatcacctcaaggaatacannnnnnnnnngattcactggttcgtcggccatgcatggatcgttgcccttctgatgcaactgcgagcgccagcaggggcatgaatctgcaacaaagctgccttggcccctccacctttcggcaaaccaatcaaccatcacctcaaggaatacaatccacactacacaccccttctccctgcgcagcatgtacggcgcgatgcgagtgcgcagctgcgcagcagctgctgcgcctcgctccctggcctcctggcgggggcaaggggagaaagacgaggatccaggcaaatcctgacacagcccggcatgcatccttactcactggcaccactcatcgcaagacacactaagacaacgcatcaggtccgtaccggcatggcagatctgtcgttcccagccagaatccacttctcatacacgtccttgaagcttttggcatcccccaacaggtcctgcgagtgcggggttatcagggtctgggtgtgtggcaagcggggcagggaggccaggtgatatgccatagtacacaagagtgcatgcatgcgtctcctcggccccataggcccagcgcgtcggtagacggtggcgagcaacaagccgcctcacccgggtggtgaagtcaaagagcgcccacagatccctcagattattctttcaggtggggagtnnnnnnnnnnctgcatccttacccactggcaccactcatcgcaagacacaccaagacaaagcatcaggtccgtaccggcatggcagatctgtcgttcccagccagaatccacttctcatacacgtccttgaagctgttggcattccccaacaggtcctgtgagtgcggggtatcagggctgggtgtgtggcaaacggggcagggaggccatatgataggccacagtacacaagagtgcatgcacgcgtctcctcggccccgtaagcccagcgcgtcggcagacggtggcaagcaacaagccgcctcaccggggtggtgaagtcaaagagcgcccacagctccctcagattattctttcaggtggggagtgcagatgggagtgttttggagctgacgcaacctgccgttgccgagagtctacaaggcacgtcaagaaccatgcaatgggtaatgcagcgtcttgcctccccctccacctgaatgggagtgccggtgatgacaagtcgggaccgagccgggatgtgatcacacttctgacgcagctcggtctttggattcttcagcttgtggccctgcccacagnnnnnnnnnnctccacctgaatgggagtgccgctgatgacaactcgggaccgagccgggatgtaatcacacttgtgacgcagctcggtcttgggattcttcagcttgtggccctgcccacagggagtgagtggcaggggtggggtgtttgtgtgtgggggggttcttctgtcagtcagcacttgaatgctagtcacacagagagcctcccagagctgccatggcacctctgcacactactgaaacgcatcccccaagggccgggcatccctggccctccccaggccccccctccaaccctcctcccatccctgtcagcctgttccacctcgtcaagaatcatgaggtcccacagggcaccctcatcggcgtcgtgagaggggtgggaggccagggagagaaaattgttctgcagcatgccgtaggtcgtgagcaggatnnnnnnnnnnggaggggtgggaggccagggagggtgcattgtgctgcagcatgccgtaggtcgtgagcaggatgccgcagcccccggccgtgcttttcagcgcccgcgtctgggcgccggggctggtgcccgtcacgaactcgtgggtgcgctgcgagaggccgcaaacctgcaactcccccttccagtgggccagcagggtcttgggcgccaccaccagagcgcgcctgagcaggcccgactccagcatgcccgccaagaaggcgcagcactgcatcgtctgcgtttgcggcgatcattcggagagagcgggggtaggtaaagcatcgatgaaggcagcgctgtgatgatgtctggcgtctgggcctctcgagtcgcaggtccggcttggccatcaggcggtacaatgtcatgccctctccgtactcttaccttgnnnnnnnnnnaagggcgcgcctgagcaggcccgactccagcaagcccgctaagaaggcgcagcactgcatcgtctgcgttnnnnnnnnnnaggtcgcagacccggcttggccaccaggcggtactatgtcatgccctctccgtactcttaccttgcccaggcccatgtcatctgcaaggatcccccccgtcttgagctggtacagccgccacagccagctcacgccctcccgctggtaagggtacagcttggaggccaggtcacccctatgccgggatgggtggggagggacacaaggaggagtggaggttcaggcaggcacatctgccgtgccgtgcagcagtcagaacacctgtagtctccagggctatcccacctgagcttaaaactcccgaggacaagggagccgtcgccgcttggcggggctggggcctgcgcagctgggaccacaagggtggtaggagcggcaggtatgtctgcagtggccaagcatgcatgcgttggggctgccgccctgcgttccacaggcgactcaggcatgcactgtctggtcgtcgggctgtcagccctgagtggtgtcctgccagggtccggctggcctgctggcgccagcgttagtctgtccagtgcgctgaccaggtcgggggtttcgctgtttgtggtccttgtggtcgtggcagggtcgctcgcgagagggctgctggaaccgggcatccccgctctatcatcaccaggagccccagctgtggcaatggcgcccgctgcagcgtcaggacctgagcaaggcctgctggacaccgtctcctcatcgccactggaaggttgtgggttcccctcctgcccacctccacccaggccgctgtcaggcaccgatcgagcgctcacaaagctctcctcttctcctgatgaatcagagtcatgtatcactcgacctgccgatgtgcgagccgcccttgcatccctctgcttccggtactcgagcagatgctcctgcaccgtccggcggtcgtcactgacccccctccgcgacatgggcgccgggaagtgtaatttgcgtttgtagaatatacctttgtgaatgcatgagggctgggaggctgtggtgatcagaagcttgctgaagatgcttcgagtctcgcatctcgccccccgccgctttcgaaaaatgcccgatctgcaaatcgcgcgcgcgcgggtactcattgtacggggttgagcacctgggggaagccgtgctatatggctggagtcatggtcaaaacatatctgtgcttcacagcaccaaccaatccaagcatcacacaagacatgcatcactggctggcagaccgagatcgccgccgtcgtttgctcctgctgcccttctcgtgcctgtccaccttgctagacttgtggtgcttggagcgcttctccttgctgcagtggtcgggacgggagggagtggttggctgggctgggtgtcttgaagggggtatgctttgcgtgtgggatactggggacacagagtgcatgcgactgaacaaggtccgtccccttgctcggcccttggcgccctaatctcgaaggcctctcctctcaggagctcnnnnnnnnnncactggacaaggttcgtccccttgctcggcccttagcgccccaatctcgaaggcctctcctctcaggagctcaaacgcccactgagtgccaccacaggtcacgtgcctggtctgccaggacgacaacactaccttctcccatccctcctgccaacacatcgcctcacctccgcttattctctttgcgctcccgcttccccaggctcttcagggtgctttccacgcgctgacgcagggccgggtccaggccgtggatgccgcccgcggcaggcgcagggtcctcggccagcctcgggcccgcagaatcctccgcacctgctccacgaacactccctcgctcgctgcgcagcttggaaaagccaaagtccgcctgcggctccctcctctcagaagccccgccgcttggatgagcatccctgccctggtccacgcttctctccagcaccacagaggcatctcctccgccccccccagcctctaggccgccaggctttctcgctccctcctccatttcctcttcttcctcctcctcgtcgtcttcaaaaatggccttgaagaggtccatggggggtgcgggcggcagcgggggcagctcctccggctccgccgcctggccaagcaggtcggccaggaatcgctcggcggccagctcagcatcggcggcggcgtctccgaccgcggtcgcctcggccgcgccgccacggggcgcgggcggcgccagcagctcggcggcccccgggcccagcttcgcggcggcctgtgcgacggccgcggcggccgtgtcgggcagggccaggaagtcggtcttgaagcgggacggctccacctcgcgcggccggccgtggaacgggtccggcacgttgaagcgcttgcagagcagggccgccggacgccactccttgctgcggcgaatggggagccgtggcgccgcgcctggggcctgcttgtcttcgccgccaaacccacctgccctgctcaggtcggcggcggtcacgatgtgccccgcggcccggggaactgcgccgacaggcgcgggcgccgggccgagggccgcggggggcggtccctgctgcgatcccggcggccgttcgggccgcgctccggggcggaggccagcgggaacctccgaggccccggcgtcgccgcactcggcgctcccgctcacgaagctgcgggacagcatccccgcgagccgcagccggtcggcggccgcgacgctgagcagcacgtcccgacgcggtgctggggggccacctcttgaagactctgcgcctgagactgccgctgtgtcgacggctccaggctgcgacggcaacggggtctcgcccagcgcccgcccgcgctcctccgccgacgtgaaggcggctttgcgctcgggggccgccggcgggccggcggaggggccctggtcccttccagtctgcccgggcgccatcagctcacgcagcgtgtgcacctgttgaagcgattgcttcggggcgggtcagtaaacttctgttgcacatcactggatggaatggctcacaagcgagtggtgccggacagcgnnnnnnnnnnacgggttgggaaacttctgctgcacgtcactgaatggactggctcacaagcgagtggtgccggacagcgggccccctgccccatgcaagtccacagactgatgctgcggtgcacgggatgcccacatgatggcgcttgttggaggcatctgtgctgtcgaacctctcccccctacaaccgtccgcccaccttccaggcgtagtatgcagagccgggcccgcctagcaggaaagaatgcccagcgccgttctggacctgcgtgctccgcgccaggtcctcgctcgccccaccgctgcgcgccacatagaacgccaggctgtcgatggcctggcgcagggcagggtcagagggcgggacgacgcgcgcgaggagggcgggggttgcctgccggctgggaagcggggcgcttgcgcctgtggaggtggtgtgtggcgaggggggattggaaggtgctggggccctcggcctgtgaatcgaagccaggtgcggagcacagccatggcagaccccaccgcagccgcgggcatgcaccagaggcctccccacctggcggctttgcccgccgacgcggggaaacccagtccctgggaataactggggctggaaaggagggcgtcacagtcgagcgcctggccctgctgaagcccgggatgaaggaggcatgagccaggtgttcctgcaggaaggaagggtgattgtactgctggagacagcatggatgagnnnnnnnnnntctgtgaatacaaatcgaagccaggtgcgaagcacagccatggcagaccccaccgcagccgcgggcatgcaccagaggcctccccacctggcggctttgcccgccgacgcagagaaacccagtccctgggaatgactggggctggaaaggagggcgtcaccgtcgagcgcctggccctgctgaaacccgggatgaaggaggcacgagccaggtgttcctgcaggaaggaagggggattgtactgctggagacagcatggacgagcacccaaatgagctgaactttgtcagggtccacaggaccaaggctggatcccgccattgaggatgagctctgccccttgttagcagcccagaaagggatgtcctcctcctccgtccacaaggaaaatagtctgccacatgtctccaannnnnnnnnnttggatcccgccattgaggataagctctgccccttgttagcagcccagaacgggacgtcctccacctccatccgcaaggaaaatagtctgccacatgtctccaaaccgcgcacgccggaccctgcagggagctagacctccccgctcaccctgctcttgatggccgccggcgccggccgcccagtcagcatggccggtccgcgagctccagtcagtgcaaggaggggggctcttccctcctcctcgtcctcgtcctcctcctcctcctacagtggggggggatgaggggggcagggatggtgcgccgacttctcactcgagaaccgaaaggcagcctggtcatccatgtgctaccccgggtcagtccaccgtatgaccagcggcagcttccagcaagcctggcgtctcctccccgaacgcgggcaggcacccatgacttggtccccagcgcgcccagtatccacacctcccccccccttccagcccccaaagccctttcaagcacagcacctggatctcaaaggagtagccgccggccaacagcctgtccccaagccccacccgctggacgcccgggccccgccgggctggcaggccacgcgcatcggcgttcacgctttccacctcgccccccacgtccccgtgcacgacgtaatcatccatgatcccctcggcgtcgtcctcttccagcacccccgtcccaaaggccacccccgggtggcgccggggtacagggcccgccgctccgctctgccgccgccccgcctccagccgggcacgcttggcggcctcgaactcgcgagcgccctgcgcgacaaggggcgattgagagaaagggggaggggtgacgttctgattgcgctgccatgcaggcaggtgtggatcggccagcatgggagggtgcctgccggcggctcaggggtggattgtgccggtcgtccagcgcagccacctgctcaccctccccagctcacgagcgcaatacacgcagatctgcacatccacccaccctgcctgcacccaaaccgagcatcagagcttctatctgtggatcaactcaccctgaaggggtcgtacccaatgccgtgcagatccgtcttgggcgccggagggaggagggaggcgagtgcggcgccggtttcacgtgcggttcccgaaatgacctcagatccagcggcgcccctcgagccggcagcatcgggcctgccgcccaggccccggccctgacgccaccccatcctgcgcagcagctggatgccgacgctgtcggccaccggcgcgatgacatcctcgggcagaaggccgggcacggcctgggggcggatggccgcctgctcccacacggcgcggcggctggcctcggcggctgtcgcgccaaaggtgtcgtacgccgccgtggtctgtggcaggggccatggggggctggttgaatgtgtggtagcgtgggagtggacgagggaaggccgtcctgaggctgccgggcgaaaccaaggggagcccacggcagggcaaagacagtcggtgctcatgaatgcacgcacctggaggtgctgtttgcggtactgctccagctcgtcctcgtccaggaactgctcgacgctctgccgcacaccggcgcgggcgccctgggagctggagaaggtggcgggcgtccagccctccttggagcccacgctgttgaagtagccggcgctgtatccccccgtgaacgcgccatggaatcgccgacgaccctggtcgtccttcacctcctgctcgcaggcgtgtgggatgtgaggtgactccacgatatgggctgggtgtggggcagcactccctggcgaggagctccgacgagcgtctacgatggggactgatcgagctccctnnnnnnnnnntcagcaatatatttgtctgagatttgactgtgtgttactggtcgcggaacatggtcgacacgacgtgtaggtttatcgcgcccttagttctcaagatctctttggggacactgcctgnnnnnnnnnngggcagtgtcgtaataaacacgactgtaattacctgttggtgcaaggggagactccgtgtgnnnnnnnnnnctgcagtgtagtaataaatacgactgtaatcacctgttggtgcaaggggagactccgtgtggcagccggatcggatcgctgaaaaggctggacgtctgactcgtcgacgaggggagcgccgaagaagtggtagtcttcctcgtccaccattgtcacatcccgatcgatgaatgctcaggcagcaatatatttgtgtgagatttgactgtgttatactggtcgaggaacatggtcgactctacatgtaggtttatcgcgccttaattctcaagatctctttggggacactgcctgtgtggggatactggaagatctcaaacatttcatacattctgaaacattggctgctctggtgggtcctctcaattcctctgttatgctacactgtgtctttgaaagtgccgcaattgttccatcagaccttcctttgccagcatgcgctccacgcatggtcagcagtgagggcgagcccttacccggtcgaatatcctctatggtacgttgattggagcttgaaggttagttatccgacgcaaggacactgtggtctgactggcctatgtctactccaaccttcaggatgtgaaggaagttctcaaaggcggcaggcaggagctgtgccattgtcagaggatggtaatgtgagtcaggcaaaccgagactagcgccaagatcaggaccgaggtgagaacgtttgcctgtgtcaactcacatggtgcaattgcggattagttgggagtggttgaccgtggcacgatctgccggggagaatgagtaatatcatccagtatctggatcgtgaggtcctccagctgactccctgcctgagttcgagagatctaatgtgcaaacctggtcaccaaaagtatgtgaagcggtcactacactccacatacgctatgtgtttgtactgtgtttcttcttgtgattgtgcttcctcaccgctttgattactggagatgacggccaagaaagtgctgacgaatatactctgatagtaaaacttcttgccttgacagttacaaaaccatctctgcgcgcatatttatttcccgaagtattgcgggtctccaatctggacccggtatggtagagttcaatctccggacacagtgaagcagcagcagtgcggatgcagtatcgtccacggcacttcagatatgtgtccagccccattcaattctatgtcccatggtattcaagtccctactgtcaaagagactgtgtgctgtgcttgtgtaatgtggatgacagccccccgctgggattatggctggcttgccggttgcggatccggatgccgtacccggcagtccagataccatcccacaagcaccttaaccttcataacttccattggttgtggaatcctgatattctgcaattatagatgtactggaggttcaagtttcacagtatctcttctctgnnnnnnnnnntagtccagattccatcccacgagcaccttaaacttcataacttctattggttgtaaaatcctgatattccgcaattatagatgtactgaaggttcaagtttcacagtatctcttctctgctgtccaactgtgccgccccctttcatcgacccgccggtggacaaatgtatgcgactgcnnnnnnnnnnnnnnnnnnnnnncgaaggccagccttcgccctcttcttgctcatacacagtctagctacccttactgaggtgcaaaattggcattcttgagcgtaggaacggcctcaggtggttcggattgccgcagtcggtgcgcacaaatcggccacctccccctcaccctttgctcccgcgtctgcccacgcaggccgcctgtccctccacattctttcccctccccgtggcaatgtgaggttaccttgaatctctgggatggcggttcgcagacatggcgtcatgccgggctgacttgcgagtgaactctggccccgcccgcaagcctcccgcatgtccggcnnnnnnnnnntgtcatgccggggtgacttgcgagtgaaccctggacccgcccgcaagcctcccgcatgtccggcgaaacaacaagtctctccagcaccctcataaatcagctcattgtccatccgtaacagatatgggccacatgtatacttcgtggaggtggcgagtgcaaacgctttctgcaggtgcgctcccatgccaggcggagatgctcgacacatccgggtgttgagactgtgattcattgcaacctggtttatgcaaattcacgactgtgctcaatccaccaattctcccttttctccaactccaggaagcaaggcttcagcaaagcaggatcattcaggnnnnnnnnnncatgcaaattcacgactgtgctcattccaccaattttcccttttctccaactccaggaatcaaggcttcagcaaagcaggatcattcagggactccacgctcgagatcatgggtctgtccgtgagtgccgtgtccatcgaacccttcaaggttctgctgccgaggtcgactcagatcattctgacagtggaatgcctgaagcccggccagactgcctgcaaagctgacagtaagggcaacattggcactggtaacgatggaaagaacaactttggggactacaacatcggcgacaacaacattggtgggcgctgggggaacgggatagattgggtgggagggaagtgcctgtgcaccggaattgctggggtggtatgagggggtttaatcaaaattgccgtacgtctcacactcgtnnnnnnnnnngtagattgggtgggagggagtgcctgtgcaccggaactgctggggtggtatgaggggtttaaatcaaaattgccgtacgtctcacactcgtaccgcactgaactcctatcccgtgcagggaggtacaataaggggaactcaaattggggcttcagaaacaatgggaacaacaaccgttgcaaccatgccgtgggcaatcggggaacggtgaacaactgcgacttgatggagctcaggaagaacgccgatctgaactacaacccaccgcctcctcccatcaagccacctcctccaccaccatccaggaagccccccccacctccctccaagccacctcctccaccaccatctaaaaannnnnnnnnnnnnntcccccaaaatgtctgcaccgcctcctccgtccaagaagtcaccccctccttcccccaagtcgcctcctccctccaccaagtcacnnnnnnnnnnccccccaaaacgtctgcaccgcctcctccatccaagaagtcaccccctccctccaccaaatcaccaccacccccctccaccaagacaccacctcctcccaccaagccaccaccacctccctccaccaagtcaccacctccttccaccaagtcgccacctcccttcatcaagccaccacctcccctcaccaagtcgccaccaccaccatctttcaagtcaccaccaccaccatccatcaagtcaccatcccctgtccacaggccgccgccttccccacttgctgtgcaacccccacctccaccctccccacctcccagtccccgtcccatcagctttccccctcccagctccccccctcccagcccacctcctgcctcgcctcctcccagcccacctcctcccagcccccag

SEQ ID NO: 42900 - DNA, 61 bp, Chlorella protothecoides
gcccacgccctcggcaccgcaccatgccggcctgggcgcggtcgatcgcccgcgccgccgt

SEQ ID NO: 42901 - DNA, 134 bp, Chlorella protothecoides
gggcatgccgccccagcgagcggagcacccagccagccagaccgtccgattgaagacctgcttcgctcacagggcagacagcatgctgacagtaccacacccaggcgctcagagctccactcagcaacgactcc

SEQ ID NO: 42902 - DNA, 61 bp, Chlorella protothecoides
gcatccttgggcagcttgtcctcggcgggggtgcccaggaagagggccacgctggaccctg

SEQ ID NO: 42903 - DNA, 77 bp, Chlorella protothecoides
ggcacgggggttcagggccccccgtcagggtctacctgccggccggtcccaggaccgagctgcggcgcgcggtgctg

SEQ ID NO: 42904 - DNA, 70 bp, Chlorella protothecoides
ggggctggggctggggctggggctcttgggactggggctggggctcttggggcttgggctggggctcttg

SEQ ID NO: 42905 - DNA, 26060 bp, Chlorella protothecoides
  modified_base (541)..(550): a, c, t, g, unknown or other
  modified_base (940)..(1088): a, c, t, g, unknown or other
  modified_base (1290)..(1364): a, c, t, g, unknown or other
  modified_base (1822)..(1831): a, c, t, g, unknown or other
  modified_base (3528)..(3537): a, c, t, g, unknown or other
  modified_base (4147)..(4156): a, c, t, g, unknown or other
  modified_base (4411)..(4420): a, c, t, g, unknown or other
  modified_base (5326)..(5335): a, c, t, g, unknown or other
  modified_base (7036)..(7045): a, c, t, g, unknown or other
  modified_base (8389)..(8398): a, c, t, g, unknown or other
  modified_base (9134)..(9143): a, c, t, g, unknown or other
  modified_base (9499)..(9508): a, c, t, g, unknown or other
  modified_base (9881)..(9890): a, c, t, g, unknown or other
  modified_base (10070)..(10079): a, c, t, g, unknown or other
  modified_base (10603)..(10612): a, c, t, g, unknown or other
  modified_base (10948)..(10957): a, c, t, g, unknown or other
  modified_base (11220)..(11229): a, c, t, g, unknown or other
  modified_base (11713)..(11722): a, c, t, g, unknown or other
  modified_base (11804)..(11813): a, c, t, g, unknown or other
  modified_base (12457)..(12466): a, c, t, g, unknown or other
  modified_base (15937)..(15946): a, c, t, g, unknown or other
  modified_base (16043)..(16052): a, c, t, g, unknown or other
  modified_base (16132)..(16141): a, c, t, g, unknown or other
  modified_base (17036)..(17045): a, c, t, g, unknown or other
  modified_base (17253)..(17262): a, c, t, g, unknown or other
  modified_base (17627)..(17636): a, c, t, g, unknown or other
  modified_base (17898)..(17907): a, c, t, g, unknown or other
  modified_base (18377)..(18386): a, c, t, g, unknown or other
  modified_base (19034)..(19043): a, c, t, g, unknown or other
  modified_base (19643)..(19652): a, c, t, g, unknown or other
  modified_base (19800)..(19809): a, c, t, g, unknown or other
  modified_base (21401)..(21410): a, c, t, g, unknown or other
  modified_base (21622)..(21631): a, c, t, g, unknown or other
  modified_base (22011)..(22020): a, c, t, g, unknown or other
  modified_base (22846)..(22855): a, c, t, g, unknown or other
  modified_base (23209)..(23218): a, c, t, g, unknown or other
  modified_base (24007)..(24016): a, c, t, g, unknown or other
  modified_base (24346)..(24355): a, c, t, g, unknown or other
  modified_base (24570)..(24579): a, c, t, g, unknown or other
caggaaagcgatgcccgcagccgcggtgtgccgcgaggcaggggacccgggcgcgccgcgccgcgcctcgacgcccgccagctcgtcgccgctgccggcgcccagcgcgacgtccaggtgctcgcgcagggggtgctcgaatccggccgcggcgtgccaggtgtccatcagccgcgccacaccggaggaggtgcggcgcgagtgcaggcgctggggcgaggccaggaagccgtccaggccgccgccgttggcggcggtgaaggagccggtggagggctggacgccgacgccgccaccgccggggccggtcacgctggcgccgctgccctccacgccctccaggcccaaggacagctgggggaagagggagcgcgccaggtccgcctcgctggcggtgaaggacacctgcgggtgcaggccgcgcggcggggaggtgaaggaccccgtgccctgccccgccagaccgcgcgagatcatgagcaggccggccgaaggctgggcggcgccggagcgggcgccgccctcgccctcctcgccctcnnnnnnnnnnagccgagggctgggcggcgccggcgcgggcgccgccctcgccctcctcgccctcccagtccgggtcggcgcgctgcgcgcgctgcagcgcggcggcgtagtgttgactcagcaggtcgtcaaaggtggcgccgggcgcaggccaggcgacctggggcgcctcgccacgcggcgagaaggcccccggcaccccctgcccctgctgctgctgggaggagtggaggcgctgggcgcggagcaggccgcccgcatggcccaccagctcttccagcggcggcgcggcgccgccgcgccgagagtgctccgcccactgctccgccagactgggcggcagcgagccctggacgctccccgcatcgcggcgcgcgccggcggccaggctggcgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccggctggcggtgccgggcggcgaggcggggcggtgctgcgccgccagccaggcgacgctgcccggggcgtgccgcgcgccgccggggatgccgccgtttggcgcgtcgtcgtcgacgtcgtagccgcccgatgcggcgggctcatagtccaggtcgctgccggtggtggtggaggcgcggggcgtgccgtccgcgcccnnnnnnnnnnnnnnnnnnnnnnnnnnnnnnnnnnnnnnnnnnnnnnnnnnnnnnnnnnnnnnnnnnnnnnnnnnnggctgccgctgccctggtcgaagcccaggtgcgcataccggctgttctggccgcggttggcgcgctgggggcgctggggtgcaggtgcgtcgccggcgcccgcggcgtcgggcgcgggcaggccgccgccgacgctgcgctgggtacgcgtggagggcgcgttcagatagtgcaccagcaccgcgtactcatactgctgctccagcagccaatagcagcgccgctgcagctggtcctgctggtcggcgtgggcgtagtagcagttcagtcgctccgtggtgcccaccttgagtttctcgtgcgtctcacgaactgtcttgttgtctgggtgcaggaagtgggggggaaacgctggtgaagggggagatgagaagggggggcgggtgccccgtgcagttcctgggctaaaggaagccagcccctgacgagcaagctggtgtgggaccccgcgccaatcnnnnnnnnnnggtggggggcaaacgctggtgaggggggagatgaggagggggggcgggggccccgtgcagctcctgggccgaaggaagccagcccctgacaagcaagctggtgtgggaccccgcgccaatcccagatccgatgagacgtgcccctgacctgcacgcaactgaacaaccccatatgttcctgcgtggtgtaaacacagctcggccagcctgtggcttgcgtgtgcaccgcgccccacatcccctcgccgcacctggtttcttgcgccactggtgctggtccttgcggaaggtgcggcagctgctacggtcgatgaggaacagagtcccacctgatggggtttggcagagggggttgacactgaggttgcaggccacaggtggctgccatggcatggggggcaggcagggaaccccactcacccggtggcagctccggcggcgaggtggagagcggcaggaggccgctggtggcatgttgcaagatttgaaagacctcgctgttcttcagccaggaactccgggccttggccacgatctcccgcacttcctcgggcaggccggcatcgtccaccggcaggggctgtgccggccccgacatgtgcggcaactggcgaggtccccctatgaacacgccaaaattgggcgcagaagagtttcgggaaggtgatgacgccccgcctgagggcagggagtatgagggcgtcccgaacttgcacggggtccctggggagccctgagggaagctgaagcccccggcttccacaacaagatgaagagtatgttcaccaccagatgtggagtagtagggtggggagtgagggtccatcatggctccccaaagttcatgtccagtccaccgcgtcgaccaccatactaggccaggtggccaaatctcatggacatgggggcctgggcggggccctcctccgagaaccatgtgtacgggaaacccagtgggcgaggccaaggcggcattcccacgccacaaggacaccgaatttgaattacgtgttttcggacccacaatggaagaccagtcccggcctcaggtcagggctgtggtgcccactggctagatcccctcggacgtcccgcaacagacgtccagatcaagagtccacgccggccacgcaggcaaacttgtgtgcaacatgtgcttcagcacttgatagccacgcaggtgcgttcatgcgcggtgtttgccagcagccagaccacctgcacccctctgaagccagccagctgggggcagttggtggggtcccaggccttgtccctcgaccgggagaagaatttgagggtcagcaggaggtgcccccccggcttgaggtacgccagcaggggctccaccattccgatcatggcgctggggtgcttgttcatgtctgagaccaggaggtctgcgcccccgcccgcccccgccgcggccagggcggcctctatctggggcagggccgtctccaccctgctcttaatgtgcgtcaggttgggcagggccagggcctccggggccatgtcggcggggtcgatggagatcacgcggtgcatggaggaggcgagcagggtggaccagccgcccggggacgcccctacacggcatagaagggaaggtggactcgtatcagacggtattctctagatacacctggggtagaacggtcgcataacagtgttgggtgcaggcagtgtctgcaggnnnnnnnnnngcctgcacggcataggagggaaggtggacctcgtatcagacggtattctccagatacacctggtagaacggtcgcatcacagtgttgggtgcaggcagtgtctgcaggagaaccaaattgcagcctggcacacccctgggctcgccgcatggcagcgctcaccgaggtctatggcgacccccccgcgaggtgcgtgcttgacccaggcgagggcctccgccagcttggacgtggccttgcacagcgagccctccagtcgcggccgggtccaggcagtggtgcggaagaggcgggggcaggggctcatggagtacgcgacgcctgcggctgtctccaccacgtccagcacgtgggtgaaggcagcaggctgcagcacccagtccaggggcaaggcgtcctgcgggacggtgtaggaagtgggatcgtgatgtgttgagaggagtggagctacaaggtggcctagttcactgggtgtaaggatggccgcagcctgttgcccaatgctctgggcgtggcatgagacagagcaaggcgcactggctgtgtcaaactctgtcccttgagcccccctagattaggcactcactcccagccacggctcaagcttatnnnnnnnnnnctcaaagtctgtcccttgagcccccctggattagccactcactcccagccacggctcaagcttatggggaaagcagtggaggcggagggctccatcaggggggcctttagccaagagctgacggaccaactcctgcaaggatgaaaggggggggtgccgctgcctcacatgcattgcatgagaatggttgtctgcccagtggtgcttgtatgctagacaaaatgagcaggaaccctgtcacaatgaagacacttnnnnnnnnnngatggttgtctgcccagtgttgcttgtatgctagacaagataagcaggaaccctgtcacaatgaagacacttgtcacaaaagtgcatggcctacattcgggccctgcagaaatatcaccaaccgaaagcctggccccatgcagctgacctgtcggtcagcacaccgctgcttaatccagtagacgcgcatgacggcccactccatcactgagtctcggagccaggcctcaaagtcggccctggggagggtcacacccttgagcaggaccaggcaggggccggcatggtctgttcggggcccaacttcctcagcctgtgggccaccagggaacaggcacgaggtgttggtctcaggacagtttgatgtaagttgtaatacactggtcgatgtgcaggatttatcgaagcgatgcatgcccctccagtcccatcgtatgtgcatcccaccgaggtgcacatagagcagcagtgcgcacctccactccacagccctcggggaagaaggctccactctggtgcagcagcacgcatctgtaggcgtgcgtctgggattgaaattgcacaatcacgtctggtgtctgcgtcgcaaggcaagcctcctgggcgtcctcgaggccgcgaacgcacatcccggcggctagccttcaggtcacaaggacatgcacgaggatactcagaagctgtaatttattttgaaaatagtcaacacttcttggatgtatatttcatggagccccccccggcgagttttgccaacgcgtgacttactcggcacttacaagcgaggcgatgctggcttcggcacgaagggggcagcgggttcaaggggatttcttaggatccaacaggccacacctgtactagcgccagcgcaatcattacgagtaaagcttgtttgcaccgtannnnnnnnnntcaagcgaggcgatgctggcttcggcacgaaaggggcagcgggttcgaggggatttcataggttccaacaggccacgcctgtactagcgccagcgcattcattacgagtaaagcttgtttgcaccgtaatcccacgacaaattgcctctttatcacaccaggacgaggcccacctctgcaaaccctcgccgtgcctacaggataacaccaggaagagcagcataaagtgcggaaaaggacgcgcaatgtacgcatgggggggtggagtgcgtggtgaatgacaggcatgggaatctggttccctcttagacatcagatctcacagtagacgcggtgcatgcggtaccccctccgccgtgccttctcaatccactcccgcccgcgctctgggttcgccttgcagccgtacccctcgttcagcatctgtcccagcagggctgccgatttctggaatgcatggggaagtacaggggccgtcaaatcgagggtatggagacactgggcaagggcccttgcatccactcccacaagatcaactttgagttgagtactccatggcccacacgcaatctcgcaccaggtctccgcgaagagcctccttctcagtctccgcataccaccgcttgagagcatccgccacgaccaggctcagcttctttgggccatcctggataactccatcagaccccagcaccacagcttgtgagttggctgtacctggcgaaagcgcagcccgggggcccgtatgttatgaaactctcacatgcatgtcactccgtcagtgatgccctgccatgcaagaacatgagtatgagcacagcgatatcacaccagtggctgccatgtcgatgtggcgcggggtcgatggcacagaacaccctcggctcccactcttctgtgcgcagtaagctggtggtagcagcgggtgaagggaagcagcgagaggcgagcggcagcctacgaaagccgccccttccagacttggcaaagccccggcgggcgggctcgcgcgatctgtggggcaattttgaggtgctcttggcaaatgaatacaccaggaatcacaaacggggtatcgggagctgtgtctttctgtgggcacggcaccccaagcttccaaggacatcctcctgccccgcacgcgcagcaagcgacgggcccctcgggaggctttcgcatcgatctccaacacgttccacaaatccaaaaatcgcactggcatttgcgagccggaagttaattctatcacgaacttagtggtatcaagaaggtgcaccgtcgttcccttgccaacacttcccccgtgcacgctcctggtcacgtccatcaccacaccctcgcactttcacgagctgcgctttgcacacatagatgtcgggccccaaactaagattctgtcccgaaagtaacgaccttctttaccccaaggaggatagagccaacaaacgactcgtatatcactgtcggagttgtccatatgtcgaggctgcagaccccagcgagtggtgtgtcttccgcaatgaggtgcagcacacctccaaggagaagctggtggtgctccaggtcagtgtcttccgtgttgggggtcttggtcccgggagtgcccgtggcaggatgagtgtggcccccctgcgccagttctggaggcttccccatggtggatcctgcagtcctgcgcgttgctaataatcgttcccaacnnnnnnnnnntaggatgagtgtggcccccctgctctaattctggaggcttccccatggtggatcctacaatcctgcgcgttgctaataatcgttcccaacaatcctgtcacaccctcccttccgccaccgtctgcaggacgtgcgctccgatccgaccctgccgcgcaccaaggacgtccgctgcccggcatgcgctaataacgaggcggtgttcttctcggcatccacggaggagggcatgaccctcttcttcaattgcataaagtgcggccaccgctggcgtgattacgtgtgaggatgcaacaaggcagctgggaattattcatatagcaaaggcgaccacggaggtgcatgggaaggcggatggcgagccagcgccctcatttccggtcgccaggagcggcgatgacccgtgggcggcgtcacatagcaggttcagcagcgttgccgctggcgctgtcacgctgcggcccaccttcccaggggaccccactgcggaacatcactggcttgccgacccgcactgcgacggggcgggtggccctctccatcaccctggccagccgagcctcctgcgtgcatgggcagatgtgggacatggttggatgtctggaacctcctgtcccaagcttgaggcagtccctggtccgacccctgagttggcgccggcagcttgactccatgtaaagcaagcagttggcgttgatagcagacaaattcccatcacagacccatcatggttttcatgttcggtccagctatcgtcaactcacatgctccgcagccgcagctgccgccttttcgcgcctctccctaagacgcctggcccttgcggcacgcagctcagcgaccccggctgcttcagcccccggacccgcatccaccgcaaggatcacagcgtccaggctcccctgctcgcgtggcgtgcagagtctctggtgggtggcagcgcccaggtgctccccagctcatcggcccccacaggcgcgagtggctcttgagattggacccagcatggaccagtagtgcagcccccccggcagatagatacatgccccgttgcatcctgccctgccgacgcccaaaattcgcccctggctatcgcactacgaaaccacaggactctcccccgaaatcagccaagcacctcgatctgctggaggaggtccagcgcgcaggcgccgccgggagcctcgcccaacccgcacagacgcagggcatcctgcagggcccagggcacggcagcagcctccgttccctcggcccctgccctcggcgcatccagcgccagcaccgcccgcgcgagctctgcctccctcagctccgcctccgccaggcagcgttccgcccagnnnnnnnnnncttccctccgcccctgccctcggtgcgtccagcgccagcaccgcccgcgtgagctctgcctccctcagttccgcctccgccaggcagcgttccgcccaggccagacgctcggccagcgcggcgatcgtgcgcaggtccgcgcgcccttcctcctccgcgtcccgtcgggcggcgtgcagggccgtcgcggccgcggcggcccccgccgccgcctggaggccgcgccgctggccatcgcgcagcagggccagaagctgctcgggcgccgtgtgaaccatcggcgcctgctccccgtccaggtcagcgtgatcgggagctggcggcggccgcgctgcccccgccgcctccgtggccgcccgcgcggcgcgcagcgccgccagccccgctgtgtactcctggtgggtgaaggcgccggcgacggcttgctctgcaagctgcaactcgtgccgggcatgttgccgcgctttctcaacggcctcacactctgaggcccaggcagcctcgcggcgtgcgcgctctgcggcttggcgcgcggcgaacgccgcaaagtgggtcgacggggtcgtggcgtccagaaacgcctggctcctgatgacggagtaggggacgtcgagggagggggaaggcaggctgtgagaggaccagccttgggattaaaggttggagtggtgagcaccttgcaaggaacacacgaggaagtgagggcagcgctggtgcatatcgcaatcccaacctnnnnnnnnnntgcgccttgcaaggaacacacaaggaagtgaggacagcgctggtgcatatcgcaatcccaacctgctgtgatccaggggtgcagagtcatggcctccgcctgaaggagcactgtgtgtgcaggtggtgatcgtcctcgccacccccccccgccatgcctgttggcctccgccagcctttcctggaggcgctccaggcctgccctggcatcatgggtcaggtgctccagcctgctagcctccgctgcggccacctgccggttccaggatgacaaggccacctcagccggtttggctgacaagagtcatgagggcacggcagccaacggagcaccacagctttacaaacaagaacagnnnnnnnnnnctgggtcaggtgctccagcctgccagcctccgctgcggccacctgccgattccaggatgacacggccatctcagccggcttggatgacaagagtcgtgagggcacggcagcccatggagcaccacagctttacaaacaagaacagccctccctccagcaaggtgcccaatcccagtacctggtgcctgtcgctcgcctcagccacggcagccagggctgcctttgtcgccgcggcatcctcctgcaggtgctgcgcaaatctcctggagtctgcctccaaggcctcctcggctgcctgcacaggggattggggatgtgggtgaagattgagtgaccctgcgcggtaggaactcgcctcaaccaccgcatcacnnnnnnnnnngcaggggagtgggggtgtggttgaagattgagtgaccctgcgaggtaggaactcgcctcaaccaccgcatcacagaaccacactccccgcagcgcgccctgcgcctggctcatgggctaaaagcacatcgacgcgtaggcgctcatgcgggccccgagcccaccagcacggcgttggctnnnnnnnnnnctggctcatgggctaaaagcacattgacgcgtaggcgctcttgcaggccccgagcccaccagcacggcgttggctctttgagcggcatgggatcggagcctgtccagttcctcctgaagctgctccacctggcttcgcagcaagaacatctcccgccttctctgcaccatgtcgcgtatggcattggcggcacggtccagaggcttgccccgccctgagcgacgtcgtgaattggatgcgcggccatcaggcgctcgctcggccggaacagggcgacgtgatggcactggaactccatgcagtgcattctcaggagggtcatacaatggacgcctgtgttgcctggacgcagtccgggcggcccgggcggctgcccactcctctggagaggttactctgaaggggttctcagccgtcaggaagttcagctctgacttcatgtgtgtaatgttgcttggtcataactgtacatatctgcgaattgtgcttgctgcgcgggtgaatacggttgccgacctccgccnnnnnnnnnnggttgcttggtcataactgtatatatctgcaaattgtgctggttacgcgggtgaatacggttgccgacctccgccatctggacatgtccccggcttgaccaaacctccccggcagcggcaagattatgtttggcgacagccaatttgcaagcctcctagttgtccttttgtagctgtcgtgggcgacctgggcatgtacccctgtaacccacgaagcctgccatgcggggggtaggagtcacgtggtcttgggtgctcttggtgggcatccatatggatgaatcttcactgaaaaacacaggtgcgtcctttcacttgaacgtggcattcacagcnnnnnnnnnngatggatgaatcttcaccgaagaacacatgtgagtcctttcacttgaacgtggcattcacagcccgctccatgattttcacaccatgacaggcattgagtcctcaacgaagtctgtgactggcacagatcctcacagttcattagcaccgatggatgcgtgatcgaccccttggagggcaatgcccgatatttcagagcatgttcctgcctggacgaattggcttggcaccgagaactgccttgcgctggagattggaagtcnnnnnnnnnntccttggagggcaatgcccggtatttcagagcatgttcctgcctggtcgaattcgcttggcaccaagaactgccttgcgctggagattggaagtctgcggcagagcaagacgatgatactgctgttcttcctcgcgcagggtgattaatccatgttggcctcacatatccagaacgcatagcgtcgcaaacgacgccataaacttcagagattcgcccagaatctctggtaacgcctgcattacaattctgctgtctgggcaaaagtccgaaccctcaaatcgcaactgcggggtcttccagcgcatcatcatccccttccgtcttgcgccaggggatgttctccaggtcctcctcgtgctcagcgtagatggcttgcccggtccacggcctccacccatcatctcggggccaccggccgccctcccactccaaaaacggcgccgcctccggcgtcagcctcagcacaagcacgtcgtgcggcnnnnnnnnnntgcgtcgccaaagacgccatcaacatcagagattcgcccagaatttctggcaacgcctgcattacaattctgctgtctgggnnnnnnnnnntggggccgccggccgccctcccacttcaaaaacggcgccgcctccggtgtcagcctcagcacaagcacgtcgtgcggcggcacccgcgcggaaaacctgccgcggaaggtgccgatgtcgtgccgtgcataaaggtcgcgcacgcgcaccgcggtgtcttcctggtacccgacctgctctgtgcgcactgcaagaatttggagggaagagagggcggcatctgagccgggctgtacagcggcaggtgaacaactgcgcccctgtgagctgccctctggcacagcgattcagaagggaacgggcagaggcagcagctgggtagcatggtaaaacaatcaagactcctgcccacagcatgcagggcggcttacgtgtgaaacgggcccctgccgccccctcgtcatgttcggcacggttgaagaacaccacggcccgatccccgcccgcgagcggcccggcgtagatctccttggacccctgaagggggggggttggagggtagatgggctcaccaccacggtctgtacaggcatccccagcatcactcaggtccaaatccaaggactggatgggcaggcttccatccccccctttcctctccagttcctggctgcctgccaggtcctccccccttgcctgcttcnnnnnnnnnntcattcccctccagttcctggctgccctgccaggtcctccccccttgcctgcttccagatgaggtcccctgccacgccaaggtcatcctgattgatggccaccacctcagcggccaagaggatggcggcagacgcgttgctcagctcctgcagcctggtgctgatcatcaggggcgacttgagcagggaccagagcgccaagttggcgcgctgctccccaagggtcagccctgggttgcccacctgttgagagggtgagtcaggagcatgggttggcattgcttgccaggtgccctgcatcgcttgtttatgcaaggcgaattccgccctgcagcagctgcatatagctggcgggcaagcagcgtcagagccttgagtgcagcccgactcccaagtttggagagggggaagggcctcctcatcttgtgcccaactggaggctgtgttttgctgtggtccaccacttgaagctgcacctcagagcctctcagaggcacgtccactctgggcccccccacaatcaccactttgacaccttttggaccgcaagcaagtaatagtattacccttggcaatcccccccattccccctccccgttctctgagacctggagcatgtctgggtcgttccatgcccccggcccagcataccgcgccaggcccacgctgttgtccaggttgttgaccaggctgagccaggaggcggaggagtcgccggtggtgcgccaggagttgccaacggcgcggccccagagccagggctcctccaccccccactcgcacaggctgaagagtatggggcgacccgtggcgttgagcgcgtcgcgcatggcgccgtacctcgcgcgcaccgagtccccctccttggggtagcagttgtcgtacttgaggtagtccgcgccccaccccgcaaacgcggcggcgtcccgggcctcgaagccgcgggagccggggtagccgccgcaggtggaggtgccggagtcggcgtacatgccgaagctcaggttgcgggcgtggacgtgtcccgccagggctgccatgccccccggaaagcgcgaatagtcggccaccaggtccccatcgggggtgcgctcatgctccgaccagccatctggatggggtgggtgaggggaggaagggagggatggcaagcattttgtgtgagtttgggaggtttgccgaggcatggcagtagagcatcgagcatttgctagcaggcgctggactgcccaaacctcggccagacccctacccttcgcccaccgtcaaggacaaggtatgtgtatcccatgtctttcaagcctagggagaccagcaggtctgctgtttgtctcacgtcctcctcgttcactggaggggaggggcaacaaggatctggtgaacttgggctgcggtccactctcatggtgccagggagggatgctccagtactcgaaatttgacaaggcccccccccctcaggcctcaccgcgcagggcaaaagagctccatgtgttgaaacccatggcgggtttgagtgccaagccattgtcgagtgatgcacatggacgaacaaagagcgctgccagcgtcagagccaagacagggtgcaccatggcgctcagacaccgcgcatggaaggattcaatttaggaggggattcgacatcccggcgccaatgcaatgcttggatggagtatagatccgtattcccgctgaagcacagcctcgcctgggtcggcaggcgaataggcccacgaatggggattatcgccgagatcagaaatttcagcgggactgcctcgaggacggtacatatcactatctccgatacatctatatttaaaattccttagtccgatctcttccgattattaagtgcattgctgggtaactgcgaccactgcaacatatcaggagggcaccgtctcctgtgactgctgtcacgatggcgccttccttgggagacacacctcctcatgagcctgaacagtgagtatcccttgggtccatattctgaatgccgattttatgtcgtatttcgtctggttgggcgccttggtggcaggacggtcatcaccaggctggcatctaccatcgccgtacatggtgggcttcttcacgtgtgcgacgtaacgaacacaccgtgccacaacactgctcctaaactgtctccaaaggtccactggtccacaaaccgaggctccgccccaacttccccggggtatgacggtgcctgagcctcgccagggcagtccccgagctggatctcctggcccgggctacgacaggagagatggcccaggctcgcacagtcaccatggaggcgactttggaggtcgctacgggtgcgctccaggggcttgtttctggctgagtacatggcggggctgccgatgttgctcccggctcctgagactcgagagggggatgaattctctgctttgctgctctcccattcctctactcgttctcttcccattcctccgattcaactctgcgctcaatgcaccttgcgttgcaggggtggtggattcggcggcggcggccacacccacacctggaagcctggcgactggacgtgcatggcttgccactcccactgctttgcctcccgcgacacctgctttcgctgcggcgccgaccgcctgggccagcgcgggccgccgccaggccccaggttcgacccacgctacccgcaggacccgggcatgtacccgccctttgaccccggcatggcgggcatgcccggggccgcgtttcctccccccggcgcggaatctgtgtacgtccacgtcccgcccccctcgatccccggcggctacggcgatgcggcggcctggggccggggccccgtcaaggacggcggctaccccatgcgctacgaggcctttgagtaccagccgcacgacacctgctaccgcgtgcctggggctccggaggccgcccccgccgccggcgggatgtcgggcggcgctcctgggtttggcggcggtgctcctggggcctccgggtgggtggggtgagggtgggcatgggcctgggctgggatgtgtggaggggcatgggggtgctgagagccctgcatcctcccacaagtaacgagccaggttgatgtttgcaccatgtacgcgccaatgctcgaatcagaccacgctgcccaggcacatgtgcacttcaagccgcgatttccacgtgttgcatacgcacctggcttcatcccccctttcccccaactgcagctcaaagccgttccggcacggagactggaactgtgccaagtgccaagcccacaactttgcctcgagggtggtgtgcttcagatgtggcgctgagaaggtggagtgatggcgcagccctggatcccagtgacacacgctgcactccccgcatgggtgcacgatccaccctgaccactatgctcatggtttaaggatacacagcgactctgtttccagacttgcagagccttcattgagcattggcacatgnnnnnnnnnncgccacatgtgcacttcaagccgcgatctccacgtgttgcatacgtacctggcttcatcccccctccccccaactgcagctcaaagccgttccggcnnnnnnnnnncacccagcagcatcagcctgcaggttccctggtgggcgccgggcgccggctttcgccatgctctgcccgccgcggcgtcnnnnnnnnnntaaggatgcacagcgactctgttcccagacgtgcagagccttcattgagcattggcacatgcccttcatgccactggaaccaaactgatcataacactacccagcatcatcagcctgcaggttccctggtcggcgccggacgccgactttcgccatgctctgcccgccgcggcgtccatcgccgcctcagcatccgtgtcgcggcgcgcatgccgcctccgaccgaccgcagcgctgcatttgtcatccagctggcgggggcaaacacacgtagtgggctgagctgcgccgggccatgtgcttgctggactgcggcatgatcgaagggagcgggcaagggaatggtgttctcaggtggcatacctgcgagacgacaggcattgctggacgagggcattcgaattgctgccagctgctcgacctccctccgctcccagacgcgaagatacagtgcaccaactcaccctccgcttgccgcgctttggggttggcatccgcagccaagatgatgaagagggggaaggccactcccacgacggcggaacctatgaagaagctggtcagcaggaccggcaggatggggagcaggccaaaccctgcgcccaggggaggagggaggggggtgcaagactgccatgggcctacctgattggaatgcagtgcatcagaggtcaaggacacatgccaccctgacacctgggcacctgcaaagtaggcccagtgcgtctcgaagaaagacacgcgggtgatgagcgggacgccatgagccgcccacttgtagtcgaatgagtagagggcgtagagccaggccatcagggccacgctggtcgcccgccctggggagcgaggagggcatgaggatttggttgagagcttgcccggctgggcgcccacnnnnnnnnnngcgctggtcgcccgccctggggagtgaggagggcatgaggatccggttgagagcttgcccggctgggcgcccaccatgatggaaagaagggcagggtgcattccagctcttcttgggccctccaatgtacacacacagagatgcaacatctccacagcagatctgtaggaggcctcggcaggtcaaattggcaaaggatggctcccannnnnnnnnngacacagagatgcaacatctccacaacggatctgtaggaggcctctgcaggtcaaattggcaaaggatggctcccactagttccctcccacacaccatgccacacacctatgacggggaggagatccagcacaaaggtttgcagggagatggagcagaggaggaggatgcggtacaccgattcggagatgagggtcatggggtcggggatcctggcctgcatgggtgcgaccatggggcaaaggggcatcggctgggtatcacagtggttgcccaatgggctcagcatccccttgctaccatcgcatggtcactgcaacccctggctggccgcatgatacagcatgtcccccgccgcctcccatnnnnnnnnnngaaaggggcatcggctgggcatcacagtgtttgcccaatgggctcggcatccccttgctaccatcgcgtggtcactgcaacccctggctggccgcgtgatacagcatgtcccccgccgcctcccatccccacccccccaccaaacctcggaccttgatgggcgagcgccgcgtgctcaagccctcgcccagtctctcggcccgccgcaccagggcctgacgctggcccgcggcaatggtgagctccgccagctcagcgtacnnnnnnnnnnccctcggaccttgatgggcgagcgccgcgcgctcaggccctcgcccagcctctcggcccgccgcaccagggcctggcgctggcccgcagcaatggtgagctccgccagctcagcgtaccacagcgtgttgatcagcaggctcacgacgtgggcgggcagcacccacagcgcgccgtatgcccccatgagcagcgaggtggccgcggagccggggccctggcccagcagggcagacagggtggtcgccagcagcggccgcagcccgtggcggaccaggaggacgctgcggggcggaaagcggaggggatcgtggtcttcctgtgagagggtcgacgagtttgcagggggttgcgatgcagtgaggattcatgtcggatggcgtcgagcttgccggcaaggagaaccttgtgcctgactgagacagcaaggcacacagacagtgcggagcagtgcttccaatgccaggccannnnnnnnnntcttgcgcctgactgagacagcaaggcacacagaccggtgcggagcagtgcttccaatgccaggccaaacaaagtcacagatgagaatacacatgcacagacctgcccaggaagacgacgccgttcaggaccgtgcattgtatggtcctggtctgcatgggggggagggtgattgagctgtgaggtgcgcgtgaaacatggcatggcccatttcttgtgataacactcatacccaacacatgacagaatcttaccaggatgcggtggtcgtacacaaagtacgctatgcagcgatgaaagctcgcggcatctcgtagccctgccaacctggaggtgtcggaaggaggggatccgatgttggctcaggcagctctgagcacgccctgatgccacttatccatgcaagatactcctataaaaaccttacggaccctgcgtgtagctggcagctggcctggcgcttgaatgccgccagatcggcactgcggccccacggcatcccgacaccggtgtgtaccacgaacacgagcaagtctccacactgccggatattccggtagcaatgattacgctggctttgctcttattcatccctcctgctccggtctcccacacacgggtcaggttgctccgacacttgatcacatnnnnnnnnnngttgctcttattcatccatcttgctcctgtctccaacaaatgggtcaggttgctccgacacttgatcacatctgcttctcgagcatgtttttgcgccctggcatgctgtgcatgctcactttctttgaacacgccgtcccctcaacatcgctgcaaggcacgcgtccttacaaagggtgtgcagcagcaggaagacacacaaggtgatggtctcccactcactccccagccgccacgactcagagactgcccatgggcgatcagcggtacctccgcagagacacacggttgttctttttccagacggcgcgccgactgggcctgttcttggtgtgcaggtgccccttgccggtcaggccgcggtacttcttgccggcgctggtcaggccgcgcagctcgcggtgcttgtggacggggttggcgatccagttgatgcgggcatcctgcagcatggtggtgcagtgttcagggtgacatggggcgcatgtggaggtgatgagaatggaaaattggattgtgggagcatgagaagtgtactgcgcactgaacatgagccggccacttgcataggtctgggaagggctaccaggacctcctccnnnnnnnnnntattggattgtgggagcatgggaagtgtactgcgcactgaacatgagccggtcacttgcatgggtctgggaagggctaccaggacctcctcccattcgaattcgatccatgtgcaatggaagccagatggctcttgtccagcggctgnnnnnnnnnncagtgcctcccttcccggccttcttgacaaagcctcagctcacgttgcggatggccttgtggaaggggtccaccaggatgacctcaaagtacttgtagactgcgtcctggttcacccagtaggagttcagcacgcgcagtccaccgcacttgcggccgacacgctcctcggccaggttggccaggttgcgggtgggcttcagctgggtgataccctggttcacgggcttgccgtacacgattccctgcagcggaggcatgggggaggggaggtgcatttcacgagggtgcactcatcaatcgccattcatcccaaacatgctcaagatgactatacgatccccacgcacatggctccgagcatgtgctcagggccccatccccaggtcgggttcgagacccagccaaccctccggaccccagaaggagggcaccagggccgagcatgttccagacgcgcaccttggggacgggcttcttgcggccaccacggcgcacgcgcacgcggtagacgacgtatccctgcttggccttgtagcccatgcggcgtgccttgtcgggccgggtaggtcccgtcaggcgcacgatgctcgggagctggcggtactcccagcagcggacgcgcagcaagaagcgcagcacatcggactgcttcttcttccaaagctcctcaatgtactgcgagggaaaatggggaggaggagagggcccctcagacctccgcccgggatggctccccgcgccggcggacctcctatccacccaaagccacatcccacgctccgcaccttgtaggcacccatggtgacagtgccccgggccgaaccgagagagggatggcctggtgggcccgccgtgccttgtaccgagacgccgcagcaccggcctagagaacagggtctacaggaagaaagccttgttcccgccatattcgcatttcgagccccggccactcaggtgcaagctgcgccccctgagctgggagcaaggtatgatatcgaatgtacactgctcgatcaagtgttagaccagtactaaccatgttgtacattcactcatcaccgcagtagggatggcaatatgactcttcaaccattccggcccttaattatcaacccctctagcaaggggtgaggcgccggcggatgcgagtattcaatctcagtcgtatctcaggctgcatcaaagccactaccaccccattctttgtctccatgcgacgcacacgggccgctgctgtcgctcttctctcagccgaccctattgccaatcagaccaagcctgcccctcctctgcaagggaggcaatcaggaaggggtccgcaggggatcgaggccagatccctgaaaagcacggcacatgtggtagttgcccaggtcgagccgccccagcagaaaactggtagccctgcctcaaagaagaagcggagcaaggcggcgcttgacccatccggttttgtccagaaggacattttgtccatacgcaacaaggcttcacgcattgcatcgcagctcgacggcctgtacccgaatcccaaggtgcccctggacagtgcatcgccgttccagctactcgttgccgtcatcctttccnnnnnnnnnnaacggcctgtacctgaatcccaaggtgcccctggatagtgcatcgcccttccagctactcgttgccgtcatcctttccgcccaggtagggggaaggcgcttacagccacccgcaaccagatggctgctggataaaaagtccaaacgcattacaaatacacatgtacagaattcacccaccctgcacccatcagacgacggatgtcaaggtcnnnnnnnnnntttacagccacccgcaagcagatggctgctgggtaaaaagtccaaacgcattacaaatgcacatttacagaattcacccaccgtgcacccatcagacgacggatgtcaaggtcaacacggtcacacctgccctcttcaagctcgccgccacctcctcggccatggcagatgctgacctggcagaggtcaccgccatcatccagcctctcggcctctccgccaccaaggccaagcacctcaagggcatgagcaaagtgggtggttgtttggatggggtgattggcgagggtgaggctattccctacgaaagcaacatgccaaggtatacatttatagggacattggtttaccaacatcctctggtgcatccttgcagaagnnnnnnnnnngtggggtgattagcgagggtgaggctattcactacgaaagcaataagccaaggtgtacacttatagggatattggtttcccaacatcctctggtgcatccttgcagaagcagacccgttcattggactcggctgagctgtgaatccgccctgaactctaccttccttttctttcttcctcccacagatgctggtcgcgctgcatggcggccaggtcccatccagctacgctgagctggaggccctgccgggggtgggccacaagacggcctccgtcatcatgtcacactgctttgggtgagcctggcacgtttggtggggtgggtttagttggaggagggccttgacagcagtggggctggtgggccagctgccatggccagaaccaatagccggctgtgtttgccgccaagactagttcccctgcaccaacatctcaccatcaagcgccgcaaacgagagccatgcccccccctttgccaacgcagcatgccggccttcccagtggatacgcacatccatcgcctggcggagcgctggggtctgtcctcggggaagagtgtggagcaaacggaggccgatctgaaggccgtgttccgggaggagttgtggaacaagctgcacctccagctcatctggtttggccggcagcactgctcggctcgggcccacaacccccaggcctgcccagtgtgcgtctgggcggcgcctaaccgggccaaggaatgagtctgccggcttgaggcaggccggagggatgggtgtaacacggattgccagaaaggactgtaacacgattttggtgcaccacctcatctcaggtgtgnnnnnnnnnngtgggtgtaacgtggattgccagaaaggactgtaacacaattttggtgcaccacctcatctcaggtgtgcaaaagtgaaactgtgccaggattgtatgtctccagcttacgcatcctcataatgcattgtaacaaacggaaggccgaagcaggtgcatcaattgaggcacaggctggcagaagtttggaagttgcttcagaatgtgaactcttcccgagataacttgggccatcccaacattatagttggataggctaacgaattatcttctgattcgtcggaatggggagagaatgctggcctttttggagttgttggcccgacttcctgtgaacgagcctgaaatgtatccnnnnnnnnnnaagagaatgctgacttttttggagttgttggcccaacttcctgtgaacgagcctgaaatgtatcctcgtgtcaggccaacgaaatcatggctggtctggtccctgtttccacttcacatggaggagctcacggtcgattcatcgcatacatggccatggaatgagtgatggctgtgcgatgctcactcgggactatcattggttcctctcttgattaaacaaacgccaggagacgacgcgagggctctcggatgctggtgtgcaggtgtacagctctgttcacgccatgcaaaccggtcaacaaccatgcgccgggaggttatgcgcgccgcagacatcctgtgaggagatataatgtcccatgcagttcatcgtccggtaagagcgagtatgccatgtgctcgactcatacttctctgcggcattattgggtggtgcggaggacgtgtgcaacaccccctgcagatgaagactccgtggagtcgctgttcaagaaagagctcgagaggcggaaaagtagagaagctctaggtcccagcgtaagacccccaagattgcgccagcctcctagcgagcccatggagcctccacgccggacagagtacgacattcctccccagttgcagaagtcacgagacctgaactccgagggcttgtcggtaaggagcaaggctcgtgggcatggcattgtcgggcggacttgcatgattgtgcaacatttctgtgcctgagcaatctactggtccacactcccttgtgcaaagcgcagggacttcccaagcgcgcttnnnnnnnnnnccgcatgattgtgcaacacttttatgcctgaacaatccactggtccacactcccttgcgcaaagcgcagggacttcccaagcgcgcttctgagctcttgaacctgggcatatcattcactcttgccttcacttcattcctactcattggcctggtagctttcggagcaatctatgcggtatgtgcgggggtgcacactctgtatccatggaaggatcacggacaagtgaaatcaaaccctggcatggatcagctgtcttacatccaaggtacatgacggtcacggtattcatcccaccccgaccccttggcaggtctttggtactagctnnnnnnnnnnagtcatggtattcctcccacctcgaccccttggcaggtctttggtactagctttgtgcatggaggagggagtcacttgccgcccagggtggatccagagcagctcttgcgggaaaggacacaagagccatttgtcttctaccactagaactcttggttgtgggtcgtgtaacaaactgcaaagtaagcttgcagtactacatcccaaaaatgaannnnnnnnnnttataattcttgattgcgggtcgtgtaagaaactgcaaagcaagcttgcagtactacatcccaaaaatgaacgctgtgtgtgttgggtgtggtgccaggacaggaatagtggaatgatccagccccacccctgcctcctctgcgcgcgccatcccgccccggtgatcacggaccttcaacgggattgatcgcgatcgattaacagcaagcctactcttccaccacgtcgtccttgagatgcagcgtcgtttgtgatggggaagggggccaaaaactccctggcgctcgctgaggcggggtccgtgctggacgaccccgtcttcacccccttcttggccgatgacttcgatgctgccaccttcgcgagccaagccatcgtgtctggcggtggatccgccccggctcacatgcgggagctgcgggagggcatagacaggctggaggcaggcatccgagagcacctgaacacccaccaggactccctcctggcctctgcggggtccctgggcagcgtggaggcagatctggaccgcacatccctgtccattgcagccctgcgcagcctcgcctctcgcgtgcgagccgatgtcgccggccccgccgcgagggtccgggcactcactcaccaggcgcggggcctgcagtccaccatcgacctgctgcagcacgtgacctacaggctcaagctcgtgtcccagctccgagccagtgtctccaacgggcaaggtgcttgatgattgggtgatgggacactggcgggcagcaattggtccggtcggagttgggctgtgctggcatcagggactctgctctgcttggacaggacctgccagggtcggcctcattgtcatcctatgcacatttggttcacgcacaagggtcggtacgggttatgctgagatggctttcccccacccactcccatttttcgctgccctccccaggcctgctggaggctgcatcagtagccaggatcttagcccagattcagtccctcgacgacagcaccagccgggacatgcgaggggtggatgtgatcagcgccgacgccgtcttcctcctttccacccgcgaaaacgtcgtccggcaagcacaggtctggcgcctgggctgtgggggcctgcgtggcatgcgctgccctcgggaacgctgaatcccttaaaccctgcgcccattgccggtgggctctgattgcgcgttggcctgcccagccttccttctgaccacccagccccaagagctgaccctctaacccccactccctccctctgcctgccgccagactgcgctgcgggagggactgtccagcctgagccaggcggacgtcggctcggcgctgcaggtcttcttcaacctgggcggcctgtccggcgcgctgcgcgcgcacctggccgccagcctggcgcgcgtggatgcagccagcacggcgtgcttagaccctcgccgcgcgcccgcgcgccagggcggcgccgcgccgggcg

SEQ ID NO: 42906 - DNA, 61 bp, Chlorella protothecoides
tgactgtagattctttgtatattggctaggggcgtcttcgctgttgcgacggctgcactgc

SEQ ID NO: 42907 - DNA, 138 bp, Chlorella protothecoides
atacctggggggaagaagggggggggggggaggcaggtgggaaccgggttccaaacgagaacgcaagagcaaggaaggttgcaggcacaccttgcactggggtgtccaggggcttgcagcacaactgggccatggtga

SEQ ID NO: 42908 - DNA, 64 bp, Chlorella protothecoides
cccccccccccccccccccccccgccatgaaatacatgccgctgagcccacctcgtcactgtag

SEQ ID NO: 42909 - DNA, 65 bp, Chlorella protothecoides
aaacctggaggccctgggaccattttccggccacgtccctcggtgccggagccgagccctcctcg

SEQ ID NO: 42910 - DNA, 126 bp, Chlorella protothecoides
tccaccacctccacgatgtcccccaccgccacctcgttccgggctgggggcgggggagtgcgggatgggggagcggttacggggcggggaggcaatgacaacaactgtgggacaccacccctcgga

SEQ ID NO: 42911 - DNA, 61 bp, Chlorella protothecoides
acgaacccggcctgagtgagctggctggggggggttgctggcaattttagagtgatctagt

SEQ ID NO: 42912 - DNA, 71 bp, Chlorella protothecoides
agcgagagcccctcctgcatcagtcatcagtagcaatcggtcaggggtatgaagtggcttgcgacagatgc

SEQ ID NO: 42913 - DNA, 160 bp, Chlorella protothecoides
cggcgcccagcgcggcggcgccgccgcaccccgcgccctccagcgccacccaggtgtccagcagcgcctcgccgcgcagcagcaggcgcgggtggcggcccagcaggcgggccagcgcctcgctccccagccccagcaggcccaggcactccagcgaggc

SEQ ID NO: 42914 - DNA, 61 bp, Chlorella protothecoides
tttcttggcaggttctctgcgctgacgggggattcttgtgaggaggtgctggggcgaaact

SEQ ID NO: 42915 - DNA, 4950 bp, Chlorella protothecoides
  modified_base (202)..(303): a, c, t, g, unknown or other
cggggcggcgagtgcgaaggcggcggcatgcacgccggccagcgccgccagcacgcaggtcgcgccgcctgcctcgcgtgctcgggcccagtccaggacctccgtgggcaccgccacgccctcctccaccatcagcgcgcggttgcccagcacgacgcgcacctcgcgcggcgccgtcccggcggcggcggcggcgggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtgaagccgcggccgggcaggggcgtggcgtcccagatcccggtcagccaggggatgggcgtgtgggctggggtggccgaggagggttgggggatcgtgccgccgtgcgatgccggcgcctgcggcgtggcaaggggggtgggagggtgggagggtgggggtgggggtctcgcgagacggggcgcgacccgacttgcgcagagcagagcccctggtgcggcgcgtgggcagtcacacccagagcgtggaggcaggccccggtggatcttgatcttgccccacacccttccagcctcgtcttctgcacccggccgcactcacctcatcgccccgtgcagcggccagtgctgccgcggcgcggccggcggccccatccccgacctcgggtccttcgaggctcgcctccagccgcaggtcgagcctcaacgccgcgtgcttcagcagcgccctgcccagagggtgctccgacccgctctccgcgcaggcaatcaggaagagcacgctctcctccggccactgtttgggaggtggggggcgaggggtagatgggtgaggtgtgtgggtagatgggtgtgggtgccaaacatgcactgatcacagacgccagacgcccagcaaaacccttcttcacccgggagtcctgccctctccaccctgccccgccaacaagaagcagccgtttccacccccacagactgaaaactcacgccgcaggcgtcctcgaagcgcgcatccaccacgcagggcttcccctgcgtcagcgtccctgtcttgtcgaacacgacgtcgctcaggtgcaccgccttgccaagcacctcggcggacttgatgaggatgccccggcgcgccgccacgcccgtgccaaccatcaccgcggtgggcgtggccaggcccagcgcgcaggggcaggcgatgaccaggacggcaatgccgaagaggagggagaagagggagggggtggtgcccgccggcagccagtcagcggggtaggcgccggccacgcccgcgccgtaccaggcggcccaggtgaccagggcggccaggatgacgccggggacaaagtaggcggagatgcggtcggccagcgcctgggcgggggccttggacagctgcgcctcctccaccaggcgcacgatctgagacagagcggagtcggcgccgacgcgtgtcgcgcgcacccacagcacccccccgctggcggtggtccccgtgatgacttcagcccccgagcgcttgggcacgggcaccggctcgcccgtgaccaggctctcgtcggcgtaggccgcgccgcgcgccaccacgccgtcggcggggatgcgcgcgccgggcagcaccttgaacaggtcgccgggctgcagcaggccggcgtccacctcgcgctcgctcgacacggcgtcggttccagggtcggtttcgcaaaggatcgcggtggggggggccagctccagcagcgcggagagcgcctgggaggtcttgcccttggccgcagactccagatacttgcccaggcacacaaaggtgatgagcagggcggaggtctcgaaaaaggtgccatgccccatgtactctgcaggcatgcgtgtgtgaagcggggggggtgtgtgtgcaatggtggcaggtggtgacaggggtgtgcgggtttgggccatggctgggaatgcagagctgcgcagggcccggcgcggcccggcgtccctgcatcaggggctcgtgctgccgcggcgcaccggctccaagccaaaggttcggagccacctcctcccgatcccagcatcagatcaaatcgactgctcccccccccaaaagaagaaagcaagaccaagcacctgggtgggccttctggtaggcgaccgacagcatgctgtaggcaaaggcggcgttggtgcccaccgagacgaggacgtccatgttggcgcggccgcggcgcagcgcgcgcagcgcgcggatgtggaacgtccagcccacgacgaactgggcggggccggcgaggagcatggggagggggttgaggggcgtgattcacagacctttgcaccccacgatgtctcctccaggccacatcgagcatgggcaggaccgccccccttccttcactgtcttccagttcccagacaccctcccagttcctctcctggacccacctggacgggggtggcgagagcaaaggagatgatgctgccaagggagaagccgttgacgctggactccagcacctgcttgggccccgggatgtacatgaggaccatgtcgaagaggaagagcgggagggcaaagatcaggctggccaggaacttgtgcttccagaagcggagctcgcgagctcgggcgcgggccccggcggccgaggcagcctcgcgcggggccagctcggccccgaacccggcctgccggactgcgcagatgagggcgcgggggccggtgagggcggcgtcgtaggtcacgcgcgcctggtgcagcgtggccgagacgttcgcctcgcggacgccggggatggccgccagggcggcgcgcaccgccgcctcgcacccggcgcacgtcatacccgtcacggtcaggctgacgctggatgcccccgggatggaggcggtgctgtcctcctccacgctgcacaggaagccgcagtcggcgatggcggccgcgagggccgtggggttggtgagggcgggatcgtactccacccgcgcctcagacagggtgagggagacagccgcgcggcggacgccggcgatcccggccaggcaggactctatgctggagctgcacccggcacaggccatgccctcgatccgcaggcgaaccacggagggctgccagcgcgggagctccgccatgggttgcgagatatctggtagggggttgggcgcatatgactgcgtgagggaggtttttgccatcttatgtgtacgatgtacacgccttccggtcgctgagccgacaggtgcagtcatgtaagtgccttcgtgcatactccatgggctagatcacttccgacaaatgacaccacgcagattacccctcgacccactttgtagatgactcacaggatatatctcttgggttttgatccgccaacttgcaaagtatgcggtattgctgctagtctcagactcgcgacgtccactcggcgggacccgacgcatacggaccggacgttgagaaagggggactacggaccgtactccctctctgggttcgcaggtccttccgtatgatttgaagccgcactgacggggagagggcacgaagaaaaagctgtgcaatggtccagcaacgggcacgtcatattcttttgagctgtatgtgacaatgcgcgcctcgcagcgctagctgtactttttcatgaccccccagcctgcgagactcgcgcccgggcgatgctgcggcgcccggcccgctaccagatgcgctgaggagtgatggctgacgcgatcccatcgaatcgaggtgcaggcgccgaggtgaagcttaatctcggtgccggggaggaggcacgccggaggacgcccagcgagtcatttgatgccgacacgcatgtcctgcgtaccacattctcattcgataagctaccggagagaacggtgcgtgggtcaaggaaaggaaaaacccctgcttgcggcgtttgttgcaccgtactgcacacctgcttctcccagtgtgctggcctgccctggccttgccacgagacccaggatgcccctcacccctccctgcgcaggcacatacgtggtaccagcgcggcatccagcgcctgcagcactcctggcgcgccctacccacggcgtgccgcgctctgctggtgcttgcggtgctgaatgccgcgctgaccattgcatatgcggcctccatctacagtgccggggacaatggcgaggccgtccatatcagcatcggcaccgtggtgagtggacaaaagggggtgaaggggagattgcagcgggtgcagaatgcttgttataatccccagttcttggcagtgcctgtgtggttgactccaattgcacaggcaactcgcgaccacatctatactcccccgttcccatgcatccgcccacacttccatcctgtccatccccccgcccagatctgcgcgttcttcatctgcgcgttcctcatcgatgcggtggtatatgaaaattctctggagagggcagccgccgtgatcataggtgagtggccggggaggacagggggccatgggcggcaggcctgtatcgcaggcacagcgtctccccgcacccgctgctgcttctcccagcagggcgtcatcttccctctcctcattcctcctggatcgccgtcctttccttaccaggctccctggtcctcatgcgcgtcgtgtggttcatcattcgcaaggagtccagcgtgaagctggtggtgctgtggggcgtcatgctctgctccacccagagtctcgtcatcgtgagcgaggggaaagcgcgggaaggggccgggggccaagtcaagctgtgtgcacgaggtggcctgccccgcattgctgtgtgagggcttgccgctcgaggggcggtcggtgttcatgctgtgcccctccagcgctgcctacaccgccagatcatgtcggaccccctgcccatcccccctgcccacgccctccttacccctcaaatccttccctcccccccc

SEQ ID NO: 42916 - DNA, 74 bp, Chlorella protothecoides
ctgggtgtatgtgtgtggtaaactttttctttacaggagcaaacctcaggacaggcaatatgtaaggatctcca

SEQ ID NO: 42917 - DNA, 3329 bp, Chlorella protothecoides
  modified_base (103)..(200): a, c, t, g, unknown or other
  modified_base (1269)..(1278): a, c, t, g, unknown or other
  modified_base (2715)..(2724): a, c, t, g, unknown or other
gccagctgtcgccaccggaggcccacgccctgctcgtgccggccatggcgccctacttggcctgcgagcccctggatgccagggtgggtgggaggggggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgacatcattgttggtgtcggtgggcgacgacagggtgctgctgctgtgccgcaggccgggagggtgcttcagtccccccatgcagcgcagcatcgccgcatcgccaaccagacgggctgtccatttggacgcctgttccaccctcacaatcacccgacccgcccgcccgccgccacataggatgtcacgtccctgacgcgcgcgctgcgggaggacaccgcgctctgcgtgccggacgccgcacgccccggcgctggtgcggcgccggcgcgggccctcgtcggccgcccgccctctgcctcgtcgctccgcgcgagcagcggctccttgacggagccggcgagaggaggaggcgcgcctcgccagggcctcggcgcggcgccgggccgggcgacaccgggttccagctccgccagcgacctgctggccagcatagcatcgtcgctgcacgcgggcgcatccctgcccgcgccgcagccgctctccggctcggccgggtcgctgccgctgccctccggcgccgcagccagctactgcctggcgctggactcccagttcctgcaccccgacgcatccctcctctccgccgcgctggagcagagcgtgcacagcgccggcggcaacgggcacttcgtgctgggcggcagcggcggcgggcgatcacacgcgcgtggcgccgccgccgcggggtcgctgctggtcccgcgcgcgcggcgcgtgccgcgcatctccgacccgctggcctcggcgctgcacatgggcagcgcatctgccgcgcagtcgcccctggtggcctacggcaacgccatgtatggtgagtggtggaggaaaggggggttgggaaaggatgaatggggtcttgtggcgggggcagaggccgaataccgggggcgaagatcgatcacatcacagggtctgcgctgtgaggcagagggacgatcatgcaccgcaccagggccccaaaggcccgatgcctctcatgcctcctcgccaccaacgactatgcgcccggccatccgcgatgccccccccccccacaccctttctgcaatcgcaggcctggatgnnnnnnnnnnctggaggaaaggggggtcgggaaagggtgaacggggtcttgtggcgggggcagaggccgaacaccgggggcgaggatcgatcacatcacagggtccgcgctgtggggcagagggacgatcatccaccacatcagggccccaaatgcccgatgcctctcatgcctcctctccaccaacgactatgcacccggccatccgcgatgcccccccccccaacaccctttctgcaatcgcaggcctggatgattcggggtccatgggtctgccgggcacggccgagagcagcggcatccagggcgccatgcaggccgcgctgaccaccgagctgtcggtggaggagagcgcgagccagatggaggcctgggcgccgcgcggcgccctggtcgcgcactttgccgaacaccaggcgtgagtttcgggggttgtgtttttggtggcttggagggggccgaacgaagtgactggctggggtggcgggtggagttccaggcctgcatcagacaggatctcagacaggggtgggtagttgaatgatgcatgcagagtttgggacttggagcaacaccattgctgcatgtggtggtgctgtacgggccgcctcctgtcatgtattctccttccgattgccgagatgttgcccctcccctccctataataccccctccctaccccccccaaaaaacaaataccgttcccaggggcgtgaaccagctggctgtggcctccagcggcctcttcttcgtcagcgcatcctcggacggcactacaaaggtgtgggacgggcggcgcctggaccgagacgtctccttccgctctcgcctcacctactccggtcaaggttgtgaagggtgtggaaaggatggaaactttccttggaaatggtaacttgtgtggcgttgtcagggtttctgtgacctccatcaggccgcaaggtgccacaaggtaggctgctcgccgcccgcccgccccgcgctggcaagagcatcctgggcacgacactcttcctcccttttctcaccccgccaggtggcaagatcaatgctgcgaccaccctgccggactcgtcctccgtggtgacagggtcaagcgacggcagcgtgcacctgtggcgcgtggacaccgtggcacgcagcggcggggagcgcttcaccggggtcaccgcccagcgccaggtggaggggggggaacagcgggaggaaggagggaactttggagaatgggtctcagcggggaggggctccagccataccctggacaccgtgtcatagggaaggagacctgggcatgcatcagtggccatgtcaggagtccctggaacgtgatcgcctacctggcctccatgcacagccacccgacgcacagtcatggaatcgccccgcgccagttcaattctctcctctccaacgtcgaccccgcagtgctcgggcgaggcgctgnnnnnnnnnncgcacagccaccccccgcatagtcatggaatcgccccacgccagttcaattgcctcctctccaacatcgaccccgcagtgctcgggcgaggcgctgggcgaggcgctggcgctggcgccctggggccacgcggcggtgctccagtcccacgcccggcgcggcctgtcggcctgggacctgcgcgccgcggagcacgcctgggcgctgccctatgaccccgcgcaggtggggggtggtgcgaacgatggcgcattcgcctgcatgcatgcttgcatggggtgccatggaaggggccaccttgcacatgctatcagtgcttctcaacccagggcccccttcaaccactccctcgcgctccccttctcccccccggcgtccaaatccagggtgtgatctcgtgcttcgtcaccgacccggccagccagaactgggtggtcaccgggtccagccgcggcgtgctctgcgtctgggacctgcgcttccgcctgcccgtgctgagctggcagctgggcgccggcgcgggggtggatgcgatggccctggccctggccccgctccccggcgagcggcgcggcgcgcgggggggcggcggcggcggcgcctcg

SEQ ID NO: 42918 - DNA, 188 bp, Chlorella protothecoides
tgggatactcgcattgaaggctggatgtgcatgtgagctacagaggcagtaggctcccttgagtcgcaaagcactctgtcccaggctggaaaaaaaccctcaagctcgccagtcctgccccgcgccccccgctcctctttctgaccccccctcgccctcccttcccccacataccctgcacccacctt

SEQ ID NO: 42919 - DNA, 110 bp, Chlorella protothecoides
cctcgacgcgagcgcagggtccccgggcgcttcgtgcgcctggccagccgaggaggtgctggacgggcggtcctgtgggagggcggcacactgatcccctggccctccct

SEQ ID NO: 42920 - DNA, 61 bp, Chlorella protothecoides
cctgttctcctgcatggctatggctgggggggtaagacactgcggcacctctggcaccctg

SEQ ID NO: 42921 - DNA, 87 bp, Chlorella protothecoides
atgtacctgcggcgcgggaggcatagggggtttgatcatgacttctgatattgtgtcgagcgggccaacgcacagccgctgtactgg

SEQ ID NO: 42922 - DNA, 61 bp, Chlorella protothecoides
ggtgcgcggtcaggcattgtaatggctcgggatgttgtctcgaatgctattggacaaggtt

SEQ ID NO: 42923 - DNA, 61 bp, Chlorella protothecoides
ccgccaactggctggcgagcagcggcgaggggcggcgcggggccaccctccccgaccttgc

SEQ ID NO: 42924 - DNA, 101 bp, Chlorella protothecoides
aagacaccctctcgtgccagccgacgggcccctgtggaaggtgcttccacccacactccatccagggatccgcgctggagactcctctcctccacccctcc

SEQ ID NO: 42925 - DNA, 110 bp, Chlorella protothecoides
cacagacagcaccatcacgagcctggggtccgcggggcggcgcgggccggggggaagcagccgctcgctggcctccctggtgccgccggcgcagagtgccgggcgcgacg

SEQ ID NO: 42926 - DNA, 61 bp, Chlorella protothecoides
cctggcctccggtgggtgctggcttgtgcaaatgggtgcacgtctgatgggtggccgggat

SEQ ID NO: 42927 - DNA, 74 bp, Chlorella protothecoides
atcgaggtcgctgcctgcatggtccccccctcgcgaccatcgttgcgcctcgtcccctcatgccctgggcacat

SEQ ID NO: 42928 - DNA, 44443 bp, Chlorella protothecoides
  modified_base (240)..(249): a, c, t, g, unknown or other
  modified_base (323)..(332): a, c, t, g, unknown or other
  modified_base (530)..(539): a, c, t, g, unknown or other
  modified_base (896)..(905): a, c, t, g, unknown or other
  modified_base (1551)..(1560): a, c, t, g, unknown or other
  modified_base (1831)..(1917): a, c, t, g, unknown or other
  modified_base (1990)..(1999): a, c, t, g, unknown or other
  modified_base (2166)..(2175): a, c, t, g, unknown or other
  modified_base (3450)..(3459): a, c, t, g, unknown or other
  modified_base (4317)..(4326): a, c, t, g, unknown or other
  modified_base (4404)..(4413): a, c, t, g, unknown or other
  modified_base (4513)..(4522): a, c, t, g, unknown or other
  modified_base (4926)..(4935): a, c, t, g, unknown or other
  modified_base (6862)..(6871): a, c, t, g, unknown or other
  modified_base (7124)..(7133): a, c, t, g, unknown or other
  modified_base (7649)..(7658): a, c, t, g, unknown or other
  modified_base (7775)..(7784): a, c, t, g, unknown or other
  modified_base (8356)..(8365): a, c, t, g, unknown or other
  modified_base (8776)..(8785): a, c, t, g, unknown or other
  modified_base (9519)..(9528): a, c, t, g, unknown or other
  modified_base (10059)..(10068): a, c, t, g, unknown or other
  modified_base (11531)..(11540): a, c, t, g, unknown or other
  modified_base (12066)..(12075): a, c, t, g, unknown or other
  modified_base (12803)..(12812): a, c, t, g, unknown or other
  modified_base (13612)..(13621): a, c, t, g, unknown or other
  modified_base (14065)..(14074): a, c, t, g, unknown or other
  modified_base (14253)..(14262): a, c, t, g, unknown or other
  modified_base (14991)..(15000): a, c, t, g, unknown or other
  modified_base (15309)..(15318): a, c, t, g, unknown or other
  modified_base (16204)..(16213): a, c, t, g, unknown or other
  modified_base (16929)..(16938): a, c, t, g, unknown or other
  modified_base (17303)..(17312): a, c, t, g, unknown or other
  modified_base (17591)..(17600): a, c, t, g, unknown or other
  modified_base (17673)..(17682): a, c, t, g, unknown or other
  modified_base (18072)..(18081): a, c, t, g, unknown or other
  modified_base (18519)..(18528): a, c, t, g, unknown or other
  modified_base (18924)..(18933): a, c, t, g, unknown or other
  modified_base (19511)..(19520): a, c, t, g, unknown or other
  modified_base (20047)..(20056): a, c, t, g, unknown or other
  modified_base (21455)..(21464): a, c, t, g, unknown or other
  modified_base (22067)..(22076): a, c, t, g, unknown or other
  modified_base (22848)..(22970): a, c, t, g, unknown or other
  modified_base (23074)..(23083): a, c, t, g, unknown or other
  modified_base (24058)..(24067): a, c, t, g, unknown or other
  modified_base (24278)..(24287): a, c, t, g, unknown or other
  modified_base (24547)..(24556): a, c, t, g, unknown or other
  modified_base (24714)..(24723): a, c, t, g, unknown or other
  modified_base (25056)..(25065): a, c, t, g, unknown or other
  modified_base (25713)..(25722): a, c, t, g, unknown or other
  modified_base (28590)..(28682): a, c, t, g, unknown or other
  modified_base (29248)..(29257): a, c, t, g, unknown or other
  modified_base (29978)..(29987): a, c, t, g, unknown or other
  modified_base (30068)..(30077): a, c, t, g, unknown or other
  modified_base (30425)..(30434): a, c, t, g, unknown or other
  modified_base (31059)..(31068): a, c, t, g, unknown or other
  modified_base (31703)..(31712): a, c, t, g, unknown or other
  modified_base (31847)..(31856): a, c, t, g, unknown or other
  modified_base (33237)..(33246): a, c, t, g, unknown or other
  modified_base (33976)..(33985): a, c, t, g, unknown or other
  modified_base (34069)..(34078): a, c, t, g, unknown or other
  modified_base (34754)..(34763): a, c, t, g, unknown or other
  modified_base (35202)..(35211): a, c, t, g, unknown or other
  modified_base (35684)..(35693): a, c, t, g, unknown or other
  modified_base (36692)..(36701): a, c, t, g, unknown or other
  modified_base (37513)..(37522): a, c, t, g, unknown or other
  modified_base (37905)..(37914): a, c, t, g, unknown or other
  modified_base (39829)..(39838): a, c, t, g, unknown or other
  modified_base (40049)..(40058): a, c, t, g, unknown or other
  modified_base (40265)..(40274): a, c, t, g, unknown or other
  modified_base (40917)..(40926): a, c, t, g, unknown or other
  modified_base (41311)..(41320): a, c, t, g, unknown or other
  modified_base (41562)..(41571): a, c, t, g, unknown or other
  modified_base (41838)..(41847): a, c, t, g, unknown or other
  modified_base (42290)..(42299): a, c, t, g, unknown or other
  modified_base (42678)..(42687): a, c, t, g, unknown or other
  modified_base (42881)..(42890): a, c, t, g, unknown or other
  modified_base (43183)..(43192): a, c, t, g, unknown or other
  modified_base (43566)..(43636): a, c, t, g, unknown or other
  modified_base (44092)..(44101): a, c, t, g, unknown or other
cggcggctggccgggggcagccgccgccccggcccccgcgcgccgcgccgggcgcaccagctccttcatgcgctgctgcagcaggggggcggggatctgcatgatgccagacagcgcggcggccacgtcctggctctcccccagctcctccgcgatgtgcgccaggatgtagtcgtgcttgggacgctgcggccccgccagcttcaccgccgccagctgaggaaagggggggggatgggnnnnnnnnnngaggatgggttgagggtggcgccccgagggtccaagggagctgaggagggctttgcggtcagcaaggaggatgnnnnnnnnnncggtgagggtggcgccccgagggttcaagggagctaaggagggctttgcggtcagcaaggaggatggacgctgccatgggtgagcgacggctgggcaggccagtctcaagagtgctccaaccccaccgggcccctcccctattcagccttgaccccgaccattggcatcagccgcgaccaactcaccacgtcgggatnnnnnnnnnngagtctcaagagtgctccaaacccatcgggcccctcccccattcagccttgaccccgaccattgacgtcagccgcgaccaactcaccacgtcgggatcctcctcattgtcactcacaggcacagtctccccgagcttgtctggtcatgggaaactcagcgagggagtgtgcaaaccaaaagagaggccatgaaaactctcctcacgcgtcagacggcaaaatctcttagaaatcccaccccaccggctgcacatcacgatgggcggtcggcgcacctgtgtaaaagagacgtcgcccaatcaccgtggcgggtgtgttgttcctgttgaaggaccagcccttgtaagggggcagggnnnnnnnnnnaaggccatgcaaacttacctcacgcgtctgacggcaaaatctcttagacatcccaccccaccggctgcacatcacgatgggtggtcggcgcacctgtgtagaagagacgtcgtccaatcaccgtggcgggtgtgttgttcctggtgaaggaccagcccttgtaagggggcaggggtggcttgctggggattgtccagcagggatggaagctgactgacatcaaagggggcttgctgttcaggatcatttccttccccgccgggatcagctttctgtaccctgtagtcccgacggcaggccagtcctccccagagccgagcatgggaatggtcatggggggcttgccctccatgcgggcggcttgcaccgccctcagcccctgcagagcggcatccagggccgcgcggttggcctccttcaccgcgcaggcttcctcccttctgtcctcctcatactgccgggacagcttcctgtgcagcgcccgcaccctgccgcgcatcgccgcaccgaaggttgtctcggcatggtgccgtgtcgtgctcagtgtgagtctgctgagttcctcgagcggcataagtcgaaggatttcctctcataatcgcagcttggccatgccggtgatcgcttcagatgtgaataaaggggnnnnnnnnnntcgtgtcgtgctcagtgtgagtctgctgagatcctcgagcggcataagtcgaagatttccctctcataatcgcagcttggccatatcggtgatcgcttcagatgtgaataaaggggacaggcgtcagccgtcgtgacctggcggcagagagtctacgaccagccccacgatgcgcccgtaaatcataaaatgagccccggtatactgcaggaattcaatgcattgagtcgacggtgtccattctgctattgctccgccgggatcgcactcnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaggcttgagtataatttatccaagtaacatattccattcgcgggaagttaggatacgcaggggtgacatnnnnnnnnnnggatgcgcccgtatatcatcaaatgagccccggtatactgcatggattcactgcattgcgttgagggtgtccgttctgctattgctccgccgggatcgcactcaaatgtgcaatatctccgtgacgatctcgcgctctcacaagccaagtagcctggctcctccggnnnnnnnnnnctggggcctgagtataatttatccaagtaacacattccattagcgggaagttaggatacgcaggggtgacatcgttgtcctgtgactagaacaatcggggggcgctgcctgagcccctgtgaccacgatcggacaacccatgttctcgggactttacggcgacctcccatccgccaaaggggaggatacgaaaccctcagatggcccctgggtcggcaaaggcctggtggcaccctccagcctgaacgcccggcgagctgggccaggtgcctcggcccccatgccccccccctcggtcctgcgcgccggcaggggccggggacgggagggtcccggccccgtcgctcctgggcgcggaggccgcggcggccgagggccgggccctggtcccaccgcccccccagctgaagctacctcctccgccgccgcggcgatcgcgtctgcggcgccgctgccgcagggcagcgcgcccagcgtggcagacgagtacgaccccgcccgccccaacgactacgaggcggtgcgccgcgcgcgggaggccaagcgcctggaggcggaggcggcggcggcgcgccaggaggcggcgcgggaggcgacggaggcggcggcgcgactggcggaggacgtcgcggcgcagaggcatgcaccccccgcgcccgctgacgagcggtcggccaggctggcgctgagcggggaggaggcgtggcagaagcgaggcgcgccgcagcgcccggcctgggccacggcgcaagaccccggggcgggggccgccggtccaccacaggccgcgccgccggcagagaagaagtccctggcgcaggtgaggggctcggagtgtgccagtgcggtgacttgtgattggactgcgtagggttgggggctggagcttgtggatcggaggttcacaggagagttttggtcggttgagtctggccctggcttccagggtgatgtttctcggagaatcctcagggaactgatcatggtgtgggcatggcattcaaaggcccgtctgcctcggtctgacccggttgctttcttaacgctttccgtgcacccctggcgctgcacagaaaatgctggagaagatgggctggcgtgagggcgaaggcctgggggccaaccggcagggcatctccacgcccctcgccgtccagaagacggatgcccggtccggggtcatcgtccaagcggcccccgccggtgccaggggcgctggagctgccatgactgaggtcgcgggtgcccggggactaccccctgcgggccccgcgnnnnnnnnnntgtcatcgtccaagtggcccccgccggtgctaggggcgctggagccgccatgactgaggtcgcgggggcccggggactaccccctgcgggccccgcgacgcgtgtggtcctgctcaagaacatggtgggtgggagaggggtgtgggagggggcccgcatggaggcttttcgaagcagcgacgcatggcgatgcccacagccgactcgagaatgcttatgcaggtggggcctgggggcgtggatgacggtctggacgaagaggtgggggaggagtgcagcaagtatggcactgtcaccaggtgagcgggcgctggtggtgcaggggcggggccttgctgccaggggtgcggtgatgctgcatcggagcaacatgcgccgggtgccgtcgctgcctgcatgccggaccttgtcgaagcatgtgcccagggccacaggcgccagcccctgcctcccatccccaaccctaccccatctttgtctcctgcctgcgcatgcagcgtgctcatattcgaggtcaccgagcccggcttcccggtcgaggaagctgtgcgcatcttcatccagttctccagtgccggggaggccacacaggtgggtggcccggtggtcgtagagccaaacctcagcagaatcccttgttgcagagttttacctggatgcggacaagtcttgcacaccccttccggcacatccaggccatgctggacttgaatgggcggttctttgcgggtcgcgtcgtcgcagccaccttctacgatgaaaccaggtttggtgcatcagacctggcgcccagtcaagaggagcttaagtccctggaacggtgatgatgattgcaaggtctctggcgatccgaccatnnnnnnnnnnggcagaaccccttgttgcagagttttacctggatgtggaaaagtctcgcacaccccttccggcacatccaggccatgnnnnnnnnnngcaagctctggcaatgggatacgtgggggtgggggcagcgcaggtacaatcgatccagacgggggccctccagcttcttctcaagtctcttgtggcgggnnnnnnnnnnccaagctctggcaatgggatacgtggggtgcgggcagcgcaggtacagtcgatccagatggggcccccccagcttcttctcaagtctcttgtggcgggagacccacaggatcacctgatggttaaggggacccacatgacaatctcatgtacaacagaccccagaggcgcattaccgcatacaatcgagctccggaatcgcattactccaggcaattaaagggtagcgagtcgggggccccgtctgagtcgtttcgtctgcgatggattcccgaccggagaacggtcccggcagcaagcccattgaccaagtctccagggtacgacattgcgggggcgataaaatgatgattgagcctaaaatgtgcggccaagcctccccagtctggccgccgcgccgttgtnnnnnnnnnnacgcatacaatcgagctccgaaatcgcattattccaggcagctaaagggtagcgagtcggggccccgtctaagtcgtttcgtctgcgatggattcccgaccggagaacggtcccggcagcaagcccattgaccaagtctccagggtaagacattgcgggggcgatagaatgatgattgagactaaaatgtgcggccatgcctccccagtctggccgccgcgccgttgtaaagctcacggatccatgtcggggattatgaatctgcactggcgatcgcacagctcacggacgagccctccgctccatgtaggactctcggaccatggcgctacccatgccgtactacggctccaccatgccctttgatgccgacacgtgcgtatgggtgggggaggtgtatcggcccaccctgtgggctgggttttagtgctgcgggtattactaatcaccttccccatgcgatccgcagggagtacaaggtcgtccagcgcgagcaggtggccaaccccgcacccctgggcctctttgcctttggtgcgtggaaaatagaccgtgttctgtgggtaacatttctgaatagggctgcgctgtgtggctactgtcgcacttgcatcatggcaccctcgacaggagcaaggacagtattaaatagaagccgacaccctcctttcttctcaatccccctgccgcacgccaggcctgaccacggccctgctccagggcgccaacacggccatcaccgaccccgagaccaccgagttctgggtgtttgcctatgcctttgcctacggcggactggcccagctgctggcggggatgtgggagtacaagcgccagaacacctttggcgccactgccttctcctcctttggcgccttctggatcggtttcgccatccatggcaccctggtggccaacggcttgtacgtggcctcggccggcgccgcccagatcacgctgtccctctggggcatcttcaccttcatcctcatggtggccaccctggagctcaactttgcgctcttctccctcttcatcaccctgtccaccctcttcttcctcctggttgcggggctgaccacgcccaacccctggaccaagattgcagggtggtggggcctgatggtggccgccatcgcctggtacatcgccgccgcggacgtgatcaacgagcagtacaagcgcaccgtcctgcccgtgggccgctggagcgtgggcacccccctggccaagggcctcaaggcggcgctgagcaagatacccctcctgggcaaggcctgcgtggcggggatggaccgcgaggacgcgctgtccggctacaccaagaaggcagaggacctggagcggccgggcacgccccacgactaccgcgccacgcgcctgcacaacaaccactcgctctaccagggcgcatgggacggcgaggccgtgcgctacgagcaggaggccaggggcctgggctccgcggtcgggccttactgaggagggggacgtgaggagcggagggaggttaccgtcccaaagccccgtgatgaacacaacccagggaggagcccctcccgacgaataggaacactggtaccagtgcctcggcccttcagcggcgagccagagttttgcttgcatgattgcctcctcattaccgttatggagacagaacaaaccggatggtgtgacacggtgctgaccagggccgcgaacagactgacaccgcgggtggcccccatgcagcagggtgcagggcggcgtggggtggaatgagaaggcgcgcgctcaggggtcatggcgacaccagtttccgcaccggtctccgggcgcgtgacgattcgacggtgggggaacctgagactaaacaacaccgaagagctcggcatgatctgccagccgggagccagtttcgtagcgatgggagaaacacaggccgttnnnnnnnnnnacgacgattcgacgatgagggaacctgagagtaaacaacaccgaagagctcggcaggatcttccagccaggagccaggttcgtagcgatgggagaaacacaggccgttgcacgaaagtgatctcccagagtgtcggaggggaggctgtcgagatgcgcggctcacccatcagccgcgtctgcatcgttattttcattgcgcaggcgtcatgctccaggtatacaggcgggcgccatgaggcatgtggggggcnnnnnnnnnntccatcatccgcgtctgcatcgttattttcatcgcgcaggcgtcatgctccaggtatgcaggcgggcgccatgaggcatgtggggggctcttgatgcggtcatgcactctctctgccagccatgcagcccagcatggcccccgttcctcgatcccatacagagccggcgaacattccaccggcacctgctccacgctgggtatctgcggtcatcgagaggatggggacgtgctgagctgtgcagagacgcggccagccccgtccatgaactccacgggcctgtccaagctccagctggtatgcccccagctggcggcagagcggggatccgatccccacttctgctgcactgagcagcagctcgacacaatacagagccaggtgggcgctgctaggggatggcacaccagggcgtggggagggagggcctgctgtgatcgttgccaggagcctaggattagatctgagcaaggtgggcccagtccttcctcgcccagggacaccctccagcacctnnnnnnnnnngcagccatgcagcccagcatggcccaagttcctcgatgccatgcagagccagcgaacattccaccgggacctgctccactctgggcatctgcggtcatcgagaggatggggacgtgnnnnnnnnnnattgccaggagcctagggttagatctgagcaaggtgggcccggtctttcctcgcccagggacaccctccagcaccttgccaatatcccgttcacgcacatgtgcccatgcagatccagatagctaacatttttctgctcggctgccccgcctgctcccacaacttcaagcacctcttctgcctgctggagtgccaccccgaccaggcgaccttcactaacgtgactgccacccagccagcacacgacaccggggtaacctccgttgccaacgtgtcctactacgtcacaccgcactttggccaggcactctttgacagctgcaaggatgtcacctaccctgtcctcaaccaaaaggccatgaagttcgtgggcgggtgagcatgaagttggtgggccgggtgcccagggggaatgtgtgggatgcatgtggtttgtggagagcttgagcaaagctgggctgtgtcctccttcggtcttctccatcaccctcgcactggtagcacctcgctcacgaggatcacgatcgtccccttggtatccacaccacacaggggcgcccaaacctaccagnnnnnnnnnnagtagcacctcgctgacgaggatcacaatcgtccccttggtatcaacaccacacaggggcgcccaaacctaccaggagtggctggacttcatcgggacggtcaaggacgcccgcttcccacccacggggtcgcccttccagatggacttcccgccgctgggcgagcttccggaaaggatgcgcgccctcaacgcctcgctggcctcctgctgcgagggccccctggcctgctcctgcggggactgccctggtgccaagggctgcaagccggtgggtcgggggtcacgtgtgctttgggtttggggggtggttgatgggatggtgtttggcggaacttgggcagtgtggacccccagtgcccagcccttgatccccccccacccccttcccacacccaatcattcccgcccnnnnnnnnnnctcgccctgcccttgatcccccctcccccttcccacacccaatcattcccgcccagcccccgccgcccccgccggcggagcactcgcgctgctccgttcccggtttcctccccggcctgcgctgtgtggacctgggctgggccctgctggcgctgctggcggcggtcgtcatcccgctgctggtccggcggcgctgcgcgcggcacgacccctccggcgagggcatgccggacctgccccccggctacgcgtcggcgtttgagggtgccaagcgcggcggcctggcctccgacggcgagctgctggactacccctccaccgagaccttcctgcgccgcgccttcttcgacctgggcgagctctgtgcccgccgcccgggcctcattctggccgccactgtcaccgcggccgggctcgctgcgcttggcctgttggcccttcgcatcgagtccgacccggagcggctgtgggtggggccggggtcgcaggcggcgagggagcaggccgactatgaggtgagggagagggagtgcgggggctgagttggggtacaggtgtggcgagtggtgcagggtggctgggagtgggaagtgcgtgccttgctgatgccatgtatgggaacccagcagcgcctgcatgtgtctggcccctggacgctagtgtcgcatccgcccgctcgccacacgccgaccgcccgcaccgtccgcaccgcccgcaggcgtccttcggccccnnnnnnnnnnggtgttgcacccgcctgctcgccgcacgccgaccgcccgcaccgcccgcaccgcccgcaggcgtccttcggccccttctaccgcatcagccagctcatcctgagcaccggcgagggcggcggggccatcaccaccgattcccacctgcgcacgctgtttgccatgcacgagctcgtggatcagctcgcggcgccctacggcgaggaggctggggcggccgggaacgccacgctctcctccgtctgcttcaagccgctgggtgctgagtgcgccatccagagcgtggcgcagtactggcaactcagcgtggatgtctacgagcatggtgggtgtttgggggtgggggtcctgagtggctttgttttggtgctgattgggtgtcggtgtacctgggcattggggactgagacagtcatgtgcgaggtcggagtggaggaaggattgtgccgagcagatgatggtcccttacaccagtgctcttctcctttggccttggtgcatgggctgcccagccctgcctggtcgggtacnnnnnnnnnnatacctgggcgttggggactgagtcagtcatgtgcgaggttggaatggaggaagaattgtgcagaacagatgctggtcccttacaccagtgcgcttgtctttggccgggtgcgtgggctgcccagccctgcctggtcgggtacgagcatgctcctctggttttgcacagcacacgttccctccacctcagcatcccccagaagagctcccccccattcccacgcgcaggcagcccgcccatgatggtccctgtgacacctgagttctgctatgggcattggaacacgcagtgcctgagcgcctatggcgcccccattgacccgcacgtcgtgctgggcggcttccccacggccgccgcggagttccgcaatttttcggcggatgccacggccttcgtggtgaccttcctcctcgaccccgccccggcgctgcggtgtgtggggagtgcgatgcttgagttagggtttggcctatgtatagataaagaacttttgttccgcatccctactctccgtcaatatccctccctcgggctgttcctggcattctgatcgccctgtccctccccacttgcacctacgatcccaacccaggccggctgccgaggcgtgggaggcggccttcacgatgctcgcgcatacgcgcctacgcagcatggcggaggaggccggcctgcgcctgtccttcagcgcgcagcgctccgtggcggatgagatctcgcgcgagggctgggccgatgcctggacggtggtcgcctcctacgcggccatgctggcctacattgcggcggccatgggcaccttcccgcgcggccaaccccgcctcctccactcccgcatcggcctggggctggcgggcgtgagctgcgtggccgcctccgtggctgcggcgctgggcttgtttggctgggcagggacccccgctacgctcatcgtcatggaggtcatccccttcctcgcgctggcaggtgtgggtgggtaatcgtaggtggaaggcttgggggggcaatatgtgtgtgtgatggggatgctagtcttagatgcaagatgtcaggaagcagggtgggcattattctgcaaatctcccgggaaagcctggttgccaaggacagtgcagtaacacaggatgcgtgggttggagtgccgccaactattcactggcctggtgcttcaccactctctccgtccccacagtcggcgtggacaacatgttcatcctcgcctcggcgctggagcggcagcctcgcagccggcccctcccccagcgtgcggggctggccctggccgccgtcgggccatccatcctcctggccgccacctgcgaggtactgtcattggcaagggtggcatttgtgggacattggcttgtcagcaatgctttcaaggggcaaaaggcttccgatcaggccagtgtggcccattcctggcacgttgtgttgtatgcccgtccctgatccagaactnnnnnnnnnnctcattggcaagggtggcatttgtgggacgtcggcttgtcagtgttgctttcacggggcaaaaggcctccaaccaggccagtgtggcccattcctggcacatcgtgttgtatgcccgtccctgatccagaactcctctcacacttttggccccacccactcaccccctcaggtggtggcctttgccctgggcggcatgaccaccatgcccgccctgcgctccttcgccctctgcgcggccctggccgtggccctggactttgggctccaggtcactgccttcatggccgtactggtgttggacgacgcccgcatcgaggcggggcgggctgactgcctgccctggatccggtaagtggtttgagcgatggatttgctgcaacctcaaacgggccaattgacgtcatcccttgcatgcaggtgctgagctccttggcctctaatgtcagagcctgtgctgccggcatgtggttctccgttgccatgcccaattccttgttgcaacctcttcccccagcacacagccnnnnnnnnnntatggatttgctgcatcctcaaaaggaccaattgacctcatcccttgcatacaggtgctgagctccatgtcctctaatgtcagagcctgtgctgccggcatgtggatttccgttgccatacccagttccctgttgcaacctcttcccccagcacacagcctctccatgcacacctcccactcaggctgaaggatacaggcagcagggcgccgctctttggaagcgaggagctggaggctgaagaggaggaaggggcggaggcggagacccggcttttaagtgcctctggacccggcttcagtcagggtgggtttgaggttggggcaagggcatgctggggaggcatcggcgtccgtgaggattctccggcagcatgggccctcaggagtcttaacttcacaccaacatgtcccgcctgcagccagaatgcacagggcatgtccccagccttcaccccttgttctccctggcagatgacgacctgggcgaggcctcctggggggagcgcagcgtcacgggcgcccttcgcgccctcatccgcgaccgcctggtcccggcgctgcgccgcccagcggtgaagagcggcgtccttgtgaccttcactgtcttcttcatcctcagtctggccgccctgcctcgcctggaaaggtgtgtgactgggggggtggctgggaagttttgctgtggtttacagaggccagccaggggaatgttggatgcgaggcagnnnnnnnnnntggggtggctggggagttttgctgtgatttacacagcccagccaggggaatgttggatgcgaggcaggggcacttttgatgtctccaactgcatgcttccgtttgcacctggaatggcagcccgggcagttcccataaaagccaccaggtggccagcattgacagccccaatactctgccgccactccgcctctgtcacgctcaccaagccagcccatctcaacctccacaggggcttggagcagtccacggccctaccggccgactcctacctgcaggactactttgctgacgtggcagggctgctccgcgtcggcccgcctctcatcctcgtggtggaaggcctggacctgacccagcacgcgcatgacaatgtcaccgccatatgctccgtgtccggctgcgacccagactccctgctcaacgaggtgggtacctgtgtcatggtgttctctggatggcaagggcttcatgtgtcctctggcgctcctgatgcattgacaaccaggtgcgtgtacagacacctgtgatgaggtgtgcgagccaggggtaccctccctttcaccccccaccctctcaccccaacaccctcccaaacaacccgtcggacaggtgtcgcgcgccgcgctcgcgccctggcagtccttcctggccgcccccgcggcctcctggctggacgacttcatcacatggctgtccccggacgccccgctctgctgccgtcagcacgggggggaccttggaggtggtattctcggcctcggccccaatcctgaccccgcctactgcccgccccccgnnnnnnnnnngccggacgccccgctctgctgccgccagcacgggggggacctcggaggtggtattctcggcctcggccccgatcctgaccccgcctactgcccgccccccgaccaggagccctgcgcctctgatcccaccgcctgcgccgactgccggccctgcctggggccgggcgagttgtccgacggccgccccactctggcccagttccaggcgcgcctgccgtggttcctggcggctaagcccagcgcggcctgcgccaagggcggcgcgggggcctacgacgccgctctgcgccgctctgcgtccgatgccaccgccgtcgcaggcctgtcccggggcagggtggacgcctccgccttccgcaccagctacgtgtctctgtcgcgccaggccgacttcatccaggctctccaggtttgtgggattgggaggaggaagatggattggcnnnnnnnnnngctctctcgcgccaggccgacttcatccaggctctcaaggttggtgggattgggaggaggaagatggattggcctgaagggggtgggatcacaaccattcacacagcgaagccagggtcatctccgccccagttctgacattaaataactcaccctctccccttcttcacccaaaggcnnnnnnnnnncatcacaacatttcacacagcgcaggcagggtcatctccgccccagttctaacagtaaatacctcaccctctccccttcttcacccaaaggcgtcgcgtgggtttgcggaggagcagtcgcgggcgctaggcctgcaggtctacgcctactccatcttccacgtcttcttcgagcagtacctgaccatcgcaggcgaggcggccaccatcctgggcatcgccgccaccgccgtattcgtcatttgcctggccatgacaggtggtgtgactgggtttcgaagagcggtgggtggggggccaaaggaaggatgtgcatgcccgactgtattctcctgacctctccacccacccctttgcaacccctcccgtcaccacaggcagccctgttgcggcctgcctggtgctgctgaccctggcttccatggtggtggacttgctgggcctgatgacgctgacggggatccagctgaatgcggtgtctgtggtcaacctggtcgccgccctgggcattggcgtggagttctgcgcccacctgctccacgccttcatggaggagtcgggggatcgggagcagcgcaccgccgcggcgctgacgcacgtcggcgcggcggtgctggccggcatcaccctcaccaagtttgtcggtgggtggtggagggtctgagcgtgttggattccgaagagagcaggagggcatgggtgcatgggttctgaatgctagttgcgacnnnnnnnnnncgagcgtgttggattccgaagagggcgcgagggcgctggtgcatgggttctgaatgctagttgcgactacacatgggtggcccctgcaagctgtggcaccgtcatgcactccactggtgttccgtttgtgatcaggaggcagagcagcatgatgagggcactttctaggctactgtcttctttccatcatacacacttcgcacagttatcccatgccccgcctcctcacatcagcgagcgcctccaggccacatgcctccaccgcaattttgggttccaggcactgctccaccatgctgccagcatctnnnnnnnnnnccccccaggccgcatgcctccaccaccattttgggttcgaggcactgctccaccatgctgccagcatctccccgggatatcttcacgccctcttgaccccaaacctccacttcatcgtccctctcgatcacgaccacgctcatattgcccccccccccaaaaaaacaaatccaacccgcaggcgtggcggtgctggcctttgcgcgcacccagatcttccgcgtctacttcttccgcatgtacctggcgctggtgctggtgggcgccgctcacggcctgatcctgctccctgtcctgctgagcctgctgggccccagcgcctgggaccgctgggagctgtgccccgcgccctcggggcggtggcgggggtcgctgggcgccgcgctgccctccgagctgttccgggacgaggaggaggaaggcgtgggcgcgtccctggcggcgcagggctccgcgggagcaaggtcggggaggggctgaaccgattacgtgagtgaaggggccccatgcatgcgacccaccgcctggcaatgaatctgcctgtcccgagtagggggggatgggagcctccctggcctgcaagtggttgaagtcagcatgatcattctacgtgttgcattgtttgtggcagggtgatcccaataggaaaaagtggagtagataccacgggcagctgagggatacgcacagtcgcggccacacggacgcccacaccgcctggggggtcagggtctccgcgccatgctttcccccccggggccctcgggccgccggccccgcacgccgccggcccccacgacgaactcgcagcgcctggcgcccaggccagggccccagaccaggtgcaggacgcgtggcccaggcgctccccccccggcggcgtgtnnnnnnnnnnggggccccagaccaggtgcaggacgcgcggcccaggcgctccccccccggcggcgtgcgcggcgaagaggcgggtgttgacgcaggatgcccaggccaggcccagcgcgggcgtcacttcgcgccccgaggtgagcaggggcgcgccgcccgtggcgctgcgcgccagcgccgcccccggccccgccaccacgtccgtcacctggttcgtgaccagcaccgcaaagccgtggcggtccgccagcgcgcgcagcgcggccgcgaggcggaagaaggtctgcgcccgggccaggagctcgcgtcggccggggctggggcccaggtcgcggagcggggcggccagggagtcgaccaccagcaggcgcacgggggctggggtgcccgcgacgcgggccagcaagggctgcagggccttgaccctggccagcagggcctcgccgcagtcgacgccgcgctccacaaacacgccggccactacgtcgccggcggagaggggggttttgcggcgtgccacggccgcctgggccagctggtgcagcctgtccaggggcgggtcgccctcggtgtagatgtacctggaggtggtgggtgtgctcggtaaagaggggggcaatgaaggggtgtggagggggcgcaagcttctggtgaaggccatgaaagacaggccaatgggccacatttccatgcaaagtcccagtcatcctcaaaactcacacnnnnnnnnnnttcggtaaagaggggggcagtgaaggggtgtggagggggcgcatccttctggtgaaggccatgatagacaggccaatgggccacatttccatccaaagtcccagtcatcctcaaaactcacacgccggagccaccgagggagaggcgggcgtggaccagggcctgcaggcacagctgtgtcttggcggtggtggcctcccctgccgggtaacaaggagcagggcgcgggtcggcgccagtgatgggcaaatctcggattgggatggagtatgctttgattaaattaacacacatactcgtatcggccccaaacacttcccaaactctccgctcgacccggacccatgacccacccacgagctctnnnnnnnnnngtctcggattgggatggagtatgctttgattgaataaaaacatatactcgcatctgccccaaacacttcccaaactctccgctccacccggacccatgacccacccacgagctctgtgatgctgccgctgcttagcccgccccccaggaaggcgtcgagaatggggcaccccaagctgcacttgctgacctgcaagctctggatgcgccgtcgggcaggtcccgatttcatggcagcgagtgccgaaatgggactgtctcggtcggctttgaattcgcnnnnnnnnnntcacccctgcatctcctagaacctaatccatccgggagtcacactgcatcatcgtcgccagccaacaggccannnnnnnnnngggtcccgatttcatggcagcgagtgccgaagtgggactgtctcggtcggctttgaatccgcgcatgcacgcgatgtttgatcctgtgtgagatacaacctggcctcgctggtcaattggtgaaatctgatagacgaagcccaagcaatccttggtaagagatcagggaaccaccataattcgatcattgaccctcagagtggaagtaatgtccagcgttgtacttctgctacccctgcatctcctagaatctaatccactcgggagtcaaactgcatcatcgtcgccagccaacaggccagctacattgaaacacaatggccagtcagagtcaggggcacacgcataagagcatgcatgacctcgacgggaatccctcttgaccatcgnnnnnnnnnnagaccagtcagagtcattggcacacgcataagagcatgcacgacctcgacgggaatccctcttgaccatcgaaatgcatgccatctacaggtgagcgaggggagacggtacacggggtcctatacccccaaccagacagattttatacagcgatgggaaatgatgacgtgtacttttccctcgacgggtgtgtctcctgcggccggttcagaggggtccacaccgggtctccgatgaagagtctcagggcctgagggtgggaggcatgcgacgagggcacaggattgaggaggaacattgatctgatgcacgcctgtgccagcaaagcttctgcagacctgttgcacacactagtgcggatggaggtacccttctattgcatgcaactaggccctaggtaagtgattatgtacccactccagcttctgcaccatcccnnnnnnnnnnccctgttgcacacaccagagcggatggaggtaccctcctattgcatgcaactcggccctaagtaagtgatcatgtacccactccagcttctgcaccatcccaaagcagcttcaaactgcgcaccttgatgtggttgctggtgtccagcgtgaagcggtggtagatcccctcgggcagcaccaacatgtcccctgtcttcacatggatgcggatccagcggtcctccaggtcccgcacgtcaaagtatcctgtggaaagggtgtggaaaggaagtgtatcgctcagagggactggcttgcagcttctgaattgatctagtaagaggttgcacgccgcatggctctgcagagcatgaatacgctcttgtcccatgatgcacgccaccatcatatccannnnnnnnnntttgcacgccacatggcgctgcagagcatgaatacgctctagtcccatgatgcacgccaccatcatatccagggaccccccaaccagccgccgcaccgctgccttccagcacgaatcggatctcctcatcagtgtggatgtgctcctcaaagaaggtcttgatcttctcatcgtaccccggaagggtggctggcgacacgtcgatggtgtcctgtggcaaagaggcgatggcagtgtgtggtgcctggagctgcatgggcgggagtgccaaggtctcggcacatgccatgcgatgtcctgatcagccacactcgcctcataagtgtagtttcggacgcgcctgatcgcagcaagcttctgtgctccttcgggagtgtcggggttaagcctccagctcagcacacccagggcacgaagtgcctggggtggcgcaggggaattgggctccaacctgcatggggtgaggaggaaatgcaacggccttgaccgagagcgagcacaaggttttatgaggatgggcctcttcaaactcgcatggtatccaggacagacccaggctgtcccacctatggggcagnnnnnnnnnntgaggaggaaatgcaacggccttcaccgagagcgagcacaaggtattatgaggatgagcctcttgaaactcgcatggtatccagggcagacccaggctgtcccacctatggggcagtcgctggtcctcgtccaggccatccatgtagtaggcatccagctgcacatccgacagtgcgtccggctgcgaatggtatgaggtcatacttacaacgcgggttgctaaagatgtgcctgcacttggtttgcgaattcattctcacctcggcaaggaggaagtcttcaggagagggtgcgggtgccatgacgtgcgctcaagtaagcaagcgtatgtatcttcaagttctcgaagccgataagcattattgcagatgctcaggagcatgccacaatcgtcatgtactttgtgagacggaatccctgtgtgtgaaagtgctgctggcaccacgtgcctcctcgagattccacgagggggaaatagtcccaagccaccatatttgtgatgcccagcctgaccacatatgcaatnnnnnnnnnncattgaagatgcttaggagcatgccacaatcgtcatgcacttcgtgagacggaatccctgtgtgtgacagtgctgctggcaccacgtgcctcctcgagattccacgaggagaaaatagtcccaatccaccatatgtgtgatgcccagcctgaccacatatgcaatgtgtaacaatgcgcatacacttgtaaaagtactcgtgccaacgctgcgcgcgtctgtcggccaactagactcccaggatcacttcgtagggccacccggctccatgtggagctcggcgcctgagacggacgagtccgatgccatcatagagcatcagatgcggatgtatgaagggcagatcgaggagtgcgagctggccaaccctgtgccatactgggacggtgggtgcgaagaagagctggggttccacatacatagctgcgtttcaggcatgttgcctgccactgacgagaccccatccatgccggcccaggttacagtgggctcgtgagagtgagtgacgagggcctggccttgaagctgcagcaagcaagccagcggcaccacggccagcgggggtcagaggcagctaccctgcagctgcccactccctttgccagcagcgacgcggaggtggaggccccgggccctggctcgggcggcgttctgctggccacctgccgcagcctggtggaggcggggcagctggcgggcgcgagcgccctgctgcgcacgctactggccagcacccccctgcgccgcgtggacgtggtggaaagcgcagcggacctcctgctccaggcacagggctgggaccgggcgctggccgccacgccctcgccccggcccgcctgcgcgtactcgcgggagctgcaggccgcgatggactgcctacgcaggtgacggttgggtgtgaggggaacgcaacggctccgtttgaagaggcggccatttgtatggtaaggaccggggttaccacggcgtcacaccacgtcatcccatgcatccctctgcgcaggagcgagccgcggagggccctcgccatcctgcacaaggctgagcaaagtcttcccagcggcgacggaggctgcgaggcagccaggcttgagattctgcgcgagttcatccagggcaagcggcatgtgtgactgagtttaggtccaggatgctgggactgctggccccagtgatctcggacttgtattcttttgctcatcagaacaacgtattcctgtcctccctgagagcagggacctgaactgcatcgactggaacatacttgatgtgcacttgaaattgaaatcctgactggaactcagccgtagatcgttcgctcaatgtaccaacatgtggagcgatactgatccaggacaccaatccccgcaccaccacgggccgcacgtgatttctccannnnnnnnnnggatcgttcgctcaatgtaccaacaagtggagcgatactgattcaggacaccaatccccacaccaccacgggccgcacgtgatttctccatgatccacatggagaggatgcccacgcctgcatgaccctcctcactgcgccaatcgcagagaacaactcggaacaattcattatgctggccattacggggtctcttgcagtggcgagccccgccctgcggggctgtggtaggaagcagccacgagcactccgagcatgcaggcgggccccccgccccatgcaccgacgccaggcttgtgcagcgctacccaatgatgagaatcctgaacaggcggtgcagcgacgccttcgggagagcgaggaggtcgcggagagggtgaagttcctgcaagaccgtgtggagctggatgcggcgctggagagggtgcggccggatttgggggccggggcgagtgcgtcgactaagcatggagggcatcccgctgagatgcttacaggggatggctttgtcgtattgcggcttctgagcgtgactcccttctaacgacgactccccccccatgcaacctctcttcaaaaggcaggggactccttggtggtccnnnnnnnnnnaagcgtgactcccttctaacgacgactttccccccatgcaacctcttttcaaaaggcaggggactccttggtggtcctggaagtagcctccgaggaaatttgccagacggggtgggacgaggagccggagctgcagtgggacgaagataagcgggcggcgctggagccctgcctgcgcctcaagcacacctttgcccgcattgcccgtgactgctcggatgccgtgtttctcgccatcagcgtgcgcgtctggggcaaggattggagtgggggcctgtgtttgaatggggtgtgcatgccgcactcggaccagccatcctattgcaagccgggaagctagttgcttgtcgtcctgcgtagcgccatgtcatctcccacccatggatcattgtcgcccttgagcggaagcctgctcaggcccgccctcctcccatccctccccatacaggcggatgaccccaagtccaaggagcttgtggaggagctgcaggtcaagacgatcccgacggtgcaattcatcaagaacaagcaactgctctgggagcacaagggcatcaacaagctggagcagaatctgagcgagggcgtgctctattatggtgaccaggcggccgagaacctgaaggccagcagctttgtcaaggatctgcacagccccgaggagttccaggagtttgtcaagtcgcaggagaaagacgtgagatggtgtgggagggtgggtggggcatagctgctgcgcttttccgagttgcatgcgtggagggcagctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcatctacaacctcacgtcccggtcagctgtacactcgatgaccatatatcaaaccccgctctccatgccaccaacctctgctcccccccccccccccccannnnnnnnnncaaagacgtgagacgtcgtgggcggggtgggtggggcgtagctgctgcgctcttccgagttgcatgcgtggagggcagctcaggctcccatgtctccaggcctggcatgcgtgcgagtgttcccattcgctgccatccccctccctgcatgggctgctggttgcatccacaacctcacgtcccggtcagctggacactcgatgaccatacatcaaaccccgctatccatgccaccaacctctgatcccccccaaaatatcttgaaggtgctgacggtggtggatgtctgcgcctccatgtgcgagccctgcgtgcacatctttcccgcggtcctggcgctggcgcgcaacttcgaaaagcacgcggcctttgcgcgcgtccagctggacgagacgcccgagctggaggcgctgctggcggggtctctgggcatccgcgacgtccccaccttcctcttctaccgcaacggcgcagcggtaggacgccacgtgggcggttcccgtgccgacctcatcggcaacatcctgcagcagcaggtgggggcggggcaccccctgccgcctcccggacccaaggcgaccaaggccgcgcccgcggcggcccgcaagttctccaattggtgaggggggacagtgtgatggcaggcagacggcatcacagggacctgggcatcattttccgcgagatgccctaggacaacagccgatcgactgccggagggacgctgagtggcggctgtggcatgccagcagggcataatcgatatgtgtgaccggcctctggcaacgggtcctgcaacagcttttctttatgtttctggatttatgtttgtgacaaaggaacaagaccctacaggcagggttgcagagcgcatggagggctttcgggaggggtctgcctgagaggggtagcagacaaatgagccgccagacaggaaagtaattgtgcccctgtctgcatctccgctcctcccgnnnnnnnnnnggagaggggcagcagacaaatcagccgccacctgccagacaggaaagtaatcgtgcccctgtctgcatctccgctcctcccgtgccgccaccaggagcacagcgacactgccaagtcggcagtcagcttgctcgaggatgcgacgcctcgctctctcatgccacccgatactcgcgcggtaccctcttccggaggtagtacagcttggccnnnnnnnnnntgacactgccaaatcgacagtcaacttgctcgaggatgcgacgtctcgctctctcatgccacgcgatactcgcgcggcaccctcttccggaggtagtacagcttggccctccgcaccggccgctcctccagcaccttgatgtcttggatgtggggggagaacctgcggggttgacgattggtttgagaagctcaggatggtgactgtggcacgatagagcgtccacgctgcggcggcgcaccctcccttgcttctcagcnnnnnnnnnntggggttgacaattggtttgagaagctcaggatgatgactgtggcacgatagagcgtcgacgcagcggcggcgcaccctcccttgcttctcagcaaggcttcccgacccacgcatcatgaaacattaaccccacgcaccgaaccctcctccccccccnnnnnnnnnnctgctctagggcgccgggacctatgaagttccgcagcgtgaaggtcgtcctcgacgcccgattggacatggcgatgcacatacccttaaacaccgttgttctccgcttgttctcaggcaccgactggtgatcggttggggttgggggttggaaggcgtctgggagtggattgagaggcaataacccctcctaccccatcaaggcgtggcaaggtttatgcctgcacaaatcaataccctctgagcaacaggagcaggcaaaatcccacaaaggcgccatcctgccgacgcttgccacactcaaatccctctccactcaccagcttgagctccnnnnnnnnnnggtggcaaggtttatgcctgcacaaatcagtaccctctgagcgacaggagcaggcaaaatcccgcaaaggcgccatcctgccgacgcttgacacactcgaatccctctccactcaccagcttgagctccaggacggcaccgggcccaaaggatggaatcttgcgctccttcataatctgtgctacccgctcccgctccagcacctccagcatgtgtcccatgcgttttgtgtacgtcttccgctttaaaagctcctgagtgggtgtccagggcatgctggggcggcccttgggccgagccaggcgctgtgcctccgcctgaagcgtgctggtctcggcaggtgcgggggcaggggtcgaagtctgcagcccccggagcccctgcaccgcccatgcagcctggcactggcgcgctgcgagcatctcagcaaccactgcggggcgcactgcgcatgctacatggcgcagccgctgcagcatactcgcagccagcagatgggtgcctgctgcagccactcggtggtctacggctttggacccggggatggcgttcaggctgtatgaataatgacctggatttgttcgagtatatactttcaaaggatgcgctgcccttctctgcaggctgaacgttcgctggatcgggcannnnnnnnnnaaataatagcctggatttgttcgagtatatatttccaaaggatgcgctgcccttccctgcaggctgaacgttcgctggatcgggcaacagtcgctgacgtggtggtaccgcaaagtcgcggggggtgcaatttgtcaggagatggtcaggcaaacccagtcaagctcacaactgctcagacctcccggacccagccccccaacactatactctttagattaatcagactgtactgacttgcctagcatcagcaccgggatctggacggggaacagcgatcctgctttcttttagtatgtcgggacccctgcagcgcctgtccgcccgagtcctggcgcatggagccgaggcccggtcactgccaggtgcatatatgaatggtgaatttccattgatttcagtccgtgggtgccgtggtgacagggttttgtcgccatccgtgcgcgtcgtccctagcctgtgtcaaccgtgacccggggcatcactcctgccttccaggcctgatccgcaccatgagcactcgcacggagcgtgacacattcggacccctggaggtgccgtccgaccggtgagatggggccccatcgggctttgggttctggacatgcatgcacccgatctcacgatggtcaggcccgaggactcctcgctccttcgaggcactgcgatgcgggcccccgtacgcacctgcgatccgtgtcccacagcgcccctgatcatccctgatcccatcccacccctcaaaccccgattgcacctcaggtactggggcgcccagacccagcgctccatccagaacttcaagattgggggccccgcagaacgcatgcccgagcccgtggtccgcgcctttggcgtgctcaagcgcgccgccgcgcgcgtcaacatgcagatgggcgtgctggatcggcgccagggcgaagccatcgtgtcggcggcgggcgaggtggcagagggccgcctgaccgaccacttcccgctggtggtgtggcagacggggtccgggacgcagagcaacatgaacgccaacgaggtgatcgccaaccgcgccatcgagatcctgggcggggagctgggggacaagtcactggtgcaccccaacgaccacgtgaacaagggccagtcctccaacgacaccttccccaccgtcatgcacatcgcgggggtgacagagatcgagcgccgcctgctgcccgcgctggcgcacctgcagtccgcgctggaggccaagcaggccgagtttgcgcacatcgtcaagatcggccgcacccacacccaggacgcgacgccgctgacgctgggccaggaattctccggctacgcgacgcaggtggcctacggcatcgagcgcgtgcgctcctccctcccgcgcctggccatgctggcccagggcggcaccgccgtcggcaccggcctgaacgcgcgcgtcggcttcgccgaggccgtggcggcggcggtggcggaggacaccggcctgcccttcgtcaccgcgcccaacaagtttgaggccctggccgcgcacgacgcggtggtggaggccagcggcgcgctcaacacgctggcggtgagcctgatgaagatcgccaacgacgtgcgcttcctggggtcgggcccgcgctgcggcctgggcgagctgagcctgccggagaacgagcccgggtccagcatcatgcccgggaaggtgaaccccacgcagtgcgaggcgctgaccatggtgtgcgcgcaggtgatgggcaaccacgtggcggtcacggtcggcggctccaacggccacttcgagctcaacgtgttcaagcccatgatggcgcgcaacctgctgcactccgcgcgcctgctggccgacgccgcgcgctccttcaccgacaactgcgtggggggcatccgggccaacgagtcgcgcatcgcgcagcttctgcacgagtccctcatgctggtcaccgcgctgaacaaccacatcgggtacgacaaggcagcagccatcgccaagaaggcgcacaaggacggcagtacgctgaagcaggcggcgctggcactgggccactgcaccgagcaggagtttgacgcatgggtgaggcccgaggacatgctcgcgcccacgccctgaacccggggctcggcgcttggggagtggggtgaggcggacggtggcgtcagggagaaaggtctcatgcctcgacaccgagggttgcagccaggggccccgctgccatgggatgcccccgaatatgttcctggaccgagtgccgtcttgtaagcactgcattacgcacacgggtgcaaatgagagggaaacaacgggctcgcagcatgaacagcggggttcggccagcgttggagttgcaaccgggcccatgggactctcaggctgtgtagctgatgcggaagatgtcgtggtgctgcaagggggggggagtgaggagggaaaagggggtgagaattgaatggggggacagacggcagcaaagaccaagccagtgggctgctaccaaggtttaggacggggggctgcacacagctcccctccccctcacaccaccgacgaccctcctgcacgcttgcccactcacctcggtcaggttggccagcttctcgttcatctccgcgatgcgctcgcggtgggacttggccgccgccttgcggatgcgggcctcctcgtacttgagcgcgtgggcatcggcagccttctctgcggcggtgcggcgggcctccactgcgaggggtgcgctggcgccctcgccctcctgcacagcctgattacttgcagtgagacacacgatgcaagacggatgcatctacacggacactctccaggcctgcatggcccctggaccactcctccctgcacacctagccaccctgcacacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgccagccgcgccatccacggcgacgagctcggtggtggtcgaggactttttcttcttcttcttgatgccggtgggtttcagaccacccttcagcttcaaggcgccacccgtgaatgtcgacatgggtggatcactagtccctcctgggccggggctccgcaacgacaaagtggtagccgaagagggctacgattaccagcactccgaggatattctgtggatcgcgtgtggatgacgaagctcgagcaccactctggcacgctaggctgcatgtttccattcgcgaaaggagcagagcaccttcctctcaccgcaaagcgaccgagatcctgatcatcaaacatcctgggctccaatcatccaagtaataagcttattctccaggccgagtctacgagggagctgctggggtcagggaagaagagcccaaatattttcaccagtgcccttggtgattactggtctcgcgccaacccgcgtaagaaagggcgagcagcctctactcgtggtggtgcaagtccaggcggccagtcggaagggtcccttttcttgcactcaaggtnnnnnnnnnnctgcaagtccaggcggccagccggaagggtcccttttcttgcactcaaggtgagcacctggccgtcgagataccccaggaacatgcctgagtggtcagcggcgagggagggtgtgcgtggcgcgccgtacagagccaatcctgccagcggggggcattgcgcgctgcggtcaggacgactgacgtatgtcctatccctccctgcacacaggttgtgtcgctgaagagcttacttcggcgccatgggtcgcatgcacagcaatggcaagggcctgagccggtcggtggctccctaccgccgctcctccccggcctggctgaagatcaccagcgccgaggtgcgatgagcgatggatgggggcgaatgcggcgcccttgtcgatattcacgataccaacgggcgtgtgccggacgagagtgacaatgttgtccggcgccttttaccccgcaggtggacgacctcatcaccaagttcgccaagaagggtctgaccccctcccagatcggcgtgctgctgcgtgacagccacggtgtcgcccaggtcaagtccgtgaccggcaaccagatcctgcgcatcctgaaggcccacggtgcgtatattgcaggggagctggggtggtcccccttggggatttggaccgctggtactgatgcatgatttgcttgtgggcatgccctctgacatgcatgtggtcactggcctgcctgagcagcaccgctgnnnnnnnnnnccgataccagcgggcgtgtgccgaacgtgagtgacaatgttgtccggcgcccttttgccccgcaggtggacgacctcatcnnnnnnnnnncggacggctgatactgatgcatgatttgcttgtgggcaagccctctgacatgcatgcggtcactggcctgcctgagcagcaccgctgcccctgcatgcccctgcttgccttcccaaaccctctgtacaacagcaagcatgtccggtgagctggggcctgggcgaggcgtctcactggggacgggggctcgccctccccaggcccagctcgctggcctgcgttgctcgagcacacccctgcgcaaatgcctccggtgggcgcggcgcccttcctgtccccctccgtggccctcccctgccttccagcgctgtgcccagtgcactggccaaggcgggggagggccgcggnnnnnnnnnnacccttcctttccccctccgtggccctcccctgccttgcagcgctgtgcccactgcactggccaaggcgggggagggccgcggggccggggaggtcgggcgccccgcctgctggggcatcttgccggtgctgcatgctgaccgggcgctccccttcccacccccctcggcgtctcaggcctggcccccgagatccccgaggacctttaccacctcatcaagaaggcggtggccatgcgcaagcacttggacgtcaaccgcaaggacaaggacggcaagttccacctgattctggtggagtcccgcatccaccgcctggcccggtactacaagaagacgaggaagctgcctcccaactggaggtacgagtcctccaccgcctccgccctggtccagggctgagcgtgccgaagccccagtgcgcacccagcgctcgcgtctgagtgcgtgccggcctgagatgtaaaccagccgccgtcagttgagaagagttacagtgagaagaatgatgggaggcacgcatggagttggaatggtgcgtgaacggactttgtagcattcgagctgtgaagaggaaaacgcgtgacgtgtggctggaggaccacctggcatgggcgtgcacgcannnnnnnnnntgttgaaaagagttacagtgagaagaatgatgggaagcacgcatggagttggaatggggcgtgaacggactttgatgcattcgagctgtgaagaggaaaacgcgtggcgtgtggccggaggaccacctggcatgggcgtgcacgcatggcggcagcagaggctcggtgctgctgtggggcacggagcgcggaccacgctggatgcacgagatcacgaaagggaagggtgggttcagttctatttgtacagggagcaggcagtcctggcctcccaggccggtcacgggaggggtggtgcgtgcctcagcacgccggcgagctggtccagcaccaagcggcagcaggcgcaggtgatgagcacccccatcacgtccatcaccacctggatgctcgtgcctgggcgtttgtgatggggggaaggggggcgtaaggcggggctgatggcgatgcccggctgatggcccgcctgaaccctcatgcacaagggttcaggcgggagtgggggagcctgccgaagtcccaggcacccccacacccaggccctccacccccaagccaaccctcacctgcgttggcggggtcgacgcccagccttgccagggcaaaggggagcgcggtgccgaccaggacactgnnnnnnnnnntggacccgcggcaacagagttcatctgtgtagttcccagtatgggatcagcaccgctggaacttctgataaacccaatgtcacccagtcccggccccgtggacagcccactctcttgaatgcccggaccccctcnnnnnnnnnntaggcacccccacacccaggccctccaccccaagcacttcccccccaagccaaccctcacctgcgttcgcggggtcgacgcccagccttgccagggcgaaggggagcgcggtgccgaccaggacactggtgttgacgatgagcaggagggagagagcgatggcggaggcgtggcgcgggtcgccggcggtgaggtagacccgcacccacccggcggaggccaggccgctggcgaggagcagccccacgatggcctggcgcgccagcgtggcgcgcagcatgcccagtgtgggccgcagcgcgcccgtggcctgggaggtgtgtggaaaaggggttggggtcgagtccttgggagggaggctcggctaggttgcaaggagtgcgagaccctaggaccaccggcaacagagttcatctgtttagttcccagtatgggatcagcaccgctgaaacttctgataaaccccaatgtcacccagtcccaaccccatggacggcccactctcttgaatgcccggaccccctcaccagccctcggatgactttgatggccgactgattgcctgcattgccgcctgctccaaccagcatggtgaggaagagggtgaccacgaggtgccgctccagaagatccgagtagccactcagcacgaagctggagctgctctgcaggatgagcagccccaccagccaccgtccgcgggaccaggcctcggctgccagggatccgggtaggcctggacgcaggcagggctcgggcaggatgctgcagtgctctatgtctggctcaggggggcccaggtgggtaccaatctggggaggcccctcccatgctccgtcgcattccaggaggggctctgcaatcagggagtgggtgaaaggacgcgggtcttcgcatatcgagcatcggagtagaataatccgccagtagatcactctaaaattgccagcaacccaccccagccagctcactcaggccgggttcgtactcagaggcgagcactttgaaggattggcgcctggattgtggttgcggcttcgacatcatggccattctgcctgaaatggtcactttaacacaccgcaattcaagtgtggggagtgacaggccctgtccggtgcgggcagctgcataggtcttggtgcggtgcaacttggattacgaggcagtcgaccaggaagcatagtgcatgttcatatttaggggagtccaggctgattatgacgtctgacctactccgcatggcgcatcatgtaccgagtccacaacggtcgcgcgcgctcattttcaagcttccgggagcacgcccacaaactcctgaaaggcaccaccattgatcgcacacgaggcctcgacgcgcagcaatcatacctcaattacnnnnnnnnnnacgggagcacgcccacaaattctgagaggcaccactattgatcgcacacgaggtctcgacgcgcagcaatcatatctcaattacataaaattgcgacaacttgtgcaggagcttgttatcccaggataggcgctgtcgccatcgcaatgacgaccaatggcgctcctgcagaagcatcaccaccaccagacgccaatgaacgtgagcactcgagggcttgcaccgcttggatgtgtcatgttcatcaaccccccttatcattcactcacatactccccaccccaccgtcccccccaggctgcccgggcaccgccagcaccgccgcgggcacctccgacgcctgcaagggctgccccaatcagcaggcctgcgcctccgcgcccaagggtcccgaccccgacatgttggccatagcggagcgcctggcccccatcaagcatatcatcctggtcctgtccggcaagggcggggtgggcaagtccaccaccgccgcccagctggcctttgcgctggccggcgaggggcacgaggtggggctcatggacatcgacatctgcggcccctccgtccccaaaatgctgggcctggagggggaggaggtgcaccagagtggggcggggtggtcgccggtctacattcaggttagagcgattggacctttaagggggggggaaatggccaaattttgagtgaacttccctgtatgacagctgcacagtctcccgatcannnnnnnnnnaggtctcctgtgagctctcactctgaacccattcccaccctctatccccttctcccttcttcatcgtcccaaaggagaacctgnnnnnnnnnnaactggacccttaggggggggtgatggcctaactttgagtgaatctcactgtatgacagctgcacagtctcccgatcagctgccaggggttgcactgccggcacctttgaacttgcaactgctcaaagcaaaatcgcagtgccatgccggatcaacacagacttcgggtctcctgtgtgctctcactctgaatccattcccaccctctatcccttcccccttcttcatcgtcccaaaggagaacctgggtgtgatgagcattggattcatgctgcccaaccccgacgacgcggtagtgtggcgcgggccgcgtaagaacgggctcatcaagcagttcctcaaggacgtgcactggggggacctggactacctcatcatcgacacgcccccggggacgagcgacgagcacatctccatcgtgcagtacttgaaagcagggcgggtggcgggggcggtggtggtcaccaccccacaggaggttgccatcgtggatgtgcgcaaggagatcagcttctgcagaaaggtgagctcgatgctgtgtgggtgggaagggaggtaaagaaggtagggacgaaggctggcaatgggagtgctggcattgtttgaataccttgagcggcgtattttgatgtcgtgatggggtacatcttacatcttcaaatattgcatcaccctnnnnnnnnnngaacgcaggtagggccggaggctggcaatgggagtgctggcattatttggatacctcgagcggcgtattttatttccgtgatggggtaaatcttacatcttcaaatattgcatcacccttcttcacccctactaatgcatccacccacttcttccctgccaaccctcacaccctcccaacactccctcccaccgatcacagaccggcatcagggtgctgggggtggtggagaacatgtcggggctgctgcagccgctgcccagcttccgcctgacctctcgtgccgacggcgccgacgtgagcgagcgcgtgtttgccgcactggccgccgcggggctggacccggccgccgtatgcgcggggctggacgtgtttgcgcccagccgcggcggcgcagccgccatggccgccgacctgggggtgcccatgctgggcgcgnnnnnnnnnngtttgcgcccagccgcggcggcgcggccgcaatggctgccgacctgggggtgcccatgctgggcgcgctgccgctggacaccgaactggggcgggcgggggaggaggggcgcagcgtgctggaggaaagcggggcagggaccgccagtgcggcgccgctgcgcgccatcgtccggcgcctggtgcaggccgtgcaggagcagtgagggaaggtgtgttcctccggcgcaaacgctttgcacgaggtgtggggcagcctgcgtcgccaagcgtgtggataccctctcctggccagcttgcggttgatgtcacgtctcacatggagaaatagtacctccatattagtacaccattccctgtgcatccccctatcttattccaagctcttggactcctctgctgcctttcctccaaggcttggcgtgtactatgaccagcttttttacgtttatggtgacaaggcaggatgagggnnnnnnnnnntgatgtcacttctcacatggagaaatagtacgtccatattagtacaccgttccctgtgcctccccctatcttattccaagctcttggacgcctctgctgtctttcctccaaggctttgcgtgtactatgaccagcttttctacgtttatggtgacaaggcaggatgagggaaagaagcagggaagcagacaaatgcacaagcctaccgtttcctcactttgcccttccgcacgtttgccttgggtatgaaccccggctgtgccttcttgcgatgcttcttgccgtacttttctgccttgagttccagctctgtgggctcctccctgtcaaatccagggagcagtgccatgggatctggagatccatgtgggccaaggctggggccggaatgcacttcttcttcccccttgcaggcacacggtgccctcccttgtactgcaagatgatggacacttcctccttccagcccaaaaccctctcccacctctcatcgccaccgcgcttgggcgccctcatgaagcccttcacagggtcgatgccctccaccttccgccgcttcctctccggcagcactcctgaacagcagcgtggcaggtggcggcatggcagggagagccagactcacaggccggaaaattatgagtggatgcccctcaaacacctgcacctccatgctcccgcgatgaatgccctcccgactctgcacccgtgttcatccccaggatctggctcacatacctgccgagttcccgatgttggagcgtgcggtgatggtggggtctcgtagatacgctggcaggtgcttcaggtgcggggcctgtaccgctgccccactcgccagcggccggtcgtgttggagcagctgcaaggggggggcatgtttgacgatcatgcatccgccaggggcaccgaatttcatgcttcacccgaccctgccagcggggcgactgcacgcactgttgcgagcctccacggccacaacctcacattgcaggtccnnnnnnnnnnaatcatgcatccgccaggggcaccgcatttcatgcttcacccgaccctgccagcggtgcgactgcacgcactgttacgagcatccacggccacaacctcacattgcaggtcccacctgcagatctgccgggtgctcctcaaagaatgcagacaagcgctgggagttgagcagctcatgcttcagctcttttgtttgtgcctgtgcaagggtattgggaatgaggatggctgtgtgggagggcgatcaaggggaagggtgtttgggaagcatcttggcggccagatttctggcgtcacagggcaacagcacactctcaagaaatgcacagaggacacacggaggcatccaagcccacctctatgatggtcctcttggtcaggctgcgggcgacgtcggtgccgcggtaccgcagcccctccagcgccactgccgtcaatttggtgtacggcttcatgacgggctcacaggccgcctcctcctcaccgctctctcctgccttcgtgcttccccccgccagcatctcctcgatgctggccgccagctcggtctcggacggccctacgatgctgatgccgaaaccatcctccccagcacgccccgtccgacccagtctgtgcacatatctgcaggggaattgcaccgtgtgtttcaagcaagggtgagtttggctgcgcagtgctggcggttggggtctattcttcatatccttggcctgcagcgacactgcgtaacagactagcgcagttccacaagctcctcctaagagaaagtctcgcgaccccccctcctgagcaaaaccctgccgaaacannnnnnnnnntgcgcagttccacaagctcctcctaagggaaagtctcgcggaccccctcctgagcaaaaccctgccgaaacacccctctttcccttctgctcacccctgggtgctggcgggcatatcgaagttaatcactgtgttcacgcccttgaagtcgatgcctcttgtgaccccaaactcctcgtcctttgcctgcggcattgtgcatgtggccaggttgaggtgcaccagatggatcggaaggactggctggtgacggactctggtctgcaacaccaccgtcggccacacagcaaaggcgtctgcctctgcacctcctgacgccagcctcaccattttgactcaattcactgcaacctaagaacaccatcatcactccagagcccccnnnnnnnnnngcagatcgatcagaaggactggctggggacggactctggtctgcaacaccaccctcggccacacagcaaatgcgtctgcctctgcacctcgtgacgccagcctcaccattctgacttaattcactgcaacttaagaacaccatcatcactccagagcccccaccaggccttgcaacccccccccaaaaaaacatcttgaccactcaccggtccctggggctgcttctgggcccgccgcccgcgcctgcccgtcccctccttggcctccttcttctccccggcgtgcacgtcgtcggtggccaccaggatgtcaaacaggcctcgattgaactcttgcaggatgtggtgccgggagttcagcggcagctccgagtgcaccagcgccgcgcgcacgccaaaggcctccaggaagagccggaccctgagccccgactccacgctgttcacgaatatgaggatctgagggggggggcgtgggagtgtgcagatcatgcgtcatggagttggtgtgagaaacgggagggaagctcaggacaggtggaggtgcaagcgtgcggcgccgggcacccagaaaccaagtttagagacagggtgccgcatcagcctgcgggctgactctgtctcggttccggccccctcagcacaagacgcacgtatgtttgcagcctccaccacaaaccaacccccagccccgccatcccacaccagcgaccaaccttgcgcttgaccaggcccagacggatgagggccagggtccgcagcaggcgctccagggtctctgcccccgcggggacatgggcggggatgtccaggcgccagtgctcaacctcggcggccacgccgccggccggtgcgacccccgcctccgcgcccagcaggtccagggtgcgtggattgtgcaggaccagcttggacagggcctccacgtcggaggaggacgtggcgctgagcagcatgcactggcaggcgcgtgggacgaggggcgccacgccgcgcatatcctcgccgtagccgtaggccagcagcaggtcggcctcgtccagcaccagcgtctgcagcgcctggctcagggcgccggctgccagcttgccggaggacagcgccagcgccagcttggccggcgtggtgaccaccagctgccccgcgcggctcagcgcggagcgcggcaggccctcccctgccagcgcggtcacccgcaggtcctggccggccgcggcggccaggcgctccccctcccgcagcacctgggagcagagctcccgggtgggcaccaggaccacggcctgccaggcccgcgcctcgccgcccgccaggatgcggtgcagggcaggcagcaggtatgccagggtcttgccggagcctgtgcgggcgcgcgccacgacatcgtggccctccaggaacaccgggatgcaggcggactgtgggggcccggagtcgaggcagtgggtggggcgcgtggtgggcctgagtgaacgaaccaaacagcctggggtggcagcccaggccacgacgacatgagaaggagtgcggctacataccccaggcccctggtcatgtgcatacgacatacctggacgggtgtgggagtggagaggcgcagcttgttcagggcgcgcagtagccgagggtccaggcccaatccgtcgaaggacatcgtgggcgcaggcggcaggcagccgggtccagtactggctcagcggggcttccgcacgataaattgagcgatgcaaaaagctgtcagtacatcttcaatagcatggttggtggggcggagaataaccactgcatgtatatgcatgcagtgattcctgggcgcgaaaacggtgtcaccacgagatcggggagcggacgagcattcgccttcggtgccgcatgctctcatagttggatgccatacaaacgctcgatactgtannnnnnnnnnaaaaacggtgtcacgacgagatcggggaggggacgagcattctccttcgctgccgcatgctctcatgcttggatgccatacaaacgctcgatactgtatataactgcctttgaaatccataccataatgaattccgttgtgcatgccagggcccctgccgtcggggtcccccgctcagcgcgggcctttgtgaagggccggccacccgccnnnnnnnnnncctgcctttgaagtccataccgtaatgaaatccgctgtgcatgccagggcacctgccgtcggggtcccccgctcagcccgggcctttgtgaagggccggccacccgcccctcgaggaccacgccctgtgagcaggcgggcttcgagcggctcaaatgggagcacacgggaggagcacagaataaccaccgagcagtattggcgagcnnnnnnnnnntcttgtgagcaggcgggcttcgagtgactcaaatggaagtacacgggaggagcccagaataaccaccgagcagtattggcgagccatcatggagggggaggagatgggtgccaggatggagagggaggacaaaaagacctttcggaagccagaaggcgccggtgagtgcagggcagtgtggcccgctcgcactgctacaagtggtcttactgagctgatgtgctgttgcataccgccaagacctgggtctgggaatcaggaggacctgaggcgtgcgatctcgtttcatcaggcgggtcctctccacatcccatccacggcagttcctctggatcaagaaggagcgctagatgctctccgcatgggcacttggcggcttcgtgggcacacgtgctcgcagatagaagccctcgtggcgcagatcgagggcgcctggaggaccgtgtttgggtcagactttcgcctctaccagctggacagggtgagatagggagagcttgtctaggtgtgagaacctctggtgctcaccagccatgtgcttacaggaagggaagcccctcacaggaacctcttcagggtttcagcccagcaacggtctcccatcactctgtcgcacacccgcccaggacatgcgttttgcggnnnnnnnnnnaagccatgtgcttacaggaagggaagcccgtcacaggaacctcttcagggtttcagcctagcaacggtctcccatcactccgttgcacacccgcccaggacatgcgttttgcggacagcgtcgacatgaacaaggactacccctcctcctgggcggagctgatggaccccaccaaggacgagcccggctaccctcggctcatgctggagaatcgggcgtaccaaacgcgcgtctttcgcaaggtgcaccttgaggtcggtatccgccaggacaacatccaggtgagccttcgatcctggtcaggaagctgcgctgggaatcttgatggggcaaccatcctcaagtcgcagtctcctggtggtgattgactctgtatggtgctgtnnnnnnnnnncatccgccaggacaacatccaggtgagcctttgatcctggtcaggaagctgtgctgggaatcttgatgggataaccaccctcaagtcgcagtcttctggtggtgattgactctgtatggtgctgtgggccccagtgtccatctcctcggcccgggactgtcttgatacaatccctaatcaccgctgccagaacgcctctctcccttcaccacccttcctccagatcctgcactgcaccatgnnnnnnnnnnctgatactatccctaatcaccgctgccagaatgcctctctcccttcaccaccccttcctccagatcctgcactgcaccatgtatcctcggttggagtatgatctgcccatcctgtccatcgatgtggtgagtgtcaaggaccgcatcaccctggcgctggcagacccctgccccgtcaatgcggacctgcgcctgccggacttctatgcccagcccatcaggtgggtgcagctggtggagcacccaggacactccagtcatacttgnnnnnnnnnntgcgctggcagacccctgccccgtcaacgcggacctgcgcctgccggagttctatgcccagcctatcaggtgggtgcagctggtgggagcacccaggacactccagtcatacttgcctccgagtactggaacgcaactctcctccctccatgccaccaccatgtccagggagatgcaggagcggtattccctgggcaaggcgcgggacatcccggcctgggcgtcctccatcctctcccccctggccgtcgtcacctcccccgccacgcccgaggaggtgggcaacttcatcaagtacgccatcaccctcgtccgctaccacacagaagtgagagagaggtcctggagctttatgtgccctagcagggcttggacggactcgaggacgggtctccaaccccccctgcactctgtgcatccgtcccagaccgcacctcccatcnnnnnnnnnntaccctagcaaggcctggagggactcgaggacgggtctccacccccccctgcacttagtgcatccgtcccagaccgcacctcccatcctgcctctacacgcccacaacccttgcaggtcgggcgcatcatcgaccccgtctctggcgcgggcgccgcggcgcgactgcagaccatccgggccgcgcacaagcactactgcacccagaacctgcggaacctgaaaacacgtcgcatgctggaggcgtcctttggcgtggagtggtcggacaagtacctgcgacacatcatgttcgacttcgagggctgattgcatcgtagattctcgggcgcgcccctgtcctgggggttcctcctccagggctctggcatggggcccannnnnnnnnngttcttgggagcgcccctgtcccggggggtcctcctccagggctctggcatggggcccactcccattgaccggtggcgattgtaatgtattgaccaaccaaatcccagggctcttgcgtgtccatcccatctttggaatgctattgatgagagcagcgcaacagtcacaggctggagtgcaggcacgttcctcnnnnnnnnnnaggcctgcgcaagggcggttgggtgggaggaaagtgagcgctggactttcaaagagaaatgggggggcgaaggcagcaggtggcggcggggtggcgggatcggagctgacgagagacgaaagccagccacatctgttcttgaccgaggagccgcacgcttaacgcccctaaacatggtcatactggggacccccattgccacgctagcatcatctcctctgctgggtctcctcccggtcccagtcatgcaccacacctcgcacccgccgccccttccctctcagcagaaacannnnnnnnnntgccgcccgcgtaacgcccctaaacatggtcataccggagacccccattgccacgctagcatcatctcctctgccgggtgtcctcccggtcctggtcatgcaccacacctcgcccccgccgccccttccctctcagcagaaacaggcatccccctgccaccggcctgtcccgcaccccagtcgacacccaaaactcaccccagtcgtcgctgaagtcgcccgccccctcgtccaggccatcctcatcggcgtccccgaacccggccagatcctcgtcgtccaggccctcctcggccagcagcgcctcctcgtccggcgtcagcgccccgagtgcggccgacagctcgtcctcctcctcgggcgcaagccggacnnnnnnnnnnnnnnnnnnnnnnnnnnnnnnnnnnnnnnnnnnnnnnnnnnnnnnnnnnnnnnnnnnnnnnntcgacgactggcgcctcggcctccggctcctcgccccagtcggccgagccctgctcgggcggcacagactgcgcgggcggcgccgccgcggcgtgcggcgcggggtccgcaaacagctcctcctcgtcggggtcctcgcctgccctgccttcaaaaccctccgcctcggtcccaaaagcctccgcctcctcctcagccgacgcggggtcgtcgtggaaggcgtacgcctggcccgcggccggcgcgccgtttgacgcggctgcctccttggcgccgcggatggggccagaggcgagtccaatcgcgctgcccactgccgccgcgccgactgcaggagcggcaccggcaccggcctcctcgctatcggccccctcgtccaccccagcctcctcggctccggcacccattcccactccctgttcctccccagcaccgacggcgccatacaccgcccgnnnnnnnnnncccggcacccattcccgctccctgttcctgcccagcaccgacggcgccatacaccgcccgctccgcctccagcgcctcgctccagcctgggaacaggtttgggtagtcgtctgggttggccagcgcctcggcggctttcgggttggcgcgcgccaggtcggcctgccagcgcaccaccacctcccccgcgcgcgaggggcggtaggtgcgcgccagcagcgccgcctcggggaaccgccccgccgccagcaggcagcccagcgcagcgtccacgtcgccgcgcagccagtgcgcggcgaaggccacgttgcgcgcgccctcgtccgcggcggcggcggcgag

SEQ ID NO: 42929 - DNA, 131 bp, Chlorella protothecoides
tcccgcgccgccttcggcgagcgcctggaaggcctggtggcccggctggccgcccacagggcgcagcgagcgggggcggggggcggtggcgccaagacggagtgacatgggacatgctgccgcgcgaggcg

SEQ ID NO: 42930 - DNA, 77 bp, Chlorella protothecoides
gcatccagctgccctccacccagtccgactttgcagtacaggtcgaggggctcccattgttgatgagcctccatgca

SEQ ID NO: 42931 - DNA, 83 bp, Chlorella protothecoides
agtgtgcacccccctccccctaacccccccatcccctgttgagtgtcgtagtatagtgtgcacccccctccccctaaccctcc

SEQ ID NO: 42932 - DNA, 103 bp, Chlorella protothecoides
gtaccacagcttgcggcatgcagacgatgatactgtgtggggtcccctgtaatgcaggactctaaaccacaccaccaagggcccacatctcacactgccctcg

SEQ ID NO: 42933 - DNA, 61 bp, Chlorella protothecoides
cgtggtttccagtccacctcccctggtttcgagtccacctcccctggtttccagcccacca

SEQ ID NO: 42934 - DNA, 61 bp, Chlorella protothecoides
cagcccttgcgcccttgtcctgcggctgggggccgagcgctttggtccactgttgggggcc

SEQ ID NO: 42935 - DNA, 43327 bp, Chlorella protothecoides
  modified_base (239)..(248): a, c, t, g, unknown or other
  modified_base (664)..(673): a, c, t, g, unknown or other
  modified_base (1650)..(1659): a, c, t, g, unknown or other
  modified_base (10238)..(10247): a, c, t, g, unknown or other
  modified_base (10407)..(10416): a, c, t, g, unknown or other
  modified_base (11432)..(11441): a, c, t, g, unknown or other
  modified_base (11751)..(11760): a, c, t, g, unknown or other
  modified_base (12260)..(12269): a, c, t, g, unknown or other
  modified_base (12666)..(12675): a, c, t, g, unknown or other
  modified_base (13100)..(13109): a, c, t, g, unknown or other
  modified_base (14546)..(14555): a, c, t, g, unknown or other
  modified_base (14659)..(14668): a, c, t, g, unknown or other
  modified_base (14886)..(14895): a, c, t, g, unknown or other
  modified_base (15303)..(15312): a, c, t, g, unknown or other
  modified_base (15540)..(15549): a, c, t, g, unknown or other
  modified_base (15606)..(15615): a, c, t, g, unknown or other
  modified_base (15671)..(15680): a, c, t, g, unknown or other
  modified_base (15944)..(15953): a, c, t, g, unknown or other
  modified_base (16050)..(16059): a, c, t, g, unknown or other
  modified_base (18115)..(18124): a, c, t, g, unknown or other
  modified_base (19509)..(19518): a, c, t, g, unknown or other
  modified_base (19797)..(19890): a, c, t, g, unknown or other
  modified_base (22240)..(22249): a, c, t, g, unknown or other
  modified_base (22320)..(22329): a, c, t, g, unknown or other
  modified_base (22411)..(22420): a, c, t, g, unknown or other
  modified_base (22503)..(22512): a, c, t, g, unknown or other
  modified_base (22586)..(22595): a, c, t, g, unknown or other
  modified_base (22747)..(22756): a, c, t, g, unknown or other
  modified_base (25506)..(25515): a, c, t, g, unknown or other
  modified_base (27163)..(27264): a, c, t, g, unknown or other
  modified_base (27691)..(27725): a, c, t, g, unknown or other
  modified_base (27955)..(27964): a, c, t, g, unknown or other
  modified_base (28058)..(28174): a, c, t, g, unknown or other
  modified_base (29105)..(29114): a, c, t, g, unknown or other
  modified_base (31316)..(31325): a, c, t, g, unknown or other
  modified_base (31735)..(31744): a, c, t, g, unknown or other
  modified_base (32026)..(32136): a, c, t, g, unknown or other
  modified_base (33525)..(33534): a, c, t, g, unknown or other
  modified_base (34113)..(34122): a, c, t, g, unknown or other
  modified_base (34645)..(34654): a, c, t, g, unknown or other
  modified_base (34721)..(34730): a, c, t, g, unknown or other
  modified_base (35479)..(35488): a, c, t, g, unknown or other
  modified_base (35747)..(35756): a, c, t, g, unknown or other
  modified_base (36777)..(36786): a, c, t, g, unknown or other
  modified_base (37087)..(37096): a, c, t, g, unknown or other
  modified_base (37612)..(37621): a, c, t, g, unknown or other
  modified_base (39019)..(39028): a, c, t, g, unknown or other
  modified_base (40172)..(40181): a, c, t, g, unknown or other
  modified_base (42036)..(42045): a, c, t, g, unknown or other
  modified_base (42264)..(42273): a, c, t, g, unknown or other
ggcaggcgccgccgcggccgccgcggccgccgcggagtcgcagaaggcggcggcggcgtaccaggcgctgctggaggccatcccagagagcgcggtgggcgcggccgcgggcgcgcccaagccgaggaagagggccaagaaggcatgaggttcatgcggtgcatgcaagatcaccacagcctttgaaaccctgcgcatatgccgtaggaaaggaggtgatctccctcaggttacatcgnnnnnnnnnngcatgcggtgcatgcaagatcaccacagcctgtaaaaccctgtgcatatgccgtagaaaaggaggtgatctccctcaggttacatcgatgacctcagcacttgaagccgcagcagcagaggggcagagcagctggatggaggccacgccagtcgtgagcagcgccgtgtaccgatggcggtcggtctggggtcgaaggaaggcatccaccctctgcccctcggtgatgccctgctgcatctggtactccagtgcctggacagggataggaggggggggtgaggtgtgtaggttggtgtcctgacacgcaaggagaaggcatatatggaacaagtacaatgttgtgcccatgcgtgcggcgtaccgccgggtcttgtttgtcccactagaaacaacacccaccatgtctgtgtcaannnnnnnnnntacagggataggagggggggttgaggtgtatgggttggtgtcctgacacgcaaggagaaggcgtaaatggaacaagtacaatgttgtgcccatgcgtgcggtgtaccgccgggtcttgttcttccctttagaaacaacacccaccatgtctgtgtcaaagcgctctatgtgctccatcaggcgcgtggccagcgtcttctgggttacgtcgccgctggccaccttgtcgatcacatccttctcgggtggggccagcctgggccgtttgcctggaaagcacggcaaggtgtgggtttgcgcactggaggaaaaatgaaatcgcacccgtttactagtactgagatgaagagattgaggagggcagcagttcaccaagttcaaaacgcaagtgcagagggtgagggagcaatgcttgctgcattgcacctcagcagcgccggcccccgccctgacacccccaaagtcaacccagcacctcacctggcctggccgcgatcccctgcacgatggcgtacacggccgccgccacattgggcacgtacttggtcagcgcgcgcttgcgctgcgcctgctcccgagctgccgcctgcttcaccagcttggatcggagctgcaggcagcaggcctggagtgcagacttgacggccgcctgcatctcctccacgtcgtccgctgtggaaaggcagacaggggagaataagtttggtttgcggtagaaaaagaaagagaggaggggatggggggaagctggggctcgccagcctgcaccgctgagtcttaccaaaaattccacgcaagaggcagaccgcatgcagacatgcgcccgcaagtgcgtcccaaggtacaagggaccagctctctgtgagtggagccattccactgccggcagcaggcacgccaagtccaagccctgcacaacctcccgccccgcccaaaccgtccgtcacaccaatgtactccttccccgcgcccttgannnnnnnnnntgctgccggcagcaggcacgccaaggccgagccctgcactacgtcccgccccgcccaaaccgtccgtcccaccaatgtactccttccccgcgcccttgaaggggatcttggtggagacgatagacacaaagacccccaccctgtcggtggcctggttgatcttgtaaagcgcccaattaatgcgcttgagggccgtgcgggtgatcacatcggagccgccctgcacagtgggcagaggaggtggtgcagggcctgctgaacggcctggtatcaactcatccgctcaccgaagacttggcgtgtcaaagaatgccccattgtgtgacccccacccagcccccaatggcccacctcaaacaggagcgggatgcggttggcaaagcggtggatattgatgccgggcttgacggtggacccgcccaggctgacccccgcttccacgaggaaagcatggccatcgtgcacacgggcctcgccctggtgggtggccaccaggtccggcccaaactccttcatgatgccgagtcgcaggttgtactcccctgcacgcttgtttggggggctcaaggctcatggtggttgggctttcatggagcagacgctggtgagggtggcgctgaaggtttccaggcccagctgcatgcagtgctgctgtcaatgcctccaagtaccatcctcaaaccctccactccaggtcccacctgcagggctcaggtggtcgccagaggggtcggggaacttgacttcatgcagcagctggtgcagcctgaccagctgcttgtcccccaactccgccggggtcatgtccgcgctcacccccgcctgcatctcatccaggatgcgtcctggaagggggaagtgggaccgtgtgagtggctgtggcggtcccaggggagggcacattgccctgatgagttcaaaattccagctgcatgtttgtcggctcagatgacggtgggatcgacccgatcctgagctggcaatggaaaggaaaggtagaggcaaacatggtgcatccccaagtgcctcctgccccattgcctgacagttcgcgggacacgcatgcaaagctcttggaaaggaaggccagcagtgtggcgtcctttgaggctgccgccaggcgcttgatgagctccaggtccacagatgctggatggtgcttgatgatctgagccagaggaaggggggagattgcagcgtgggacattcgccagccagccaaacacagtctctggctctcaggccccatccctcagcagactgatttatcatgtagagcaagatgtgtctgtcggcaacccatcaccttgggagggggcgccatcacatcggtcctgcgagcaaacacgatgttgagggactgcttctcctcctctgccacgtacttgaagttgaactgcacagcgtgggaggggttgcagaactgagtgaaaagcacaggttgggaagcagtcccagccgggagggctctccggtcaaggtgcacatccgactcgggtgtcagtggtattccagggtgtgcaatcctgagcgcaccctgccaatgagcatgcacggccctgttggcctccatgacccccctataatcaccctaagtccgcaacctgggtgtacggagtgatgacagcgatgagctgcaggtacttgagcacctttgagcggtagtactgccagttcccggcgatgatgaggctcagctccgccccatgccagtggtcggggttgtccagcagcttctgttcgtgcacattgggctggttcctgcggagagaaaagaggaatcggagcacccgcaaggggcgcactcgagttgagagtgggaagaagtcagggcaggtaccaagccccttagcatgccacatgatgggatgagcacaggcagcacagacgccacctacttctggatgtcgatgtccagcttgtagtaagaaatggtggcggaccgtgggcgcgccgagcggatggtgatgggcagccccgtgctcatcttgctccagatcagcgccatcttggctcccagcccaaatttgccccgcgtttgggccacgccgtacttggtgcctgacaggacccggcccagcatgtctgggatctgggcgtgggccatgcccgcgccattgtcctgggtggggatggaaatggtttgagaggggggttcctactctgaggtaggatcactgcagggtccaggtcctgccaggcgcaaggagggcggctgtaagcaaagcccacaaccccatggactggatgcagggaaggcgcgatgcggagcaggacccaaaggtacccgcttaccttaatggtcaccctgtagaagaccttgtcggacctgccgccttgcgccgccgcctgccgggcctccagatcccgccgcttgccgtccagggcatcgcctgtttcacccttctgcaatggttcaggaaggtttccagagcctgggctacccgccatcagatgagcaccatctgtagccaatgtatgcttcccacccgagtgccttgttcaagtcccttgctttctgcaacgaacggatgttgatccatgcaccgacatcagcgttctcccacgcagacctaccatccagacctcaccttggcagccagcttttccagtctttccagctccttggcctctctttggagccttttctgaaaggttgccaatgggaatcacggagtaaggtcatgtgcacgatcaatgacatccaggcagcaggagtgcataaagaagctggaaagagtgctgcggtgcaactcttcccagcactgtgtaaacgtacttgcagctctgtaacatatcaagctgcccacacctccaatcccacacgaaatcccaccacgcgcgccgcatctgactcaaagtcatggtatagggcctcatcgattcggtctggattgctgatcccgcgcatgtggttgagggcatgctggctcatctcctcactgtacaaggtaacatgccatgagagggacgtgggcgtgtgagcgtgcgggatcagcatataggaagtgttacatacgcatcccttacccagacaaatctcacaccatcaatcccttacatggtgatgtcaatgtccgggaggacacgaatgctctctgcagcatccagtgcattctccaccagctctcgtatcgttgtgtacaggcacttcccaggctgtgttggcgaggagaaaggggactagttattgaacaggaggcctccagcacctctgccaacaccctagagctagatcaacagaatgctcacattgtcgaagccagcgatgttcctgttatccgcgaaaaactcagcggggctcttctgttccaatatatcgtcctttagcgctttggacgtcttgggagccgctttgacgcccatggtggggatctgcccgaccctggctagctgccccgtcagggtgagactttgcactgttgacgggcactattgcagagcatcacgacacagtcatctcgcccgacgcatgagctgtgaagtgtgtaattgcaagaaattgggcgatcagggtcgttcagagtgcaccgagatccttgcgggcacacatactgattgcagcgattcaatttttatcatgggcgccacgacgaaacaaccctcactccgagacccacacacattgggcctgcatcggtctgccaaggatacatattctgtctcgcattcattctgaatactctgagaccaaacatcgttgcttggatgctgtgttctaggttggttcgtcgggcactggctagtccagcggcgaccacgacagtccgcgacctgcctgccttcttctctctgcgcccacccaagctctataacagcgaatgggacgcatgcttctcgtctcagagtcaaggcagggaaccagatgctggcgcaatcctgcaggtgtgcatccaggggtgcagcgtggacctctcctccagcttctgggtggtgtgagatgattgacagcgaccgccacatcgaggtcaccagggcaggcaatgcgttcctttacactaccgagcagaacatccaggcccagaagttcctgagggatctgaagcagctgcagaggcaccagaaagtgatgagcttctcggagctggtgcaagggtacatgaagaggtgagcccctgcatgaattctcatgtgtcctgcttcttgcgccaagctgagccctggatccttgcccttgaccatgtcccgctcaggcccccctcaacctacgcccatgcatgcagcacgggggtcacggatgccgacgaggcctcgcggaactgcgccgcgctttccaccgcgggcctgatcttgaagcatggagacctggtctaccttgagcctggggaggtggcgctggccgtgctgggggcgctgccccagcagccgcagctcctgcgtgccaagctggaggagacgcggcgggagctggcggtcctggaggaccggcgaaggcatatcgagcggagcgtggccaggtggggctcagtgggtggggcccaggagcggtggagggggatgctggactagcactgggcactagcttggccctggaaacgcagcgcattgtagttttagcttgggggatggagtccaggccgtggcatcagtatgacgacgtcgcgccagcgtctccatgaccatgtgaactctcctccccatcttccaaaggaaacatcacctggcgaggtggggagggctggccttcctcaccctcccctgggccatcctcttcaggctgacatactgggagctgtcctgggacgtggtggtgagtgggggctttgagatctgaaggaattggcatggggatggaggtgcagcttctctccgctgctttcacccctctaatcttgcggcgctgcagaggaggaatgacacaactgactgctctgcttttaacactcgactgaaggctggccgcacaccgccacttccacacctacacagtccattcccgcctcctccttcccaggaacccattggctttttcctgactgggctcaccaccatcctctcatacctctggtacatgcaccaccgcgccgagttcacgtggagcgagatgcaccagcgcatgatcagcggctgggaggtgggctcttggggggaaatggcagcgggtgttgcactggaatcgtatggcgtgcgcaacctcagctacgggtgagtgccttgcaagaactggcttcccgcgcgcgttcaccccccacctgcctcaacccttccatccttccacctccacagcaacaagccttcaaacgtgccaattttgacgtcgctcgatatgagcagctgcggcgagccgcagagcgccaggaacaggcgctgcgcctgaccacgccgacccaacccctatcaccccatgctgaacctccttgatgtagaggctggccgcatgcaatccctgcagcagaaggaagaccttggcaattgcacagcactgggatcgcctcaactgtgcccagggaccgagctcaaggcactaggtcagctcaatgagagctctccagagttacagtccgggttgttgcatcatggcttcagtccgcgtcacgccttcttgccccgacccttggcactgccctcccgcccgcccttcttcgccacgcctccggccttggtcttgccggtgggcgcccccgcgcccttgctgatgcgccccttcttgttggcgcccttcatcttcatgcggtggcggtcctcccgcgcagcgctctcaaatttgccaatcgcgcggcccacatccacgatgtcgtcggcgtttttccgcaggatgtggtcgaccagcttgctctgggaggtccgctcgcctccgtcctgcagggtggcgatgggatacatggcgcagggatggtaaacacgcgttatgcgctgcttaggcagtggtatttggggtacgggcgtgttggtgtgccaaagctttgcctactatgagcagaccgccccatccaagctctccaactctaggcaggtcgtggggttcaagtccctcatggggtccaagcctctcaccgggcatgcagcctgcagggaggccgcagcctccccccccaaaagaagtatatacatacaagtataatatacatataccaccctctcccacccatcattagccctaccttgttagccacggggggcagcttcttcctcttgcccggcagcttccggtccgccacattctcaccagcaaccacacgatcgtgtctccccagcgacgccgtggagatggctgcctgccgcgtcgccgctttcagctgggaggggaaaggcgagtctggatgaagagcatggccatcggccacaccccactctgaccaagcgccccaccatgtatgtcccggaaccccaccgcccttcctatgacctctgtggttagttcattggcaccatgctcaaggctctcacctcctgcttgtagtccttgtggcgcaccggccggccccgcccatgctctggcagggcggccgccagcctcaacgtgggcggcagggcccccttgcccccgctcttggcagccgccttcagattggccagctgcgccttctcctgcttggccacccgtgccttcttatcacgcttctgcttggagaaggggtcatcgcccacctgcattttgcggaaaaggtgatacggtcgattggtgacagtgttggtgcacacatttgaactgtttcccaaccatgcgcgcatccacatattatgactggcacagtgaagcatcgcccccctcactaacccactcacgtcttcgccgtccttggcgtcaatgatggggacggccgccgggtcgttggccttgctgtacccgtgcctcctcttgaatgtgtcgctggtctcgtccagcaccagcttgctgcgcttgtgtttggtaatgcccttcttcttggcaaacagctcccacttggtgggaggcctgggcctgggtattggcttctcccggggcaaggctgtggtgggggctggtagttctgcgatgcggcccacgtcggcgggctctgagggcagggcgaagagtcggcccaccagcgcctgcatgatgcgggatgccgtggaggcgcaagcaccggaggcgtcccgggcgtaggcttccgcatccacgggactggggtcgtaggcacacagattcccaaggtcaaactccagtctcgcatctacttcctcgctgcatgtgcgaggtattggagtgggggggttggcgatcagggaattggccggtcctgaccgtgggcactcaggacgactcccaccggcgactcctcacctggggccgagccccagctcagcgggggtgacttttacgggtccttctgccatgctgataatgtaaagtgtgcatgcagcccggaaaatgtgctgcctttcacgaacttcacagagcaccgggaaaaaggcgcgcgattgcgctccccagcactgttgcgcgctggcgaagacctccttggaccccattaaacctgcatggccgtgctgaaagctcccggtcctcccagcagcctcgagctgtacatgttttagtcacgtcacgtcagacatcctcaatcacatccaggaccgtatcgaggggcagggcactttgctccgggccgtcggctggcgcgtccgcaggcagattcggatgctcctcggatacaggcactgagggttcaagggacgcgctccggggttgaccctcctcaaccgccatatcttgcgcaggtgaggactgttccggcggcgggggtgggtctccctggccccggcatctcaccgcctcctgttcctccgccaggcgagccagctgagcggcctgggggagcagaagagggggacgttagctgctgagtccaccccagtcatggtcgcaatcggaaccttccagccttgacacgggagcagtgtaaggggaggggcctgatccccgtcccactggcccccatccgcaccttccactccgctctttccagcttatgtgcagcccacagcccagcggtggccacactgtccttagcaggcctccagtacaggcgggggcctgcgctggcaggcgtgaggaggtactgggcgtcccagcatgcatgccgcgccagccgctgcgccgtcagcagctccactcgcttcagattggcctcgatggccaccctggcccgctctgccacggcctccgccctgcgggtgtgtgcaaggtggacacaaggtcatgtgcgagtcttaaatgtttgtcggcctccctctgcggccaaggcaatgacaccatgcacacggtgtctttgggcgctgttctcccctcaaaccctcgccagcctatcacctggcatccttctgctggcggagcagggtctccctcgcgagtctggaggcattgctggagcgctgctctgccttctgcaacagcgctgctcgccgcttgctgacctcaaggttggcagagccctcttctgcagccttgaactgagctagcgtgcccagcagggatccaaaaatcctcctgttacgcttctgcagcacagaggagcacggagagggaatagagtcagtcacaaagggtaccttggtggaggttatcaactgcagacccagtcggcagcagggacctccttggctgatagcggctgcagctnnnnnnnnnnatgcaactgctgtggaagccactttccggcgagactgcactcaaagaagggtggatgtgtattcagatgtgaagggccccttccacactcagaaccaacacattcccaaatcttggtgaccgattgtcacccacctcttgtggctgctgagagggaggcnnnnnnnnnntctgacgtggcggctccaatgctccccaccttgatgtcggtcctttcttcaagggcggccccctcaggctcgcgtttgaggccacggctctcatcatccacgtcacactcgccgccaaatcccgaggggacagccactcctgacgaaactgcaactgctgtggaagccactctccggcgagactgcgctcgaagaagggtggaagtgtattcagatgcgaaaggccccttccacactcagaaccaacacgttcccaaatcttggtgaccaactgtcgcccacctcttgtggctgctgagagggaggctccctccacccgtgatcccttccagcaggagccctgccctcgttctgccaccccgggtctctcattgttgcatgtggagcgccaggaggtcctcgctgcctccttgtgaaggattcatcgccatggaacccgcgaaaggcaccattgttgtcctcacggggaggttctcggctcacagtgccgcctctgcctggcaagcccctcccccggccgcgacctctgccgctgtgctccctcaagcgcgcatcgatctgagggcggtttaaagtgatactttaatccaacccaggtaaaatcgaccaaagcacagcgtgtcaaacggacactgacctgttgttgcttggaggtgagctcttctagttccgctttgatcctgcccacatccatatcttggccattcatcttgatgactcaatgtaatgtttgtgctatacggtggtctctctcaggaagtcctcgccgcctgctcttcattgaggtcgtaggcgcggacgaaattgcatgcgatgcatgggctcaacacgggagacattcgtcggtggtgatgcatgggtcagatgaaactgcgccgtactcatgtacactgcttctagtaaaagattcgtctgccgattccctgagcgctgcggattattcaggacgggaatggtcagtgccgtccagggagtgatattcaagtggtaaggggcctggtgtcaaccagactcgnnnnnnnnnntattgagatcgtgggcgcggacgaaatcgcatgcgatgcatgggctcaaaacacgggagacatgcgtcggtggtgatgcatgggtcggatgaaattgcgctgtactcatgtacactgcttctagtacaagactcgtctgccgactccctgagcgctgcggattattcaggacggcaatggtcagtgccgtccagggagtgatcttcaattggtaaggggcctggtgtcaaccagactcgtaatgccttggccacgccaccaaatcaaatcaactgataattctgactcctttccatattctgtgccgatnnnnnnnnnntggcttggccacgccaccaaatcaaatcaactcatgtttctgactcctttccatattctgtgccgatggtagtgatgtgccgctgaaggagtacatccgatccctggacgatgcggcatcggctgcagagaagttcatcatcgccgagctggacgatcagaacctatttgtgaaggtggctcgcgcggagttcgtggaggccaaggtgaagcagtttgtcaacgccctgcacttcacaaagccggaggttgcgccagggcaggcctgagcctgaggaggaagatgggggagctgcggcccagcgtcctgttagtgcagcaagaccgcgcggcggtgtacaacgacctgaagcaggccttcctctgcttcatcaagaccagggcggaggggccttggcggtgagagccgggtagacagatcttgttcgcgcagtggctgacttcgtggcgctgcctcccatgcacgcaaacgagccatagctcccttcccgaatctcggannnnnnnnnnattgacttcgtggcgctgcctcccatgcacgccggcgagccatagctcccttcccgaatctcggattcctcctgctgcctcaaccacagacacgccatggcagcagcagctcccgcgttccaggctctgtctgacaagatcaggtccctgatcgcctcctgcccagcgcatgcccccctcctctccagactgcaagacctagagagggagaggctgcgcatgacgctggcgctctatgccctgcaagcccctgcccgcctggagctctttgcctggcagcagaatgacggcagccccctcgaagcagggcaggggtgcgggtgcagctccggcgatggccactcgcatgccgcccatcagacccgagagcccacggaggcagagttccgtgcggcannnnnnnnnnaaagcagggcaggggtgcgggtgcggctccggcgatggccactcgcgtgccgcccatcagacccaggagcccacggaggcagagttccgtgcggcagtgagggagctcacctgcggcattgaggtgggggttatgggaccagaggatgccctgtctccacagcccaggcggagagtgtgcttgacgtggcgtcgaggaattctcggctctgggctgccctcaaacccgcctgccgacctacaaagcactcacaccgcaggagaacaccattgccatcaatgatgtcttggatgaggtgcgggacatcgaggacagtgacggcagcgaggacatgagcgagacaagaaacagagctccctgcgatcccagcgatgctcatacagccaggacggcgacccaaggttgacaccaagtgtttgcacgtnnnnnnnnnntgacatcgaggacaatgacggcagcgaggacatgagcgaggcaagaaacggagctccctgcgatcccagcgatgcacatacagccaggacggcaacccaaggttgacaccaagtgtttgcacgtctcctccccgacccaacgcctggcagtatgtacattggagcaccccattaaacacaaagaggcagatcacaggtcttgcctgcagcacagcatgctggtatgcctgcctgcctgatgcatggccagtgcctcagctcggcagctccttgccgtacaccacgaagaatggattcagggcttcaggcttgttgtaatgcagcggtatcgcctgttctagggctccctgggatggagagggggttggtcaagaagcatcggtcgcatacctcggggcaagagaatggcgctctcaaggccatgttgccttgtgcggcagacacaggatggcgacagtgccaggcttcatcacttttgtgttggtatctcatgacagtcgaggccccatgtcttcctgagaaggatgcccctctcagggacccctcccccaacaaaaagctcatgccagccacctgcaccccctcaacacaccctccagccctccagggcattgccgctggagtcgcatctgccggcctgcagcacccggccccctgcctcctcaacgatggcatgggccgccgcggtgtcccactcgcacgtcggggccagccgggggtacatgtgcgccgcgccctccgccaccatgagcagcttcagggaggagccgacggcgcggaactggggcgcccggaactcgcccacaaactccgccgtctcctggctggcatggctggcagatcccacgatcacgaggcccgggtctgtctccctgaaggtcgcacagtggagctggcggggaggcgaggccggcgactcacgcgcccaggcccccttgccggcgacggcccagtacaccttgccctgccgggtgaaagcaggtgctacaggggtgagctggcaaggggaggcacagttggagcaccaggcatgcgctgagtgatccaagcaaagccagcccctcatcatgagggggggggagactgcaccgtccacgggcagagcaggtgcgtcaggtgagcgcccacctacgctccctcgacacgcattccacactcttgcaccctcttggcacctggactggcacgtggaccacgcccagcaccggcttggcgccctggagcagggcgatgttgacggtgaactggccattgcgtttgaggaactccttggtcccatccaaggggtcgacgcaccagcagtactggtagttctgcaggaggaggggccacaggggggtggtgttgagcatggcgatggtccggccaaagatttgcaaggcgagaccagacacgctccagccagtcctactcacgcaccttgcgtgtgctgtactnnnnnnnnnntgggggggggggctgcaccgtccgcgggcagagcaggtgcgtcaggtgagcgcacacctacgctccctcgacccgcattccacactcttgcaccctcttggcannnnnnnnnnatggtgtggagcatggtgatggtccggccaaaggcttgcaaggcgagaccagacgcgctccatccagccctactcacgcaccttgcgtgtgctgtactccaccttctggttctcctcagacacaatgggaatgtggggcgctggggggggggaatgagggggctggtgagcggcggtacatttgtaatgaggttccagcaccgctggcacacagccgnnnnnnnnnnagggggaatgagggggctggtgagcggtggtacatttgtattgaggttccagcaccgctggcacacagccgtcgacagatccctacccacccagctgagtgaggccggagcagatgatgctgttggcctcccggtcggcccgtgtcagtggggactgatcagccttgatctccacctccgggttctgcatggagtagccgagagcggaaacacatcttggatgcagcttgagatgggctcaggcctgctcacagcccagcgaccagggctcccccgctcgccttggcatggtacacccggaggatggcttgcgcggccacctccgcgatggccacgacctcctggacatctatatcaaacctcagctcaacatgaagtttgtgcatgctgcagctggcgagaggcgcnnnnnnnnnntgcccttaaccacactggtgttgacggttggggggtaaggagcgtagtgtacagcaagcgggcggtccggcagcctctgcaccgccatcagacagcattcttcaatatctatgacacacacacacgtgatgtggaggtgatggggagacccggagggagccgctgcggccggcccgcctccatgccggcaaggcggtgtcccaggcccccttcacccgacgctgcccnnnnnnnnnnggggggcgacgtcggaaataacgctacgagtgtcggagccccgtcagttccgacggnnnnnnnnnnaggggcgacgtcggaaataaggctgcgagtgtcggagccccgtcagttccgacggnnnnnnnnnntccagcttcaggctcatcagctggttgacctccgcggcaaactccaggggcagctcgttaaacacctcgcggcagaagcccgagatgatcatgcccaccgcctcctccaccgccacgccacgctgctggaagtagaacagctggtcctctccgatcttggaggtggaggcctcgtgctccacgcgcgcggtggggttgcgcacctgagcgagggggggaaaggggagcatggtgggggggggggggggggcaaggggggggggnnnnnnnnnnctgctgtgcagatgtgcaaggggctccgcacctccttcccccccgtcccaagcgagaccccccacaccgcacctggatgtacgggtaggtgttggcnnnnnnnnnngcagccgctgtgcagatgtgcgaggggctccacacctccttccccagcgtcccacgccagatccgccaccccgcacctggatgtacgggtaggtgttggccccggcctcgtccccgatcagcatggagtcgcactgggagtggttgcgcgcgccgtcggccccggggccgatgctgaccaggccgcggtagacgttgcgcgactggccggcggagatgcccttggacacgatgcgcgagcgtgttcgcggacccacgtggatcatctttgtccccgtgtcggcctgctgccggttgttggtcagggccacggagtagaactcgcccaccgagtccgcccccgccagcaccaccgaggggtacttccaggtgatggccgacccggtctccacctgggtccaggagatcttggagcgcgcgccggcgcacacgccgcgcttggtcacgaagttgtagatgccgccgcgccccgcggcgtcccccgcgtaccagttctggaccgtggagtacttgatctctgcatccgcggccgcgctgagctccaccaccgccgcgtgcagctggttggtgtcgtaggcgggggcggtgcagccctccaggtaggacacgtgggacccctcctctgccacgatcagcgtgcgctcaaactgccccgtctccgcggcgttgatgcggaagtaggtggacagctccatggggcagcgcaccccgcgcgggatgtagacaaaggagccgtcggagaagacggcagagttcagggccgcaaagtagttgtcgctggtggggacctgcaagcgattgttttttgggggggaaggggggggggcgtatgcatactgactgtacgagggtggtgtaaacgataaaggagggatgcggaggagacagtctaggggcaggggagccatgtctgagcaagaagcagaggagtgtcaaaggggccggggcgaaggctttgcagaagggcgagggggcacagaacatggatcaaactgccagccccggcccaatcatcatgatgataaacacacgcgcagtcacacacccgattcccgcccacccacgacacttcccccaacctcgatcccagacgcaccaccgagcccaggtgcttgcggatgaggtccgggtactcgcgcacagcctcggagatggagcagaagatgacgccggcctttcccagctcctcgcggaaggtggtggcgatggacaccgaatcaaacacggcatcgacggccacgttggccagccgcttctgctcggccagggggatgcccagcttgtcaaaggtggccagcagctctgggtccacctcttccagggaccccttcttctccttctggcgcggggcagagtagtagctgtaggcctggtagtcaatggcagggtagtcgttgtccgaccaggtcggctcctccatggccagccacctgcgccacgccttgagcctgcgcggggtgcggggtggacaggggtgagggaatggttttggaagattgcatcatgtatcgagggcgccgtgatccctcgtggtcgaaataggcatgccatgtcccacgcccaatcccatgaacccagccagctgcctacctaaactccaggagccactccggctcctccttcttgagggagatagcccgcaccacgtcctcatccaggcccttgggaaagacgtcagactctatgaacgtcttgaagccgtacttgtacggcttgctcaacatgcgctgcaggtcccgcttctcctccgacatttccgtggccggctcacgcacgaagtccgtggcggtggcccgcactcgcgcgcactggggccttgaggggcgggcggggcgtgagcctgcccggaaagggcgtgcggggcatagactagaggtcagtaggctcgcgccctggagcgcctgtgtgtgcatcccgctcaggctctccgggggggagggagggtgtcctaggggtcgaagatgtatgtcaggaacagaatatatctgcaggtgaagttaagagggggttgtagttgtgcgacggatgattgctccctgggcataaagacgagaggnnnnnnnnnnaatgtatgtcaggaacagaatatatccgcaggtgaagttaagagggagttgtagttgtgcgacgggtgattgctccctgggcataaagacgagaggccggatgggggagggggggatccgcaaagatatccacgctggcaccatgaaagatttcccagggcaaaaaatgaaccaaaactccgtcaaatgaagaaatcaatggtgtacaatcgtaataaaaagctgcttctgtagatggaatttacctgaccctcgcgtggtccatgcaagcatgccgtgcatctccgtgcctcccctctgttcagcgagtgggtgtgcaatggtataatatactccagcgatcaagctgcgcatcattgcatcataccttgggatcagggagctgtgcgacacccgagcgccggggcttttgtcaggcatcctcctcacaccgcgacggcccggctgcggccttagacaggtccggtacaggaccactcgcaggccttatttctgagttcctagccatgatttgcgctccctcaatacctcctcatccacttgctcccctgcagggaatcgcaggcccccgccctgcgcccagacctccacatcgtcctggttcaccctcaaattcctcagaacaccggcagcatagcccgaacatgcgcagccacatgcgtggggctccacctggtgggccctatggggtttcagatttccgcaaccaagtaagacggtcggtgggatctcgagtgagggatggagctggtggtgctagaagtcgggaagtgatgcgcatggcgcatgtcttgcacgcagcacgagctccctcggtcgaccggctcaacaagactgagcagtttatgtgatcgctaagaataaaatccagacacatccctaactctcactctgcaaggttgaagcgcgccggccttgattactgggaccacgtgtgcatgcaggtgcacgatgacatagaggcattcctggcgttctacgagtcattgccgggccccaaacgcctcatcggctacagcaagtttgcagagcgccactatgctcaggatggactgtatggtccagggacgtggcttgtgtttggcagcgagacttcaggcctgccgaccatggtgcgtgcgtacggggatgcagcattctgcaggaaagaagggtgctgtgccgccttcaggcagcatgtacatggtgcatgatcctgtggtggtgaccacaacgagcgcatatttgcgaacaaggacgtgcctcgtgttccaaaagctcttgcgtgtccttcctgtgctcacactaccactgccgtaccttccaggccgtggaggccgtcaacaatgacgcagggaatagtgccatggtgaagatacccatgcagcagcagcatgtgcgcagcnnnnnnnnnntacatgccttgagttccaaaagctcttgcgtgtccttactgtgctcacactaccactgccgtacctcccaggccgtggaggccgtcaacaaggacgcagggaatagtgccatggtgaaaatacccatgcagcagcagcatgtgcgcagcctgaacctggcaaccagcgtgggcatcggcgtgtatgaggcgctgcggcagctcgacggcgccgtcctgccggacgtgaaaaatcactgactggggcaaggctggccagtgcgaccagctgacatgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagccatgaccacgtgctccacccccctagcgcgcggggagcaacgtgcttcctagccaactcgtgaacaaaggtttggggacatgggatttaccaacaagaactcctcgagtactgcacgaattgacaggccgcaccccgtattccttgcgactcggaacacccccacccgactccgaccagtccggaccagccccaaccacccggtaacaggggtttcccggtcggcgaccatggcggcactgacatgcaccgcccagatagtaccgagcctgcctcgccaggccgcgagcgttcgggtcgggtctagggtacgtgctgggggagggtgagtaggccgaccccggtgccacccttattctgtgtcaaggcaaagcatgtcgcctcctccacatcgcaggcacgctctgtctctgcccctcgctccctgcgctgcatggtgggtctcgatgccgagcggatggccggtgtctcctgggcattggcttcatggagattcttgccgaatgttcacccaatgcctgtgcaggagtgctgatcgaagctcagctggcggcatcctgccggggcccatgcctctccttgcatcactcgccactccacctgctccctcccttcccccccacccgcaggccaccgcggtccccaccgacaccccggcggccaagaagctgtggggcgggcgcttcaccggcgccaccgacccgctgatggagaagttcaacgagtccctgccctttgacaagcgcatgtgggccgaggacatccgcggcagccaggcctacgccaaggccctggccaaggcgggcgtgctgaccgacgaggaggcggccaccatcgtggagggcctggcccgcgtggcgggcgagtgggaggccggcaccttccgcatcgtggccggggacgaggacatccacaccgccaacgagcggcgcctcagcgagctgatcggcgcgctggggggcaagctccacacggggcgcagccgcaacgaccagtgcgtcaccgacacgcgcctctggctgctgggcgcgctgggccgcgtccgcgcctcgctgcacgcgctcatcgccgcggcggcggaccgcgcggcggccgaggccgatgtgctcatgcctgggtacacccacctgcagcccgcgcagacggtgcgctggagccactggctgctgagccacgcggcggcctggcagcgtgacgaccagcgcctggcgggcctgctgccgcgcgtggccacgctgccgctgggctccggcgcgctggcggggaacccctttggcgtggaccgccagttcctggcgcgcgagctgggcttccacggcggcgtctgcccgaactccatggacgcggtgtcggaccgagacttcgtggcggagaccatcttcaccgccagcctgcacctggtgcacctctcacgctgggcggaggacctcatcatttactcctcagggccctaccgcttcgtgcagtgcagcgacgcctacgccaccggtgagtgccactttgcgtgtgtgtgttttgtgtcaatggcggggggttgtgggtgaggggccggtctgagaccgccggtgtgctgcgagattcgtgaggtatgccctctttggtcgtgtgggccggactttgagcagggtcacagcaggcgtcccactcctccccctgccgcttccccccaggctccagcctgatgccccagaagaagaatcccgacgcactggagctgatccggggcaagggcgggcgcagcatcggcggcgtgacctccatgctggcggtgctcaagggcacccccaccacctacaacaaggacttccaggagtcgtgggagctcatgttcgacgcggtggacacgctgcacgactgcgtgcgcatcgccacgggcgtgctgagcacgctgcgcatcgatcccgaggccatgcgccgcggcctctccgccgacatgctggccaccgacctggccgagtacctggtgcgccgcggcgtacccttccgcgagacgcaccacatctccggcgcggcggtgaagatggctgaggaccgcggctgcgcgctcagcgacctgacccctgccgacctgcgcaccatccacccgctcttcgacgatgacgtggcagaggtgtgggactttgcgcgctccgccgacacgcgcgacaccgagggcggcgccagccatcgcagcgtggcagagcagatctccaagctgcgcgcctacctggagcagaacgcggtctgacggcgctcggcaaggaggagggaggagggatggatcgaggggaggggggccggtgtgcagacgccacgccctcgggtcaggcgacccgagctagccgccgccttcatggaccttctgnnnnnnnnnntgacgacgacgtcgcggaggtatgggactttgcgcgctctgccgacacgcgcgacaccgagggcggcgccnnnnnnnnnncggcaccgaggctgggcgcgatcggctcgctggcgagccctcactggcacacgccaccctcatccactgatgtcctgatttnnnnnnnnnnaggcaccgaggctgggcgcggtcagctcgctggcgagccctcactggcacaccgccaccctcatccactgatgtcctgatttnnnnnnnnnngtggggtcaggcgtcacggtggagacggcattctccctttgcgcgccggaacgggtgcctgttccgtggtccannnnnnnnnnttacacagcatgcacggctccagcttcctttggtaatgtctagttgacccacgtaagaaactgccccaccaggcatcaggaagttgggaccccacgcgctcgagggatcagatcagttccattcccgccgacgtccgcgccccggtcgcggnnnnnnnnnnaactaggcgtcagggtgctgggaccccacgcgcgctcgagggatcagatcagttccgttcccgccgacgtccgcgccccggtcgcggcccgtgattggccagatggtcatcagcagggtgcggcacattggccacccagaaccaagggccagatttaaggcagcgatacaatctttacaggtgtgtctggtcatgggctgtggtgggttggggtcgggcgtcccggtggagacggcatccccctttgcacgccggaacgggtgcctgttccgtggtccagacttcacgcattccatggtaccggtgccgagcgaccctttgattcctacaatcgcttggcctatgccatcctctcatcccttccctcccccacacactagggttccccgacacccccccgggacccctctcaccatggcccggtgcctcctcctcgctgccctggccgcgctgctgatctcaggcgcccaggccgggtgcaagctgcgccgcgaccccaacctgaagccggaggaccggttctacaaccacgtccccctgaactcccagctccccctggaggccctgcccaagaactttgactggaacaacaaggacggccgctcctacctggcccccagctggaaccagcacatcccccagtactgcggctcctgctggctgcacggcaccgcctccatgctccaggaccggctgaagatcaccaaggacggtgccggtcccgatgcgatgctggcgcgccaggtcatcctgaactgcgccgccttccacggcttcggcggcggctgcgacggcggcgacgtcatcgacgtcctgcgctacatggccgcctacggcctgccggacgagtcctgcatgccctacgccgccacggaccacaccaagtatggcaagcatgccaaggcctgccccgcggaggggtactgcatgaactgcatgcccatcaagggcaaggacacgtgctgggcggtgaagacccccatccgctactatgtggagagctacggccagatcacggagaagggcgaggcgcccatcatgaacgaggtgctggcccgagggccggtggtctgctccatcgccactcccaccgtcttcgactacggctaccacgccggcatcttccacgacaaggacaactccaccgacgtggaccacgacatcgagatcgtgggctggggcgaggaggacggccaaaagtactggatcgtgcgcaactcttggggcacctactttggtaacctgggcttcttcaagctggagcgcggcgtcaactccctcatgatcgagaacggcgactgctggtgcgcgggagggggcctgtggtgttcagggcggggccgggcgcagggactcgggccgctgcagcggggtgtggcctaggtgactgcaagcagacccgactgagagagaacaggctgcggcgcaccttgccaagtgggcttccaggcatcctggctcctatggtcctctggtgccaaccgcacgtgcatgagccagccactcagtgcagccctcccccattcctcacccgtggccaccaaatccatcccaataggtatgcgactgtgagctggcaagacgagcaggacatccggtccggcaagaaggttgggaccatgtggggcatcatgaccaaggaggaggccgccagggtcaagccggaggaggggaccaagccccatatgaaggacagggccgatgaggaggagggggatgaggaggcccctctgcgcatcaagccctttggaggcaagggatctgcacagagcgtgctggctgctgcatgagggtcgtgtgcaagcagcagagggggcgcttcagggacacctactcctcctcagcatgcccttggtgccatctggattgctccgggcgtgtcctacccacatgttctgcaatgcatgagcaagtaataaaggagcacttgagtaacatggatgacggcatcgagtccctggggagaagagaggagagctgctgagcgtgccgtgtcgccggaagcgatccacgataattttaggaaacccgcaacactctctcgtagacaaggcgacgatgcaagcggttttcagaatagtcaagcatgcccaggtcctcgactgcacgacctgatggcggtatacacgcacatcaaggcggtatgagtgcctgtcaactgtaaccgagcaggggaggcgagcccggaggacagccagcatgtctgtgatcctggagaccagcaagggagacatcatcatcgatgtcttcgtggacgagtgcccaaaggctgccactaatttcctcaagtgcgcctctgtgtgtgtgtgtgtaccgggggtatccctactatgtgtatgtcgagccttgctccccagctaaaaagctacaatcactatcttcatggtacccctcccccttcatcagactgtgcaagatcaagtactacaacaactgcctgttctacaacgtccagcggaacttcatcgcccagacaggcgatcccactaatactggcaagggtggggagtctgtttacggggtgctctacggggagcaggcccggttcttcgaggatgagatccgaccagcgctgaagcacaagaagaagggcatggtcggcatggccagtgagtgccgctgtgggggtttgtgggtggcgcgggataccgggcctgatgaatctgctggggagtgtttttctctggatgccccttgcagaatgactggaagggtgacgatgaagtatggcttgttcgacagtcaccccnnnnnnnnnnaaatctgctggggagtggtttttgctggatgccccttgcagaatgactgaaagggtgacaatgaagtatggcttgttcgacagtcacccctcctgagattccccatccccccccaaaaaaaaacacactcaccactaggcgtcggccccgacgccaacgcctcccaattctacatcaccaccggggaggagctgcagagcctggacgagaagcacaccatcttcggggaggtggcggagggctgggaggtgctggaggccatcgacgacgcgccgtgcgacgacgagggtcgcccgctgcagaacatccgcgtgcgccacaccatcgtgctggacgaccccacccccgacccgccggcgctggctgtgcacgtccccgacgcctccccgccgccgcagttcgcggaggacgggcggctggaggacgactgggagccgggggaggacgcgcggccggcggaggaggtggagcgcgcggggcgcgaggcggaggcgcacaaccgcgcggtggtgctggagatgatcggggacctgccggaggcggatgccaagccgccatccaacatgctcttcatctgcaagctgcaccccgtgaccagcgaggaggacctggagaccatcttttcccggttcggcaacatcacctcctgcgacatcatccgcgactggaagacgggggactcgctgtcctacgccttcatcggcttcgacaccgagaaggcgtgcgaggaggcctacttcaagatgaacaatgtcctcatcgacgaccggcgcatcaaggcaagctcgtcattggcaggggggggcgcagtgagaggggtgtggaatgaggaagtcgttcgcatggggagggcgtgcatcctgagtgaggcggtgctccaacaatgcggtgcggcaccaggaccggccgccttgatggcttgcaaagacctgtgcaggtccttgaccgccatcgtaatcccccttcatatcctttcaaccccaggtggacttcagccagagcgtgcaccacctgtggcgccaattcaagcgctttgggaagaaggggaacgctgagctggcagacgcggcagccggccacgaccgcggcggcagggacgcaggtggggcgaggggctcacattgctggcaggccagccggcgtgtccttgcaacagtgccgggcgaaacgcagggcccttggagcggtcccaggcgacgctgctgccatggcgccctgttgccgggtggcgattctgtgactcatcctgctctcccctcccatgcaggcacatcaggccggctggagctcaaggagcagttccgtggcccaacactcagtcacgggaggggcaacagggagggctacggcttaatcctagatcattacgaggtacgtggggaggggagaccctttccctggttcgactgactccctgtcagatgcctgggtggcccagagactctggcctgaccaaagcggcggcctgcctcaagcccaggagcatgatcgaggcagtgcaggcaaccgctcctcgagcttgtggcaagaagctggtgtcctcatcgcacccacaccccatccgtgcacaggaccatgggcggccgcagggcggggcgcgccccttgtccccgtctcgcgacagtgggaggccggggcggatggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggccggcacaggagcaggagcagggaggggaggcacgggaaacccaggagcaggagccgggaggggaggcacggcaaccacgggagcaggagccgggaggaggggcacggttgtcacgacagcaggagtcgggatgggcactccgagcatcgagagcgctctgacaggcgcagggagtccgaacgggaggggaggagggaccgcagcggggacaggaagcgtcgcgggcgctgcaggtccctgggcaggagcgatcctggagaggtggagactgagaggcggcctcacgcccatcggcatgctgatcgccactaatacggattttccacccttggatggaaacaaatggagcatggcaggtcgagagggcgtccagatcgtcatgctcccatgagagatcaatgaccgcctgcgtcgatgacccnnnnnnnnnnnnnnnnnnnnnnnnnnnnnnnnnnntgtggtgttctattacagttgggatgcgtcttgcagaagctgcgcttaaaacgtgggcgactccccccatccgcgggtcgtcccgggaacaaatcggcgggcagggcgtgccaagtgttttctgagctgctggcgcgccagactctccccgaggcttgatgcagaaaggcgcccccagtgtcacacaatacccagttcgtctgtaccctgtttattccctgtctggcacnnnnnnnnnncaagatcttccctcccccgcgatggccactacgcagccattcgccagcgcagtccggtgcaagttaggggcattagaatggaatatccagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagctgctggcgcgccagacccttcccgaggcttgatgcagaaaggcacccccagtgtcacacaatacccagttcatctgtaccctgtttattccctgtctggcactcagggtttgggattttcaaacacatcccccacccgtgccaagatgcagttcgccccctcggcccgggctaccctgcctgtggcgagctgccggccccgactggtggcaactcgccccattgctcgtgtggcaagcctgcacaccgccaaggcggcaatggtgccccagccgctggtgcgccttggggttgggtagggtctggcgtctgcactcgttgggccggggccgagcagccatgacgtcgctccgcgtcggtccatatcggaatgtggtcggccagagtctgtctactttttcaggaagttcgagtggccgggccggatgtccccgtgtcctgggtcccgcgccttaccctcccatccccatgcaccctgtccccagatggctaggcctctggggctggcgtccctgcccgcccagcagcgcgccaagcccactagcgtgcgcgtggaggccagcagcagcgcagctgcccccgccccggcccccaaggagggttccttcctgggcatccctgccttcacctggcagaaaatcgtccccctgggcatcatgttcttctggtgagctccgtcctgggtgcttctggtgcctggcagtgctgtaatttgccttgttggcaatgtcgaacgcctgtgtcatgatcgtcgatgcgcccctgctcaagcggatccctggcgtcgggccttgcgtaccccgcccgtccatcctcgaacccatgcatggggtcccaagcgcatgctgacccttccccccagaccgcccctgcacccctgtacaccacacccctcccccccacagcatcctgttcaactacaccannnnnnnnnnaaacgcctgtgtgatgatcgtcaatgcgaccctgctcaagcggatccctggcgtcgagccttgcgtaccccgcccgcccatcctcgagcccatgcatggggtcccaagcgcatgctggcccttccccccagaccgccccttcacccctgtacaccacacgcccaccccccacagcatcctgttcaactacaccatcctgcgcgacaccaaggatgtgctggtggtgaccgcccccgggtccggcgcggagatcatccccttcctgaagacgtgggtgaacctccccatggccatcggcttcaccatcctctacaccaagctggccaacgtgctgaacaacgagcagctgttctacacctgcatcatccccttcatcgccttcttctccgcatttgccttcctgctctaccccctgcgcgacgtgctgcaccccaccgcctgggccacccaggccctggcccagtacggcccgcgcttcgccggccccctggccatcgtgcgcaactggaccttctgcctcttctacgtcatggccgagctgtgggggtcggtggtggtgtcggtgctcttctggggctttgccaaccagatcaccaccgtggacgaggccaagcagttctacccgctcttcggcctgggtgccaacgtggccctcatcttctccggccgtgccgtcaagtggttcagccagatccgggccagcctgcccccgggcgtcgacggctggggctacagcctgaagggcatgatgggcatggtctccgcctttggcctggtcatcgtcgcggtgttctactacctcaaccgcaccgtggtgccgagggtgcaggacgccatcccgaagcgcgccaagaagaagaaggagccgatgtcggttggcgagtcctttgccttcctggccaagtcggcctacatccggaacctggccacgctggtggtggcctacggcatctccatcaacctggtggaggtaacctggaagtccaagatcaagcagcagttccccaaccccaacgagtactccgccttcatgggcgacttctccaccgccacgggcgccgtcaccttcaccatgatgctggtgtcgcgctggatcttctcccgcttcggatggggcatggccgccctcatcacccccaccgtcctcctcatcaccggtgggtggcggcgcgtgtgtggtggtggggttgagggcggggtgttgtgagggagtaggagcggggtattgtgagggagtagaagcggggtagtgtgagggagtaggagcggggatgttaacaaagatgagtggaacttgtgctgcatggcctagggatcaagaacggccctggccatgttgccgcacatactagactcgtacgtgatcccgacacgtgtgccaatcggtgttgccgtccacgcattcacgcgcatgcatgcccaggctctgaccgcaccccccaactccagagaaccacctcacccctcgtctcacacccccctctcctcccccccaaccccctcccctccaggcgtggtcttcttcgcattggtgctgttcagcacccccctgacgcccatgctggcggggctggggatgacccccctcttcgccgccgtgctggtgggcgcggcgcagaacatcttctccaagtcctccaagtactcgctgttcgacccctgcaaggagatggcctacatccccctggacgacgagaccaagaccaagggcaaggccgccatcgacgtcatctgcaacccgctgggcaagtcgggtggcgcactcatccagcagttcatgatcatcgggtttggctcgctggccgcctccaccccctacctgggcatcattctgctggtcatcgtggccggctggatcgcggcagccaaggacctggactggcgcttctccgcacagcagacggaggccgccgaggccaagctggagcttgcgcgcagcgacgcgcgcgccgcacaggaggccaaggactcctctgcctgattttacaccgggagcaaagccacgccagccccaccggatgacctgccgtctgcaggaccacatggtgacagccctgtgcaggggaagccacccttccctcctcctcccacccaagggatgatggggctcccgccccaaccacccactggtcgcccctgcacgacccagcgggatgcctacctccacatctgcccccactgtctctgacccaacacacactnnnnnnnnnnttggtcgcccctgcacgacccaacgggatgcctacctctacatccgcccccactgtctctgacccaacacacactgaacccccgttgctctcgctcgttcgtatggtgtcttctccctgcagaatgcgcaactccgtgccttttcggcctagacgcctttcacgaattgccacgagcgagggtgccgcagcgctgggaaggtcccgtcgtgtcgaggagtgcacgcgcgctgggacctcatgcatatgcctgtcggcccactgcgtacttgcaagggcgagcatccaagtctggaggatagaatgcgagaaattccgacatataatataaaacgctgcttgtctcgccatcgcaacttccgatccctggcgaactgactgtgtgaaggcgagacatccaagcccgcacgnnnnnnnnnntcgtgccttttcggcctagacacctttcacaactttcaggaaaacgcattgccaagggggaaatttgggaaggtcccgtcgtgtcgagaagtgcacgcgcgcttggacctcatgcatatgcctgtcggcccacttcgtacgtgcaagggcgagcatccaagtctggagatagaatgcgagacaatttcgacatatgatataaaacgctgcttgtctcgccatcgtaactttcgatccctgacgaactgcccgtgtgaaggcgagacatccaagcccgcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcgccccagaggttctggaaggagtttgtaagccagcgacgaccggtgcgcaggccgtggacaatgtgacatggccgctcacgctgggcatgttatttctggagtcaatctccgtgccctcaccctgtgcgagtgtcgactccttccttcaggtggtactggatggcctggacgcccatatagcagaactttccaggaaatggacaaaggagaacctcagcgagcgtgcggtgcgtgtgtgggtttgggtattgcatggctggccacattggctcccctctaccaaggcttcaggcttccaacggctcatgaactccccaatgtgacagggagactgcatgctggaggtggagttttccgacgagggagcagcgcggaagtacggccaggggatgaagcagaccatgccctttcgccggttcctgcagtccattgctgatggggaggactcgcggtacctcaccacccaggatgtcagtcggagagcgtgattgggagtaggagagcgtgcctcagagtcttgagcctgcactgggtccagaagggtgacccagcatatgctggcttgccccgttctcccacccccataatcgtcccgtcccctacacccaggtccccaccgagattgacggccaccccgccctgtacggcagccccctcgtggcgctggagggggacttcccccggctcccggagctggccggcagcctcgttcccgcctccatcaacctgtggatgggtctgtcggcgcagggcaccagctccggcctgcaccacgatttccacgacaacctgtactccctgctgcgcgggaggaagacctttaggctgtggccgccctcggcgctggactccatgtatccacacggccggccagtcaagcgctggcccaatggcagagtggtgtacagcgaacaggtaccgcgctgggtttgacttgccagggaggtgtaagaggagagtgccccccggctctacgtgccacacctctggtgctctccatgacgaatcgaatgcctggctcctgggtgggctacttggagtcgtccccctgcccagacctttggacctggtgctcgcaggggaacattgggccagatggggtcgacatggatgaagagcggcgctgggaggaaaaatttgctgctgagatggagctggagatggctgagaaggctgtggaggctggcgagcaggtgggctgccacctgtggctatattgttgaggcaggcagggttgatgttgttccaagtacgggagacagcctcctgtccttggagggggcatgattgcgggcttcccgctcaggcccattgcccgaacacccaaccacataacccacagggtgcaaagcggcggctgcaggctgccaacaggaggctgnnnnnnnnnnagaacacccaaccacatgacccacagggtgcaaaacggcggctgcaggctgccaacaggaggctagatgcagtcatggatgcggcgatggacgagggatcagagtggttggacgactttgatgcgatggagcgacctgctcagaggcccactacctcaggtgggcccctgccaggtgaatgtaggttatgaggaggagtcgcggtgaacacgagtgcaagtggcactgaaccctcacctgtgcgtagtaagctgtcaccaaggcatgcttattttgccaagacagagcgcccctgtgccggcacaggtgcggcccctattcctcccagcttcagtcggattgacgctgacctgccaccagctgagatcgagaagaagtttcctcgtttcaaggtgcgctactgtgcgagggagggtgtaggaggacaatcctgcctgttgacgtctgtcgaggcacatgcatgccaggtcggcgacagcgccgagaggccatgcccatcatgaatcttctcgcggggatggtcctcaccaagtcccatgttctagaaataacacttccaaccccaccggccgccgggannnnnnnnnntctgttgacgtctgtcgagggacatgcatgccaggtcggccacagcgccgagaggccatgctgatcatgcaagttctcgcggggagggtcctcaccaagtcccatgttctagaagtaacacttccaaccccaccggccgccgggagcaggggttttccagtgccatcacgtgcacggtggaagcagggcagaccctgtacctgccggctggatggtggcatgaggtcactagccagggggccggggattcaaaggacgctcccggggagcacatggctctgaaccactggttccacccccctgacaacctggatgcagaagcaggtttcagcaagccatacacgtgaggaggagagtggggcagcgagtgtgaaactgtcatggctgtgcagcctggtgatgtgatggtcacgtcgagagtccttgcatgagagctggacggccactactgacaccatcccaaaggtcagctcctcccatgacaaccccctcctcattgcagctccgacttctggcctgcggnnnnnnnnnngtggtggcatgaggtcaccagccaggggttcgggggttcaaaggacgctcccggggagcacatggcnnnnnnnnnncctgtgcagcctggtgatgtgatggtcacgttgagagtccttgcacgagagctggaggcccactgctgacaccatcccaaaggccagctcctcccatgacaaaccccttctcattgcagctccgacttctggcctgcggtgtggcgggggcgatgcaggcatgctgccgccgcgccgggtgggacggcaaatcctggctcagaagctgggggagacctggtgctcctgcaggcggctgggctgtcgcacgggcctgttgatcaccaccatgatcatcaccaccatcatcacgatggaaagtcctgctgctcggggcatcgcgcgggcgcagggtacaggccgctgaagtgggatgggccatggggcatgggccggcggcaccacctcaaccgattcctggcagtggcggcgttccaagcccctgccaagcggcggcgggggctgtgatgctgggacgtgagttttagggcatccagagcaaaccgcgaccagaactgctgtagaattgctcgccagccgccatgcaatgcagctcggggttaacaccagagcacgggatggcaatgcactcgacagtctccaccgccaaggtgaaggagcaccctgcaagtacagtccattgtaatttaggtccaacctccacatcagtctggtttacacccgtgtgaagcaaatctgactttgctcatgcctagcacttccgtggcggctgctgcaaaagtgggaatggaccgtgtcacccagcagcnnnnnnnnnnccagtccgttgtaatttaggtccaccctccacatcagcctggtttacacctgtgtgaagcaaatctgaggttgctcatgcctagcactttcgtggaggctgctgcagaagtgggaatggaccgtgtcacccagcagcactgactgcacaagttgttactgcattccatgcaaatgttggtgaggtcatcagatttgcgaagcatgttgtagtttgggactgacaggcaataatcatgtatggaaggggaatcaattttnnnnnnnnnntttggtgaggtcgtcagatttgcgaagcatgttgtagtttgagactgagaggcgataatcatgtatggaaggggaatcaattttgcaccagatcggagtggcgccctgccatcgcgacgagtgtttcttgagaaggaccgcgcctagacacctgatcattgtcagattgctttaaaaagatttcagccttgcatttatttcgattcttagcataccgtaacagcccagcgaatccgggcagcttggtcgaggatcgcaccaacacacctccctctcaaggaggtggggacacaatgcacacagccctgtacagggccaatgcgctactcacgtatgccggatcagtgctcgcagtcctgtgcgtgctggctacgataacaggtgccaatcagaggttgagtgagctgtgcctacaggcgcatttctagggatgtatacaatgtctcaagcatcagtgttctcactccgccatttgatttcgcagatgtgttccatactgcacatccctccgtaacatgcgagttcaagggcatcgacggcctgcaaagagagtatggccacgacagggtgcgctggggctgtgggtgggtcatggcctcgggcctggacaggcagcgacttccaggcatttacaggtagctgctccagggactcctatgatttgcacctcggccatgtgtttaagtagcctcatttacctcacaccctccaggcctacccagtgctgagcctgaggggtgactggacaagcgagttcacgtggaacacaaaacagatcttcgtgtatgccaatgtggagtttgagacacggcagaacaagcggaacgagatgctcatgtggagcaagctgctgaccagcaaggtgggtgatgaagggcggcttgactgtggtgtcggtttactgcatgactaacagccaagggagtggatggagcctatgctgtgacaggcatcctttttccccaagattagtgagtggacgcagagggtgcccttgtaatgtctgttgacccaagatggnnnnnnnnnntggtttactgcatgaataacagccaagggagtggatggggcccatgctgtgacaggcatcctttttcccaaagattaatgagtggacgcagagggcgcccttgtaatgtctgttgacccaagatgggctgtcgggtcgaatggtattacaagcgggatgagtgtgccttccactactgagcgagatgggggcactcgtcggaccttccttgcgacacagtgccacagctcacccctccccattgcccctctgcaggacgaggcgactgttgacctccctcgcctggcccaggagttccccnnnnnnnnnnctatcgcaagcgggatgagtgtgcctgccactactgagcgagatgggggtactcgtctgaccttccttgcgacacggtgccacagctcacccctccccaattcccctctgcaggacgaggcgactgtcgacctccctcgcctggcccaggagttcccctatgctgtcacggaccagggttacacgctgcggggcacgctcttcaacatcagcatcacctggaacgtgatgccacgtgtggggcgcctctacacccgcacgcaggcgtttgggccctgggagctgccgcaggactaccagaccctccagaaggagggctgaagggatggcagggtcttggccttgcccgcggaagttttgcgtgcacgactgtcagcgatggacactgctgtgaacgaaggcccggccgcagcccgccagaggtcctgccatgtgcatcttgtcgattcaagggactgtcagcacgcgtcacgcgagcatgcctgtgcccacgtccacgctgctcactcctgcatgnnnnnnnnnnagtcagcacgtgtcacccgagcatgcctgcgcccacgtccacgctgctcactcctgcatggccgcctcgccggcgacgacgttgcacagctgccactcgcccccgaagtcgggccgccagaggcagacctggccgcgctgggtggagcacgccagccaggtccccagcgggttccaccccacctgccagacggggctgtcgtgcggcagcacggccgagcgccgaacctccagcgcatcgattgtgccgcgcagcgtgcacagcgtgacgacggacccggatgctgttgccaccgtctcgtgcgcccggcccagggccgggccccacgccgcgctggtcacgctctccagtcccgctgctgcgattggtcgacctgcgtgcgccgggcccgtgccttccccatcgccggccaggggtaggtctgtggccttgacccaggacgccgtctctttcctcagccaccacaccgccgcctggccgcgggaggtgccgaccaggaggagggacgggagcgcggttccatgcgccgcgccgtcgccgatgtcatgccagctgaggcatgtgggggtgccggcggcgccgctgcaccgtaggctgttgcagggctcccaggccgtatgggacgggtcgcggtcgttccgctcgaagaatctgacaaagtacaagaggggtgaggattgagcacccagggtaacaaataccgggaggagagcgagggtcgcatgcctgcccccacggcctgcacggcccagcagcagctgcctacctcacgaagccgtcctcgcaggcagcggccagtgtgcaggcatgggtagctgggttgggatcgaaggctagctggcgcagggaggccttcccagcttgcagacgggcgatgcgcgtccagcatggttcgggggacgtcgggtcacaggcccagagcatgaggcagccagcacctgttcccgcagcgaggagggggccctgatcggggggagcccatgccaggctgctcacgtgtttatcgctgtcgtccagctgcagcacgccatggggatggaaggagcgggaggggtcctccctgcgaagcacgcgaatgtgggcagacgacagcaccgccagccaggtattcgtgcagtcatatgccgcatcgaccgcggatgttcccacaggacaggtcagagtcctggtagacatcctattccggctgtggagcagaagattttcgtatggccgcgagaacttgaggggggccggggaaaatcaagtacaagcccgatttcccagctccgagggggccttcatcaaattgatcatgtcagaagagttgtacgtctccccagaacattgatcgggtcagatcgctgttgttgggggggggcaggcccgctctcccgaacagcacctagccagggaccnnnnnnnnnncacgtctcaccagaacattgatcgggtcagatcgcagttgttgggtggggggggatgcctgctctcccgaacagcacctagccagggacctgttcgcgcgcgtcgggcatcaatccgcgagaggaaagcacgtcggcgcacctagggaggtagcgccatcaggaacccttcgcatcccctgcccggagtcatgtggcagcccatgaggagtgaatccagtctcgatctatcattatacggagaccatctgctcatgcacctttgtgactcgtgctgacgccgccagagtccctaccctcgaaagccctaacccaccctcgcttcgggtttgcccctcgaacggtgggcgctgagggtgccttcgtccccgctccacccggatccctgcatcgcatcgattgtttgagcatactcctggtccagcgacccccgagccaccccctgcctcagcagcatgagcctcctcagcaccaggcgggacggcttcgccaccgccctgtccatgtccaaggatggcccctccgcctacgccctggaggtcaaccaggccctcctgaaggaggacgatgacctgctgcgccagaccttcctgtctgtcttccgccaccaccacccccagctggccaacaaggtggatgtcatctttgcgctctcccaggcgtggtgcatgtctgagagcgacgacgacttcgacatgctggtgaagaggctggagagcctgaagcccgacgagcacatcctggtgagtagaaggggttccggagcttcctactgcttggatctgtggggtccgggggatcgggtttcgtgtgtgtgtgggtaaactggacccctggccatccatgcttctggatgtgctccaagggggcaagcaggggttagtcccggcacggcatgggtactgagatgcagtgaatgcgtcaagggcttagggtttggcccgtgtccttgcctgctgtggagccttgccatgcactacccttaggacacatgcctggtatagcaggagtcatggggagctccgggttccagtcccctgttagtcggctgcatgtcccacccctctcgcccttgcacctcgccatgcaaaccacatttcccccccttgtacctcccaggtggccagcgccttctcgcagctccnnnnnnnnnnttttcctctcacccttgcacctcgccatgcaaaccaccttcccccgccttgtcccccccaggtggccagcgccttctcgcagctcctcaacctgcacaacctgaccgaggagatcgtgacggcgcgtgtggagaaggcggcgcgcctgggcgaggtggagcagagcacgcggtccaccaacaagtcgctggagcgccttgtgaacgagctcggacagaacccggaggacatcttcaaggcgctgtgccgccagcgcgtggacatcgtgttcacggcccaccccacccaggccatccgccagtcgctgctgaagaagtaccagaagatccggagcgagatggacgcactgcacaacacgcgcatgacgccctacgagcggctggagtgcctggacgagatcaagtcccagatccaggccgcctggcgcaccgacgagatccggcgcaagaagcccacgccccaggacgagtcgcgccaggggctgagctacttccacgacaccatcttccacggcctgcccgtgttcctgcgccgcatcgacaccgcactgaagaacatcgggcagcccatgctgcccctggacacaaagctcttcaactttggcgcctggatgggcggcgaccgcgacggcaaccccttcgtcaccgccgccaccacacgcgacgtggtcctgggcgcgcgcctgtcggccaccatgctgctccagagccagatcagccggctggtatacgagttgtcagtctggcgtgccagcgacgagctgaccgccgctgccgcccggatcctggaggcgcgcaaggatggcctgtacgcgcacaccacgcgcgagtcgtatgagactgagttcgggtcggtgcgggagcccttccgcgtggtgctgtcggagatccgggagcgtctgaacagcaccagcaccacgctgcgctacctcatgtcgcacccgcacctgaatgtgaaggagacgctggacaacgacccgggcgcgtactccgacgcggaggccatcatcacccccctcatgctctgctacgactcgctggtggccacgggggacagcaccatcgccttcagcgagctgactgacgtcatccgtcaggcccagacctttggcctgcacctctgccagctggacatccggcaggagagcacgaagcacgccgaggccatcgacgccatcaccacctacctgggcctgggctccttcaatgcctgggacgaggcccagcgcaccgccttcttactgaaggagctggaggagcggaggccgctcctccccgccgacctgcccatgagcgaggaggtggccgacgtcatcggcaccttcaagatgctggccaccctgccctccgactccctgggcgcctacatcatctccatggcgcacaccgcctccgacgtcctggcggtgctcctcctccagaaggagtgcggcatccgggagacgctgcgcgtggtccccctgtttgagaccctggacgacctggagtacgccgagaccgccatggagcagctgttcggcaacgcctggtaccatgcacacatcgcgggcgcgcaggagtgcatgatcggctactctgactcgggcaaggacgcggggcgcctggccgccgcctggggcctgtacgaggtgcaggagcgcctggcagccgtggccgccaagtatgacgtccacctcaccctcttccacggccgcggcgggactgtgggacgcggcggcggccccgcccacctcgccatcctctcccagccgcccaagaccatcagcggcaccctccgcgtcaccgtgcaggtgtgtggctgggtgcttttgtacgccgttgtgttgaggatggaggaaagggggcggttgcatgcnnnnnnnnnncgtggctgggtgctttagtacgccgttgtatcgaggatggaggaaagggggcggttgcatgcggtcatccgggggcgagaactggggtattggcgggggcgatccgcagaccctgccccccttccaaaaccgcttcccccctgctcgtacttccccacccactcagggcccccccccttccccccaacacctccacagggcgaggtgatggagcagcannnnnnnnnnagggcgagaactgaggtactggcgggggcgatccgcagtccctgccccccttccaaaccccccttcccccggctcatacttccccacccactcagggcccccccccccttccccccaatacctccacagggcgaggtgatggagcagcagtttggagaaaaggaaattgccttccgcaccatggacctgtacacctcggcggtgctggaggcaacgctggcgcccatggaggagccgcaggcggtgtggcgcgaggcgatgcgcgagatgtcgcgcacctcctgcgaggcctaccgcgcggtcgtccgccacgacccgcgcttcatcgagtacttccagaccctgacccctgtgaatgagctggggcgcatgaacatcgggtcgcgccccgccaagcgcaaggcccacggctccatcgacaccctgcgcgccatcccctggatctttgcctggacccagatccggttccacctccccgtctggctgggcatgggccaggccctgcgcgccatgatcgacgcgggcaagctggagctgctccaggacatgtaccagaactggatgttcttccgcgtcaccctggacatgctggagatggtgttcgccaaggccgacccccgcgtggtcaccatgtaccagcgccagctggtggacgccgggctgcacgccctgggcgacgagctcctccgcaccttctacgaggccgaggagctggtgctcaaggtgatgaagcacaagggcctgctgtccagctccagcaccgccttcctgcagcagaagctgcagctgcgcgcgccctacgttgcgccgctgaacatcctccaggtctactgcctgaagaccatccgcgacatcgaggcggggaaggaggtggatgagtcgggctacaagcccgaccccgccgccgtggcgctgatgagccgcgacccggagaagacgcccttcgtgggcgccgtggaggacaccctgtgagttctttgtttatgggcattaggagacaggaggggagggggagggggttgaggggggggggggtcagggaatatgtgagtga

SEQ ID NO: 42936 - DNA, 61 bp, Chlorella protothecoides
gtcctcgggggaggggctgggggagtcctccggggaggggctgggggagtcctcgggggag

SEQ ID NO: 42937 - DNA, 66 bp, Chlorella protothecoides
agtcagcggccgcgccagctgcaaagaccattgaagtttgaggagcgtcagcgaccccagagccag

SEQ ID NO: 42938 - DNA, 87 bp, Chlorella protothecoides
gcacagcgacaggatcaggttggtccggcaggtggccgccgtgcccctggtggtgctgaggtcgcggcatgtgacgccgaggggcag

SEQ ID NO: 42939 - DNA, 61 bp, Chlorella protothecoides
ggcacggtgacgtgcaaacattggtatcgacgggaaaattggcactacccccgccactgtt

SEQ ID NO: 42940 - DNA, 61 bp, Chlorella protothecoides
ctgtggttactggccctgtccgggctggacccccctgtgtgttggctacctactgcttcac
